US008110361B2

(12) United States Patent
Laird et al.

(10) Patent No.: US 8,110,361 B2
(45) Date of Patent: Feb. 7, 2012

(54) DNA METHYLATION MARKERS ASSOCIATED WITH THE CPG ISLAND METHYLATOR PHENOTYPE (CIMP) IN HUMAN COLORECTAL CANCER

(75) Inventors: Peter W. Laird, South Pasadena, CA (US); Kimberly D. Siegmund, San Marino, CA (US); Mihaela Campan, Los Angeles, CA (US); Daniel J. Weisenberger, Playa del Rey, CA (US); Tiffany I. Long, Chino, CA (US)

(73) Assignee: University of Southern California USC Stevens Center for Innovation, Los Angeles, CA (US)

( * ) Notice: Subject to any disclaimer, the term of this patent is extended or adjusted under 35 U.S.C. 154(b) by 263 days.

(21) Appl. No.: 11/913,535

(22) PCT Filed: May 2, 2006

(86) PCT No.: PCT/US2006/017160
§ 371 (c)(1),
(2), (4) Date: Dec. 28, 2007

(87) PCT Pub. No.: WO2006/119434
PCT Pub. Date: Nov. 9, 2006

(65) Prior Publication Data
US 2009/0053706 A1 Feb. 26, 2009

Related U.S. Application Data

(60) Provisional application No. 60/677,181, filed on May 2, 2005.

(51) Int. Cl.
*C12Q 1/68* (2006.01)
(52) U.S. Cl. .................. 435/6.14; 435/6.11; 435/6.12
(58) Field of Classification Search .................. None
See application file for complete search history.

(56) References Cited

U.S. PATENT DOCUMENTS

| 5,565,552 | A | 10/1996 | Magda et al. |
| 5,567,810 | A | 10/1996 | Weis et al. |
| 5,574,142 | A | 11/1996 | Meyer, Jr. et al. |
| 5,585,481 | A | 12/1996 | Arnold, Jr. et al. |
| 5,587,371 | A | 12/1996 | Sessler et al. |
| 5,597,696 | A | 1/1997 | Linn et al. |
| 5,786,146 | A | 7/1998 | Herman et al. |
| 5,958,773 | A | 9/1999 | Monia et al. |
| 6,251,594 | B1 | 6/2001 | Gonzalgo et al. |
| 6,265,171 | B1 | 7/2001 | Herman et al. |
| 6,331,393 | B1 | 12/2001 | Laird et al. |
| 2003/0013091 | A1 | 1/2003 | Dimitrov |
| 2004/0265833 | A1* | 12/2004 | Lofton-Day et al. ........... 435/6 |

FOREIGN PATENT DOCUMENTS

| WO | WO 95/00669 | 1/1995 |
| WO | WO 95/15373 | 6/1995 |
| WO | WO 97/46705 | 12/1997 |
| WO | WO 99/28498 | 6/1999 |
| WO | WO 00/26401 | 5/2000 |
| WO | WO 02/077272 | 10/2002 |
| WO | WO 03/052135 | 6/2003 |
| WO | WO 2005/038051 | 4/2005 |

OTHER PUBLICATIONS

U.S. Appl. No. 60/677,181, filed May 2, 2005, Laird et al.
Belyavsky et al., "PCR-based cDNA library construction: general cDNA libraries at the level of a few cells," Nucleic Acids Research, 1989, pp. 2919-2983, vol. 17.
Database, "Homo sapiens cDNA clone Image: 6014407 5', mRNA sequence," XP002410381, retrieved from EMBL, Database accession No. bq422178, May 28, 2002 (1 page).
Eads et al., "CpG Island Hypermethylation in Human Colorectal Tumors Is Not Associated with DNA Methyltransferase Overexpression," Cancer Research, May 15, 1999, pp. 2302-2306, vol. 59.
Feil et al., "Methylation analysis on individual chromosomes: improved protocol for bisulphite genomic sequencing," Nucleic Acids Research, 1994, pp. 695-696, vol. 22.
Frommer et al., "A genomic sequencing protocol that yields a positive display of 5-methylcytosine residues in individual DNA strands," The Proceedings of the National Academy of Sciences, Mar. 1992, pp. 1827-1831, vol. 89.
Galfre et al., "Preparation of Monoclonal Antibodies: Strategies and Procedures," Methods in Enzymology, 1981, pp. 3-46, vol. 73.
Gonzalgo et al., "Identification and Characterization of Differentially Methylated Regions of Genomic DNA by Methylation-sensitive Arbitrarily Primed PCR," Cancer Research, Feb. 15, 1997, pp. 594-599, vol. 57.
Gonzalgo et al., Rapid quantitation of methylation differences at specific sites using methylation-sensitive single nucleotide primer extension (Ms-SNuPE), Nucleic Acids Research, 1997, pp. 2529-2531, vol. 25.
Grigg et al., "Sequencing 5-Methylcytosine Residues in Genomic DNA," BioEssays, Jun. 1994, pp. 431-436, vol. 16.

(Continued)

*Primary Examiner* — James Martinell
(74) *Attorney, Agent, or Firm* — Barry L. Davison; Davis Wright Tremaine LLP

(57) ABSTRACT

Particular aspects confirm the existence of a CpG island methylator phenotype (CIMP) in colorectal cancer, and provide novel validated DNA methylation markers associated with CIMP. Additional aspects provide novel methods and compositions for: determining CIMP status in colorectal cancers, determining the relationship between CIMP status and other molecular features of the cancers (e.g., BRAF mutation, KRAS mutation and MSI status); determining the relationship between CIMP status and other variables (e.g., age, sex, tumor location, family history, race, country of origin, tumor characteristics (including, tumor type, tumor grade, invasive margin characteristics, lymphocyte infiltration characteristics, direct spread, lymph node spread, venous spread and type of residual adjacent polyp, if present)); and determining, between subgroups defined by CIMP status and BRAF mutations, effects of selected risk factors (e.g., body mass index, smoking history, alcohol intake, dietary folate intake, folate metabolic enzyme polymorphisms and history of hormonal use).

29 Claims, 6 Drawing Sheets

OTHER PUBLICATIONS

Gut et al, "DNA and Matrix Assisted Laser Desorption Ionization Mass Spectrometry," Molecular Biology: Current Innovations and Future Trends, 1995, pp. 147-157, Horizon Scientific Press, Wymondham, United Kingdom.

Gut et al., "A procedure for selection DNA alkylation and detection by mass spectrometry," Nucleic Acids Research, 1995, pp. 1367-1373, vol. 23.

Heid et al., "Real Time Quantitative PCR," Genome Research, 1996, pp. 986-994, vol. 6.

Herman et al., "Methylation-specific PCR: A novel PCR assay for methylation status of CpG islands," The Proceedings of the National Academy of Sciences, Sep. 1996, pp. 9821-9826, vol. 93.

Issa, "CpG island methylator phenotype in cancer," Nature, 2004, pp. 988-993, vol. 4.

Karas et al., "Laser Desorption Ionization of Proteins with Molecular Masses Exceeding 10 000 Daltons," Analytical Chemistry, Oct. 15, 1988, pp. 2299-2301, vol. 60.

Koehler et al., "Continuous cultures of fused cells secreting antibody of predefined specificity," Nature, Aug. 7, 1975, pp. 495-496, vol. 256.

Krug et al., "First-Strand cDNA Synthesis Primed with Oligo(dT)," Methods in Enzymology, 1987, pp. 316-325, vol. 152.

Martin et al., "Genomic sequencing indicates a correlation between DNA hypomethylation in the 5' region of the pS2 gene and its expression in human breast cancer cell lines," Gene, 1995, pp. 261-265, vol. 157.

Ogino et al., "CpG island methylator phenotype (CIMP) of colorectal cancer is best characterized by quantitative DNA methylation analysis and prospective cohort studies," Gut, 2006, e-published on Jan. 11, 2006 (19 pages).

Ogino et al., "CpG island methylator phenotype (CIMP) of colorectal cancer is best characterized by quantitative DNA methylation analysis and prospective cohort studies," Gut, 2006, pp. 1000-1006, vol. 55.

Olek et al., "A modified and improved method for bisulphite based cytosine methylation analysis," Nucleic Acids Research, 1996, pp. 5064-5066, vol. 24.

Olek et al., "The pre-implantation ontogeny of the H19 methylation imprint," Nature Genetics, Nov. 1997, pp. 275-276, vol. 17.

Oue et al., "DNA methlation of multiple genes in gastric carcinoma: Association with histological type and CpG island methylator phenotype," Cancer Science, 2003, pp. 901-905, vol. 94.

Rein et al., "Identifying 5-methylcytosine and related modifications in DNA genomes," Nucleic Acids Research, 1998, pp. 2255-2264, vol. 26.

Sadri et al., "Rapid analysis of DNA methylation using new restriction enzyme sites created by bisulfite modification," Nucleic Acids Research, 1996, pp. 5058-5059, vol. 24.

Sanger et al., "DNA Sequencing with chain-terminating inhibitors," The Proceedings of the National Academy of Sciences, Dec. 1977, pp. 5463-5468, vol. 74.

Stites et al., "Clinical laboratory methods for detection of antigens and antibodies," *Basic and Clinical Immunology*, 7th ed., 1991, pp. 217-262, Appleton & Lange, Norwalk, Conn.

Strathdee et al., "Primary Ovarian Carcinomas Display Multiple Methylator Phenotypes Involving Known Tumor Suppressor Genes," American Journal of Pathology, 2001, pp. 1121-1127, vol. 158.

Toyota et al., "CpG island methylator phenotype in colorectal cancer," The Proceedings of the National Academy of Sciences, Jul. 1999, pp. 8681-8686, vol. 96.

Toyota et al., "Identification of Differentially Methylated Sequences in Colorectal Cancer by Methylated CpG Island Amplification," Cancer Research, May 15, 1999, pp. 2307-2312, vol. 59.

Van Der Krol et al., "Modulation of Eukaryotic Gene Expression by Complementary RNA or DNA Sequences," BioTechniques, 1988, pp. 958-976, vol. 6, No. 10.

Watson et al., "Isolation of Differentially Expressed Sequence Tags from Human Breast Cancer," Cancer Research, 1994, pp. 4598-4602, vol. 54.

Widschwendter et al., "Association of Breast Cancer DNA Methylation Profiles with Hormone Receptor Status and Response to Tamoxifen," Cancer Research, 2004, pp. 3807-3813, vol. 64.

Xiong et al., "COBRA: a sensitive and quantitative DNA methylation assay," Nucleic Acids Research, 1997, pp. 2532-2534, vol. 25, No. 12.

Yu et al., "Specific Inhibition of PCR by Non-Extendable Oligonucleotides Using a 5' to 3' Exonuclease-Deficient DNA Polymerase," BioTechniques, 1997, pp. 714-720, vol. 23, No. 4.

Zeschnigk et al., "Imprinted segments in the human genome: different DNA methylation pattersn in the Prader-Willi/Angelman syndrome region as determined by the genomic sequencing method," Human Molecular Genetics, 1997, pp. 387-395, vol. 6, No. 3.

Zeschnigk et al., "A single-tube PCR test for the diagnosis of Angelman and Prader-Willi syndrome based on allelic methylation differences at the SNRPN locus," European Journal of Human Genetics, Mar.-Apr. 1997, pp. 94-98, vol. 5, No. 2.

Zon, "Oligonucleotide Analogues as Potential Chemotherapeutic Agents," Pharmaceutical Research, 1988, pp. 539-549, Voume 5, No. 9.

* cited by examiner

DNA METHYLATION MARKERS ASSOCIATED WITH THE CPG ISLAND METHYLATOR PHENOTYPE (CIMP) IN HUMAN COLORECTAL CANCER

CROSS REFERENCE TO RELATED APPLICATIONS

The present application is a national submission under 35 U.S.C. 371, and claims the benefit of priority to International Application PCT/US2006/017160, filed 2 May 2006, which claims the benefit of priority to U.S. Provisional Patent Application No. 60/677,181, filed 2 May 2005, both of which are incorporated by reference herein in their entireties.

STATEMENT REGARDING FEDERAL SUPPORT

This work was supported by a NIH grant R01 CA075090, and the United States Government may have certain rights in this invention.

FIELD OF THE INVENTION

Aspects of the present invention relate generally to cancer and colorectal cancer, and more particularly to identification of, and diagnostic and/or prognostic use of novel validated DNA methylation markers associated with the CpG island methylator phenotype (CIMP) in colorectal cancer. The present invention also relates to genomic DNA sequences that exhibit altered expression patterns in disease states relative to normal. Particular embodiments provide, inter alia, novel methods, nucleic acids, nucleic acid arrays and kits useful for detecting, or for detecting and differentiating CIMP and/or cell proliferative disorders. Preferably, the methods, nucleic acids, nucleic acid arrays and kits for the detection and diagnosis of cell proliferative disorders are used for the diagnosis of CIMP, and in particular colorectal cancer.

SEQUENCE LISTING

A Sequence Listing, pursuant to 37 C.F.R. §1.52(e)(5), has been provided as part of this application on compact disc (1 of 1) as a 6.02 MB text file, entitled "47675-189 Sequence Listing.txt" ("180_0001.txt") and which is incorporated by reference herein in its entirety.

BACKGROUND

Cancer Epigenetics. Epigenetics refers to a switch between phenotypic states that is not based upon a change in genotype, such as a mutation, but is the result of a change in gene activity without any accompanying alteration of the DNA sequence. Simply put, this amounts to a stable change in gene expression. In cancer epigenetics, the most commonly observed situation is a change from a transcriptionally active gene to an epigenetically 'silenced' state. Epigenetic alterations are distinct from transitory changes in gene regulation, in that they involve relatively extensive, stable changes in chromatin structure, histone modification, associated protein composition, and in many cases, altered distribution of cytosine-5 DNA methylation at CpG dinucleotides in, for example, the promoter region of the gene. Of all of these molecular mechanisms, DNA methylation is the easiest to measure in archival samples, because cytosine methylation is retained in the genomic DNA throughout, for example, formalin-fixation, years of storage in paraffin blocks, and subsequent extraction from paraffin sections. Even heavily degraded, crosslinked DNA can be subjected successfully to DNA methylation analysis using, for example, bisulfite-based technique (e.g., with PCR amplicons, as is the case for the MethyLight™ technology).

The main targets for epigenetic gene silencing in cancer cells are promoter regions containing G:C- and CpG-rich stretches of DNA, called 'CpG islands.' CpG islands are G:C and CpG-rich stretches of DNA in the genome, often located in the vicinity of genes, and generally unmethylated in normal somatic tissues. Aberrant methylation of CpG islands has, for example, been documented in both benign and malignant human colorectal tumors and is associated with gene silencing.

It is important to note, however, that not all epigenetically silenced genes in cancer cells are tumor-suppressor genes, and that many of the affected CpG islands are not even located in promoter regions, and are not thought to affect gene expression (e.g., they may be in promoter regions of genes that are not expressed in either the normal or malignant cells of an organ giving rise to a malignancy). Yet, the occurrence of CpG island hypermethylation events is, in many cases, cancer-specific, suggesting a scenario in which the overall rate of CpG island hypermethylation during tumorigenesis needs to be sufficiently high to acquire the necessary hits at key loci, but at the same time perhaps affecting many other loci which are essentially innocent bystanders.

CIMP in colorectal cancer; prior art uncertainty and inconsistencies. A subset of colorectal tumors has been described to have an unusually high number of hypermethylated CpG islands, leading to the definition of a distinct phenotype, referred to as "CpG Island Methylator Phenotype", or "CIMP" (16, 21). Colorectal cancer has a lifetime incidence of 1 in 20, and CIMP cancers account for at least 15% of this, representing a large cohort of affected patients. Colorectal cancer has been traditionally been considered to be a single disease for the purposes of treatment, but recent evidence has suggested that there are different outcomes in sub-groups with distinct molecular features. Such CIMP+ colorectal tumors have been reported to have distinct profiles of genetic alterations, anatomic subsite, gender prevalence, histopathologic characteristics and clinical behavior.

However, a clear understanding of the CIMP phenomenon has been hampered by two complexities. First, the intricacy of the relationship between CIMP and microsatellite instability continues to result in different perspectives on the issue (38, 77). Second, the concept that CIMP affects only a subset of colorectal tumors and a subset of CpG islands, as opposed to all CpG islands known to be susceptible to hypermethylation, is not universally embraced or appreciated (38), and is further complicated by the fact that there are no firm rules for recognizing which CpG islands belong to the CIMP group. An initial panel of cancer-specifically methylated CpG island markers (21) has not been applied consistently in the literature, nor does it appear that all cancer-specifically methylated genes are affected by CIMP. Nevertheless, it seems clear that some CpG islands are more prone to cancer-specific hypermethylation than others. Thus, a lack of standardization in the classification methods used to define CIMP has resulted in varying and contradictory conclusions regarding, or example, the association of CIMP with a family history of cancer, and even the very existence of CIMP as a distinct subgroup of colorectal tumors. Not only has there been some ambiguity as to which CpG islands belong to the CIMP subset, but there has also been a lack of a uniform standard for applying this subset to the definition of CIMP status. The existence of unique CIMP-related etiologic and pathogenetic mechanisms can only be defined when this subgroup can be clearly and accurately identified. There are presently no clear guidelines for what constitutes CIMP-associated versus non-CIMP-associated CpG islands.

Therefore, there is a pronounced need in the art to further elucidate and understand the epidemiology and etiology of DNA methylation alterations in human colorectal cancer, and to clarify the uncertainties regarding the existence of CIMP and its classification. There is a pronounced need in the art to not only unambiguously confirm the existence of CIMP as a distinct subgroup of colorectal cancer, but also to establish an improved CIMP classification panel of methylation markers. There is a pronounced need in the art to provide compositions and methods for determining the relationship between CIMP status and molecular, demographic, and histopathologic features, and environmental risk factors. There is a pronounced in the art to understand the pathogenesis of this colorectal cancer subset and its association with risk factors so that we will be better placed to prevent its occurrence. There is a pronounced in the art to correctly identify cases which will best respond to particular therapies.

SUMMARY OF THE INVENTION

Applicants, as described herein, have provided definitive evidence for the existence of CIMP as a distinct trait among colorectal adenocarcinomas. Additionally, applicants have developed an improved method for the classification of CIMP. Furthermore, applicants have found that CIMP underlies almost all cases of sporadic MSI-H colorectal cancer and tumors with mutation of the BRAF oncogene.

Therefore, aspects of the present invention confirm the existence of a CpG island methylator phenotype (CIMP) in colorectal cancer, and provide novel validated DNA methylation markers associated with CIMP.

Additional aspects provide novel methods and compositions for determining CIMP status in colorectal cancers.

Particular aspects provide a panel of 14 CIMP genomic (preferably, particular CpG islands thereof described herein) markers corresponding to BCL2, BDNF, CACNA1G, CALCA, CRABP1, DLEC1, GATA3, HOXA1, IGF2, KL, NEUROG1, NR3C1, RUNX3, SOCS1 (Table 6), SEQ ID NOS:128-141, 114-127 and 100-113 (respective genomic, CpG island and amplicons, respectively) and a preferred sub panel of 5 genomic (preferably, particular CpG islands thereof described herein) markers (CACNA1G, IGF2, NEUROG1, RUNX3, and SOCS1), that provide, inter alia, an excellent classifier for CIMP status.

Additional preferred aspects provide a panel of three genomic and CpG island markers that identify KRAS mutant, BRAF wildtype tumors (CDKN2A, CRABP1 and NEUROG1); that is that are positively associated with KRAS mutation (after exclusion of BRAF mutant tumors, indicating that a separate KRAS-associated CIMP subgrouping exists with an overlapping set of methylation markers).

Further aspects provide novel methods and compositions for determining the relationship between CIMP status and other molecular features of the cancers including, but not limited to BRAF mutation, KRAS mutation and MSI status.

Additional aspects provide novel methods and compositions for determining the relationship between CIMP status and other variables including, but not limited to age, sex, tumor location, family history, race, country of origin, tumor characteristics (including, tumor type, tumor grade, invasive margin characteristics, lymphocyte infiltration characteristics, direct spread, lymph node spread, venous spread and type of residual adjacent polyp, if present).

Yet additional aspects provide novel methods and compositions for determining, between subgroups defined by CIMP status and BRAF mutations, effects of selected risk factors including, but not limited to body mass index, smoking history, alcohol intake, dietary folate intake, folate metabolic enzyme polymorphisms and history of hormonal use.

Further aspects of the present invention provide a foundation for a population-based study of CIMP, by providing a novel panel of very carefully selected methylation markers representing the CIMP subgroup, and having utility to classify CIMP.

DETAILED DESCRIPTION OF THE INVENTION

Figure 1:
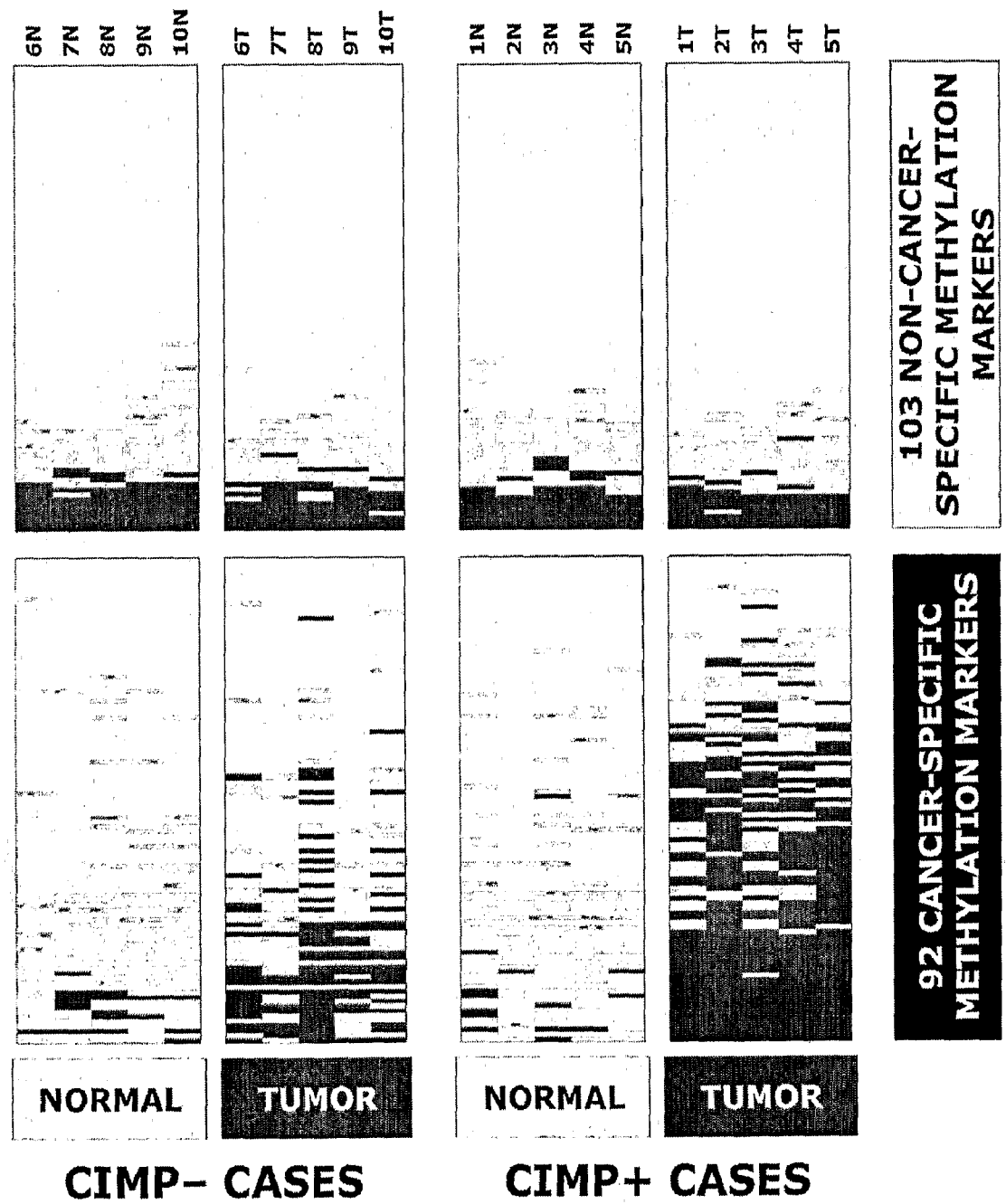
FIG. 1 shows an identification of Type C methylation markers. MethyLight™ analysis was performed for 195 MethyLight™ reactions on five CIMP+ and five CIMP− tumors as described in Methods (Example 1). Prior CIMP classification was performed as described in the Methods section "Tissue Samples". PMR values are indicated in color with a PMR of 0 (very light blue), less than 5 (light yellow), 5-50 (dark yellow), and above 50 (dark red). Genes selected for further evaluation are grouped at the bottom and sorted by increasing mean PMR from top to bottom.

Aspects of the present invention confirm the existence of a CpG island methylator phenotype (CIMP) in colorectal cancer, and provide novel validated DNA methylation markers associated with CIMP.

Additional aspects provide novel methods and compositions for determining CIMP status in colorectal cancers.

CIMP is a relatively new subclassification with an unknown underlying molecular defect. There is currently no external gold standard for defining CIMP, against which CIMP markers and panels can be compared and performance evaluated. Particular aspects disclose and describe a careful and methodical screen, starting with 195 different CpG islands, through a stepwise selection process involving the analysis of 245 different colorectal adenocarcinomas, and employing a battery of different cluster analysis routines, all of which identified the same subset of CIMP tumors, to arrive at a panel of 14 preferred CIMP markers (BCL2, BDNF, CACNA1G, CALCA, CRABP1, DLEC1, GATA3, HOXA1, IGF2, KL, NEUROG1, NR3C1, RUNX3, SOCS1) genomic markers (preferably, particular CpG islands thereof described herein) (TABLE 6), and a preferred sub panel of 5 markers (CACNA4G, IGF2, NEUROG1, RUNX3, and SOCS1) (preferably, particular CpG islands thereof described herein), that provide an excellent classifier for CIMP status.

Additional preferred aspects provide a panel of three genomic markers (CDKN2A, CRABP1 and NEUROG1) (preferably, particular CpG islands thereof described herein) that identify KRAS mutant, BRAF wildtype tumors.

Further aspects provide novel methods and compositions for determining the relationship between CIMP status and other molecular features of the cancers including, but not limited to BRAF mutation, KRAS mutation and MSI status.

Additional aspects provide novel methods and compositions for determining the relationship between CIMP status and other variables including, but not limited to age, sex, tumor location, family history, race, country of origin, tumor characteristics (including, tumor type, tumor grade, invasive margin characteristics, lymphocyte infiltration characteristics, direct spread, lymph node spread, venous spread and type of residual adjacent polyp, if present).

Yet additional aspects provide novel methods and compositions for determining, between subgroups defined by CIMP status and BRAF mutations, effects of selected risk factors including, but not limited to body mass index, smoking history, alcohol intake, dietary folate intake, folate metabolic enzyme polymorphisms and history of hormonal use.

TABLE 6

List of 14 Preferred CIMP markers, along with representative amplicons and respective associated coordinately-methylated CpG island sequences.

| HUGO Gene Nomenclature | Reaction Number | Reaction ID | GenBank Accession Number | MethyLight Amplicon Start (GenBank Numbering) | MethyLight Amplicon End (GenBank Numbering) | CpG Island Start (GenBank Numbering) | CpG Island End (GenBank Numbering) |
|---|---|---|---|---|---|---|---|
| BCL2 | HB-140 | BCL2-M1 | AY220759 | 1221 | 1304 | 746 | 1876 |
| BDNF | HB-258 | BDNF-M2 | AC103796 | 3794 | 3866 | 3351 | 4751 |
| CACNA1G | HB-158 | CACNA1G-M1 | AC021491 | 48345 | 48411 | 47327 | 49295 |
| CALCA | HB-166 | CALCA-M1 | X15943 | 1706 | 1806 | 1614 | 2359 |
| CRABP1 | HB-197 | CRABP1-M1 | AC011270 | 122223 | 122142 | 122717 | 120620 |
| DLEC1 | HB-225 | DLEC1-M1 | AP006309 | 19959 | 20088 | 19425 | 20529 |
| GATA3 | HB-327 | GATA3-M1 | AL390294 | 51880 | 51959 | 50613 | 54089 |
| HOXA1 | HB-268 | HOXA1-M2 | AC004079 | 78220 | 78138 | 79793 | 77693 |
| IGF2 | HB-319 | IGF2-M2 | AC132217 | 108633 | 108720 | 106219 | 110017 |
| KL | HB-175 | KL-M1 | AB009667 | 2062 | 2189 | 1239 | 3185 |
| NEUROG1 | HB-261 | NEUROG1-M1 | AC005738 | 75429 | 75342 | 76036 | 73946 |
| NR3C1 | HB-067 | NR3C1-M1 | AY436590 | 1786 | 1860 | 32 | 3034 |
| RUNX3 | HB-181 | RUNX3-M1 | AL023096 | 64762 | 64646 | 67973 | 63661 |
| SOCS1 | HB-042 | SOCS1-M1 | AC009121 | 108803 | 108888 | 107037 | 109517 |

Despite the lack of an external gold standard for CIMP classification, a comparison of cross-panel misclassification errors and the associations with other molecular features strongly indicates that the present novel panel outperforms a similar panel of five traditional markers derived from the initial CIMP classification paper (21) (MLH1, CDKN2A (p16$^{INK4A}$), MINT1, MINT2, and MINT31).

Applicants and others have reported a strong association between CIMP+ status in colorectal adenocarcinomas and mutation of the BRAF proto-oncogene (40, 42, 127, 131-133). With the present new CIMP classification panel, there is a remarkably strong association between CIMP+ status and BRAF mutation, with an odds ration of 203 (95% confidence interval=41,995), and a P-value of $1.6 \times 10^{-21}$ (see below).

In a particular study presented herein, 24 out of 26 mutant BRAF tumors were classified as CIMP+, while the 154 CIMP− tumors contained only two mutant BRAF tumors, along with 152 BRAF wildtype tumors (see also TABLE 4, Example 4).

TABLE 4

Distribution of covariates by New CIMP Panel.

| VARIABLE | | OVERALL N | % | CIMP+ (3-5 loci) N | % | CIMP− (0-2 loci) N | % | P-value |
|---|---|---|---|---|---|---|---|---|
| TOTAL | | 187 | 100% | 33 | 18% | 154 | 82% | |
| SEX | Male | 103 | 55% | 13 | 39% | 90 | 58% | |
| | Female | 84 | 45% | 20 | 61% | 64 | 42% | 0.05 |
| SUBSITE | Proximal | 57 | 33% | 19 | 59% | 38 | 27% | |
| | Distal | 118 | 67% | 13 | 41% | 105 | 73% | 0.0005 |
| | No Info | 12 | | | | | | |
| MSI | MSI-high | 21 | 11% | 12 | 36% | 9 | 6% | |
| STATUS | MSI-low | 19 | 10% | 4 | 12% | 15 | 10% | |
| | MSS | 147 | 79% | 17 | 52% | 130 | 84% | $3.1^{-5}$ |
| HNPCC | Yes | 8 | 4% | 0 | 0% | 8 | 5% | |
| STATUS | No | 179 | 96% | 33 | 100% | 146 | 95% | 0.35 |
| MLH1 | Yes | 16 | 9% | 13 | 39% | 3 | 2% | |
| METHYLATION | No | 171 | 91% | 20 | 61% | 151 | 98% | $2.6^{-9}$ |
| BRAF | Mutant | 26 | 14% | 24 | 73% | 2 | 1% | |
| MUTATION | WT | 161 | 86% | 9 | 27% | 152 | 99% | $1.6^{-21}$ |
| KRAS | Mutant | 55 | 31% | 3 | 10% | 52 | 35% | |
| MUTATION | WT | 123 | 69% | 28 | 90% | 95 | 65% | .002 |
| | No Info | 9 | | | | | | |
| MEAN AGE (SD)* | | 65.5 (12.9) | | 68.6 (12.7) | | 64.8 (12.9) | | 0.13 |

P-values are for likelihood ratio tests from logistic regression with CIMP status as the outcome. For the variable HNPCC we report the p-value from Fisher's exact test.
*Four CIMP− subjects are missing age.

Nevertheless, 9 out of 33 CIMP+ were wild-type for BRAF, indicating that BRAF mutant tumors represent a large subset of CIMP+ tumors, but that there are BRAF-independent CIMP+ tumors as well. Therefore, BRAF mutation appears to arise almost only in the context of CIMP+ status, indicating that this epigenetic phenomenon dominates over this particular genetic alteration in human colorectal cancer, which is a different conclusion from that reached in the art (see, e.g., 38).

Additionally, all 8 of the hereditary non-polyposis colorectal cancer (HNPCC)-associated MSI+ tumors were classified as CIMP−, while 12 out of 13 non-HNPCC MSI+ tumors were classified as CIMP+. On the other hand, 21 out of 33 of the CIMP+ tumors were MSI-low or MSS (see below). Therefore, non-HNPCC MSI+ colorectal tumors are a subset of CIMP+ tumors, but not the other way around, indicating that sporadic MSI+ colorectal cancer is largely attributable to the CIMP phenomenon. Thus, the present novel markers enables a well-executed population-based studies of CIMP, and a full etiologic understanding of MSI+ sporadic cancer.

Further aspects of the present invention, therefore, provide a foundation for a population-based study of CIMP, by providing a novel panel of very carefully selected methylation markers representing the CIMP subgroup, and having utility to classify CIMP.

Definitions

The term "Observed/Expected Ratio" ("O/E Ratio") refers to the frequency of CpG dinucleotides within a particular DNA sequence, and corresponds to the [number of CpG sites/(number of C bases×number of G bases)]/band length for each fragment.

The term "CpG island" refers to a contiguous region of genomic DNA that satisfies the criteria of (1) having a frequency of CpG dinucleotides corresponding to an "Observed/Expected Ratio">0.6, and (2) having a "GC Content">0.5. CpG islands are typically, but not always, between about 0.2 to about 1 KB, or to about 2 kb in length.

The term "methylation state" or "methylation status" refers to the presence or absence of 5-methylcytosine ("5-mCyt") at one or a plurality of CpG dinucleotides within a DNA sequence. Methylation states at one or more particular CpG methylation sites (each having two CpG dinucleotide sequences) within a DNA sequence include "unmethylated," "fully-methylated" and "hemi-methylated."

The term "hemi-methylation" or "hemimethylation" refers to the methylation state of a double stranded DNA wherein only one strand thereof is methylated.

The term 'AUC' as used herein is an abbreviation for the area under a curve. In particular it refers to the area under a Receiver Operating Characteristic (ROC) curve. The ROC curve is a plot of the true positive rate against the false positive rate for the different possible cut points of a diagnostic test. It shows the trade-off between sensitivity and specificity depending on the selected cut point (any increase in sensitivity will be accompanied by a decrease in specificity). The area under an ROC curve (AUC) is a measure for the accuracy of a diagnostic test (the larger the area the better, optimum is 1, a random test would have a ROC curve lying on the diagonal with an area of 0.5; for reference: J. P. Egan. Signal Detection Theory and ROC Analysis, Academic Press, New York, 1975).

The term "hypermethylation" refers to the average methylation state corresponding to an increased presence of 5-mCyt at one or a plurality of CpG dinucleotides within a DNA sequence of a test DNA sample, relative to the amount of 5-mCyt found at corresponding CpG dinucleotides within a normal control DNA sample.

The term "hypomethylation" refers to the average methylation state corresponding to a decreased presence of 5-mCyt at one or a plurality of CpG dinucleotides within a DNA sequence of a test DNA sample, relative to the amount of 5-mCyt found at corresponding CpG dinucleotides within a normal control DNA sample.

The term "microarray" refers broadly to both "DNA microarrays," and 'DNA chip(s),' as recognized in the art, encompasses all art-recognized solid supports, and encompasses all methods for affixing nucleic acid molecules thereto or synthesis of nucleic acids thereon.

"Genetic parameters" are mutations and polymorphisms of genes and sequences further required for their regulation. To be designated as mutations are, in particular, insertions, deletions, point mutations, inversions and polymorphisms and, particularly preferred, SNPs (single nucleotide polymorphisms).

"Epigenetic parameters" are, in particular, cytosine methylation. Further epigenetic parameters include, for example, the acetylation of histones which, however, cannot be directly analysed using the described method but which, in turn, correlate with the DNA methylation.

The term "bisulfite reagent" refers to a reagent comprising bisulfite, disulfite, hydrogen sulfite or combinations thereof, useful as disclosed herein to distinguish between methylated and unmethylated CpG dinucleotide sequences.

The term "Methylation assay" refers to any assay for determining the methylation state of one or more CpG dinucleotide sequences within a sequence of DNA.

The term "MS.AP-PCR" (Methylation-Sensitive Arbitrarily-Primed Polymerase Chain Reaction) refers to the art-recognized technology that allows for a global scan of the genome using CG-rich primers to focus on the regions most likely to contain CpG dinucleotides, and described by Gonzalgo et al., *Cancer Research* 57:594-599, 1997.

The term "MethyLight™" refers to the art-recognized fluorescence-based real-time PCR technique described by Eads et al., *Cancer Res.* 59:2302-2306, 1999.

The term "HeavyMethyl™" assay, in the embodiment thereof implemented herein, refers to an assay, wherein methylation specific blocking probes (also referred to herein as blockers) covering CpG positions between, or covered by the amplification primers enable methylation-specific selective amplification of a nucleic acid sample.

The term "HeavyMethyl™ MethyLight™" assay, in the embodiment thereof implemented herein, refers to a HeavyMethyl™ MethyLight™ assay, which is a variation of the MethyLight™ assay, wherein the MethyLight™ assay is combined with methylation specific blocking probes covering CpG positions between the amplification primers.

The term "Ms-SNuPE" (Methylation-sensitive Single Nucleotide Primer Extension) refers to the art-recognized assay described by Gonzalgo & Jones, *Nucleic Acids Res.* 25:2529-2531, 1997.

The term "MSP" (Methylation-specific PCR) refers to the art-recognized methylation assay described by Herman et al. *Proc. Natl. Acad. Sci. USA* 93:9821-9826, 1996, and by U.S. Pat. No. 5,786,146.

The term "COBRA" (Combined Bisulfite Restriction Analysis) refers to the art-recognized methylation assay described by Xiong & Laird, *Nucleic Acids Res.* 25:2532-2534, 1997.

The term "MCA" (Methylated CpG Island Amplification) refers to the methylation assay described by Toyota et al., *Cancer Res.* 59:2307-12, 1999, and in WO 00/26401A1.

The term "hybridisation" is to be understood as a bond of an oligonucleotide to a complementary sequence along the lines of the Watson-Crick base pairings in the sample DNA, forming a duplex structure.

"Stringent hybridisation conditions," as defined herein, involve hybridising at 68° C. in 5×SSC/5×Denhardt's solution/1.0% SDS, and washing in 0.2×SSC/0.1% SDS at room temperature, or involve the art-recognized equivalent thereof (e.g., conditions in which a hybridisation is carried out at 60° C. in 2.5×SSC buffer, followed by several washing steps at 37° C. in a low buffer concentration, and remains stable). Moderately stringent conditions, as defined herein, involve including washing in 3×SSC at 42° C., or the art-recognized equivalent thereof. The parameters of salt concentration and temperature can be varied to achieve the optimal level of identity between the probe and the target nucleic acid. Guidance regarding such conditions is available in the art, for example, by Sambrook et al., 1989, Molecular Cloning, A Laboratory Manual, Cold Spring Harbor Press, N.Y.; and Ausubel et al. (eds.), 1995, Current Protocols in Molecular Biology, (John Wiley & Sons, N.Y.) at Unit 2.10.

The terms "Methylation-specific restriction enzymes" or "methylation-sensitive restriction enzymes" shall be taken to mean an enzyme that selectively digests a nucleic acid dependant on the methylation state of its recognition site. In the case of such restriction enzymes which specifically cut if the recognition site is not methylated or hemimethylated, the cut will not take place, or with a significantly reduced efficiency, if the recognition site is methylated. In the case of such restriction enzymes which specifically cut if the recognition site is methylated, the cut will not take place, or with a significantly reduced efficiency if the recognition site is not methylated. Preferred are methylation-specific restriction enzymes, the recognition sequence of which contains a CG dinucleotide (for instance cgcg or cccggg). Further preferred for some embodiments are restriction enzymes that do not cut if the cytosine in this dinucleotide is methylated at the carbon atom C5.

"Non-methylation-specific restriction enzymes" or "non-methylation-sensitive restriction enzymes" are restriction enzymes that cut a nucleic acid sequence irrespective of the methylation state with nearly identical efficiency. They are also called "methylation-unspecific restriction enzymes."

The term "gene" shall be taken to include all transcript variants thereof (e.g. the term "NEUROG1" shall include for example its transcripts and any truncated transcript, etc) and all promoter and regulatory elements thereof. Furthermore as a plurality of SNPs are known within said gene the term shall be taken to include all sequence variants thereof.

The term "pre-cancerous" or "pre-neoplastic" and equivalents thereof shall be taken to mean any cellular proliferative disorder which is undergoing malignant transformation. Examples of such conditions include, in the context of colorectal cellular proliferative disorders, cellular proliferative disorders with a high degree of dysplasia and the following classes of adenomas:

Level 1: penetration of malignant glands through the muscularis mucosa into the submucosa, within the polyp head;

Level 2: the same submucosal invasion, but present at the junction of the head to the stalk;

Level 3: invasion of the stalk; and

Level 4: invasion of the stalk's base at the connection to the colonic wall (this level corresponds to stage Dukes A).

Exemplary Preferred Embodiments

In particular aspects, the present invention provides compositions and methods for at least one of: determining and/or classifying CIMP status in colorectal cancers; identifying KRAS mutant, BRAF wildtype tumors; determining the relationship between CIMP status and other molecular features of the cancers including, but not limited to BRAF mutation, KRAS mutation and MSI status; determining the relationship between CIMP status and other variables including, but not limited to age, sex, tumor location, family history, race, country of origin, tumor characteristics (including, tumor type, tumor grade, invasive margin characteristics, lymphocyte infiltration characteristics, direct spread, lymph node spread, venous spread and type of residual adjacent polyp, if present); determining, between subgroups defined by CIMP status and BRAF mutations, effects of selected risk factors including, but not limited to body mass index, smoking history, alcohol intake, dietary folate intake, folate metabolic enzyme polymorphisms and history of hormonal use; and providing a foundation for a population-based study of CIMP, by providing a novel panel of carefully selected methylation markers representing the CIMP subgroup, and having utility to classify CIMP.

Said methods comprising determining the methylation status or the expression levels of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); SEQ ID NOS:128-141, 114-127 and 100-113 (respective genomic, CpG island and amplicons, respectively) in a biological sample isolated from said subject wherein underexpression and/or CpG methylation is indicative of the presence or class of said disorder. Said markers may be used for the methods listed above, and for diagnosis of neoplastic cellular proliferative disorders (cancer), including early detection during the pre-cancerous stages of the disease, and furthermore for the differentiation of neoplastic from benign cellular proliferative disorders. In particular aspects, the present invention discloses a method wherein a neoplastic cell proliferative disorder is distinguished from a benign cell proliferative disorder said method characterized in that underexpression and/or the presence of CpG methylation is indicative of the presence of a neoplastic cell proliferative disorder or pre-neoplastic disorder and the absence thereof is indicative of the presence of a benign cell proliferative disorder.

The markers of the present invention are particularly efficient in detecting or distinguishing between colorectal cell proliferative disorders, thereby providing improved means for the early detection, classification and treatment of said disorders.

In addition to the embodiments above wherein the methylation analysis of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); SEQ ID NOS:128-141, 114-127 and 100-113 (respective genomic, CpG island and amplicons, respectively) is analysed, the invention presents further panels of genes comprising at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); SEQ ID NOS: 128-141, 114-127 and 100-113 (respective genomic, CpG island and amplicons, respectively) with novel utility for the detection of cancers, in particular colorectal cancer.

In a first further embodiment the present invention is based upon the analysis of CpG methylation status of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); SEQ ID NOS:128-141, 114-127 and 100-113 (respective genomic, CpG island and amplicons, respectively).

Bisulfite modification of DNA is an art-recognized tool used to assess CpG methylation status. 5-methylcytosine is the most frequent covalent base modification in the DNA of eukaryotic cells. It plays a role, for example, in the regulation of the transcription, in genetic imprinting, and in tumorigenesis. Therefore, the identification of 5-methylcytosine as a component of genetic information is of considerable interest. However, 5-methylcytosine positions cannot be identified by sequencing, because 5-methylcytosine has the same base pairing behavior as cytosine. Moreover, the epigenetic information carried by 5-methylcytosine is completely lost during, e.g., PCR amplification.

The most frequently used method for analyzing DNA for the presence of 5-methylcytosine is based upon the specific reaction of bisulfite with cytosine whereby, upon subsequent alkaline hydrolysis, cytosine is converted to uracil which corresponds to thymine in its base pairing behavior. Significantly, however, 5-methylcytosine remains unmodified under these conditions. Consequently, the original DNA is converted in such a manner that methylcytosine, which originally could not be distinguished from cytosine by its hybridization behavior, can now be detected as the only remaining cytosine using standard, art-recognized molecular biological techniques, for example, by amplification and hybridization, or by sequencing. All of these techniques are based on differential base pairing properties, which can now be fully exploited.

The prior art, in terms of sensitivity, is defined by a method comprising enclosing the DNA to be analysed in an agarose matrix, thereby preventing the diffusion and renaturation of the DNA (bisulfite only reacts with single-stranded DNA), and replacing all precipitation and purification steps with fast dialysis (Olek A, et al., A modified and improved method for bisulfite based cytosine methylation analysis, *Nucleic Acids Res.* 24:5064-6, 1996). It is thus possible to analyse individual cells for methylation status, illustrating the utility and sensitivity of the method. An overview of art-recognized methods for detecting 5-methylcytosine is provided by Rein, T., et al., *Nucleic Acids Res.,* 26:2255, 1998.

The bisulfite technique, barring few exceptions (e.g., Zeschnigk M, et al., *Eur J Hum Genet.* 5:94-98, 1997), is currently only used in research. In all instances, short, specific fragments of a known gene are amplified subsequent to a bisulfite treatment, and either completely sequenced (Olek & Walter, *Nat. Genet.* 1997 17:275-6, 1997), subjected to one or more primer extension reactions (Gonzalgo & Jones, *Nucleic Acids Res.,* 25:2529-31, 1997; WO 95/00669; U.S. Pat. No. 6,251,594) to analyse individual cytosine positions, or treated by enzymatic digestion (Xiong & Laird, *Nucleic Acids Res.,* 25:2532-4, 1997). Detection by hybridisation has also been described in the art (Olek et al., WO 99/28498). Additionally, use of the bisulfite technique for methylation detection with respect to individual genes has been described (Grigg & Clark, *Bioessays,* 16:431-6, 1994; Zeschnigk M, et al., *Hum Mol. Genet.,* 6:387-95, 1997; Feil R, et al., *Nucleic Acids Res.,* 22:695-, 1994; Martin V, et al., *Gene,* 157:261-4, 1995; WO 9746705 and WO 9515373).

The present invention provides for the use of the bisulfite technique, in combination with one or more methylation assays, for determination of the methylation status of CpG dinucleotide sequences within at least one sequence selected from the group consisting of SEQ ID NOS:128-141, 114-127 and 100-113 (respective genomic, CpG island and amplicons, respectively). Genomic CpG dinucleotides can be methylated or unmethylated (alternatively known as up- and down-methylated respectively). However the methods of the present invention are suitable for the analysis of biological samples of a heterogeneous nature, e.g., a low concentration of tumor cells within a background of blood or stool. Accordingly, when analyzing the methylation status of a CpG position within such a sample the person skilled in the art may use a quantitative assay for determining the level (e.g., percent, fraction, ratio, proportion or degree) of methylation at a particular CpG position as opposed to a methylation state. Accordingly the term methylation status or methylation state should also be taken to mean a value reflecting the degree of methylation at a CpG position. Unless specifically stated the terms "hypermethylated" or "upmethylated" shall be taken to mean a methylation level above that of a specified cut-off point, wherein said cut-off may be a value representing the average or median methylation level for a given population, or is preferably an optimized cut-off level. The "cut-off" is also referred herein as a "threshold". In the context of the present invention the terms "methylated", "hypermethylated" or "upmethylated" shall be taken to include a methylation level above the cut-off be zero (0) % (or equivalents thereof) methylation for all CpG positions within and associated with (e.g. in promoter or regulatory regions) the genes or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); SEQ ID NOS:128-141, 114-127 and 100-113 (respective genomic, CpG island and amplicons, respectively).

According to the present invention, determination of the methylation status of CpG dinucleotide sequences BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) has utility both in the diagnosis and characterization of CIMP.

Methylation Assay Procedures. Various methylation assay procedures are known in the art, and can be used in conjunction with the present invention. These assays allow for determination of the methylation state of one or a plurality of CpG dinucleotides (e.g., CpG islands) within a DNA sequence. Such assays involve, among other techniques, DNA sequencing of bisulfite-treated DNA, PCR (for sequence-specific amplification), Southern blot analysis, and use of methylation-sensitive restriction enzymes.

For example, genomic sequencing has been simplified for analysis of DNA methylation patterns and 5-methylcytosine distribution by using bisulfite treatment (Frommer et al., *Proc. Natl. Acad. Sci. USA* 89:1827-1831, 1992). Additionally, restriction enzyme digestion of PCR products amplified from bisulfite-converted DNA is used, e.g., the method described by Sadri & Hornsby (*Nucl. Acids Res.* 24:5058-5059, 1996), or COBRA (Combined Bisulfite Restriction Analysis) (Xiong & Laird, *Nucleic Acids Res.* 25:2532-2534, 1997).

COBRA. COBRA™ analysis is a quantitative methylation assay useful for determining DNA methylation levels at specific gene loci in small amounts of genomic DNA (Xiong & Laird, *Nucleic Acids Res.* 25:2532-2534, 1997). Briefly, restriction enzyme digestion is used to reveal methylation-dependent sequence differences in PCR products of sodium bisulfite-treated DNA. Methylation-dependent sequence differences are first introduced into the genomic DNA by standard bisulfite treatment according to the procedure described by Frommer et al. (*Proc. Natl. Acad. Sci. USA* 89:1827-1831, 1992). PCR amplification of the bisulfite converted DNA is then performed using primers specific for the CpG islands of interest, followed by restriction endonuclease digestion, gel electrophoresis, and detection using specific, labeled hybridization probes. Methylation levels in the original DNA sample are represented by the relative amounts of digested and undigested PCR product in a linearly quantitative fashion across a wide spectrum of DNA methylation levels. In addition, this technique can be reliably applied to DNA obtained from microdissected paraffin-embedded tissue samples.

Typical reagents (e.g., as might be found in a typical COBRA™-based kit) for COBRA™ analysis may include, but are not limited to: PCR primers for specific gene (or bisulfite treated DNA sequence or CpG island); restriction enzyme and appropriate buffer; gene-hybridization oligonucleotide; control hybridization oligonucleotide; kinase labeling kit for oligonucleotide probe; and labeled nucleotides. Additionally, bisulfite conversion reagents may include: DNA denaturation buffer; sulfonation buffer; DNA recovery reagents or kits (e.g., precipitation, ultrafiltration, affinity column); desulfonation buffer; and DNA recovery components.

Preferably, assays such as "MethyLight™" (a fluorescence-based real-time PCR technique) (Eads et al., *Cancer Res.* 59:2302-2306, 1999), Ms-SNuPE™ (Methylation-sensitive Single Nucleotide Primer Extension) reactions (Gonzalgo & Jones, *Nucleic Acids Res.* 25:2529-2531, 1997), methylation-specific PCR ("MSP"; Herman et al., *Proc. Natl. Acad. Sci. USA* 93:9821-9826, 1996; U.S. Pat. No. 5,786,146), and methylated CpG island amplification ("MCA"; Toyota et al., *Cancer Res.* 59:2307-12, 1999) are used alone or in combination with other of these methods.

The "HeavyMethyl™" assay, technique is a quantitative method for assessing methylation differences based on methylation specific amplification of bisulfite treated DNA. Methylation specific blocking probes (also referred to herein as blockers) covering CpG positions between, or covered by the amplification primers enable methylation-specific selective amplification of a nucleic acid sample.

The term "HeavyMethyl™ MethyLight™" assay, in the embodiment thereof implemented herein, refers to a HeavyMethyl™ MethyLight™ assay, which is a variation of the MethyLight™ assay, wherein the MethyLight™ assay is combined with methylation specific blocking probes covering CpG positions between the amplification primers. The HeavyMethyl™ assay may also be used in combination with methylation specific amplification primers.

Typical reagents (e.g., as might be found in a typical MethyLight™-based kit) for HeavyMethyl™ analysis may include, but are not limited to: PCR primers for specific genes (or bisulfite treated DNA sequence or CpG island); blocking oligonucleotides; optimized PCR buffers and deoxynucleotides; and Taq polymerase.

MSP. MSP (methylation-specific PCR) allows for assessing the methylation status of virtually any group of CpG sites within a CpG island, independent of the use of methylation-sensitive restriction enzymes (Herman et al. *Proc. Natl. Acad. Sci. USA* 93:9821-9826, 1996; U.S. Pat. No. 5,786,146). Briefly, DNA is modified by sodium bisulfite converting all unmethylated, but not methylated cytosines to uracil, and subsequently amplified with primers specific for methylated versus unmethylated DNA. MSP requires only small quantities of DNA, is sensitive to 0.1% methylated alleles of a given CpG island locus, and can be performed on DNA extracted from paraffin-embedded samples. Typical reagents (e.g., as might be found in a typical MSP-based kit) for MSP analysis may include, but are not limited to: methylated and unmethylated PCR primers for specific gene (or bisulfite treated DNA sequence or CpG island), optimized PCR buffers and deoxynucleotides, and specific probes.

MethyLight™. The MethyLight™ assay is a high-throughput quantitative methylation assay that utilizes fluorescence-based real-time PCR (TaqMan®) technology that requires no further manipulations after the PCR step (Eads et al., *Cancer Res.* 59:2302-2306, 1999). Briefly, the MethyLight™ process begins with a mixed sample of genomic DNA that is converted, in a sodium bisulfite reaction, to a mixed pool of methylation-dependent sequence differences according to standard procedures (the bisulfite process converts unmethylated cytosine residues to uracil). Fluorescence-based PCR is then performed in a "biased" (with PCR primers that overlap known CpG dinucleotides) reaction. Sequence discrimination can occur both at the level of the amplification process and at the level of the fluorescence detection process.

The MethyLight™ assay may be used as a quantitative test for methylation patterns in the genomic DNA sample, wherein sequence discrimination occurs at the level of probe hybridization. In this quantitative version, the PCR reaction provides for a methylation specific amplification in the presence of a fluorescent probe that overlaps a particular putative methylation site. An unbiased control for the amount of input DNA is provided by a reaction in which neither the primers, nor the probe overlie any CpG dinucleotides. Alternatively, a qualitative test for genomic methylation is achieved by probing of the biased PCR pool with either control oligonucleotides that do not "cover" known methylation sites (a fluorescence-based version of the HeavyMethyl™ and MSP techniques), or with oligonucleotides covering potential methylation sites.

The MethyLight™ process can by used with any suitable probes e.g. "TaqMan®", Lightcycler® etc. . . . . . For example, double-stranded genomic DNA is treated with sodium bisulfite and subjected to one of two sets of PCR reactions using TaqMan® probes; e.g., with MSP primers and/or HeavyMethyl blocker oligonucleotides and TaqMan® probe. The TaqMan® probe is dual-labeled with fluorescent "reporter" and "quencher" molecules, and is designed to be specific for a relatively high GC content region so that it melts out at about 110° C. higher temperature in the PCR cycle than the forward or reverse primers. This allows the TaqMan® probe to remain fully hybridized during the PCR annealing/extension step. As the Taq polymerase enzymatically synthesizes a new strand during PCR, it will eventually reach the annealed TaqMan® probe. The Taq polymerase 5' to 3' endonuclease activity will then displace the TaqMan® probe by digesting it to release the fluorescent reporter molecule for quantitative detection of its now unquenched signal using a real-time fluorescent detection system.

Typical reagents (e.g., as might be found in a typical MethyLight™-based kit) for MethyLight™ analysis may include, but are not limited to: PCR primers for specific gene (or bisulfite treated DNA sequence or CpG island); TaqMan® or Lightcycler® probes; optimized PCR buffers and deoxynucleotides; and Taq polymerase.

The QM™ (quantitative methylation) assay is an alternative quantitative test for methylation patterns in genomic DNA samples, wherein sequence discrimination occurs at the level of probe hybridization. In this quantitative version, the PCR reaction provides for unbiased amplification in the presence of a fluorescent probe that overlaps a particular putative methylation site. An unbiased control for the amount of input DNA is provided by a reaction in which neither the primers, nor the probe overlie any CpG dinucleotides. Alternatively, a qualitative test for genomic methylation is achieved by probing of the biased PCR pool with either control oligonucleotides that do not "cover" known methylation sites (a fluorescence-based version of the HeavyMethyl™ and MSP techniques), or with oligonucleotides covering potential methylation sites.

The QM process can by used with any suitable probes e.g. "TaqMan®", Lightcycler® etc. . . . in the amplification process. For example, double-stranded genomic DNA is treated with sodium bisulfite and subjected to unbiased primers and the TaqMan® probe. The TaqMan® probe is dual-labeled with fluorescent "reporter" and "quencher" molecules, and is designed to be specific for a relatively high GC content region so that it melts out at about 10° C. higher temperature in the PCR cycle than the forward or reverse primers. This allows the TaqMan® probe to remain fully hybridized during the PCR annealing/extension step. As the Taq polymerase enzymatically synthesizes a new strand during PCR, it will eventually reach the annealed TaqMan® probe. The Taq polymerase 5' to 3' endonuclease activity will then displace the TaqMan® probe by digesting it to release the fluorescent reporter molecule for quantitative detection of its now unquenched signal using a real-time fluorescent detection system. Typical reagents (e.g., as might be found in a typical QM™-based kit) for QM™ analysis may include, but are not limited to: PCR primers for specific gene (or bisulfite treated DNA sequence or CpG island); TaqMan® or Lightcycler® probes; optimized PCR buffers and deoxynucleotides; and Taq polymerase.

Ms-SNuPE. The Ms-SNuPE™ technique is a quantitative method for assessing methylation differences at specific CpG sites based on bisulfite treatment of DNA, followed by single-nucleotide primer extension (Gonzalgo & Jones, *Nucleic Acids Res.* 25:2529-2531, 1997). Briefly, genomic DNA is reacted with sodium bisulfite to convert unmethylated cytosine to uracil while leaving 5-methylcytosine unchanged. Amplification of the desired target sequence is then performed using PCR primers specific for bisulfite-converted DNA, and the resulting product is isolated and used as a template for methylation analysis at the CpG site(s) of interest. Small amounts of DNA can be analyzed (e.g., microdissected pathology sections), and it avoids utilization of restriction enzymes for determining the methylation status at CpG sites.

Typical reagents (e.g., as might be found in a typical Ms-SNuPE™-based kit) for Ms-SNuPE™ analysis may include, but are not limited to: PCR primers for specific gene (or bisulfite treated DNA sequence or CpG island); optimized PCR buffers and deoxynucleotides; gel extraction kit; positive control primers; Ms-SNuPE™ primers for specific gene; reaction buffer (for the Ms-SNuPE reaction); and labelled nucleotides. Additionally, bisulfite conversion reagents may include: DNA denaturation buffer; sulfonation buffer; DNA recovery regents or kit (e.g., precipitation, ultrafiltration, affinity column); desulfonation buffer; and DNA recovery components.

The Genomic Sequence According to SEQ ID NOS:128-141, 114-127 and 100-113 (Respective Genomic, CpG Island and Amplicons, Respectively), and Non-Naturally Occurring Treated Variants Thereof According to SEQ ID NOS:170-197, 226-253, 142-169 and 198-225, were Determined to have Novel Utility for the Detection, Classification and/or Treatment of CIMP, in Particular Colorectal Cell Proliferative Disorders In one embodiment the invention of the method comprises the following steps: i) contacting genomic DNA (preferably isolated from body fluids) obtained from the subject with at least one reagent, or series of reagents that distinguishes between methylated and non-methylated CpG dinucleotides within at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) (including their promoter and regulatory regions); and ii) detecting, or detecting and distinguishing CIMP or colon proliferative disorders (e.g., afforded with a sensitivity of greater than or equal to 80% and a specificity of greater than or equal to 80%).

Preferably, the sensitivity is from about 75% to about 96%, or from about 80% to about 90%, or from about 80% to about 85%. Preferably, the specificity is from about 75% to about 96%, or from about 80% to about 90%, or from about 80% to about 85%.

Genomic DNA may be isolated by any means standard in the art, including the use of commercially available kits. Briefly, wherein the DNA of interest is encapsulated in by a cellular membrane the biological sample must be disrupted and lysed by enzymatic, chemical or mechanical means. The DNA solution may then be cleared of proteins and other contaminants, e.g., by digestion with proteinase K. The genomic DNA is then recovered from the solution. This may be carried out by means of a variety of methods including salting out, organic extraction or binding of the DNA to a solid phase support. The choice of method will be affected by several factors including time, expense and required quantity of DNA. All clinical sample types comprising neoplastic matter or pre-neoplastic matter are suitable for us e in the present method, preferred are cell lines, histological slides, biopsies, paraffin-embedded tissue, body fluids, stool, colonic effluent, urine, blood plasma, blood serum, whole blood, isolated blood cells, cells isolated from the blood and combinations thereof. Body fluids are the preferred source of the DNA; particularly preferred are blood plasma, blood serum, whole blood, isolated blood cells and cells isolated from the blood.

The genomic DNA sample is then treated with at least one reagent, or series of reagents that distinguishes between methylated and non-methylated CpG dinucleotides within at least one target region of the genomic DNA, wherein the target region comprises, or hybridizes under stringent conditions to a sequence of at least 16 contiguous nucleotides of at least one sequence selected from the group consisting of SEQ ID NOS:128-141, 114-127 and 100-113 (respective genomic, CpG island and amplicons, respectively), wherein said contiguous nucleotides comprise at least one CpG dinucleotide sequence.

It is particularly preferred that said reagent converts cytosine bases which are unmethylated at the 5'-position to uracil, thymine, or another base which is dissimilar to cytosine in terms of hybridisation behaviour. However in an alternative embodiment said reagent may be a methylation sensitive restriction enzyme.

Wherein the genomic DNA sample is treated in such a manner that cytosine bases which are unmethylated at the 5'-position are converted to uracil, thymine, or another base which is dissimilar to cytosine in terms of hybridization behavior It is preferred that this treatment is carried out with bisulfite (hydrogen sulfite, disulfite) and subsequent alkaline hydrolysis. Such a treatment results in the conversion of SEQ ID NOS:128-141, 114-127 and 100-113 (respective genomic, CpG island and amplicons, respectively) to SEQ ID NOS: 170-197 and 142-169, (respectively) wherein said CpG dinucleotides are methylated or SEQ ID NOS:226-253 and 198-225 wherein said CpG dinucleotides are unmethylated.

The treated DNA is then analysed in order to determine the methylation state of the target gene sequences (at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) prior to the treatment). It is particularly preferred that the target region comprises, or hybridizes under stringent conditions to at least 16 contiguous nucleotides of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively). It is preferred that the sequence of said genes according to SEQ ID NOS:128-141, 114-127 and 100-113 (respective genomic, CpG island and amplicons, respectively) are analysed. The method of analysis may be selected from those known in the art, including those listed herein. Particularly preferred are MethyLight™, MSP and the use of blocking oligonucleotides (HeavyMethyl™) as described herein. It is further preferred that any oligonucleotides used in such analysis (including primers, blocking oligonucleotides and detection probes) should be reverse complementary, identical, or hybridise under stringent or highly stringent conditions to an at least 16-base-pair long segment of the base sequences of one or more of SEQ ID NOS:170-197, 226-253, 142-169 and 198-225 and sequences complementary thereto.

Aberrant methylation, more specifically hypermethylation of the genes or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) (including their promoter and/or regulatory regions) is associated with the presence of CIMP, and is particularly prevalent in colorectal carcinomas. Accordingly, in certain embodiments, wherein a biological sample presents within methylation as disclosed herein, said sample should be determined as CIMP.

Analysis of one the genes or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) enables for the first time detecting, or detecting and distinguishing CIMP or colon cell proliferative disorders (e.g., afforded with a sensitivity of greater than or equal to 80% and a specificity of greater than or equal to 80%. Sensitivity is calculated as: (detected neoplasia/all neoplasia; e.g., (detected colon neoplasia/all colon neoplasia); and specificity is calculated as (non-detected negatives/total negatives)).

Preferably, the sensitivity is from about 75% to about 96%, or from about 80% to about 90%, or from about 80% to about 85%. Preferably, the specificity is from about 75% to about 96%, or from about 80% to about 90%, or from about 80% to about 85%.

For certain embodiments, colon neoplasia is herein defined as all colon malignancies and adenomas greater than 1 cm., or subsets thereof. Negatives can be defined as healthy individuals.

In one embodiment the method discloses the use of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) (or promoter and/or regulatory regions thereof) as a marker for detection and distinguishing of CIMP, etc. as described herein.

Said method may be enabled by means of any analysis of the expression of an RNA transcribed therefrom or polypeptide or protein translated from said RNA, preferably by means of mRNA expression analysis or polypeptide expression analysis. Accordingly the present invention also provides diagnostic assays and methods, both quantitative and qualitative for detecting the expression of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) in a subject and determining therefrom upon the presence or absence of, e.g., CIMP, etc., in said subject.

Aberrant expression of mRNA transcribed from the genes or genomic sequences selected from the group consisting of BCL2, BDNF, CACNA1G, CALCA, CRABP1, DLEC1, GATA3, HOXA4, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) are associated with the presence of CIMP, cancer in a subject. According to particular aspects of the present invention, under expression (and/or presence methylation) is associated with the presence of CIMP, colon cancer, and vice versa over-expression (and/or absence of methylation) is associated with the absence of CIMP, colon cancer.

To detect the presence of mRNA encoding a gene or genomic sequence, a sample is obtained from a patient. The sample may be any suitable sample comprising cellular matter of the tumour. Suitable sample types include cell lines, histological slides, biopsies, paraffin-embedded tissue, body fluids, stool, colonic effluent, urine, blood plasma, blood serum, whole blood, isolated blood cells, cells isolated from the blood and all possible combinations thereof. It is preferred that said sample types are stool or body fluids selected from the group consisting colonic effluent, urine, blood plasma, blood serum, whole blood, isolated blood cells, cells isolated from the blood.

The sample may be treated to extract the RNA contained therein. The resulting nucleic acid from the sample is then analyzed. Many techniques are known in the state of the art for determining absolute and relative levels of gene expression, commonly used techniques suitable for use in the present invention include in situ hybridisation (e.g., FISH), Northern analysis, RNase protection assays (RPA), microarrays and PCR-based techniques, such as quantitative PCR and differential display PCR or any other nucleic acid detection method.

Particularly preferred is the use of the reverse transcription/polymerisation chain reaction technique (RT-PCR). The method of RT-PCR is well known in the art (for example, see Watson and Fleming, supra).

The RT-PCR method can be performed as follows. Total cellular RNA is isolated by, for example, the standard guanidium isothiocyanate method and the total RNA is reverse transcribed. The reverse transcription method involves synthesis of DNA on a template of RNA using a reverse transcriptase enzyme and a 3' end oligonucleotide dT primer and/or random hexamer primers. The cDNA thus produced is then amplified by means of PCR. (Belyavsky et al, Nucl Acid Res 17:2919-2932, 1989; Krug and Berger, Methods in Enzymology, Academic Press, N.Y., Vol. 152, pp. 316-325, 1987 which are incorporated by reference). Further preferred is the "Real-time" variant of RT-PCR, wherein the PCR product is detected by means of hybridisation probes (e.g. TaqMan, Lightcycler, Molecular Beacons & Scorpion) or SYBR green. The detected signal from the probes or SYBR green is then quantitated either by reference to a standard curve or by comparing the Ct values to that of a calibration standard. Analysis of housekeeping genes is often used to normalize the results.

In Northern blot analysis total or poly(A)+ mRNA is run on a denaturing agarose gel and detected by hybridisation to a labelled probe in the dried gel itself or on a membrane. The resulting signal is proportional to the amount of target RNA in the RNA population.

Comparing the signals from two or more cell populations or tissues reveals relative differences in gene expression levels. Absolute quantitation can be performed by comparing the signal to a standard curve generated using known amounts of an in vitro transcript corresponding to the target RNA. Analysis of housekeeping genes, genes whose expression levels are expected to remain relatively constant regardless of conditions, is often used to normalize the results, eliminating any apparent differences caused by unequal transfer of RNA to the membrane or unequal loading of RNA on the gel.

The first step in Northern analysis is isolating pure, intact RNA from the cells or tissue of interest. Because Northern blots distinguish RNAs by size, sample integrity influences the degree to which a signal is localized in a single band. Partially degraded RNA samples will result in the signal being smeared or distributed over several bands with an overall loss in sensitivity and possibly an erroneous interpretation of the data. In Northern blot analysis, DNA, RNA and oligonucleotide probes can be used and these probes are preferably labelled (e.g., radioactive labels, mass labels or fluorescent labels). The size of the target RNA, not the probe, will determine the size of the detected band, so methods such as random-primed labelling, which generates probes of variable lengths, are suitable for probe synthesis. The specific activity of the probe will determine the level of sensitivity, so it is preferred that probes with high specific activities, are used.

In an RNase protection assay, the RNA target and an RNA probe of a defined length are hybridised in solution. Following hybridisation, the RNA is digested with RNases specific for single-stranded nucleic acids to remove any unhybridized, single-stranded target RNA and probe. The RNases are inactivated, and the RNA is separated e.g. by denaturing polyacrylamide gel electrophoresis. The amount of intact RNA probe is proportional to the amount of target RNA in the RNA population. RPA can be used for relative and absolute quantitation of gene expression and also for mapping RNA structure, such as intron/exon boundaries and transcription start sites. The RNase protection assay is preferable to Northern blot analysis as it generally has a lower limit of detection.

The antisense RNA probes used in RPA are generated by in vitro transcription of a DNA template with a defined endpoint and are typically in the range of 50-600 nucleotides. The use of RNA probes that include additional sequences not homologous to the target RNA allows the protected fragment to be distinguished from the full-length probe. RNA probes are typically used instead of DNA probes due to the ease of generating single-stranded RNA probes and the reproducibility and reliability of RNA:RNA duplex digestion with RNases (Ausubel et al. 2003), particularly preferred are probes with high specific activities.

Particularly preferred is the use of microarrays. The microarray analysis process can be divided into two main parts. First is the immobilization of known gene sequences onto glass slides or other solid support followed by hybridisation of the fluorescently labelled cDNA (comprising the sequences to be interrogated) to the known genes immobilized on the glass slide (or other solid phase). After hybridisation, arrays are scanned using a fluorescent microarray scanner. Analysing the relative fluorescent intensity of different genes provides a measure of the differences in gene expression.

DNA arrays can be generated by immobilizing presynthesized oligonucleotides onto prepared glass slides or other solid surfaces. In this case, representative gene sequences are manufactured and prepared using standard oligonucleotide synthesis and purification methods. These synthesized gene sequences are complementary to the RNA transcript(s) of the genes of interest (in this case the genes or genomic sequences selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) and tend to be shorter sequences in the range of 25-70 nucleotides. Alternatively, immobilized oligos can be chemically synthesized in situ on the surface of the slide. In situ oligonucleotide synthesis involves the consecutive addition of the appropriate nucleotides to the spots on the microarray; spots not receiving a nucleotide are protected during each stage of the process using physical or virtual masks. Preferably said synthesized nucleic acids are locked nucleic acids.

In expression profiling microarray experiments, the RNA templates used are representative of the transcription profile of the cells or tissues under study. RNA is first isolated from the cell populations or tissues to be compared. Each RNA sample is then used as a template to generate fluorescently labelled cDNA via a reverse transcription reaction. Fluorescent labelling of the cDNA can be accomplished by either direct labelling or indirect labelling methods. During direct labelling, fluorescently modified nucleotides (e.g., Cy®3- or Cy®5-dCTP) are incorporated directly into the cDNA during the reverse transcription. Alternatively, indirect labelling can be achieved by incorporating aminoallyl-modified nucleotides during cDNA synthesis and then conjugating an N-hydroxysuccinimide (NHS)-ester dye to the aminoallyl-modified cDNA after the reverse transcription reaction is complete. Alternatively, the probe may be unlabelled, but may be detectable by specific binding with a ligand which is labelled, either directly or indirectly. Suitable labels and methods for labelling ligands (and probes) are known in the art, and include, for example, radioactive labels which may be incorporated by known methods (e.g., nick translation or kinasing). Other suitable labels include but are not limited to biotin, fluorescent groups, chemiluminescent groups (e.g., dioxetanes, particularly triggered dioxetanes), enzymes, antibodies, and the like.

To perform differential gene expression analysis, cDNA generated from different RNA samples are labelled with Cy®3. The resulting labelled cDNA is purified to remove unincorporated nucleotides, free dye and residual RNA. Following purification, the labelled cDNA samples are hybridised to the microarray. The stringency of hybridisation is determined by a number of factors during hybridisation and during the washing procedure, including temperature, ionic strength, length of time and concentration of formamide. These factors are outlined in, for example, Sambrook et al. (Molecular Cloning: A Laboratory Manual, 2nd ed., 1989). The microarray is scanned post-hybridisation using a fluorescent microarray scanner. The fluorescent intensity of each spot indicates the level of expression of the analysed gene; bright spots correspond to strongly expressed genes, while dim spots indicate weak expression.

Once the images are obtained, the raw data must be analysed. First, the background fluorescence must be subtracted from the fluorescence of each spot. The data is then normalized to a control sequence, such as exogenously added nucleic acids (preferably RNA or DNA), or a housekeeping gene panel to account for any non-specific hybridisation, array imperfections or variability in the array set-up, cDNA labelling, hybridisation or washing. Data normalization allows the results of multiple arrays to be compared.

Another aspect of the invention relates to a kit for use in diagnosis of cancer in a subject according to the methods of the present invention, said kit comprising: a means for measuring the level of transcription of genes or genomic sequences selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively). In a preferred embodiment, the means for measuring the level of transcription comprise oligonucleotides or polynucleotides able to hybridise under stringent or moderately stringent conditions to the transcription products of a gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively). Preferably said oligonucleotides or polynucleotides are able to hybridise under stringent or moderately stringent conditions to at least one of the transcription products of a gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively). In one embodiment said oligonucleotides or polynucleotides comprise at least 9, 18 or 25 bases of a sequence complementary to or hybrising to at least one sequence selected from the group consisting of SEQ ID NOS:254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332 and 334 and sequences complementary thereto.

In a most preferred embodiment, the level of transcription is determined by techniques selected from the group of Northern Blot analysis, reverse transcriptase PCR, real-time PCR, RNAse protection, and microarray. In another embodiment of the invention the kit further comprises means for obtaining a biological sample of the patient. Preferred is a kit, which further comprises a container which is most preferably suitable for containing the means for measuring the level of transcription and the biological sample of the patient, and most preferably further comprises instructions for use and interpretation of the kit results.

In a preferred embodiment the kit comprises (a) a plurality of oligonucleotides or polynucleotides able to hybridise under stringent or moderately stringent conditions to the transcription products of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively); (b) a container, preferably suitable for containing the oligonucleotides or polynucleotides and a biological sample of the patient comprising the transcription products wherein the oligonucleotides or polynucleotides can hybridise under stringent or moderately stringent conditions to the transcription products, (c) means to detect the hybridisation of (b); and optionally, (d) instructions for use and interpretation of the kit results. It is further preferred that said oligonucleotides or polynucleotides of (a) comprise in each case at least 9, 18 or 25 bases of a sequence complementary to or hybridising to at least one sequence selected from the group consisting of SEQ ID NOS:254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332 and 334 and sequences complementary thereto.

The kit may also contain other components such as hybridisation buffer (where the oligonucleotides are to be used as a probe) packaged in a separate container. Alternatively, where the oligonucleotides are to be used to amplify a target region, the kit may contain, packaged in separate containers, a polymerase and a reaction buffer optimised for primer extension mediated by the polymerase, such as PCR. Preferably said polymerase is a reverse transcriptase. It is further preferred that said kit further contains an Rnase reagent.

The present invention further provides for methods for the detection of the presence of the polypeptide encoded by said gene sequences in a sample obtained from a patient.

Aberrant levels of polypeptide expression of the polypeptides encoded by the genes or genomic sequences selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) are associated with CIMP and/or the presence of colon cancer.

According to the present invention, under expression of said polypeptides is associated with the presence of CIMP and/or the presence of colon cancer. It is particularly preferred that said polypeptides are according to at least one of the amino acid sequences provided in SEQ ID NOS:255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333 and 335 polypeptides transcribed from the BCL2, BDNF, CACNA1G, CALCA, CRABP1, DLEC1, GATA3, HOXA1, IGF2, KL, NEUROG1, NR3C1, RUNX3, SOCS1 (Table 6) genes).

Any method known in the art for detecting polypeptides can be used. Such methods include, but are not limited to mass-spectrometry, immunodiffusion, immunoelectrophoresis, immunochemical methods, binder-ligand assays, immunohistochemical techniques, agglutination and complement assays (e.g., see Basic and Clinical Immunology, Sites and Terr, eds., Appleton & Lange, Norwalk, Conn. pp 217-262, 1991 which is incorporated by reference). Preferred are binder-ligand immunoassay methods including reacting antibodies with an epitope or epitopes and competitively displacing a labelled polypeptide or derivative thereof.

Certain embodiments of the present invention comprise the use of antibodies specific to the polypeptide encoded by a gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively). It is particularly preferred that said polypeptides are according to at least one of the amino acid sequences provided in SEQ ID NOS:255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333 and 335.

Such antibodies are useful for CIMP and/or cancer diagnosis. In certain embodiments production of monoclonal or polyclonal antibodies can be induced by the use of an epitope encoded by a polypeptide of SEQ ID NOS:255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333 and 335 as an antigene. Such antibodies may in turn be used to detect expressed polypeptides as markers for CIMP and/or cancer diagnosis. The levels of such polypeptides present may be quantified by conventional methods. Antibody-polypeptide binding may be detected and quantified by a variety of means known in the art, such as labelling with fluorescent or radioactive ligands. The invention further comprises kits for performing the above-mentioned procedures, wherein such kits contain antibodies specific for the investigated polypeptides.

Numerous competitive and non-competitive polypeptide binding immunoassays are well known in the art. Antibodies employed in such assays may be unlabelled, for example as used in agglutination tests, or labelled for use a wide variety of assay methods. Labels that can be used include radionuclides, enzymes, fluorescers, chemiluminescers, enzyme substrates or co-factors, enzyme inhibitors, particles, dyes and the like. Preferred assays include but are not limited to radioimmunoassay (RIA), enzyme immunoassays, e.g., enzyme-linked immunosorbent assay (ELISA), fluorescent immunoassays and the like. Polyclonal or monoclonal antibodies or epitopes thereof can be made for use in immunoassays by any of a number of methods known in the art.

In an alternative embodiment of the method the proteins may be detected by means of western blot analysis. Said analysis is standard in the art, briefly proteins are separated by means of electrophoresis, e.g., SDS-PAGE. The separated proteins are then transferred to a suitable membrane (or paper), e.g., nitrocellulose, retaining the spacial separation achieved by electrophoresis. The membrane is then incubated with a blocking agent to bind remaining sticky places on the membrane, commonly used agents include generic protein (e.g., milk protein). An antibody specific to the protein of interest is then added, said antibody being detectably labelled for example by dyes or enzymatic means (e.g., alkaline phosphatase or horseradish peroxidase). The location of the antibody on the membrane is then detected.

In an alternative embodiment of the method the proteins may be detected by means of immunohistochemistry (the use of antibodies to probe specific antigens in a sample). Said analysis is standard in the art, wherein detection of antigens in tissues is known as immunohistochemistry, while detection in cultured cells is generally termed immunocytochemistry. Briefly, the primary antibody to be detected by binding to its specific antigen. The antibody-antigen complex is then bound by a secondary enzyme conjugated antibody. In the presence of the necessary substrate and chromogen the bound enzyme is detected according to coloured deposits at the antibody-antigen binding sites. There is a wide range of suitable sample types, antigen-antibody affinity, antibody types, and detection enhancement methods. Thus optimal conditions for immunohistochemical or immunocytochemical detection must be determined by the person skilled in the art for each individual case.

One approach for preparing antibodies to a polypeptide is the selection and preparation of an amino acid sequence of all or part of the polypeptide, chemically synthesising the amino acid sequence and injecting it into an appropriate animal, usually a rabbit or a mouse (Milstein and Kohler Nature 256:495-497, 1975; Gulfre and Milstein, Methods in Enzymology: Immunochemical Techniques 73:1-46, Langone and Banatis eds., Academic Press, 1981 which are incorporated by reference in its entirety). Methods for preparation of the polypeptides or epitopes thereof include, but are not limited to chemical synthesis, recombinant DNA techniques or isolation from biological samples.

In the final step of the method the diagnosis of the patient is determined, whereby under-expression (of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) is indicative of the presence of CIMP and/or cancer. The term under-expression shall be taken to mean expression at a detected level less than a pre-determined cut off which may be selected from the group consisting of the mean, median or an optimised threshold value.

Another aspect of the invention provides a kit for use in diagnosis of CIMP and/or cancer in a subject according to the methods of the present invention, comprising: a means for detecting polypeptides at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively). Preferably the sequence of said polypeptides is as provided in SEQ ID NOS:255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333 and 335. The means for detecting the polypeptides comprise preferably antibodies, antibody derivatives, or antibody fragments. The polypeptides are most preferably detected by means of Western Blotting utilizing a labelled antibody. In another embodiment of the invention the kit further comprising means for obtaining a biological sample of the patient. Preferred is a kit, which further comprises a container suitable for containing the means for detecting the polypeptides in the biological sample of the patient, and most preferably further comprises instructions for use and interpretation of the kit results. In a preferred embodiment the kit comprises: (a) a means for detecting polypeptides at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively); (b) a container suitable for containing the said means and the biological sample of the patient comprising the polypeptides wherein the means can form complexes with the polypeptides; (c) a means to detect the complexes of (b); and optionally (d) instructions for use and interpretation of the kit results. It is preferred that said means for detecting polypeptides of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) are specific for at least one of the polypeptide sequences selected from SEQ ID NOS:255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333 and 335. The kit may also contain other components such as buffers or solutions suitable for blocking, washing or coating, packaged in a separate container.

Particular embodiments of the present invention provide a novel application of the analysis of methylation levels and/or patterns within said sequences that enables a precise detection, characterisation and/or treatment of CIMP and/or colorectal cell proliferative disorders. Early detection of CIMP is directly linked with disease prognosis, and the disclosed method thereby enables the physician and patient to make better and more informed treatment decisions.

Further Improvements

The present invention provides novel compositions and uses as disclosed herein for genomic (e.g., CpG island) markers corresponding to at least one of BCL2, BDNF, CACNA1G, CALCA, CRABP1, DLEC1, GATA3, HOXA1, IGF2, KL, NEUROG1, NR3C1, RUNX3, SOCS1 (Table 6) sequences corresponding to e.g., within SEQ ID NOS:128-141, 114-127 and 100-113 (respective genomic, CpG island and amplicons, respectively). Additional embodiments provide modified variants of e.g., within SEQ ID NOS:128-141, 114-127 and 100-113 (respective genomic, CpG island and amplicons, respectively), as well as oligonucleotides and/or PNA-oligomers for analysis of cytosine methylation patterns within e.g., within SEQ ID NOS:128-141, 114-127 and 100-113 (respective genomic, CpG island and amplicons, respectively).

An objective of the invention comprises analysis of the methylation state of one or more CpG dinucleotides within at least one sequence selected form the group consisting of e.g., within SEQ ID NOS:128-141, 114-127 and 100-113 (respective genomic, CpG island and amplicons, respectively) and sequences complementary thereto.

The disclosed invention provides treated nucleic acids, derived from genomic e.g., within SEQ ID NOS:128-141, 114-127 and 100-113 (respective genomic, CpG island and amplicons, respectively), wherein the treatment is suitable to convert at least one unmethylated cytosine base of the genomic DNA sequence to uracil or another base that is detectably dissimilar to cytosine in terms of hybridization. The genomic sequences in question may comprise one, or more consecutive methylated CpG positions. Said treatment preferably comprises use of a reagent selected from the group consisting of bisulfite, hydrogen sulfite, disulfite, and combinations thereof. In a preferred embodiment of the invention, the invention provides a non-naturally occurring modified nucleic acid comprising a sequence of at least 16 contiguous nucleotide bases in length of a sequence selected from the group consisting of SEQ ID NOS:170-197, 226-253, 142-169 and 198-225. In further preferred embodiments of the invention said nucleic acid is at least 50, 100, 150, 200, 250 or 500 base pairs in length of a segment of the nucleic acid sequence disclosed in SEQ ID NOS:170-197, 226-253, 142-169 and 198-225. Particularly preferred is a nucleic acid molecule that is identical or complementary to all or a portion of the sequences SEQ ID NOS:170-197, 226-253, 142-169 and 198-225 but not SEQ ID NOS:128-141, 114-127 and 100-113 (respective genomic, CpG island and amplicons, respectively) or other naturally occurring DNA.

It is preferred that said sequence comprises at least one CpG, TpA or CpA dinucleotide and sequences complementary thereto. The sequences of SEQ ID NOS:170-197, 226-253, 142-169 and 198-225 provide non-naturally occurring modified versions of the nucleic acid according to SEQ ID NOS:128-141, 114-127 and 100-113 (respective genomic, CpG island and amplicons, respectively), wherein the modification of each genomic sequence results in the synthesis of a nucleic acid having a sequence that is unique and distinct from said genomic sequence as follows. For each sense strand genomic DNA, e.g., SEQ ID NO:1, four converted versions are disclosed. A first version wherein "C" is converted to "T," but "CpG" remains "CpG" (i.e., corresponds to case where, for the genomic sequence, all "C" residues of CpG dinucleotide sequences are methylated and are thus not converted); a second version discloses the complement of the disclosed genomic DNA sequence (i.e. antisense strand), wherein "C" is converted to "T," but "CpG" remains "CpG" (i.e., corresponds to case where, for all "C" residues of CpG dinucleotide sequences are methylated and are thus not converted). The 'upmethylated' converted sequences of SEQ ID NOS: 128-141, 114-127 and 100-113 (respective genomic, CpG island and amplicons, respectively) correspond to SEQ ID NOS:170-197 and 142-169. A third chemically converted version of each genomic sequences is provided, wherein "C" is converted to "T" for all "C" residues, including those of "CpG" dinucleotide sequences (i.e., corresponds to case where, for the genomic sequences, all "C" residues of CpG dinucleotide sequences are unmethylated); a final chemically converted version of each sequence, discloses the complement of the disclosed genomic DNA sequence (i.e. antisense strand), wherein "C" is converted to "T" for all "C" residues, including those of "CpG" dinucleotide sequences (i.e., corresponds to case where, for the complement (antisense strand) of each genomic sequence, all "C" residues of CpG dinucleotide sequences are unmethylated). The 'downmethylated' converted sequences of SEQ ID NOS:128-141, 114-127 and 100-113 (respective genomic, CpG island and amplicons, respectively) correspond to SEQ ID NOS:226-253 and 198-225.

Significantly, heretofore, the nucleic acid sequences and molecules according SEQ ID NOS:170-197, 226-253, 142-169 and 198-225 were not implicated in or connected with the detection, classification or treatment of cellular proliferative disorders.

In an alternative preferred embodiment, the invention further provides oligonucleotides or oligomers suitable for use in the methods of the invention for detecting the cytosine methylation state within genomic or treated (chemically modified) DNA, according to SEQ ID NOS:128-141, 114-127 and 100-113 (respective genomic, CpG island and amplicons, respectively), SEQ ID NOS:170-197, 226-253, 142-169 and 198-225. Said oligonucleotide or oligomer nucleic acids provide novel diagnostic means. Said oligonucleotide or oligomer comprising a nucleic acid sequence having a length of at least nine (9) nucleotides which is identical to, hybridizes, under moderately stringent or stringent conditions (as defined herein above), to a treated nucleic acid sequence according to SEQ ID NOS:170-197, 226-253, 142-169 and 198-225 and/or sequences complementary thereto, or to a genomic sequence according to SEQ ID NOS:128-141, 114-127 and 100-113 (respective genomic, CpG island and amplicons, respectively) and/or sequences complementary thereto.

Thus, the present invention includes nucleic acid molecules (e.g., oligonucleotides and peptide nucleic acid (PNA) molecules (PNA-oligomers)) that hybridize under moderately stringent and/or stringent hybridization conditions to all or a portion of a sequence selected form the group consisting SEQ ID NOS:128-141, 114-127 and 100-113 (respective genomic, CpG island and amplicons, respectively), SEQ ID NOS:170-197, 226-253, 142-169 and 198-225 or to the complements thereof. Particularly preferred is a nucleic acid molecule that hybridizes under moderately stringent and/or stringent hybridization conditions to all or a portion of the sequences SEQ ID NOS:170-197, 226-253, 142-169 and 198-225 but not SEQ ID NOS:128-141, 114-127 and 100-113 (respective genomic, CpG island and amplicons, respectively) or other human genomic DNA.

The identical or hybridizing portion of the hybridizing nucleic acids is typically at least 9, 16, 20, 25, 30 or 35 nucleotides in length. However, longer molecules have inventive utility, and are thus within the scope of the present invention.

Preferably, the hybridizing portion of the inventive hybridizing nucleic acids is at least 95%, or at least 98%, or 100% identical to the sequence, or to a portion thereof of a sequence selected from the group consisting of SEQ ID NOS:128-141, 114-127 and 100-113 (respective genomic, CpG island and amplicons, respectively), SEQ ID NOS:170-197, 226-253, 142-169 and 198-225, or to the complements thereof.

Hybridizing nucleic acids of the type described herein can be used, for example, as a primer (e.g., a PCR primer), or a diagnostic and/or prognostic probe or primer. Preferably, hybridization of the oligonucleotide probe to a nucleic acid sample is performed under stringent conditions and the probe is 100% identical to the target sequence. Nucleic acid duplex or hybrid stability is expressed as the melting temperature or Tm, which is the temperature at which a probe dissociates from a target DNA. This melting temperature is used to define the required stringency conditions.

For target sequences that are related and substantially identical to the corresponding sequence of SEQ ID NOS:128-141, 114-127 and 100-113 (respective genomic, CpG island and amplicons, respectively) (such as allelic variants and SNPs), rather than identical, it is useful to first establish the lowest temperature at which only homologous hybridization occurs with a particular concentration of salt (e.g., SSC or SSPE). Then, assuming that 1% mismatching results in a 1° C. decrease in the Tm, the temperature of the final wash in the hybridization reaction is reduced accordingly (for example, if sequences having >95% identity with the probe are sought, the final wash temperature is decreased by 5° C.). In practice, the change in Tm can be between 0.5° C. and 1.5° C. per 1% mismatch.

Examples of inventive oligonucleotides of length X (in nucleotides), as indicated by polynucleotide positions with reference to, e.g., (NEUROG1 CpG Island; SEQ ID NO:124, include those corresponding to sets (sense and antisense sets) of consecutively overlapping oligonucleotides of length X, where the oligonucleotides within each consecutively overlapping set (corresponding to a given X value) are defined as the finite set of Z oligonucleotides from nucleotide positions:

n to (n+(X−1));

where n=1, 2, 3, . . . (Y−(X−1));

where Y equals the length (nucleotides or base pairs) of SEQ ID NO:124 (2,091);

where X equals the common length (in nucleotides) of each oligonucleotide in the set (e.g., X=20 for a set of consecutively overlapping 20-mers); and where the number (Z) of consecutively overlapping oligomers of length X for a given SEQ ID NO of length Y is equal to Y−(X−1). For example Z=2,091−19=2,072 for either sense or antisense sets of SEQ ID NO:124, where X=20.

Preferably, the set is limited to those oligomers that comprise at least one CpG, TpG or CpA dinucleotide.

Examples of inventive 20-mer oligonucleotides include the following set of 2,072 oligomers (and the antisense set complementary thereto), indicated by polynucleotide positions with reference to SEQ ID NO: 124:

1-20, 2-21, 3-22, 4-23, 5-24, . . . and 2,072-2,091.

Preferably, the set is limited to those oligomers that comprise at least one CpG, TpG or CpA dinucleotide.

Likewise, examples of inventive 25-mer oligonucleotides include the following set of 2,067 oligomers (and the antisense set complementary thereto), indicated by polynucleotide positions with reference to SEQ ID NO: 124:

1-25, 2-26, 3-27, 4-28, 5-29, . . . and 2,067-2,091.

Preferably, the set is limited to those oligomers that comprise at least one CpG, TpG or CpA dinucleotide.

The present invention encompasses, for each of SEQ ID NOS:128-141, 114-127 and 100-113 (respective genomic, CpG island and amplicons, respectively), SEQ ID NOS:170-197, 226-253, 142-169 and 198-225 (sense and antisense), multiple consecutively overlapping sets of oligonucleotides or modified oligonucleotides of length X, where, e.g., X=9, 10, 17, 20, 22, 23, 25, 27, 30 or 35 nucleotides.

The oligonucleotides or oligomers according to the present invention constitute effective tools useful to ascertain genetic and epigenetic parameters of the genomic sequences selected from the group consisting of SEQ ID NOS:128-141, 114-127 and 100-113 (respective genomic, CpG island and amplicons, respectively). Preferred sets of such oligonucleotides or modified oligonucleotides of length X are those consecutively overlapping sets of oligomers corresponding to SEQ ID NOS:128-141, 114-127 and 100-113 (respective genomic, CpG island and amplicons, respectively), SEQ ID NOS:170-197, 226-253, 142-169 and 198-225 (and to the complements thereof). Preferably, said oligomers comprise at least one CpG, TpG or CpA dinucleotide.

Particularly preferred oligonucleotides or oligomers according to the present invention are those in which the cytosine of the CpG dinucleotide (or of the corresponding converted TpG or CpA dinucleotide) sequences is within the middle third of the oligonucleotide; that is, where the oligonucleotide is, for example, 13 bases in length, the CpG, TpG or CpA dinucleotide is positioned within the fifth to ninth nucleotide from the 5′-end.

The oligonucleotides of the invention can also be modified by chemically linking the oligonucleotide to one or more moieties or conjugates to enhance the activity, stability or detection of the oligonucleotide. Such moieties or conjugates include chromophores, fluorophors, lipids such as cholesterol, cholic acid, thioether, aliphatic chains, phospholipids, polyamines, polyethylene glycol (PEG), palmityl moieties, and others as disclosed in, for example, U.S. Pat. Nos. 5,514,758, 5,565,552, 5,567,810, 5,574,142, 5,585,481, 5,587,371, 5,597,696 and 5,958,773. The probes may also exist in the form of a PNA (peptide nucleic acid) which has particularly preferred pairing properties. Thus, the oligonucleotide may include other appended groups such as peptides, and may include hybridization-triggered cleavage agents (Krol et al., *BioTechniques* 6:958-976, 1988) or intercalating agents (Zon, *Pharm. Res.* 5:539-549, 1988). To this end, the oligonucleotide may be conjugated to another molecule, e.g., a chromophore, fluorophor, peptide, hybridization-triggered cross-linking agent, transport agent, hybridization-triggered cleavage agent, etc.

The oligonucleotide may also comprise at least one art-recognized modified sugar and/or base moiety, or may comprise a modified backbone or non-natural internucleoside linkage.

The oligonucleotides or oligomers according to particular embodiments of the present invention are typically used in 'sets,' which contain at least one oligomer for analysis of each of the CpG dinucleotides of a genomic sequence selected from the group consisting of SEQ ID NOS:128-141, 114-127 and 100-113 (respective genomic, CpG island and amplicons, respectively) and sequences complementary thereto, or to the corresponding CpG, TpG or CpA dinucleotide within a sequence of the treated nucleic acids according to SEQ ID NOS:170-197, 226-253, 142-169 and 198-225 and sequences complementary thereto. However, it is anticipated that for economic or other factors it may be preferable to analyse a limited selection of the CpG dinucleotides within said sequences, and the content of the set of oligonucleotides is altered accordingly.

Therefore, in particular embodiments, the present invention provides a set of at least two (2) (oligonucleotides and/or PNA-oligomers) useful for detecting the cytosine methylation state in treated genomic DNA (SEQ ID NOS:170-197, 226-253, 142-169 and 198-225), or in genomic DNA (e.g., within SEQ ID NOS:128-141, 114-127 and 100-113 (respective genomic, CpG island and amplicons, respectively) and sequences complementary thereto). These probes enable diagnosis, classification and/or therapy of genetic and epigenetic parameters of liver and/or colorectal cell proliferative disorders. The set of oligomers may also be used for detecting single nucleotide polymorphisms (SNPs) in treated genomic DNA (SEQ ID NOS:170-197, 226-253, 142-169 and 198-225), or in genomic DNA (e.g., within SEQ ID NOS:128-141, 114-127 and 100-113 (respective genomic, CpG island and amplicons, respectively) and sequences complementary thereto).

In preferred embodiments, at least one, and more preferably all members of a set of oligonucleotides is bound to a solid phase.

In further embodiments, the present invention provides a set of at least two (2) oligonucleotides that are used as 'primer' oligonucleotides for amplifying DNA sequences of one of SEQ ID NOS:128-141, 114-127 and 100-113 (respective genomic, CpG island and amplicons, respectively), SEQ ID NOS:170-197, 226-253, 142-169 and 198-225 and sequences complementary thereto, or segments thereof.

It is anticipated that the oligonucleotides may constitute all or part of an "array" or "DNA chip" (i.e., an arrangement of different oligonucleotides and/or PNA-oligomers bound to a solid phase). Such an array of different oligonucleotide- and/or PNA-oligomer sequences can be characterized, for example, in that it is arranged on the solid phase in the form of a rectangular or hexagonal lattice. The solid-phase surface may be composed of silicon, glass, polystyrene, aluminium, steel, iron, copper, nickel, silver, or gold. Nitrocellulose as well as plastics such as nylon, which can exist in the form of pellets or also as resin matrices, may also be used. An overview of the Prior Art in oligomer array manufacturing can be gathered from a special edition of Nature Genetics (*Nature Genetics Supplement*, Volume 21, January 1999, and from the literature cited therein). Fluorescently labelled probes are often used for the scanning of immobilized DNA arrays. The simple attachment of Cy3 and Cy5 dyes to the 5'-OH of the specific probe are particularly suitable for fluorescence labels. The detection of the fluorescence of the hybridised probes may be carried out, for example, via a confocal microscope. Cy3 and Cy5 dyes, besides many others, are commercially available.

It is also anticipated that the oligonucleotides, or particular sequences thereof, may constitute all or part of an "virtual array" wherein the oligonucleotides, or particular sequences thereof, are used, for example, as 'specifiers' as part of, or in combination with a diverse population of unique labeled probes to analyze a complex mixture of analytes. Such a method, for example is described in US 2003/0013091 (U.S. Ser. No. 09/898,743, published 16 Jan. 2003). In such methods, enough labels are generated so that each nucleic acid in the complex mixture (i.e., each analyte) can be uniquely bound by a unique label and thus detected (each label is directly counted, resulting in a digital read-out of each molecular species in the mixture).

It is particularly preferred that the oligomers according to the invention are utilised for at least one of: determining and/or classifying CIMP status in colorectal cancers; identifying KRAS mutant, BRAF wildtype tumors; determining the relationship between CIMP status and other molecular features of the cancers including, but not limited to BRAF mutation, KRAS mutation and MSI status; determining the relationship between CIMP status and other variables including, but not limited to age, sex, tumor location, family history, race, country of origin, tumor characteristics (including, tumor type, tumor grade, invasive margin characteristics, lymphocyte infiltration characteristics, direct spread, lymph node spread, venous spread and type of residual adjacent polyp, if present); determining, between subgroups defined by CIMP status and BRAF mutations, effects of selected risk factors including, but not limited to body mass index, smoking history, alcohol intake, dietary folate intake, folate metabolic enzyme polymorphisms and history of hormonal use; and providing a foundation for a population-based study of CIMP, by providing a novel panel of carefully selected methylation markers representing the CIMP subgroup, and having utility to classify CIMP In particular aspects, this is enabled by use of said sets for the detection or detection and differentiation of one or more of the following classes of tissues: colorectal carcinoma, colon adenoma, inflammatory colon tissue, grade 2 dysplasia colon adenomas less than 1 cm, grade 3 dysplasia colon adenomas larger than 1 cm, normal colon tissue, non-colon healthy tissue and non-colon cancer tissue.

Particularly preferred are those sets of oligomers according to the Examples.

In the most preferred embodiment of the method, CIMP status is determined or classified. This is achieved by analysis of the methylation status of at least one target sequence comprising at least one CpG position said sequence comprising, or hybridizing under stringent conditions to at least 16 contiguous nucleotides of a sequence selected from the group consisting of SEQ ID NOS:128-141, 114-127 and 100-113 (respective genomic, CpG island and amplicons, respectively) and complements thereof. The present invention further provides a method for ascertaining genetic and/or epigenetic parameters of the genomic sequence according to SEQ ID NOS:128-141, 114-127 and 100-113 (respective genomic, CpG island and amplicons, respectively) within a subject by analysing cytosine methylation and single nucleotide polymorphisms. Said method comprising contacting a nucleic acid comprising e.g., within SEQ ID NOS:128-141, 114-127 and 100-113 (respective genomic, CpG island and amplicons, respectively) in a biological sample obtained from said subject with at least one reagent or a series of reagents, wherein said reagent or series of reagents, distinguishes between methylated and non-methylated CpG dinucleotides within the target nucleic acid.

In a preferred embodiment, said method comprises the following steps: In the first step, a sample of the tissue to be analysed is obtained. The source may be any suitable source, such as cell lines, histological slides, biopsies, paraffin-embedded tissue, body fluids, stool, colonic effluent, urine, blood plasma, blood serum, whole blood, isolated blood cells, cells isolated from the blood and all possible combinations thereof. It is preferred that said sources of DNA are stool or body fluids selected from the group consisting colonic effluent, urine, blood plasma, blood serum, whole blood, isolated blood cells, cells isolated from the blood.

The genomic DNA is then isolated from the sample. Genomic DNA may be isolated by any means standard in the art, including the use of commercially available kits. Briefly, wherein the DNA of interest is encapsulated in by a cellular membrane the biological sample must be disrupted and lysed by enzymatic, chemical or mechanical means. The DNA solution may then be cleared of proteins and other contaminants e.g. by digestion with proteinase K. The genomic DNA is then recovered from the solution. This may be carried out by means of a variety of methods including salting out, organic extraction or binding of the DNA to a solid phase support. The choice of method will be affected by several factors including time, expense and required quantity of DNA.

Wherein the sample DNA is not enclosed in a membrane (e.g. circulating DNA from a blood sample) methods standard in the art for the isolation and/or purification of DNA may be employed. Such methods include the use of a protein degenerating reagent e.g., chaotropic salt e.g. guanidine hydrochloride or urea; or a detergent e.g. sodium dodecyl sulphate (SDS), cyanogen bromide. Alternative methods include but are not limited to ethanol precipitation or propanol precipitation, vacuum concentration amongst others by means of a centrifuge. The person skilled in the art may also make use of devices such as filter devices, e.g., ultrafiltration, silica surfaces or membranes, magnetic particles, polystyrol particles, polystyrol surfaces, positively charged surfaces, and positively charged membranes, charged membranes, charged surfaces, charged switch membranes, charged switched surfaces.

Once the nucleic acids have been extracted, the genomic double stranded DNA is used in the analysis.

In the second step of the method, the genomic DNA sample is treated in such a manner that cytosine bases which are unmethylated at the 5'-position are converted to uracil, thymine, or another base which is dissimilar to cytosine in terms of hybridisation behaviour. This will be understood as 'pretreatment' or 'treatment' herein.

This is preferably achieved by means of treatment with a bisulfite reagent. The term "bisulfite reagent" refers to a reagent comprising bisulfite, disulfite, hydrogen sulfite or combinations thereof, useful as disclosed herein to distinguish between methylated and unmethylated CpG dinucleotide sequences. Methods of said treatment are known in the art (e.g., PCT/EP2004/011715, which is incorporated by reference in its entirety). It is preferred that the bisulfite treatment is conducted in the presence of denaturing solvents such as but not limited to n-alkylenglycol, particularly diethylene glycol dimethyl ether (DME), or in the presence of dioxane or dioxane derivatives. In a preferred embodiment the denaturing solvents are used in concentrations between 1% and 35% (v/v). It is also preferred that the bisulfite reaction is carried out in the presence of scavengers such as but not limited to chromane derivatives, e.g., 6-hydroxy-2, 5,7,8,-tetramethylchromane 2-carboxylic acid or trihydroxybenzoe acid and derivates thereof, e.g., Gallic acid (see: PCT/EP2004/011715 which is incorporated by reference in its entirety). The bisulfite conversion is preferably carried out at a reaction temperature between 30° C. and 70° C., whereby the temperature is increased to over 85° C. for short periods of times during the reaction (see: PCT/EP2004/011715 which is incorporated by reference in its entirety). The bisulfite treated DNA is preferably purified priori to the quantification. This may be conducted by any means known in the art, such as but not limited to ultrafiltration, preferably carried out by means of Microcon™ columns (manufactured by Millipore™). The purification is carried out according to a modified manufacturer's protocol (see: PCT/EP2004/011715 which is incorporated by reference in its entirety).

In the third step of the method, fragments of the treated DNA are amplified, using sets of primer oligonucleotides according to the present invention, and an amplification enzyme. The amplification of several DNA segments can be carried out simultaneously in one and the same reaction vessel. Typically, the amplification is carried out using a polymerase chain reaction (PCR). Preferably said amplificates are 100 to 2,000 base pairs in length. The set of primer oligonucleotides includes at least two oligonucleotides whose sequences are each reverse complementary, identical, or hybridise under stringent or highly stringent conditions to an at least 16-base-pair long segment of the base sequences of one of SEQ ID NOS:170-197, 226-253, 142-169 and 198-225 and sequences complementary thereto.

In an alternate embodiment of the method, the methylation status of pre-selected CpG positions within at least one nucleic acid sequences selected from the group consisting of SEQ ID NOS:128-141, 114-127 and 100-113 (respective genomic, CpG island and amplicons, respectively) may be detected by use of methylation-specific primer oligonucleotides. This technique (MSP) has been described in U.S. Pat. No. 6,265,171 to Herman. The use of methylation status specific primers for the amplification of bisulfite treated DNA allows the differentiation between methylated and unmethylated nucleic acids. MSP primers pairs contain at least one primer which hybridises to a bisulfite treated CpG dinucleotide. Therefore, the sequence of said primers comprises at least one CpG dinucleotide. MSP primers specific for non-methylated DNA contain a "T" at the position of the C position in the CpG. Preferably, therefore, the base sequence of said primers is required to comprise a sequence having a length of at least 9 nucleotides which hybridises to a treated nucleic acid sequence according to one of SEQ ID NOS:170-197, 226-253, 142-169 and 198-225 and sequences complementary thereto, wherein the base sequence of said oligomers comprises at least one CpG dinucleotide. A further preferred embodiment of the method comprises the use of blocker oligonucleotides (the HeavyMethyl™ assay). The use of such blocker oligonucleotides has been described by Yu et al., *BioTechniques* 23:714-720, 1997. Blocking probe oligonucleotides are hybridised to the bisulfite treated nucleic acid concurrently with the PCR primers. PCR amplification of the nucleic acid is terminated at the 5' position of the blocking probe, such that amplification of a nucleic acid is suppressed where the complementary sequence to the blocking probe is present. The probes may be designed to hybridize to the bisulfite treated nucleic acid in a methylation status specific manner. For example, for detection of methylated nucleic acids within a population of unmethylated nucleic acids, suppression of the amplification of nucleic acids which are unmethylated at the position in question would be carried out by the use of blocking probes comprising a 'CpA' or 'TpA' at the position in question, as opposed to a 'CpG' if the suppression of amplification of methylated nucleic acids is desired.

For PCR methods using blocker oligonucleotides, efficient disruption of polymerase-mediated amplification requires that blocker oligonucleotides not be elongated by the polymerase. Preferably, this is achieved through the use of blockers that are 3'-deoxyoligonucleotides, or oligonucleotides derivitized at the 3' position with other than a "free" hydroxyl group. For example, 3'-O-acetyl oligonucleotides are representative of a preferred class of blocker molecule.

Additionally, polymerase-mediated decomposition of the blocker oligonucleotides should be precluded. Preferably, such preclusion comprises either use of a polymerase lacking 5'-3' exonuclease activity, or use of modified blocker oligonucleotides having, for example, thioate bridges at the 5'-terminii thereof that render the blocker molecule nuclease-resistant. Particular applications may not require such 5' modifications of the blocker. For example, if the blocker- and primer-binding sites overlap, thereby precluding binding of the primer (e.g., with excess blocker), degradation of the blocker oligonucleotide will be substantially precluded. This is because the polymerase will not extend the primer toward, and through (in the 5'-3' direction) the blocker—a process that normally results in degradation of the hybridized blocker oligonucleotide.

A particularly preferred blocker/PCR embodiment, for purposes of the present invention and as implemented herein, comprises the use of peptide nucleic acid (PNA) oligomers as blocking oligonucleotides. Such PNA blocker oligomers are ideally suited, because they are neither decomposed nor extended by the polymerase.

Preferably, therefore, the base sequence of said blocking oligonucleotides is required to comprise a sequence having a length of at least 9 nucleotides which hybridises to a treated nucleic acid sequence according to one of SEQ ID NOS:170-197, 226-253, 142-169 and 198-225 and sequences complementary thereto, wherein the base sequence of said oligonucleotides comprises at least one CpG, TpG or CpA dinucleotide.

The fragments obtained by means of the amplification can carry a directly or indirectly detectable label. Preferred are labels in the form of fluorescence labels, radionuclides, or detachable molecule fragments having a typical mass which can be detected in a mass spectrometer. Where said labels are mass labels, it is preferred that the labelled amplificates have a single positive or negative net charge, allowing for better delectability in the mass spectrometer. The detection may be carried out and visualized by means of, e.g., matrix assisted laser desorption/ionization mass spectrometry (MALDI) or using electron spray mass spectrometry (ESI).

Matrix Assisted Laser Desorption/Ionization Mass Spectrometry (MALDI-TOF) is a very efficient development for the analysis of biomolecules (Karas & Hillenkamp, *Anal Chem.*, 60:2299-301, 1988). An analyte is embedded in a light-absorbing matrix. The matrix is evaporated by a short laser pulse thus transporting the analyte molecule into the vapor phase in an unfragmented manner. The analyte is ionized by collisions with matrix molecules. An applied voltage accelerates the ions into a field-free flight tube. Due to their different masses, the ions are accelerated at different rates. Smaller ions reach the detector sooner than bigger ones. MALDI-TOF spectrometry is well suited to the analysis of peptides and proteins. The analysis of nucleic acids is somewhat more difficult (Gut & Beck, *Current Innovations and Future Trends,* 1:147-57, 1995). The sensitivity with respect to nucleic acid analysis is approximately 100-times less than for peptides, and decreases disproportionally with increasing fragment size. Moreover, for nucleic acids having a multiply negatively charged backbone, the ionization process via the matrix is considerably less efficient. In MALDI-TOF spectrometry, the selection of the matrix plays an eminently important role. For desorption of peptides, several very efficient matrixes have been found which produce a very fine crystallisation. There are now several responsive matrixes for DNA, however, the difference in sensitivity between peptides and nucleic acids has not been reduced. This difference in sensitivity can be reduced, however, by chemically modifying the DNA in such a manner that it becomes more similar to a peptide. For example, phosphorothioate nucleic acids, in which the usual phosphates of the backbone are substituted with thiophosphates, can be converted into a charge-neutral DNA using simple alkylation chemistry (Gut & Beck, *Nucleic Acids Res.* 23: 1367-73, 1995). The coupling of a charge tag to this modified DNA results in an increase in MALDI-TOF sensitivity to the same level as that found for peptides. A further advantage of charge tagging is the increased stability of the analysis against impurities, which makes the detection of unmodified substrates considerably more difficult.

In the fourth step of the method, the amplificates obtained during the third step of the method are analysed in order to ascertain the methylation status of the CpG dinucleotides prior to the treatment.

In embodiments where the amplificates were obtained by means of MSP amplification, the presence or absence of an amplificate is in itself indicative of the methylation state of the CpG positions covered by the primer, according to the base sequences of said primer.

Amplificates obtained by means of both standard and methylation specific PCR may be further analysed by means of based-based methods such as, but not limited to, array technology and probe based technologies as well as by means of techniques such as sequencing and template directed extension.

In one embodiment of the method, the amplificates synthesised in step three are subsequently hybridized to an array or a set of oligonucleotides and/or PNA probes. In this context, the hybridization takes place in the following manner: the set of probes used during the hybridization is preferably composed of at least 2 oligonucleotides or PNA-oligomers; in the process, the amplificates serve as probes which hybridize to oligonucleotides previously bonded to a solid phase; the non-hybridized fragments are subsequently removed; said oligonucleotides contain at least one base sequence having a length of at least 9 nucleotides which is reverse complementary or identical to a segment of the base sequences specified in the present Sequence Listing; and the segment comprises at least one CpG, TpG or CpA dinucleotide. The hybridizing portion of the hybridizing nucleic acids is typically at least 9, 15, 20, 25, 30 or 35 nucleotides in length. However, longer molecules have inventive utility, and are thus within the scope of the present invention.

In a preferred embodiment, said dinucleotide is present in the central third of the oligomer. For example, wherein the oligomer comprises one CpG dinucleotide, said dinucleotide is preferably the fifth to ninth nucleotide from the 5'-end of a 13-mer. One oligonucleotide exists for the analysis of each CpG dinucleotide within a sequence selected from the group consisting of SEQ ID NOS:128-141, 114-127 and 100-113 (respective genomic, CpG island and amplicons, respectively), and the equivalent positions within SEQ ID NOS: 170-197, 226-253, 142-169 and 198-225.

Said oligonucleotides may also be present in the form of peptide nucleic acids. The non-hybridised amplificates are then removed. The hybridised amplificates are then detected. In this context, it is preferred that labels attached to the amplificates are identifiable at each position of the solid phase at which an oligonucleotide sequence is located.

In yet a further embodiment of the method, the genomic methylation status of the CpG positions may be ascertained by means of oligonucleotide probes (as detailed above) that are hybridised to the bisulfite treated DNA concurrently with the PCR amplification primers (wherein said primers may either be methylation specific or standard).

A particularly preferred embodiment of this method is the use of fluorescence-based Real Time Quantitative PCR (Heid et al., *Genome Res.* 6:986-994, 1996; also see U.S. Pat. No. 6,331,393) employing a dual-labelled fluorescent oligonucleotide probe (TaqMan™ PCR, using an ABI Prism 7700 Sequence Detection System, Perkin Elmer Applied Biosystems, Foster City, Calif.). The TaqMan™ PCR reaction employs the use of a non-extendible interrogating oligonucleotide, called a TaqMan™ probe, which, in preferred embodiments, is designed to hybridise to a CpG-rich sequence located between the forward and reverse amplification primers. The TaqMan™ probe further comprises a fluorescent "reporter moiety" and a "quencher moiety" covalently bound to linker moieties (e.g., phosphoramidites) attached to the nucleotides of the TaqMan™ oligonucleotide. For analysis of methylation within nucleic acids subsequent to bisulfite treatment, it is required that the probe be methylation specific, as described in U.S. Pat. No. 6,331,393, (hereby incorporated by reference in its entirety) also known as the MethyLight™ assay. Variations on the TaqMan™ detection methodology that are also suitable for use with the described invention include the use of dual-probe technology (Lightcycler™) or fluorescent amplification primers (Sunrise™ technology). Both these techniques may be adapted in a manner suitable for use with bisulfite treated DNA, and moreover for methylation analysis within CpG dinucleotides.

In a further preferred embodiment of the method, the fourth step of the method comprises the use of template-directed oligonucleotide extension, such as MS-SNuPE as described by Gonzalgo & Jones, *Nucleic Acids Res.* 25:2529-2531, 1997.

In yet a further embodiment of the method, the fourth step of the method comprises sequencing and subsequent sequence analysis of the amplificate generated in the third step of the method (Sanger F., et al., *Proc Natl Acad Sci USA* 74:5463-5467, 1977).

Best Mode

In a preferred embodiment of the method, the genomic nucleic acids are isolated and treated according to the first three steps of the method outlined above, namely:

a) obtaining, from a subject, a biological sample having subject genomic DNA;

b) extracting or otherwise isolating the genomic DNA;

c) treating the genomic DNA of b), or a fragment thereof, with one or more reagents to convert cytosine bases that are unmethylated in the 5-position thereof to uracil or to another base that is detectably dissimilar to cytosine in terms of hybridization properties; and wherein d) amplifying subsequent to treatment in c) is carried out in a methylation specific manner, namely by use of methylation specific primers or blocking oligonucleotides, and further wherein e) detecting of the amplificates is carried out by means of a real-time detection probe, as described above.

Preferably, where the subsequent amplification of d) is carried out by means of methylation specific primers, as described above, said methylation specific primers comprise a sequence having a length of at least 9 nucleotides which hybridises to a treated nucleic acid sequence according to one of SEQ ID NOS:170-197, 226-253, 142-169 and 198-225 and sequences complementary thereto, wherein the base sequence of said oligomers comprise at least one CpG dinucleotide.

Step e) of the method, namely the detection of the specific amplificates indicative of the methylation status of one or more CpG positions of at least one sequences of the group comprising SEQ ID NOS:128-141, 114-127 and 100-113 is carried out by means of real-time detection methods as described above.

Additional embodiments of the invention provide a method for the analysis of the methylation status of genomic DNA according to the invention (e.g., within SEQ ID NOS:128-141, 114-127 and 100-113 (respective genomic, CpG island and amplicons, respectively), and complements thereof) without the need for bisulfite conversion. Methods are known in the art wherein a methylation sensitive restriction enzyme reagent, or a series of restriction enzyme reagents comprising methylation sensitive restriction enzyme reagents that distinguishes between methylated and non-methylated CpG dinucleotides within a target region are utilized in determining methylation, for example but not limited to DMH.

In the first step of such additional embodiments, the genomic DNA sample is isolated from tissue or cellular sources. Genomic DNA may be isolated by any means standard in the art, including the use of commercially available kits. Briefly, wherein the DNA of interest is encapsulated in by a cellular membrane the biological sample must be disrupted and lysed by enzymatic, chemical or mechanical means. The DNA solution may then be cleared of proteins and other contaminants, e.g., by digestion with proteinase K. The genomic DNA is then recovered from the solution. This may be carried out by means of a variety of methods including salting out, organic extraction or binding of the DNA to a solid phase support. The choice of method will be affected by several factors including time, expense and required quantity of DNA. All clinical sample types comprising neoplastic or potentially neoplastic matter are suitable for use in the present method, preferred are cell lines, histological slides, biopsies, paraffin-embedded tissue, body fluids, stool, colonic effluent, urine, blood plasma, blood serum, whole blood, isolated blood cells, cells isolated from the blood and combinations thereof. Body fluids are the preferred source of the DNA; particularly preferred are blood plasma, blood serum, whole blood, isolated blood cells and cells isolated from the blood.

Once the nucleic acids have been extracted, the genomic double-stranded DNA is used in the analysis.

In a preferred embodiment, the DNA may be cleaved prior to treatment with methylation sensitive restriction enzymes. Such methods are known in the art and may include both physical and enzymatic means. Particularly preferred is the use of one or a plurality of restriction enzymes which are not methylation sensitive, and whose recognition sites are AT rich and do not comprise CG dinucleotides. The use of such enzymes enables the conservation of CpG islands and CpG rich regions in the fragmented DNA. The non-methylation-specific restriction enzymes are preferably selected from the group consisting of MseI, BfaI, Csp6I, Tru1I, Tvu1I, Tru9I, Tvu9I, MaeI and XspI. Particularly preferred is the use of two or three such enzymes. Particularly preferred is the use of a combination of MseI, BfaI and Csp6I.

The fragmented DNA may then be ligated to adaptor oligonucleotides in order to facilitate subsequent enzymatic amplification. The ligation of oligonucleotides to blunt and sticky ended DNA fragments is known in the art, and is carried out by means of dephosphorylation of the ends (e.g., using calf or shrimp alkaline phosphatase) and subsequent ligation using ligase enzymes (e.g., T4 DNA ligase) in the presence of dATPs. The adaptor oligonucleotides are typically at least 18 base pairs in length.

In the third step, the DNA (or fragments thereof) is then digested with one or more methylation sensitive restriction enzymes. The digestion is carried out such that hydrolysis of the DNA at the restriction site is informative of the methylation status of a specific CpG dinucleotide of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively).

Preferably, the methylation-specific restriction enzyme is selected from the group consisting of Bsi E1, Hga I HinPI, Hpy99I, Ava I, Bce AI, Bsa HI, BisI, BstUI, BshI236I, AccII, BstFNI, McrBC, GlaI, MvnI, HpaII (HapII), HapII, AciI, SmaI, HinPII, HpyCH4IV, EagI and mixtures of two or more of the above enzymes. Preferred is a mixture containing the restriction enzymes BstUI, HpaII, HpyCH4IV and HinP1I.

In the fourth step, which is optional but a preferred embodiment, the restriction fragments are amplified. This is preferably carried out using a polymerase chain reaction, and said amplificates may carry suitable detectable labels as discussed above, namely fluorophore labels, radionuclides and mass labels. Particularly preferred is amplification by means of an amplification enzyme and at least two primers comprising, in each case a contiguous sequence at least 16 nucleotides in length that is complementary to, or hybridizes under moderately stringent or stringent conditions to a sequence selected from the group consisting of SEQ ID NOS:128-141, 114-127 and 100-113 (respective genomic, CpG island and amplicons, respectively), and complements thereof. Preferably said contiguous sequence is at least 16, 20 or 25 nucleotides in length. In an alternative embodiment said primers may be complementary to any adaptors linked to the fragments.

In the fifth step the amplificates are detected. The detection may be by any means standard in the art, for example, but not limited to, gel electrophoresis analysis, hybridisation analysis, incorporation of detectable tags within the PCR products, DNA array analysis, MALDI or ESI analysis. Preferably said detection is carried out by hybridisation to at least one nucleic acid or peptide nucleic acid comprising in each case a contiguous sequence at least 16 nucleotides in length that is complementary to, or hybridizes under moderately stringent or stringent conditions to a sequence selected from the group consisting of SEQ ID NOS:128-141, 114-127 and 100-113 (respective genomic, CpG island and amplicons, respectively), and complements thereof. Preferably said contiguous sequence is at least 16, 20 or 25 nucleotides in length.

Subsequent to the determination of the methylation state or level of the genomic nucleic acids the presence, absence or class of CIMP and/or cellular proliferative disorder (e.g., colon cancer) is deduced based upon the methylation state or level of at least one CpG dinucleotide sequence of at least one sequence selected from the group consisting of SEQ ID NOS:128-141, 114-127 and 100-113 (respective genomic, CpG island and amplicons, respectively), or an average, or a value reflecting an average methylation state of a plurality of CpG dinucleotide sequences of at least one sequence selected from the group consisting of SEQ ID NOS:128-141, 114-127 and 100-113 (respective genomic, CpG island and amplicons, respectively) wherein methylation is associated with CIMP and/or cellular proliferative disorder (e.g., colon cancer). Wherein said methylation is determined by quantitative means the cut-off point for determining said the presence of methylation is preferably zero (i.e. wherein a sample displays any degree of methylation it is determined as having a methylated status at the analysed CpG position). Nonetheless, it is foreseen that the person skilled in the art may wish to adjust said cut-off value in order to provide an assay of a particularly preferred sensitivity or specificity. Accordingly said cut-off value may be increased (thus increasing the specificity), said cut off value may be within a range selected form the group consisting of 0%-5%, 5%-10%, 10%-15%, 15%-20%, 20%-30% and 30%-50%. Particularly preferred are the cut-offs 10%, 15%, 25%, and 30%.

In an alternative embodiment of the method wherein a panel of genes comprising BCL2, BDNF, CACNA1G, CALCA, CRABP1, DLEC1, GATA3, HOXA1, IGF2, KL, NEUROG1, NR3C1, RUNX3, SOCS1 (Table 6), subsequent to the determination of the methylation state of the genomic nucleic acids the presence, absence or subclass of CIMP and/or colon proliferative disorders, in particular colorectal cell proliferative disorder is deduced based upon the methylation state of at least one CpG dinucleotide sequence of SEQ ID NOS:128-141, 114-127 and 100-113 (respective genomic, CpG island and amplicons, respectively), or an average, or a value reflecting an average methylation state of a plurality of CpG dinucleotide sequences thereof wherein hypermethylation is associated with CIMP and/or colorectal cancer.

Diagnostic and Prognostic Assays for CIMP and/or Cellular Proliferative Disorders The present invention enables diagnosis of events which are disadvantageous to patients or individuals in which important genetic and/or epigenetic parameters within at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) may be used as markers. Said parameters obtained by means of the present invention may be compared to another set of genetic and/or epigenetic parameters, the differences serving as the basis for a diagnosis and/or prognosis of events which are disadvantageous to patients or individuals.

More specifically the present invention enables the screening of at-risk populations for the early detection of cancers, most preferably CIMP and/or colorectal carcinomas. Furthermore, in certain aspects, the present invention enables the differentiation of neoplastic (e.g. malignant) from benign (i.e. non-cancerous) cellular proliferative disorders. For example, in certain embodiments, it enables the differentiation of a colorectal carcinoma from small colon adenomas or polyps. Neoplastic cellular proliferative disorders present decreased methylation (i.e. decreased expression) within at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively), as opposed to said benign disorders which do not.

Specifically, the present invention provides for diagnostic and classification CIMP and/or cancer assays based on measurement of differential expression (preferably methylation) of one or more CpG dinucleotide sequences of at least one sequence selected from the group consisting of SEQ ID NOS:128-141, 114-127 and 100-113 (respective genomic, CpG island and amplicons, respectively) that comprise such a CpG dinucleotide sequence. Typically, such assays involve obtaining a sample from a subject, performing an assay to measure the expression of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively), preferably by determining the methylation status of at least one sequence selected from the group consisting of SEQ ID NOS:128-141, 114-127 and 100-113 (respective genomic, CpG island and amplicons, respectively), derived from the sample, relative to a control sample, or a known standard and making a diagnosis based thereon.

In particular preferred embodiments, inventive oligomers are used to assess the CpG dinucleotide methylation status, such as those based on SEQ ID NOS:128-141, 114-127 and 100-113 (respective genomic, CpG island and amplicons, respectively), SEQ ID NOS:170-197, 226-253, 142-169 and 198-225 or arrays thereof, as well as in kits based thereon and useful for the diagnosis and/or classification of cellular proliferative disorders.

Kits

Moreover, an additional aspect of the present invention is a kit comprising: a means for determining methylation of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively). The means for determining methylation comprise preferably a bisulfite-containing reagent; one or a plurality of oligonucleotides consisting whose sequences in each case are identical, are complementary, or hybridise under stringent or highly stringent conditions to a 9 or more preferably 18 base long segment of a sequence selected from SEQ ID NOS:170-197, 226-253, 142-169 and 198-225; and optionally instructions for carrying out and evaluating the described method of methylation analysis. In one embodiment the base sequence of said oligonucleotides comprises at least one CpG, CpA or TpG dinucleotide.

In a further embodiment, said kit may further comprise standard reagents for performing a CpG position-specific methylation analysis, wherein said analysis comprises one or more of the following techniques: MS-SNuPE, MSP, MethyLight™, HeavyMethyl, COBRA, and nucleic acid sequencing. However, a kit along the lines of the present invention can also contain only part of the aforementioned components.

In a preferred embodiment the kit may comprise additional bisulfite conversion reagents selected from the group consisting: DNA denaturation buffer; sulfonation buffer; DNA recovery reagents or kits (e.g., precipitation, ultrafiltration, affinity column); desulfonation buffer; and DNA recovery components.

In a further alternative embodiment, the kit may contain, packaged in separate containers, a polymerase and a reaction buffer optimised for primer extension mediated by the polymerase, such as PCR. In another embodiment of the invention the kit further comprising means for obtaining a biological sample of the patient. Preferred is a kit, which further comprises a container suitable for containing the means for determining methylation of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) in the biological sample of the patient, and most preferably further comprises instructions for use and interpretation of the kit results. In a preferred embodiment the kit comprises: (a) a bisulfite reagent; (b) a container suitable for containing the said bisulfite reagent and the biological sample of the patient; (c) at least one set of primer oligonucleotides containing two oligonucleotides whose sequences in each case are identical, are complementary, or hybridise under stringent or highly stringent conditions to a 9 or more preferably 18 base long segment of a sequence selected from SEQ ID NOS:170-197, 226-253, 142-169 and 198-225; and optionally (d) instructions for use and interpretation of the kit results. In an alternative preferred embodiment the kit comprises: (a) a bisulfite reagent; (b) a container suitable for containing the said bisulfite reagent and the biological sample of the patient; (c) at least one oligonucleotides and/or PNA-oligomer having a length of at least 9 or 16 nucleotides which is identical to or hybridises to a pre-treated nucleic acid sequence according to one of SEQ ID NOS:170-197, 226-253, 142-169 and 198-225 and sequences complementary thereto; and optionally (d) instructions for use and interpretation of the kit results.

In an alternative embodiment the kit comprises: (a) a bisulfite reagent; (b) a container suitable for containing the said bisulfite reagent and the biological sample of the patient; (c) at least one set of primer oligonucleotides containing two oligonucleotides whose sequences in each case are identical, are complementary, or hybridise under stringent or highly stringent conditions to a 9 or more preferably 18 base long segment of a sequence selected from SEQ ID NOS:170-197, 226-253, 142-169 and 198-225; (d) at least one oligonucleotides and/or PNA-oligomer having a length of at least 9 or 16 nucleotides which is identical to or hybridises to a pre-treated nucleic acid sequence according to one of SEQ ID NOS:170-197, 226-253, 142-169 and 198-225 and sequences complementary thereto; and optionally (e) instructions for use and interpretation of the kit results.

The kit may also contain other components such as buffers or solutions suitable for blocking, washing or coating, packaged in a separate container.

Typical reagents (e.g., as might be found in a typical COBRA™-based kit) for COBRA™ analysis may include, but are not limited to: PCR primers for at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively); restriction enzyme and appropriate buffer; gene-hybridization oligo; control hybridization oligo; kinase labeling kit for oligo probe; and labeled nucleotides. Typical reagents (e.g., as might be found in a typical MethyLight™-based kit) for MethyLight™ analysis may include, but are not limited to: PCR primers for the bisulfite converted sequence of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively); bisulfite specific probes (e.g., TaqMan™ or Lightcycler™); optimized PCR buffers and deoxynucleotides; and Taq polymerase.

Typical reagents (e.g., as might be found in a typical Ms-SNuPE™-based kit) for Ms-SNuPE™ analysis may include, but are not limited to: PCR primers for specific gene (or bisulfite treated DNA sequence or CpG island); optimized PCR buffers and deoxynucleotides; gel extraction kit; positive control primers; Ms-SNuPE™ primers for the bisulfite converted sequence of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively); reaction buffer (for the Ms-SNuPE reaction); and labelled nucleotides.

Typical reagents (e.g., as might be found in a typical MSP-based kit) for MSP analysis may include, but are not limited to: methylated and unmethylated PCR primers for the bisulfite converted sequence of or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively), optimized PCR buffers and deoxynucleotides, and specific probes.

Moreover, an additional aspect of the present invention is an alternative kit comprising a means for determining methylation of at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively), wherein said means comprise preferably at least one methylation specific restriction enzyme; one or a plurality of primer oligonucleotides (preferably one or a plurality of primer pairs) suitable for the amplification of a sequence comprising at least one CpG dinucleotide of a sequence selected from SEQ ID NOS:128-141, 114-127 and 100-113 (respective genomic, CpG island and amplicons, respectively); and optionally instructions for carrying out and evaluating the described method of methylation analysis. In one embodiment the base sequence of said oligonucleotides are identical, are complementary, or hybridise under stringent or highly stringent conditions to an at least 18 base long segment of a sequence selected from SEQ ID NOS:128-141, 114-127 and 100-113 (respective genomic, CpG island and amplicons, respectively).

In a further embodiment said kit may comprise one or a plurality of oligonucleotide probes for the analysis of the digest fragments, preferably said oligonucleotides are identical, are complementary, or hybridise under stringent or highly stringent conditions to an at least 16 base long segment of a sequence selected from SEQ ID NOS:128-141, 114-127 and 100-113 (respective genomic, CpG island and amplicons, respectively).

In a preferred embodiment the kit may comprise additional reagents selected from the group consisting: buffer (e.g., restriction enzyme, PCR, storage or washing buffers); DNA recovery reagents or kits (e.g., precipitation, ultrafiltration, affinity column) and DNA recovery components.

In a further alternative embodiment, the kit may contain, packaged in separate containers, a polymerase and a reaction buffer optimised for primer extension mediated by the polymerase, such as PCR. In another embodiment of the invention the kit further comprising means for obtaining a biological sample of the patient. In a preferred embodiment the kit comprises: (a) a methylation sensitive restriction enzyme reagent; (b) a container suitable for containing the said reagent and the biological sample of the patient; (c) at least one set of oligonucleotides one or a plurality of nucleic acids or peptide nucleic acids which are identical, are complementary, or hybridise under stringent or highly stringent conditions to an at least 9 base long segment of a sequence selected from SEQ ID NOS:128-141, 114-127 and 100-113 (respective genomic, CpG island and amplicons, respectively); and optionally (d) instructions for use and interpretation of the kit results.

In an alternative preferred embodiment the kit comprises: (a) a methylation sensitive restriction enzyme reagent; (b) a container suitable for containing the said reagent and the biological sample of the patient; (c) at least one set of primer oligonucleotides suitable for the amplification of a sequence comprising at least one CpG dinucleotide of a sequence selected from SEQ ID NOS:128-141, 114-127 and 100-113 (respective genomic, CpG island and amplicons, respectively); and optionally (d) instructions for use and interpretation of the kit results.

In an alternative embodiment the kit comprises: (a) a methylation sensitive restriction enzyme reagent; (b) a container suitable for containing the said reagent and the biological sample of the patient; (c) at least one set of primer oligonucleotides suitable for the amplification of a sequence comprising at least one CpG dinucleotide of a sequence selected from SEQ ID NOS:128-141, 114-127 and 100-113 (respective genomic, CpG island and amplicons, respectively); (d) at least one set of oligonucleotides one or a plurality of nucleic acids or peptide nucleic acids which are identical, are complementary, or hybridise under stringent or highly stringent conditions to an at least 9 base long segment of a sequence selected from SEQ ID NOS:128-141, 114-127 and 100-113 (respective genomic, CpG island and amplicons, respectively) and optionally (e) instructions for use and interpretation of the kit results.

The kit may also contain other components such as buffers or solutions suitable for blocking, washing or coating, packaged in a separate container.

The invention further relates to a kit for use in providing a diagnosis of the presence of a cell proliferative disorder in a subject by means of methylation-sensitive restriction enzyme analysis. Said kit comprises a container and a DNA microarray component. Said DNA microarray component being a surface upon which a plurality of oligonucleotides are immobilized at designated positions and wherein the oligonucleotide comprises at least one CpG methylation site. At least one of said oligonucleotides is specific for the at least one gene or genomic sequence selected from the group consisting of BCL2, BDNF, CACNA1G, CALCA, CRABP1, DLEC1, GATA3, HOXA1, IGF2, KL, NEUROG1, NR3C1, RUNX3, SOCS1 (Table 6); e.g., within SEQ ID NOS:128-141, 114-127 and 100-113 (respective genomic, CpG island and amplicons, respectively) and comprises a sequence of at least 15 base pairs in length but no more than 200 bp of a sequence according to one of SEQ ID NOS:128-141, 114-127 and 100-113 (respective genomic, CpG island and amplicons, respectively). Preferably said sequence is at least 15 base pairs in length but no more than 80 bp of a sequence according to one of SEQ ID NOS:128-141, 114-127 and 100-113 (respective genomic, CpG island and amplicons, respectively). It is further preferred that said sequence is at least 20 base pairs in length but no more than 30 bp of a sequence according to one of SEQ ID NOS:128-141, 114-127 and 100-113 (respective genomic, CpG island and amplicons, respectively).

Said test kit preferably further comprises a restriction enzyme component comprising one or a plurality of methylation-sensitive restriction enzymes.

In a further embodiment said test kit is further characterized in that it comprises at least one methylation-specific restriction enzyme, and wherein the oligonucleotides comprise a restriction site of said at least one methylation specific restriction enzymes.

The kit may further comprise one or several of the following components, which are known in the art for DNA enrichment: a protein component, said protein binding selectively to methylated DNA; a triplex-forming nucleic acid component, one or a plurality of linkers, optionally in a suitable solution; substances or solutions for performing a ligation e.g. ligases, buffers; substances or solutions for performing a column chromatography; substances or solutions for performing an immunology based enrichment (e.g. immunoprecipitation); substances or solutions for performing a nucleic acid amplification e.g. PCR; a dye or several dyes, if applicable with a coupling reagent, if applicable in a solution; substances or solutions for performing a hybridization; and/or substances or solutions for performing a washing step.

The described invention further provides a composition of matter useful for detecting, differentiation and distinguishing between colon cell proliferative disorders. Said composition comprising at least one nucleic acid 18 base pairs in length of a segment of the nucleic acid sequence disclosed in SEQ ID NOS:170-197, 226-253, 142-169 and 198-225, and one or more substances taken from the group comprising: 1-5 mM Magnesium Chloride, 100-500 µM dNTP, 0.5-5 units of taq polymerase, bovine serum albumen, an oligomer in particular an oligonucleotide or peptide nucleic acid (PNA)-oligomer, said oligomer comprising in each case at least one base sequence having a length of at least 9 nucleotides which is complementary to, or hybridizes under moderately stringent or stringent conditions to a pretreated genomic DNA according to one of the SEQ ID NOS:170-197, 226-253, 142-169 and 198-225 and sequences complementary thereto. It is preferred that said composition of matter comprises a buffer solution appropriate for the stabilization of said nucleic acid in an aqueous solution and enabling polymerase based reactions within said solution. Suitable buffers are known in the art and commercially available.

In further preferred embodiments of the invention said at least one nucleic acid is at least 50, 100, 150, 200, 250 or 500 base pairs in length of a segment of the nucleic acid sequence disclosed in SEQ ID NOS:170-197, 226-253, 142-169 and 198-225.

While the present invention has been described with specificity in accordance with certain of its preferred embodiments, the following examples serve only to illustrate the invention and are not intended to limit the invention within the principles and scope of the broadest interpretations and equivalent configurations thereof.

Example 1

Rationale, Samples and Methods for Studies of CpG Island Methylator Phenotype in Human Colorectal Cancer Rationale. As reviewed above, a lack of uniform standards and systematic marker development has created confusion and uncertainty in the field regarding the precise classification of the CpG Island Methylator Phenotype (CIMP).

Unsupervised two-dimensional cluster analysis of DNA methylation data for large numbers of markers and large numbers of tumor samples can be a useful tool to identify such distinct correlated subsets of tumors and markers. Although microarray-based methods for screening CpG island hypermethylation have been developed, most are not limited to Type C loci, and most are not readily applied to large numbers of tumor samples, which is required to obtain stable clusters.

Therefore, to resolve the controversy surrounding the validity of a distinct CpG island methylator phenotype, we explored the DNA methylation behavior of human colorectal tumors using automated real-time PCR-based MethyLight™, which is capable of rapidly assessing the methylation status of more than 100 different CpG islands on more than 100 different tissue samples. Specifically, an initial systematic evaluation of DNA methylation markers was conducted by the present applicants to address the following three issues:

First, and most importantly, a confirmation that CIMP could be recognized as a distinct subgroup of colorectal cancer was needed. Although the CIMP trait is widely accepted in the scientific community, and has been reported as a distinct entity by a very large number of independent laboratories, a recently published influential report suggests that CpG island hypermethylation frequency is a continuous trait in human colorectal cancer, without a clearly defined separate subgroup of tumors with frequent CpG island hypermethylation (38). It was thus of interest to confirm whether this report was due to the inclusion of a large number of CpG islands that do not belong to the CIMP subset, or whether there is indeed little justification for separating out a distinct subset of colorectal cancers. To avoid bias either for or against the existence of CIMP, applicants started a multi-step screen with 195 unique MethyLight™ CpG island hypermethylation assays available in applicants' laboratory, and used both previously characterized CIMP+ and CIMP− tumors to select cancer-specific methylation markers for further evaluation (see below). Furthermore, applicants used a battery of cluster analysis routines to evaluate whether CIMP tumors form a distinct grouping, and used several different gene selection algorithms, including gene filter, logistic regression, classification and regression trees (CART) (140) and gene shaving (141) to choose potential CIMP markers for further consideration (see below).

Second, a CIMP analysis technology platform was needed that could accommodate the difficult requirements of a large-scale study, including i) compatibility with very limited amounts of formalin-fixed, paraffin-embedded tissue (a single 5-µm microscopic slide), ii) robust performance, regardless of DNA quantity and quality (traditional gel-based methylation-specific PCR (MSP) is DNA quality and quantity-dependent), and iii) automatable analysis, to accommodate large numbers of specimens, while minimizing human error, cross contamination, and post-PCR contamination (see below).

Third, if CIMP could be verified, then the question as to whether the existing classification panels of markers were sufficient, or whether better panels could be developed needed to be evaluated. Applicants perceived in advance that the evaluation of classification panels would be particularly problematic without an external gold standard for CIMP classification. Therefore, a cross-panel misclassfication error rate strategy was selected by applicants to best confront this challenge (see below).

These issues needed to be resolved to enable the characterization of CIMP in a large-scale population-based studies.
Materials and Methods Colorectal Cancer Specimens. DNA samples were drawn from the Walter Paulson Tumour Bank, a consecutive series of over 800 colorectal cancer cases collected at the Royal Brisbane and Womens Hospital between 1989 and 2004. Patients gave informed consent in writing to the use of their bowel tissue for research. The study was approved by the Royal Brisbane Hospital Human Research Ethics Committee, the Bancroft Centre Ethics Committee and the USC Institutional Review Board. Tumors were collected at surgery and representative sections for research were removed by a pathologist. DNA was extracted using a modification of the salt precipitation technique of Miller et al.[13]. The first screen (FIG. 1) included five CIMP+ tumors, and five CIMP− tumors, which had been previously assessed for their CIMP status using a panel of four MINT loci (1, 2, 12 and 31) and MLH1, analyzed by combined bisulfite restriction analysis (COBRA) and three Type C genes (p14/ARF, CDKN2A (p16), MGMT), analyzed by gel-based methylation specific PCR (MSP)[14]. CIMP+ tumors were defined as having 80-100% of the markers methylated, while the five CIMP− tumors had an average of only 11% of markers methylated. Other tumor characteristics were obtained by standard techniques. KRAS (K-ras) mutation analysis at codons 12 and 13 was performed using direct automated sequencing of a fragment containing codon 12 and 13 in exon 1 of the KRAS gene, amplified using a touchdown PCR cycle and hotstart protocol. BRAF (B-raf) mutation analysis at codon 600 (V600E; formerly V599E[15]) was performed by a real-time PCR-based allelic discrimination method, as described[16]. Microsatellite instability was determined as described[17]. Eight cases of MSI-H cancer showed features consistent with HNPCC including young age of onset (average 44, range 31-53), family history, lack of MSH2 expression by tumor immunohistochemistry (n=4), and germline mutation of a mismatch repair gene (n=4).

DNA Methylation Analysis Technology. Treatment of genomic DNA with sodium bisulfite, followed by alkaline treatment converts unmethylated cytosines to uracil, while leaving methylated cytosine residues intact was used. Sequence variants at a particular locus can subsequently be analyzed by PCR amplification with primers designed to anneal with bisulfite-converted DNA. The benefit of sodium-bisulfite-based assays is that they require very small amounts of DNA and consequently, are compatible with DNA obtained from microdissected paraffin-embedded tissue samples (8, 145-158). However, until the development of the MethyLight™ assay (6-8, 20, 106), bisulfite-based DNA methylation detection required gel electrophoresis and many of the techniques also employed restriction enzyme digestion, radiolabeled dNTPs, or hybridization probes. These labor-intensive steps limited the use of these methods for high-throughput analyses. More recently, sodium-bisulfite-based microarray platforms have been developed. However, these platforms still require separate PCR amplification of each target locus to hybridize with the chip. With MethyLight™ technology, the methylation analysis is complete, as soon as the PCR reaction is finished. With microarray-based detection, the PCR amplificates need to be subsequently hybridized to the microarray, the hybridization signal needs to be captured, and then interpreted to yield DNA methylation measurements. Therefore, compared to MethyLight™, the current chip-based platforms are neither more cost-effective, nor less labor-intensive. More importantly, however, MethyLight™ is much better suited for the analysis of challenging samples, such as formalin-fixed paraffin-embedded samples with small amounts of highly degraded cross-linked DNA. The average amplicon size for reactions developed in applicants' laboratory is about 80 bp, which is well below the median amplifiable fragment size from formalin-fixed tissues. The MethyLight™ technique has been cross-validated with several other DNA methylation analysis techniques, including COBRA and bisulfite genomic sequencing(6). MethyLight™ is rapidly becoming the method of choice for large-scale automated DNA methylation studies requiring high sensitivity (8, 20, 98, 99, 106, 161-174), and has been adopted by many other laboratories.

Therefore, genomic DNA was treated with sodium bisulfite and subsequently analyzed by MethyLight™ as described[18,19]. A complete list of all MethyLight™ reactions is provided in TABLE 1 (supplemental table 1). MethyLight™ data are reported as a ratio between the value derived from the real-time PCR standard curve plotted as log (quantity) versus threshold C(t) value for the methylation reaction and likewise for a methylation-independent control reaction. However, since such a ratio is dimensionless, can vary from gene to gene, and is affected by many experimental parameters, such as primer and probe batches, it is useful to normalize this ratio to the ratio obtained for a constant reference sample. M.SssI-treated genomic DNA, frozen in aliquots, was used as a constant reference sample to determine this ratio and to derive the standard curve[20]. Thus, the Percent of Methylated Reference ("PMR") can be defined as $100*(METHYLATED\ REACTION/CONTROL\ REACTION)_{sample}/(METHYLATED\ REACTION/CONTROL\ REACTION)_{M.SssI-Reference}$, in which "METHYLATED REACTION" refers to the methylation measurement at a particular locus and "CONTROL REACTION" refers to the methylation-independent measurement using the control reaction[20]. Applicants have developed an improved normalization control reaction based on dispersed Alu repeats[18]. For the data supplied in FIG. 1, COL2A1 was used as a normalization control reaction[21]. For the data in FIG. 2, the mean of PMR values derived with COL2A1 and ALU was used. For the data in FIGS. 3, 4 and 5, PMR values were derived exclusively using the ALU normalization control reaction. This ALU normalization reaction is methylation independent[18], and not the methylation-dependent ALU reactions, which we have also previously described[18]. Applicants currently rely on the ALU normalization reaction, since it is less prone to fluctuations caused by aneuploidy and copy number changes affecting single-copy normalization reactions.

Selection of Type C Markers. Applicants screened all 195 available MethyLight™ markers in the Laird laboratory to identify Type C markers in colorectal cancer. Most of these markers had been developed for other purposes, including studies of esophageal cancer, lung cancer, pancreatic cancer, ovarian cancer, brain cancer and neurodegenerative disorders. Therefore, this starting collection is not likely to be biased with respect to CIMP analysis. Applicants used five CIMP+ tumors, and five CIMP− tumors, which had been previously assessed for their CIMP status as described above. Applicants used three criteria to select Type C markers for further evaluation. First, any marker for which the highest PMR value among these 20 samples was less than 2 was excluded. Second, any marker for which the mean PMR for tumor samples was at least twice that of normal samples was included. Third, any marker for which all normal samples had a PMR<2 and for which all tumor samples had a PMR>2 was included. Both the second and third criteria were applied separately to both the CIMP+ tumors and CIMP− tumors as well as to all ten cases collectively. A marker was included if it passed at least one of the criteria in any of the three sample comparisons (CIMP−, CIMP+, or both). Applicants applied this relatively relaxed, inclusive marker filter primarily to eliminate non-cancer-specifically methylated markers, not to identify top marker candidates. This marker screen resulted in a collection of 92 reactions that passed this first screen for tumor-specificity. Among these 92 reactions were five methylation markers (CDKN2A (p16), MLH1, MINT1, MINT2, and MINT31) that have been commonly used to define CIMP status.

Cluster Analysis. For the hierarchical cluster analysis shown in FIG. 2, applicants grouped the PMR values for each marker into quartiles. Applicants used Manhattan distance and average linkage to perform the clustering[7]. Two distinct clusters were identified. Applicants also performed three other clustering routines (not shown). For the second clustering routine, applicants defined loci with PMR values above 10 as methylated and counted the number of methylated loci for each tumor. The resulting index was clustered using PAM (partitioning around medioids)[7]. The number of clusters was selected by choosing the number that gave the highest average silhouette width. This method selected two clusters. The third method, the Gaussian mixture model[8], was fit using the top nine principal components of the log-transformed data (ln (PMR+1)). These nine principal components explained 78% of the variability in the DNA methylation data. Using the BIC curve to select the number of clusters, applicants selected four. The final method, PAM, was also fit to the log-transformed data. Again two clusters were suggested by the average silhouette width. Using these four different algorithms applicants saw remarkable overlap in subjects that fell into what applicants call our CIMP+ cluster. A subset of six individuals was defined as CIMP+ by all four clustering methods. Another seven individuals are identified as CIMP+ by at least one method. The remaining 35 subjects were classified as CIMP– by all methods. Scaling the data before conducting the principal components analysis, or before clustering with PAM, had little effect on the results.

CIMP Marker Selection. Applicants used the different cluster routines described above to classify tumors as either CIMP+ or CIMP–. This yielded similar but distinct classifications of CIMP+ or CIMP–. Applicants then applied three different marker selection algorithms (gene filter, classification and regression trees (CART)[22], logistic regression) to these classifications to identify those markers that best identify CIMP. For each marker selection algorithm, applicants ranked the importance of each marker for each definition of CIMP and selected the five markers for each algorithm that ranked the highest across all definitions of CIMP. Applicants also applied a fourth marker selection algorithm (gene shaving[23]) designed to select the markers that explain the most variability in the data without knowledge of CIMP status.

For the gene filter approach, applicants ranked the individual markers based on their ability to predict CIMP+ using the Wilcoxon test. Multivariable models to predict CIMP+ were created using CART and logistic regression. For logistic regression, forward stepwise regression to was used to select the five most significant markers for each outcome. CART selected at most two markers before the CIMP+ group was perfectly identified for each of the four gene cluster algorithms. Each of the first three approaches was fit to each of the definitions of CIMP+. The markers were ranked in terms of importance and those achieving the highest rank across all CIMP definitions were selected. For gene shaving, we shaved off 10% of the markers at each step. A total of 36 markers (39%) are identified as explaining the most variability in the tumor samples. From this subset, applicants selected the five markers that explained the most variability in the samples.

The four CIMP marker selection algorithms described above each generated five top CIMP marker candidates. The union of markers from the overlapping sets comprised a panel of 9 CIMP-predicting markers. Although the five most popular traditional CIMP markers (CDKN2A (p16), MINT1, MINT2, MINT31, and MLH1) all participated in the 92-marker cluster routines and marker selection strategies, none of these five markers was selected as one of the top five candidates in any of the marker selection algorithms.

As an added precaution, in addition to the nine CIMP-specific markers selected above, applicants also included the five best Type-C markers among the CIMP-specific markers, selected using a gene filter approach, since the CIMP marker selection strategies described above were driven by a relatively small number of CIMP+ tumors. Inappropriately retained markers would be expected to drop out at subsequent screening steps. Using a PMR of 10 to define positive methylation, applicants found the subset of markers that had no methylation in adjacent normal tissue (N=31 markers, all PMR values <10). In this subset, applicants ranked markers by the number of samples that showed positive methylation (PMR>10) in tumor tissue. Fourteen markers show more frequent methylation in tumor tissue than in normal tissue (all p<0.008). Five of the fourteen markers are markers that have been selected as CIMP-predicting (CRABP1, NR3C1, BCL2, BDNF, CACNA1G). The remaining nine are correlated with the selected markers. Applicants selected the top five Type C markers that were not already selected in a previous panel.

Figure 6:
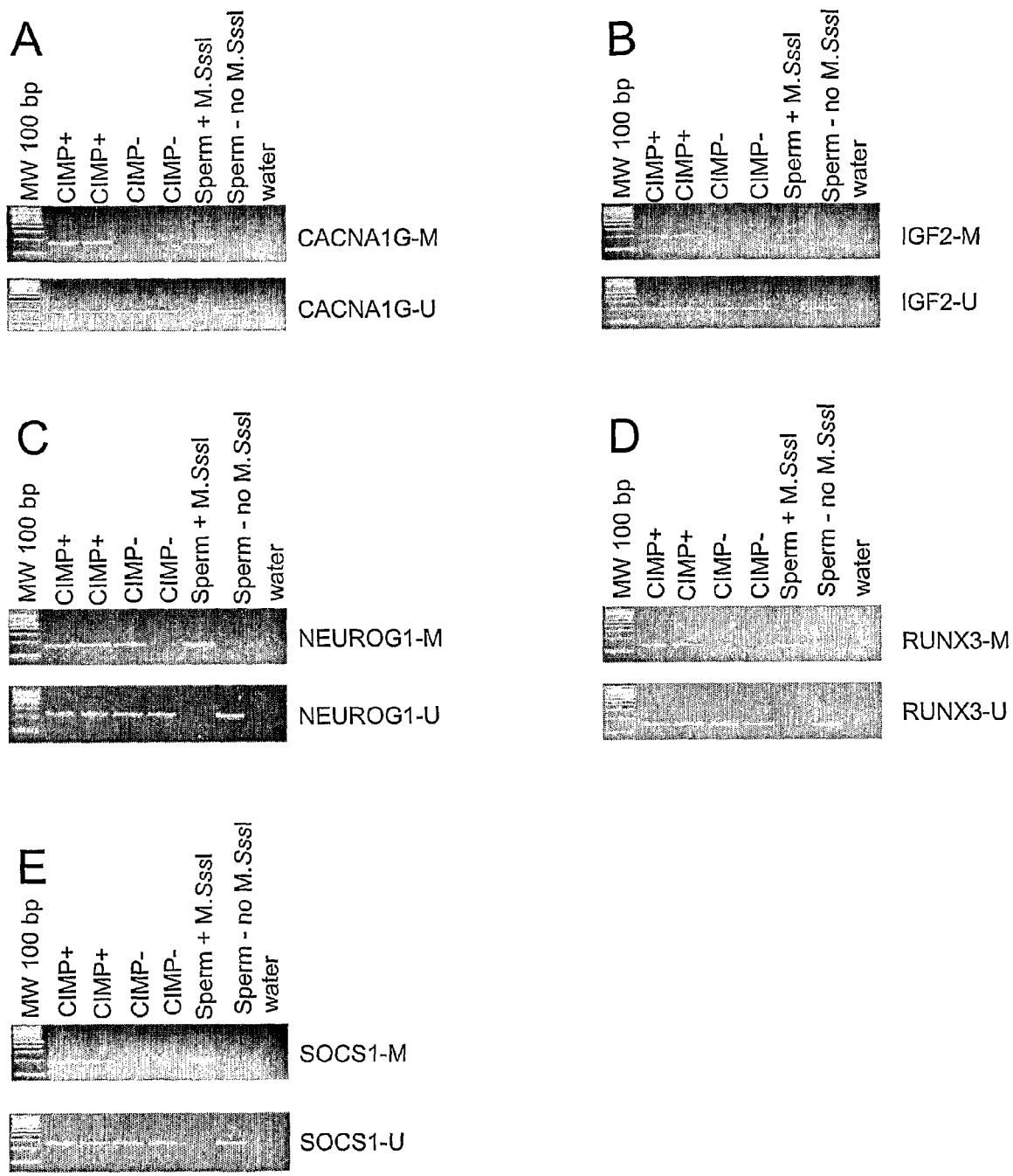
FIG. 6 shows, according to particular aspects, methylation-specific PCR (MSP) of a New CIMP Panel on CIMP+ and CIMP− colon tumor DNA samples. MSP reactions specific for the methylated (M) and the unmethylated (U) bisulfite-converted DNA sequences were designed for each gene in the New CIMP Panel: (A) CACNA1G, (B) IGF2, (C) NEUROG1, (D) RUNX3 and (E) SOCS1. Each MSP reaction was evaluated on two CIMP+ and two CIMP− bisulfite-converted colon tumor DNA samples using AmpliTaq Gold DNA polymerase (Applied Biosystems). Human sperm DNA and human sperm DNA treated in vitro with the M.SssI CpG methylase served as negative and positive methylation controls, respectively, for each MSP reaction. The PCR products were visualized by UV illumination after electrophoresis on 3% agarose gels and ethidium bromide staining. A 100 base pair molecular weight ladder was used to assess the PCR product size. MSP reactions tend to be less specific, but more sensitive than MethyLight reactions, since they lack the additional methylation specificity conferred by the MethyLight probe. This difference may be particularly noticeable for the less specific markers in our panel, such as NEUROG1 (highest percentage of methylated tumors in FIGS. 4 and 5). One CIMP− tumor was methylated for the NEUROG1 marker, consistent with MethyLight™ results obtained for this tumor. The threshold of three methylated markers out of a panel of five markers for the definition of CIMP-positive tumors was developed for the equivalent MethyLight™ reactions. The optimal threshold may differ when using the MSP versions of these markers. The MSP primer and probe sequences are described in the table of MSP primers on page 3.

New CIMP Classification Panel. Applicants dichotomized all PMR values at 10 to simplify panel assembly and to allow for an easier translation of our panels to gel-based MSP[24], which outputs only nominal data (methylated or unmethylated) (FIG. 6). The dichotomization threshold of PMR=10 was chosen as a point sufficiently above background measurements of methylation, using the MethyLight™ technique, possibly reflecting low rates of stochastic hypermethylation, yet well below the much higher PMR values generally obtained for hypermethylation observed for most markers in colorectal tumors. This definition yields 85% specificity in normal mucosa for the CIMP-specific markers identified in the clustering analysis routines. Applicants strove to identify as small a panel as possible that would accurately identify CIMP+ tumors, since this would provide the most cost-effective screening method for CIMP status. Based on the results obtained in FIG. 4, applicants considered a panel of five markers to be sufficient to detect bimodal methylation distribution among tumors, and to thus provide reasonably accurate CIMP classification ability. Applicants subsequently also tested larger panels of ten markers but found very little gain in classification accuracy. To select the best possible five-marker panel from the 14 markers shown in FIG. 3, applicants evaluated all 2,002 possible five-marker panels by measuring a panel's ability to identify CIMP by its bimodal appearance. Statistically, bimodal appearance is measured by the proportion of total variability of our index (0-5 methylated loci) explained by our classification rule (3-5 methylated loci=CIMP+, 0-2 methylated loci=CIMP–). The larger the variance explained, the more bimodal the distribution. The threshold of three or more methylated loci for defining CIMP+ tumors was established by minimizing the within group sum of squared errors. Applicants also considered MethyLight™ reaction performance characteristics of each individual marker. Among the most important reaction characteristics is the real-time PCR threshold cycle (C(t) value) on a standardized sample of fully methylated DNA, which is a measure of reaction sensitivity and efficiency. This measure is of particular importance for the analysis of samples containing borderline quantities of DNA. Applicants also considered the delta C(t) value for methylated, versus unmethylated human genomic reference DNA samples—a measure of methylation specificity for the reaction. As a final criterion, applicants also considered a bimodal distribution of the PMR values for the individual markers—markers with a large fraction of intermediate methylation measurements will more likely cause misclassification than markers that are more bimodal in their distribution of PMR values. One of the criteria that was specifically not considered is the functional consequence of the CpG island hypermethylation event. Applicants hypothesize that CIMP represents an epigenetic control defect and that many of the markers that may best reflect this defect may be of no functional significance to tumorigenesis. The five-marker panel that best satisfied all of the criteria described above and retained a high ranking in their ability to explain the percent of variance by the CIMP definition consisted of CACNA1G, IGF2, NEUROG1, RUNX3, and SOCS1 (TABLE 2 (supplemental table 2)).

TABLE 1

(supplementary table 1); Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| ABCB1 | ABCB1-M1B | HB-051 | MDR1; PGY1/AT P-binding cassette, sub-family B (MOR/TAP), member 1 | Y | N | 7q21.1 | TCGGGTCGGG AGTAGTTATT TG | CGACTATACT CAACCCACGC C | 6FAM-AGGCTATTCC TACCCAACCA ATCAACCTC A-BHQ-1 | Ehrlich, M. et al. Oncogene 21, 6694-6702 (2002) |
| APC | APC-M1B | HB-153 | Adenomatous polyposiscoli | Y | N | 5q21-q22 | GAACCAAAAC GCTCCCCAT | TTATATGTCG GTTACGTGCG TTTATAT | 6FAM-CCCGTCGAAA ACCCGCCGAT TA-BHQ-1 | Eads, C. A. et al. Cancer Res 61, 3410-3418 (2001) |
| APEX1 | APEX1-M1B | HB-090 | APEX nuclease (multifunctional DNA repair enzyme 1) | N | N | 14q11.2-q12 | CGTATTTGTA TCGGTTCGAT GGTA | GCGCATTCTT CGACCACG | 6FAM-CAAACGCGCC TCTAATCACG TAACCAAAT-BHQ-1 | GenBank Number AL355075; Amplicon Location: 64818-64684 |
| APP | APP-M1B | HB-266 | Amyloid beta (A4) precursor protein (protease nexin-II, Alzheimer disease) | N | N | 21q21.2 | AACGAAATGC GGATAAAAAC GTAT | TCGTCCCCGT AAACTTAAAT CATC | 6FAM-CCCGCAAACC TCCCGAAAAT ATCGTATAA A-BHQ-1 | GenBank Number 08767S; Amplicon Location: 8572-8667 |
| ARF/CDKN2A | ARF-M1B | HB-196 | P14 ARF; alternate reading frame of CDKN2A | Y | N | 9p21 | ACGGGCGTTT TCGGTAGTT | CCGAACCTCC AAAATCTCGA | 6FAM-CGACTCTAAA CCCTACGCAC GCGAAA-BHQ-1 | Eads, C. A. et al. Cancer Res 61, 3410-3418 (2001) |
| ARPC1B | ARPC1B-M1B | HB-186 | Actin related protein 2/3 complex, subunit 1B, 41 kDa; ARC41 | N | N | 7q22.1 | TGCGCGGGTA TCGGTAGTAT | ACCTAAAACA ACGATCGCGA AAT | 6FAM-CAAATCCCGC CCTCCCTTCG AAAT-BHQ-1 | GenBank Number AC004922; Amplicon Location: 57135-57206 |
| ATM | ATM-M1B | HB-179 | Ataxia telangiectasia mutated (includes complementation groups A, C and D) | N | N | 11q22-q23 | ACGGAGAAAA GAAGTCGTGG TC | GCGACGATAA CTACAACGCA AAT | 6FAM-CGACTCCTCT CGCCTCCTCC CG-BHQ-1 | GenBank Number U82828; Amplicon Location: 10785-10854 |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| ATR | ATR-M1B | HB-180 | Ataxia telangiectasia and Rad3 related; FRP1; SCKL; SCKL1 | N | N | 3q22-q24 | AGCGGTTTTC GGGAGAGT | GAATCCCGA CGTCTCCAAA | 6FAM-CGACGCCCGA CGAAACCGTA TAA-BHQ-1 | GenBank Number AC134509; Amplicon Location: 59222-59312 |
| AXIN1 | AXIN1-M1B | HB-227 | Axin 1 | N | N | 16p13.3 | CGGTTTTTGT AGTTGTTTCG TGTT | CGACGCGATA ACCGCTTAAA | 6FAM-ATCCGAAACC TCGAACGCGT CTCG-BHQ-1 | GenBank Number AE006463; Amplicon Location: 84738-84807 |
| BCL2 | BCL2-M1B | HB-140 | Bcl-2; B-cell CLL/lymphoma2 | Y | Y | 18q21.3 | TCGTATTTCG GGATTCGGTC | AACTAAACGC AAACCCCGC | 6FAM-ACGACGCCGA AAACAACCGA AATCTACA-BHQ-1 | Widschwendter, M. et al Cancer Res 64, 3807-3813 (2004) |
| BDNF | BDNF-M2B | HB-258 | Brain derived neurotrpohic factor | Y | Y | 11p13 | CGTATCGGGT TGGTTTTTT GTT | CGCCCGCTCG CTATCC | 6FAM-CCGTAACGCC TCGAACTCCC GA-BHQ-1 | GenBank Number AC103796; Amplicon Location: 3794-3866 |
| BRCA1 | BRCA1-M1B | HB-045 | Breast cancer 1, early onset; RNF53; BRCC1 | N | N | 17q21 | GAGAGGTTGT TGTTTAGCGG TAGTT | CGCCCAATCG CAATTTTAAT | 6FAM-CCGCGCTTTT CCGTTACCAC GA-BHQ-1 | Fiegl, H. et al Cancer Epidemiol Biomarkers Prev 13, 882-888 (2004) |
| BRCA2 | BRCA2-M1B | HB-126 | breast cancer 2, early onset | N | N | 13q12.3 | CGTTACGGCG TTACGTGGT | CCGCCTCTAC CGCCTAATTT | 6FAM-CGGCCACAA ACCCGCG-BHQ-1 | GenBank Number AL445212; Amplicon Location: 83637-83703 |
| CACNA1G | CACNA1G-M1B | HB-518 | Calcium channel, voltage-dependent, alpha 1G subunit | Y | Y | 17q22 | TTTTTTCGTT TCGCGTTTAG GT | CTCGAAACGA CTTCGCCG | 6FAM-AAATAACGCC GAATCCGACA ACCGA-BHQ-1 | GenBank Number AC021491; Amplicon Location: 48345-48411 |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| CALCA | CALCA-M1B | HB-166 | Calcitonin/calcitonin-related polypeptide, alpha; CALC1 | Y | Y | 11p15.2-p15.1 | GTTTTGGAAG TATGAGGGTG ACG | TTCCGCCGC TATAAATCG | 6FAM-ATTCCGCCAA TACACAACAA CCAATAAAC G-BHQ-1 | Eads, C. A. et al. Cancer Res 61, 3410-3418 (2001) |
| CCND1 | CCND1-M1B | HB-146 | Cyclin D1 (PRAD1: parathyroid adenomatosis 1); BCL1; D11S287E | N | N | 11q13 | GGTAATTTCG TCGTAGGGTA GGC | GAACGCCAAA CGCCCGA | 6FAM-ACCCAAAAAC CATCCCTAAA ACGCCG-BHQ-1 | GenBank Number AF511593; Amplicon Location: 1211-1293 |
| CCND2 | CCND2-M1B | HB-040 | Cyclin D2 | Y | N | 12p13 | GGAGGGTCGG CGAGGAT | TCCTTTCCCC GAAAACATAA AA | 6FAM-CACGCTCGAT CCTTCGCCC G-BHQ-1 | Ehrlich, M. et al. Oncogene 21, 6694-6702 (2002) |
| CDH1 | CDH1-M2B | HB-050 | E-cadherin (epithelial)/Cadherin 1, type 1 | N | N | 16q.22.1 | AGGGTTATCG CGTTTATGCG | TTCACTTACC GACCACAACC A | 6FAM-ACTAACGACC CGCCACCCG A-BHQ-1 | GenBank Number AC099314; Amplicon Location: 80648-80743 |
| CDH13 | CDH13-M1B | HB-075 | H-Cadherin/Cadherin 13, H-cadherin (heart)/T-cadherin; CDHH | Y | N | 16q24.2-q24.3 | AATTTCGTTC GTTTTGTGCG T | CTACCCGTAC CGAACGATCC | 6FAM-AACGCAAAAC GCGCCCGAC A-BHQ-1 | Fiegl, H. et al Cancer Epidemiol Biomarkers Prev 13, 882-888 (2004) |
| CDK2AP1 | CDK2AP1-M1B | HB-226 | CDK2-associated protein 1; DOC-1 (Deleted in oral cancer); DORC1; ST19 | N | N | 12p14.1 | CGCGGAAAGT TTGCGGT | CGACTTTTT ATTATCGACG ACTC | 6FAM-CGACAAATAT AACCGTCCGC GCCCTA-BHQ-1 | GenBank Number AC068768; Amplicon Location: 51406-51526 |
| CDKN1A | CDKN1A-M1B | HB-230 | Cyclin-dependent kinase inhibitor 1A; p21; Cip1p21; CIP1; SDI1; WAF1; CAAP20; CDKN1 | N | N | 6p21.2 | CGCGTTCGGT TTGCGTAT | TTATAATCCC GCTCTCCGCC | 6FAM-AAATCTCCGA CACATCCCGA CTCTCGT-BHQ-1 | GenBank Number Z85996; Amplicon Location: 3463-3554 |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| CDKN1C | CDKN1C-M2B | HB-329 | Cyclin-dependent kinase inhibitor 1C (p57, Kip2)/ BWS; WBS; BWCR; KIP2 | Y | N | 11p15.5 | TCGAGTAGGG CGCGAATTAG | GTCCCGAAAT CCCCGAAT | 6FAM-AACTAATCAA CGAAAAACTC CTAACCGCGC T-BHQ-1 | GenBank Number A0013791; Amplicon Location: 57564-57638 |
| CDKN2A | CDKN2A-M2B | HB-081 | p16/Cyclin-dependent kinase inhibitor 2A; CDKN2; CDK4I; p16; INK4a; MTS1; CMM2 | Y | Y | 9p21 | TGGAGTTTTC GGTTGATTGG TT | AACAACGCCC GCACCTCCT | 6FAM-ACCCGACCCC GAACCGCG-BHQ-1 | Eads, C. A. et al. Cancer Res 61, 3410-3418 (2001) |
| CDKN2B | CDKN2B-M1B | HB-173 | p15/Cyclin-dependent kinase inhibitor 2B; P15; MTS2; INK4B | N | N | 9p21 | AGGAGGAGA GAGTGCGTCG | CGAATAATCC ACCGTTAACC G | 6FAM-TTAACGACAC TCTTCCCTTC TTTCCCACG-BHQ-1 | Eads, C. A. et al. Cancer Res 61, 3410-3418 (2001) |
| CDX1 | CDX1-M1B | HB-195 | Caudal type homeo box transcription factor | N | N | 5q31-q33 | TGAGCGGTTG TTCGTCGTC | AAATCCCCCG CGCATACTA | 6FAM-CCTAAAACCG CCGCTACCG ACCG-BHQ-1 | GenBank Number A0005895; Amplicon Location: 35199-35266 |
| CGA | CGA1-M1B | HB-237 | Glycoprotein hormones, alpha polypeptide; GPHa; GPHA1 | N | N | 6q12-q21 | GGGTTTTTG TAGGATGTGT TTAGG | AACTACAATT ACTAAAAACT CATAAAAACGA AACT | 6FAM-TCCCTCTTCG AATCCACAAT CAACCG-BHQ-1 | GenBank Number AL138827; Amplicon Location: 56007-56096 |
| CHFR | CHFR-M1B | HB-190 | Checkpoint with forkhead and ring domains; FLJ10796 | Y | N | 12q24.33 | CGGGAGTTTT TATGGGCGT | AACCGTCCCC AAAACTACGA C | 6FAM-CCTCGACCCG CTCCATCGAA ATTCA-BHQ-1 | GenBank Number AC127070; Amplicon Location: 62442-62545 |
| CLDN1 | CLDN1-M1B | HB-059 | Claudin-1 | N | N | 3q28-q29 | CGGTGAGTCG TTTTGAAATC G | ACGCAAAACC GCTAAACGC | 6FAM-GATTTAAAAC AACTCCCGCC GCCTCA-BHQ-1 | GenBank Number A0009520; Amplicon Location: 27434-27530 |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| CLIC4 | CLIC4-M1B | HB-062 | Chloride intracellular channel 4 | N | N | 1p36.11 | GGCGGTGTTG AGGAGTTGA | CCGATTCCCG CCGTACTAC | 6FAM-CGCTAAACTA TCCGAAATCG AACTAACCAC G-BHQ-1 | GenBank Number AL117424; Amplicon Location: 47-119 |
| COL1A2 | COL1A2-M1B | HB-193 | Collagen, type I, alpha 2; OI4 | Y | N | 7q22.1 | CGGTAGTAGG AGGTTTCGGT TAAGT | CCTAAATCAC CGACGAAAAT ATCA | 6FAM-CGAACGCCAA CATACAATCG TAACCAATAC CT-BHQ-1 | GenBank Number AF004877; Amplicon Location: 2302-2390 |
| CRABP1 | CRABP1-M1B | HB-197 | Cellular retinoic acid binding protein 1; RBP5; CRABP; CRABPI; CRABP-I | Y | Y | 15q24 | TCGAAATTTT CGTTGTTGCG T | TATCCGTACC TACCGCCGC | 6FAM-ACCATACCCAA CTTCGCCGACA CCTAA-BHQ-1 | GenBank Number A0011270; Location: 122142-122223 |
| CTNNB1 | CTNNB1-M1B | HB-170 | Catenin (cadherin-associated protein), beta 1, 88 kDa; CTNNB | N | N | 3p22-21.3 | GGAAAGGCGC GTCGAGT | TCCCCTATCC CAAACCCG | 6FAM-CGGCGTTTC CCGAACCG-BHQ-1 | Eads, C. A. et al. Cancer Res 61, 3410-3418 (2001) |
| CTSD | CTSD-M1B | HB-147 | Cathepsin D (lysosomal aspartyl protease); CPSD | N | N | 11p15.5 | TACGTTTCGC GTAGGTTTGG A | TCGTAAAACG ACCCACCCTA A | 6FAM-CCTATCCCGA CCGCCGGA-BHQ-1 | GenBank Number AC068580; Amplicon Location: 43076-43166 |
| CXADR | CXADR-M1B | HB-054 | Coxsackie virus and adenovirus receptor; CAR | N | N | 21q11.2 | TACGCGGTTG GAGAAGTCG | ATAAACTCGC GTCACTTCGA | 6FAM-AACGACCCGA ACCGACTAC GAACG-BHQ-1 | Ehrlich, M. et al. Oncogene 21, 6694-6702 (2002) |
| CYP1B1 | CYP1B1-M1B | HB-078 | Cytochrome P450, family 1, subfamily B, polypeptide 1; GLC3A; CP1B | Y | N | 2p21 | GTGCGTTTGG ACGGGAGTT | AACGGACCT AACAAAACGA A | 6FAM-CGCCGCACAC CAAACCGCT T-BHQ-1 | Fiegl, H. et al Cancer Epidemiol Biomarkers Prev 13, 882-888 (2004) |

TABLE 1-continued (supplementary table 1); Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| CYP27B1 | CYB27B1-M1B | HB-223 | Cytochrome P450, family 27, subfamily B, polypeptide 1; CYP1; VDD1; PDDR | Y | N | 12q14.1 | GGGATAGTTAGAGAGAACGGATGTTT | CCGAATATAACCACACCGCC | 6FAM-CCAACCTCAACTCGCCTTTCCTTATTTCA-BHQ-1 | GenBank Number AY288916; Amplicon Location: 1728-1805 |
| DAPK1 | DAPK1-M1B | HB-046 | Death-associated protein kinase 1 | N | N | 9q34.1 | TCGTCGTCGTTTCGGTTAGTT | TCCCTCCGAAACGCTATCG | 6FAM-CGACCATAAACGCCAACGCCG-BHQ-1 | Muller, H.M. et al. Cancer Lett209, 231-236 (2004) |
| DCC | DCC-M1B | HB-178 | Deleted in colorectal carcinomas | Y | N | 18q21.3 | GGGTTCGGCGCGTGT | CGAAAAATACAAAAACCAACTTAAATACC | 6FAM-ACCAAAAATCGCAACGAACGACAACACT-BHQ-1 | GenBank Number AC011155; Amplicon Location: 118286-118444 |
| DCLRE1C | DCLRE1C-M1B | HB-133 | ARTEMIS/hypothetical protein FLJ11360; artemis protein; DNA cross-link repair 1C (PSO2 homolog, S. cerevisiae); SNM1C; A-SCID | N | N | 10p13 | CGAAGCGCGGGTGATTTA | AAAATCCGAAAACCGAAAACAA | 6FAM-ATCCGATCGAATTCTAAACGCCCGCTACT-BHQ-1 | GenBank Number AL360083; Amplicon Location: 54518-54603 |
| DDB1 | DDB1-M1B | HB-116 | Damage-specific DNA binding protein 1, 127 kDa | N | N | 11q12-q13 | GGGCGGAGGTAGCGGT | CCCGTCGAAACTCGAACG | 6FAM-CCAACAACGCGCAACGAACTCCA-BHQ-1 | GenBank Number AC090584; Amplicon Location: 203224-203324 |
| DIRAS3 | DIRAS3-M1b | HB-043 | Ras homolog gene family, memeber I/NOEY2; DIRAS family; GTP-binding RAS-like 3; ARHI | N | N | 1p31 | GCGTAAGCGGAATTTATGTTGT | CCGGCGATTTTATATTCCGACTT | 6FAM-CGACAAAAACGACAAATACGAAACGCAAA-BHQ-1 | Previously described as ARHI in Fiegl, H. et al Cancer Epidemiol Biomarkers Prev 13, 882-888 (2004) |
| DLC1 | DLC1-M1B | HB-218 | Deleted in liver cancer 1; HP; ARHGAP7; STARD12; FLJ21120; DLC-1; p122-RhoGAP | Y | N | 8p22-p21.3 | AGTAAGGATGCGTTGAGGATCG | ACGACTCGACTTCCGCGTC | 6FAM-AACCCACGACGACACCCGAAACG-BHQ-1 | GenBank Number AC015641; Amplicon Location: 115709-115784 |

TABLE 1-continued (supplementary table 1); Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| DLEC1 | DLEC-M1B | HB-225 | Deleted in lung and esophageal cancer 1 | Y | Y | 3p22-p21.3 | TCGTTGCGTA TTTAAGATAT TTCGTATT | CGTAACGCTC ATTCTCGCTA CC | 6FAM-TAATCAAACT TACGCTCACT TCGTCGCCG-BHQ-1 | GenBank Number AP006309; Amplicon Location: 19959-20088 |
| DNAJC15 | DNAJC15-M1B | HB-048 | DnaJ (Hsp40) homolog, subfamily C, member 15; DNAJD1; MCJ | N | N | 13q13 | TTTCGGGTCG TTTTGTTATG G | ACTACAAATA CTCAACGTAA CGCAAACT | 6FAM-TCGCCAACTA AAACGATAAC ACCAGAAC A-BHQ-1 | Previously described as MCJ in Ehrlich, M. et al. Oncogene 21, 6694-6702 (2002) |
| DPH1 | DPH1-M1B | HB-049 | Dipthamide Biosynthesis Protein 2, S. crevisiae, Homolog-Like 1; Candidate tumor suppressor in ovarian cancer 2 (OVCA2); DHP2L1; DPH2L | N | N | 17p13.3 | ACGCGAGAGAG CGTAGATATT G | CCGCCCAACG GAATATCCC | 6FAM-CCCGCTAACC GATCGACGAT CGA-BHQ-1 | GenBank Number AC090617; Amplicon Location: 196988-197057 |
| DRD1 | DRD1-M1B | HB-252 | Dopamine receptor D1 | Y | N | 5q35.1 | GGCGCGCGTT GGTTC | TACCCGTAAA ACGCCTATAC TCACC | 6FAM-CTCGCAAAAA AAACGCGAC GCAACTA-BHQ-1 | GenBank Number AC091393; Amplicon Location: 111358-111429 |
| DRD2 | DRD2-M1B | HB-253 | Dopamine receptor D2 | Y | N | 11q23 | GAAGTCGGAA ATTTTGGTCG C | ATCTCGAAAA AACACTTCCC CC | 6FAM-ACACCCAAAC GCGAAACCCG AAACT-BHQ-1 | GenBank Number AP002840; Amplicon Location: 110939-111008 |
| EBF3 | EBF3-M1B | HB-229 | COE3; Early B-cell factor 3; DKFZp667B0210 | Y | N | 10q26 | GTAGGATATT GCGGGATCGT TC | GCAACACTCA CTACCCCGTT TAT | 6FAM-TCTTTAAAAC AAACGAACCG CGCCAA-BHQ-1 | GenBank Number AL354950; Amplicon Location: 144175-144252 |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| EPM2AIP1 | EPM2AIP1-M1B | HB-152 | EPM2A (laforin) interacting protein 1; KIAA0766; FLJ11207 | Y | N | 3p21.3 | CGTTATATAT CGTTCGTAGT ATTCGTGTTT | CTATCGCCG CCTCATCGT | 6FAM-CCGGACGTCA AACGCCACTA CG-BHQ-1 | Eads, C. A. et al. Cancer Res 61, 3410-3418 (2001) |
| ERBB2 | ERBB2-M1B | HB-233 | Epidermal growth factor receptor (erythroblastic leukemia viral (v-erb-b) oncogene homolog, avian); NGL; HER-2; NEU | N | N | 17q21.1 | AGTGTGAGAA CGGTTGTAG GTAATTTAG | CCCTCTCTTC GCGCAAAC | 6FAM-AAATACGTCC GTCCTAACGC CGAAACG-BHQ-1 | GenBank Number AC079199; Amplicon Location: 44277-44352 |
| ERCC1 | ERCC1-M1B | HB-110 | Excision repair cross-complementing rodent repair deficiency, complementation group 1 (includes overlapping antisense sequence) | Y | N | 19q13.2-q13.3 | GGGCGAGTCG AAGGTGG | CTCCGAAAAC TCCATAACGT CAA | 6FAM-CCCAACGCTA AAAACTCTAT AACGCCACG-BHQ-1 | GenBank Number M63796; Amplicon Location: 22178-22088 |
| ERCC2 | ERCC2-M1B | HB-105 | Excision repair cross-complementing rodent repair deficiency, complementation group 2 (xeroderma pigmentosum D; XPD) | N | N | 19qq13.3 | CGAGTTTTCG AGGATGTTTA CGA | CCGACCGAAC CTATACAACG AAAT | 6FAM-ACCCGCCTC CCTCATAAAT ATTCAACGA A-BHQ-1 | GenBank Number AC092309; Amplicon Location: 4166-4250 |
| ERCC4 | ERCC4-M1B | HB-111 | Excision repair cross-complementing rodent repair deficiency, complementation group 4; RAD1; XPF | N | N | 16p13.3-p13.11 | TCGACCGATT GTTATGGCG | CCGTCAATAT CGAACAATTC CA | 6FAM-CACCAACTAT CGCTCGTACT CCAACACG-BHQ-1 | GenBank Number L76568; Amplicon Location: 2113-2184 |
| ERCC5 | ERCC5-M1B | HB-109 | Excision repair cross-complementing rodent repair deficiency, complementation group 5 (xeroderma pigmentosum, complementation | N | N | 13q22 | TAAGCGTAGA AAATATACGT TATGTGCG | CCCGCTCGAT TTCCGTCT | 6FAM-CGACGCCAA AACGAAAACT CCG-BHQ-1 | GenBank Number AL157769; Amplicon Location: 130480-130556 |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| | | | group G (Cockayne syndrome)); ERCM2; XPGC | | | | | | | |
| ERCC6 | ERCC6-M1B | HB-114 | Excision repair cross-complementing rodent repair deficiency, complementation group 6 (PGBD3); CKN2; CSB; RAD26 | N | | 10q11 | ACGTAAGTAG AAAGGCGTTG TTGAG | CGACTCCGAC TTCTACTAAT ACGAAA | 6FAM-CCCGTAACGC ATACGCCTAA CTCAACG-BHQ-1 | GenBank Number AC073366; Amplicon Location: 164190-164315 |
| ERCC8 | ERCC8-M1B | HB-113 | Excision repair cross-complementing rodent repair deficiency, complementation group 8 (ERCC8); Cockayne syndrome 1 (classical), CKN1; CSA | N | | 5q12.1 | GGTTAAGGCG TTTAGAGTCG GG | TCATACGACA CTTAAAATAT CACCGAAA | 6FAM-CCCTTCACTC TAACATCGAA ACCCTACCC G-BHQ-1 | GenBank Number AC073546; Amplicon Location: 21088-21200 |
| ESR1 | ESR1-M1B | HB-164 | Estrogen Receptor Alpha; NR3A1; Era | Y | | 6q25.1 | GGCGTTCGTT TTGGGATTG | GCCGACACGC GAACTCTAA | 6FAM-CGATAAAACC GAACGACCCG ACGA-BHQ-1 | Eads, C. A. et al. Cancer Res 60, 5021-5026 (2000) |
| ESR2 | ESR2-M1B | HB-165 | Estrogen receptor 2 (ER beta); MR3A2; Erb | Y | | 14q | TTTGAAATTT GTAGGGCGAA GAGTAG | ACCCGTCGCA ACTCGAATAA | 6FAM-CCACCCAACG CTCGCCG-BHQ-1 | Fiegl, H. et al Cancer Epidemiol Biomarkers Prev 13, 882-888 (2004) |
| FAF1 | FAF1-M1B | HB-304 | Fas (TNFRSF6) associated factor 1; CGI-03; hFAF1 | N | | 1p33 | CGTTTTGCGG TTTTACGTGA | CAACGCAAAA ATCCTAACCG AA | 6FAM-CGCGGCGCTCA ACGCTTAACA AAAAATA-BHQ-1 | GenBank Number AL359977; Amplicon Location: 63234-63308 |
| FBXW7 | FBXW7-M1B | HB-151 | F-box and WD-40 domain protein 7 (archipelago) | N | | 4q31.23 | TGTCGTTGCG GTTGGGAT | CGAAATAAA TAACTACTCC GCGATAA | 6FAM-ACGCCAAAAC TTCTACCTCG | GenBank Number AC023424; Amplicon |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| | | | homolog, Drosophila); AGO; FLJ11071; SEL10; FBW7; CDC4; FBXW6 | | | | | | TCCCGTAA-BHQ-1 | Location: 113422-113545 |
| FHIT | FHIT-M2B | HB-041 | Fragile Histidine Triad; FRA3B; AP3Aase | Y | N | 3p14.2 | GGCGCGGGTT TGGG | CGCCCCGTAA ACGACG | 6FAM-CACTAAACTC GAAATAATA ACCTAACGCG CG-BHQ-1 | GenBank Number AC097357; Amplicon Location: 121650-121724 |
| GABRA2 | GABRA2-M1B | HB-254 | Gamma-aminobutyric acid A, receptor, alpha 2 | Y | N | 4p12 | TCGTCGGAGG AGCGGA | AACCTCTCGA AAACCCCAAC A | 6FAM-ACGACTTCGA AAAACAACCC GAAACTACG-BHQ-1 | GenBank Number AC095060; Amplicon Location: 42382-42455 |
| GAD1 | GAD1-M2B | HB-256 | Glutamine decarboxylase 1 (67 kda) | Y | N | 2q31 | CGATTGGTTC GGCGTAGAAA | CCCTCCGATA TACAAAACCC C | 6FAM-CCCGCACAAC TCTCGCTTCT CTTTACAA-BHQ-1 | GenBank Number AC007405; Amplicon Location: 70850-70932 |
| GATA3 | GATA3-M1B | HB-327 | GATA binding protein 3/HDR; MGC5445 | Y | Y | 10p15 | TGTATCGGGA CGGAATCGTT | ACGCGCGCTC TAACCCTT | 6FAM-AAATATAACC GCGACTCCTA CCAATTCATT CG-BHQ | GenBank Number AL390294; Amplicon Location: 51880-51959 |
| GATA4 | GATA4-M1B | HB-323 | GATA binding protein 4 | Y | N | 8p23.1-8p22 | GATGGTGGTC GCGTGAAGTT A | TTCCCTCCAT ATACGAACTA CCG | 6FAM-CCTATCCCGA ATCCGTCAAT CCCG-BHQ-1 | GenBank Number AC069185; Amplicon Location: 28557-28630 |
| GATA5 | GATA5-M1B | HB-326 | GATA binding protein 5; bB379O24.1 | Y | N | 20q13.33 | AGTTACGTGA TTTTGGTAGG TTTTGTT | TAATCCGAAC TCCGCGCTA | 6FAM-CCCGTATCGT ACGTCCTTAT CGCCAAA-BHQ | GenBank Number AL499627; Amplicon Location: 19744-19828 |

TABLE 1-continued (supplementary table 1); Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| GDNF | GDNF-M1B | HB-221 | Glial cell derived neurotrophic factor | Y | N | 5p13.1-p12 | CGGTAGTTGT CGTTGAGTCG TTC | AACAACCGCC GCTACTTTAA ATA | 6FAM-CCGCGGTCGC GCTCTTAACT AAAA-BHQ-1 | GenBank Number AC008869; Amplicon Location: 108758-108866 |
| GRIN2B | GRIN2B-M1B | HB-250 | Glutamate receptor, ionotrophic, N-methyl-D-aspartate 2B (NR3); NMDAR2B | Y | N | 12p12 | GTCGGATTTA CGCGTCGAGT | CTACCGCCGC GCTAAAATAC | 6FAM-ACCCACGAAA CTTCACCTAC AACGTATCG-BHQ-1 | GenBank Number AC007916; Amplicon Location: 111645-111727 |
| GSTP1 | GSTP1-M1B | HB-172 | Glutathione-S transferase pi1; FAEES; GST3 | Y | N | 11q13 | GTCGGCGTCG TGATTTAGTA TTG | AAACTACGAC GACGAAACTC CAA | 6FAM-AAACCTCGCG ACCTCCGAAC CTTATAAAA-BHQ-1 | Eads, C. A. et al. Cancer Res 61, 3410-3418 (2001) |
| HIC1 | HIC1-M1B | HB-168 | Hypermethylated in cancer 1; ZBTB29 | Y | N | 17p13.3 | GTTAGCGCGGT TAGGGCGTC | CCGAACGCCT CCATCGTAT | 6FAM-CAACATCGTC TACCCAACAC ACTCTCCTAC G-BHQ-1 | Eads, C. A. et al. Cancer Res 61, 3410-3418 (2001) |
| HLA-G | HLA-G-M1B | HB-215 | HLA-G histocompatibility antigen, class I, G | N | N | 6p21.3 | CACCCCCATA TACGCGCTAA | GGTCGTTACG TTTCGGGTAG TTTA | 6FAM-CGGCGCTCACA CGCTCAAAAA CCT-BHQ-1 | Muller, H. M. et al Ann NY Acad Sci 1022, 44-49 (2004) |
| HOXA1 | HOXA1-M2B | HB-268 | Homeo box A1; HOX1F | Y | Y | 7p15 | TTGTTTATTA GGAAGCGGTC GTC | TCGAACCATA AAATTACAAC TTTCCA | 6FAM-TCGTACGCGA TCAAGCCAA CAATTA-BHQ-1 | GenBank Number AC004079; Amplicon Location: 78138-78220 |
| HOXA10 | HOXA10-M1B | HB-270 | Homeo box A10; HOX1H | N | N | 7p15-p14 | TGTATTGATG GGTTAGGAGA CGTATT | CCCACCAACC CACGTTAAAA CA | 6FAM-CAACTCCCGA CCTTCGAACC AAAATATCG-BHQ-1 | GenBank Number AC004080; Amplicon Location: 47850-47933 |

TABLE 1-continued (supplementary table 1); Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence$^a$ | Source |
|---|---|---|---|---|---|---|---|---|---|---|
| HOXA11 | HOXA11-M1B | HB-270 | Homeo box A11; HOX1I | N | N | 7p15-p14 | TTTTGTTTTC GATTTTAGTC GGAAT | TAATCAAATC ACCGTACAAA TCGAAC | 6FAM-ACCACCAAAC AACACCATCC ACGACTTCA-BHQ-1 | GenBank Number AC004080; Amplicon Location: 59150-59249 |
| HRAS | HRAS-M1B | HB-144 | V-Ha-ras Harvey rat sarcoma viral oncogene homolog; HRAS1 | N | N | 11p15.5 | GAGGCGATGAC GGAATATAAG TTGG | CGTCCACAAA ATAATTCTAA ATCAACTAA | 6FAM-CACTCTTACC CACACCGCCG ACG-BHQ-1 | Widschwendter, M. et al Cancer Res 64, 3807-3813 (2004) |
| HSD17B4 | HSD17B4-M1B | HB-066 | 17beta-hydroxysteroid dehydrogenase IV | N | N | 5q21 | TATCGTTGAG GTTCGACGGG | TCCAACCTTC GCATACTCAC C | 6FAM-CCCGCGCCGA TAACCAATAC CA-BHQ-1 | Muller, H. M. et al. Cancer Lett 209, 231-236 (2004) |
| ICAM1 | ICAM1B-M1B | HB-076 | Intercellular adhesion molecule 1 (CD54), human rhinovirus receptor; BB2; CD54 | N | N | 19p13.3-p13.2 | GGTTAGCGAG GGAGGATGAT T | TCCCCTCCGA AACAAATACT ACAA | 6FAM-TTCCGAACTA ACAAAATACC CGAACCGAA A-BHQ-1 | Ehrlich, M. et al. Oncogene 21, 6694-6702 (2002) |
| IFNG | IFNG-M1M | HB-313 | Interferon Gamma | N | N | 12q14 | TGAAGAGTTA ATATTTTATT AGGGCGAA | TTCCTTTAAA CTCCTTTAAA TCCTTTAACG | 6FAM-ACAAACCCAT TATACCCACC TA-MGBNFQ | GenBank Number AF375790; Amplicon Location: 1245-1407 |
| IGF2 | IGF2-M2B | HB-319 | IGF2: Insulin-like growth factor 2 (somatomedin A) | Y | N | 11p15.5 | GAGCGGTTTC GGTGTCGTTA | CCAACTCGAT TTAACCGAC G | 6FAM-CCCTCTACCG TCGCGAACCC GA-BHQ-1 | GenBank Number AC132217; Amplicon Location: 108633-108720 |
| IGSF4 | IGSF4-M1B | HB-069 | Immunoglobulin superfamily, member 4; TSLC1; NECL2; ST17; BL2; SYNCAM; IGSF4A | Y | N | 11q23.2 | GGGTTTCGGA GGTAGTTAAC GTC | CACTAAAATC CGCTCGACAA CAC | 6FAM-ACACTCGCCA TATCGAACAC CTACCTCAA A-BHQ-1 | Widschwendter, M. et al Cancer Res 64, 4472-4480 (2004) |
| ITGA4 | ITGA4-M1B | HB-321 | integrin, alpha 4 (antigen CD49D, alpha 4 subunit of VLA-4 receptor); CD49D | Y | N | 2q31-q32 | TGCGGAGGCG TAGGGTC | CAACCGAAAT TCCCCAACG | 6FAM-CCTACACCG CGGTAAACA AAAACG-BHQ-1 | GenBank Number AC020595; Amplicon Location: 146566-146639 |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| JUP | JUP-M1B | HB-203 | Junction Plakoglobin; CTNNG; PDGB; PKGB; DPIII | Y | N | 17q21 | GGATAGCGAA TTGAGTTCGG C | CTCTTCGCCT TTTATTCGAT TACTAAAT | 6FAM-AACAACCGCC GCCCGACCA-BHQ-1 | GenBank Number AC109319; Amplicon Location: 81609-81699 |
| KL | KL-M1B | HB-175 | human Klotho gene | Y | Y | 13q12 | AGTTTCGTTT TCGCGTAGTA TGTTC | CGCCCGACTC CGCAC | 6FAM-CGAACGACGC GACGAAACGC T-BHQ-1 | GenBank Number AB009667; Amplicon Location: 2062-2189 |
| LDLR | LDLR-M1B | HB-219 | Low density lipoprotein receptor (familial hypercholesterolemia) | N | N | 19p13.3 | GATATCGGTT TTTTAATTCG TGAAGTT | TTCACCGAAA ACCCAAATAC AA | 6FAM-ATCAAAATCGC CTACCCTAAC GACACTTTC G-BHQ-1 | GenBank Number AC011485; Amplicon Location: 90572-90674 |
| LIG3 | LIG3-M1B | HB-091 | ligase III, DNA, ATP-dependent | N | N | 17q11.2-q12 | GTCGCGGGTA GTTTACGACG | CGACCTTAAC TCTTACGCCT ACG | 6FAM-CGCTACCTCC CGCTCTAAAA CCCGA-BHQ-1 | GenBank Number AC022903; Amplicon Location: 14538-14629 |
| LPHN2 | LPHN2-M1B | HB-202 | Latrophilin 2; LEC1; LPHH1; KIAA0786 | Y | N | 1p31.1 | GAGGATTAG CGCGTAGTGA GTG | AATCCCGAA CTCTACCTCC A | 6FAM-CCCATTAACA CACCCATTCA ACCGCTAA-BHQ-1 | GenBank Number AL358939; Amplicon Location: 143237-143336 |
| LZTS1 | LZTS1-M1B | HB-200 | Leucine zipper, putative tumor suppressor 1 F37; FEZ1 | N | N | 8p22 | GCGGGCTTGT AGGGACG | CGCGCGCTAA CTCTTCTACG | 6FAM-ATTACCGCCT TTAAACTCCG AACCCTCCA-BHQ-1 | GenBank Number AC025853; Amplicon Location: 24463-24547 |
| MBD2 | MBD2-M1B | HB-142 | Methyl-CpG binding domain protein 2 | N | N | 18q21 | AGGCGAGAT AAGATGGTCG T | CCCTCCTACC CGAAACGTAA C | 6FAM-CGACCACCGC CTCTTTAAAT CCTCCAAA-BHQ-1 | GenBank Number AC093462; Amplicon Location: 143589-143667 |
| MBD4 | MBD4-M1B | HB-083 | Methyl-CpG binding domain protein 2 | N | N | 3q21-q22 | TCGTGTTTAT CGAGTAGGGT | TCGATTACAA CCCGATACCG | 6FAM-CACACCCTAA | GenBank Number AF449212; |

TABLE 1-continued (supplementary table 1); Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| | | | | | | | TCG | TAA | ACGTTACGAC GCTAAACTC G-BHQ-1 | Amplicon Location: 59852-59967 |
| MGMT | MGMT1-M2B | HB-160 | O-6-methylguanine-DNA methyltransferase | Y | N | 10q26 | GCGTTTCGAC GTTCGTAGGT | CACTCTTCCG AAAACGAAAC ACG | 6FAM-CCGAAACGAT ACGCACCGCG A-BHQ-1 | Virmani, A. K. et al. Cancer Epidemiol Biomarkers Prev11, 291-297 (2002) |
| MINT1 | MINT1-M1B | HB-161 | Colon cancer diferentially methylated CpG island genomic sequence; PROTEIN 2C (SV2C) in rats | Y | Y | 5q13-14 | GGGTTGAGGT TTTTGTTAG CG | CCCCTCTAAA CTTCACAACC TCG | 6FAM-CTACTTCGCC TAACCTAACG CACAACAAAC G-BHQ-1 | GenBank Number AC026774; Amplicon Location: 44288-44415 |
| MINT2 | MINT2-M1B | HB-187 | Colon cancer differentially methylated CpG island genomic sequence | Y | Y | 2p22-21 | TTGAGTGGCG CGTTTCGT | TCCCCGCCTA AACCAACC | 6FAM-CTTACGCCAC CGCCTCCGA-BHQ-1 | GenBank Number AC007238; Amplicon Location: 74436-74524 |
| MINT31 | MINT31-M1B | HB-162 | Colon cancer differentially methylated CpG island genomic sequence | Y | Y | 17q22 | GTCGTCGGCG TTATTTTAGA AAGTT | CACCGACGCC CAACACA | 6FAM-ACGCTCCGCT CCCGAATACC CA-BHQ-1 | GenBank Number AC021491; Amplicon Location: 50060-50130 |
| MLH1 | MLH1-M2B | HB-150 | Mut L Homolog 1 (E. coli) (colon cancer, nonpolyposis type 2); COCA2 | Y | Y | 3p21.3 | AGGAAGAGCG GATAGCGATT T | TCTTCGTCCC TCCCTAAAAC G | 6FAM-CCCGCTACCT AAAAAAATAT ACGCTTACGC G-BHQ-1 | Fiegl, H. et al Cancer Epidemiol Biomarkers Prev 13, 882-888 (2004) |
| MLH3 | MLH3-M1B | HB-099 | MutL (E. coli) homolog 3 | Y | N | 14q24.3 | TGATGATGGT TGCGCGTAGT | CGACCGCCAA AACCGC | 6FAM-CGAAACCCTC GCGCATCCG A-BHQ-1 | GenBank Number AL049780; Amplicon Location: 110441-110511 |
| MMS19L | MMS19L-M1B | HB-117 | MMS19 (MET18 S. cerevisiae)-like: MET-18, hMMS19 | N | N | 10q24-10q25 | TTAGGTAGAA GTCGGTAGGT ACGTGA | ATAACTCGA AACGAACTC TCCGC | 6FAM-CGCCTCCCGA ACCAATCTCC | GenBank Number AL359388; Amplicon |

TABLE 1-continued (supplementary table 1); Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| | | | | | | | | | G-BHQ-1 | Location: 11495-11598 |
| MSH2 | MSH2-M1B | HB-095 | MutS (E. coli) homolog 2 (colon cancer, nonpolyposis type 1); COCA1 | N | | 2p22-p21 | TTTTAGTGCG GAGGTACGGG | AAACGATCCT TCCGAAACCA AA | 6FAM-CCGCACAAAC ACCAACGTTC CG-BHQ-1 | GenBank Number AC079775; Amplicon Location: 98483-98569 |
| MSH4 | MSH4-M1B | HB-096 | MutS (E. coli) homolog 4 | N | | 1p31 | CGGATTTTAG GAGATTTTAT AGAGTCG | CCGATCGCCC GCAAC | 6FAM-AACGTACCAA AACAAATAAA TACAAAAACC ACCTAAACCG G-BHQ-1 | GenBank Number AL359206; Amplicon Location: 16910-17000 |
| MSH5 | MSH5-M1B | HB-097 | MutS (E. coli) homolog 5 | N | | 6p21.3 | TTCGTGGCGG TCGGTTA | CCGCCATCGC AACGTT | 6FAM-CCCGCCTTTT CAATAACCTA AATCGCTAC A-BHQ-1 | GenBank Number AC020768; Amplicon Location: 68650-68732 |
| MSH6 | MSH6-M1B | HB-084 | MutS (E. coli) homolog 6; GTBP | Y | | 2p16 | GGAGTGTTTC GGTTCGGTTA GT | CTACCGCCGA ACGCCTAAA | 6FAM-CCCTTCCCTC ACGCCGCGA-BHQ-1 | GenBank Number AC006509; Amplicon Location: 34144-34228 |
| MT1A | MT1A-M1B | HB-205 | Metallothionein 1A; MT1S; K01383 | Y | | 16q13 | CGTGTTTTCG TGTTATTGTG TACG | CTCGCTATCG CCTTACCTAT CC | 6FAM-TCCACACCTA AATCCCTTCG ACCCACT-BHQ-1 | GenBank Number AC106779; Amplicon Location: 18175-18254 |
| MT1G | MT1G-M1B | HB-204 | Metallothionein 1G | Y | | 16q13 | CGTTTAAGGG ATTTGTATTT GGTTTAT | CCGCTAAATC CGCACCG | 6FAM-CGCGATCCCG ACCTAAACTA TACGCA-BHQ-1 | GenBank Number AC026461; Amplicon Location: 19549-19625 |
| MT2A | MT2A-M1B | HB-206 | Metallothionein 2A; Metallothionein-II; MT2 | Y | | 16q13 | GCGTTTTCGT CGTGTGTATA GTTT | TTCCCAAATC CGCTTTCA | 6FAM-CGGCGCTAA CGACTCAAAT TCG-BHQ-1 | GenBank Number AC026461; Amplicon Location: 79477-79565 |

TABLE 1-continued (supplementary table 1); Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| MT3 | MT3-M1B | HB-207 | Metallothionien 3 (growth inhibitory factor (neurotrophic)) | Y | N | 16q13 | GGTTTTAGGG TTTATGTCGA GGAGA | CCGCGCGTCC AATTACTTA | 6FAM-AAAACCCGTT CACCGCCTCC AACTACTA-BHQ-1 | GenBank Number AC026461; Amplicon Location: 98167-98241 |
| MTHFR | MTHFR-M1B | HB-058 | 5,10-methylenetetrahydrofolate reductase (NADPH) | N | N | 1p36.3 | TGGTAGTGAG AGTTTTAAAG ATAGTTCGA | CGCCTCATCT TCTCCCGA | 6FAM-TCTCATACCG CTCAAAATCC AAACCG-BHQ-1 | Eads, C. A. et al. Cancer Res 61, 3410-3418 (2001) |
| MUTYH | MUTYH-M1B | HB-088 | MutY (E. coli) homolog; MYH | N | N | 1p34.3-p32.1 | TCGGGTGGAT TCGAGTTACG | AAAATTACCT CCCGCGAACT CTA | 6FAM-CGCGCCCGAC TTTCCGACG-BHQ-1 | GenBank Number AL359540; Amplicon Location: 54075-54149 |
| MYOD1 | MYOD1-M1B | HB-154 | Myogenic determining factor 3; MYF3 | Y | N | 11p15.4 | GAGCGCGCGT AGTTAGCG | TCCGACACGC CCTTTCC | 6FAM-CTCCAACACC CGACTACTAT ATCCGCGAA A-BHQ-1 | Eads, C. A. et al. Cancer Res 61, 3410-3418 (2001) |
| NCL | NCL-M1B | HB-077 | Nucleolin | N | N | 2q12-qter | CGTGTCGTTT CGGTTCGTT | ACCAAAACTC GCGACCGTC | 6FAM-CCATAAACCA ATCGGCGAACC TCTAACCGT-BHQ-1 | GenBank Number M60858; Amplicon Location: 886-975 |
| NEUROD1 | NEUROD1-M1B | HB-259 | Neurogenic differentiation 1; NeuroD; BETA2. BHF-1 | Y | N | 2q32 | GTTTTTTGCG TGGGCGAAT | CCGGCTTAA CATCACTAAC TAAA | 6FAM-CGCGGCACCA CGACACGAA A-BHQ-1 | GenBank Number AC013733; Amplicon Location: 78576-78657 |
| NEUROD2 | NEUROD2-M1B | HB-260 | Neurogenic differentiation 2; NDRF | Y | N | 17q12 | GGTTGGTAT AGAGGTTGGT ATTTCGT | ACGAACGCCG ACGTCTTC | 6FAM-CGCCATACGA ACCGGGAAAC GAATATAA-BHQ-1 | GenBank Number AC087491; Amplicon Location: 38463-38551 |
| NEUROG1 | NEUROG1-M1B | HB-261 | Neurogenin 1 NEUROD3; AKA | Y | Y | 5q23-q31 | CGTGTAGCGT TCGGGTATTT | CGATAATTAC GAACACACTC | 6FAM-CGATAACGAC | GenBank Number AC005738; |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| | | | | | | | GTA | CGAAT | CTCCCGCGAA CATAAA-BHQ-1 | Amplicon Location: 75342-75429 |
| NR3C1 | NR3C1-M1B | HB-067 | Glucocorticoid Receptor/Nuclear receptor subfamily 3, group C, member 1; GRL; GR | Y | Y | 5q31 | GGGTGGAAGG AGACGTCGTA G | AACTTCCGA ACGCGCG | 6FAM-GTCCCGATCC CAACTACTTC GACCG-BHQ-1 | GenBank Number AY436590; Amplicon Location: 1786-1861 |
| NTF3 | NTF3-M1B | HB-251 | Neurotrophin 3 | N | | 12p13 | TTTCGTTTTT GTATTTTATG GAGGATT | CCGTTTCCGC CGTAATATTC | 6FAM-TCGCCACCAC GAAACTACCC ACG-BHQ-1 | GenBank Number AC135585; Amplicon Location: 7503-7576 |
| NTHL1 | NTHL1-M1B | HB-089 | Nth (E. coli endonuclease III)-like 1; NTH1; OCTS3 | N | | 16p13.3 | CGGGACGTCG TCGGAAG | CCGACCTTTC CGCCAAA | 6FAM-CGACCCTCCG CGCAATACC G-BHQ-1 | GenBank Number AC005600; Amplicon Location: 24563-24676 |
| OGG1 | OGG1-M1B | HB-087 | 8-oxoguanine DNA glycosylase | N | | 3p26.2 | TAGGGTGGGC GGGTCG | CCGCGAAACG CCCAA | 6FAM-CAATACCGAC CAACCGCGCG A-BHQ-1 | GenBank Number AJ131341; Amplicon Location: 1723-1854 |
| ONECUT2 | ONECUT2-M1B | HB-242 | One cut domain, family member 2. OC-2 | N | | 18q21.1-18q21.2 | ACGGGCGTTA AGCGTAATTA TTT | CCACAACCAC TAATAACTTC CCGTA | 6FAM-CCCGCCTCCC GAAACAACTA CGA-BHQ-1 | GenBank Number AC090340; Amplicon Location: 75559-75639 |
| OPCML[b] | OPCML-M1B | HB-209 | Opioid binding protein/cell adhesion molecule-like; OPCM, OBCAM | Y | | 11q25 | CGTTTCGAGG CGGTATCG | CGAACCGCCG AAATTATCAT | 6FAM-AACAACTCCA TCCCTAACCG CCACTTTCT-BHQ-1 | GenBank Number AC027631; Amplicon Location: 157489-157560 |
| PARP1[c] | PARP1-M1B | HB-093 | Poly (ADP-ribose) polymerase family member 1; PPOL; ADPRT; PARP | N | | 1q41-q42 | CGGGTTTAGG GAGCGAGC | AAACGACCGC GAACCCATA | 6FAM-CGTCCGAAA ACCGACCG AA-BHQ-1 | GenBank Number AL359704; Amplicon Location: 146947-147015 |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| PARP2 | PARP2-M1B | HB-094 | Poly(ADP-ribose) polymerase) family, member 2; ADPRTL2 | N | N | 14q11.2-q12 | GGGCGAGAGG TTCGGAGT | TCGTTCCTTT CTAACTACCC GC | 6FAM-CCCGCATACC GTCCCGCGAT A-BHQ-1 | GenBank Number AL355075; Amplicon Location: 176220-176286 |
| PAX8 | PAX8-M2B | HB-211 | Paired Box Gene 8; Paired Domain Gene 8 | N | N | 2q12 | GTTCGTAGTT CGTCGGAGGGT TC | CGCATCTCAT ACCCTTCTCC TAAAT | 6FAM-CAAACGCGAC CCGAACCTAC GAAAA-BHQ-1 | GenBank Number AC016683; Amplicon Location: 115663-115758 |
| PENK | PENK-M1B | HB-163 | ppENK/ Proenkephalin precursor | Y | N | 8q23-q24 | GGTTAATTAT AAAGTGGTTT TAGTAGTCGT TAAG | CAACGTCTCT ACGAAATCAC GAAC | 6FAM-AACGCCTACC TCGCCGTCCC G-BHQ-1 | GenBank Number AC012349; Amplicon Location: 81412-81510 |
| PGR | PGR-M1B | HB-149 | Progesterone Receptor A; PR; NR3C3 | Y | N | 11q22-q23 | GGCGGTGACG GTCGTATTC | ACAAACCGTC CCGCGAA | 6FAM-AACAACCGCTC GCGGCCGA-BHQ-1 | Woodson, K. et al Cancer Epidemiol Biomarkers Prev 14, 1219-1223 (2005) |
| PITX2 | PITX2-M2B | HB-235 | Paired-like homeodomain transcription factor 2; IRID2; IHG2; RIEG; RGS; IGDS | Y | N | 4q25-27 | AGTTCGGTTG CGCGGTT | TACTTCCCTC CCCTACCTCG TT | 6FAM-CGACGCTCGC CCGAACGCT A-BHQ-1 | GenBank Number AC017068; Amplicon Location: 117302-117404 |
| PLAGL1 | PLAGL1-M1B | HB-199 | Pleiomorphic adenoma gene-like 1; LOT1 | N | N | 6q24-q25 | ATCGACGGGT TGAATGATAA ATG | CTCGACGCAA CCATCCCTCTT | 6FAM-ACTACCGCGA ACGACAAAAC CCACG-BHQ-1 | GenBank Number AL109755; Amplicon Location: 52969-53045 |
| PMS2 | PMS2-M1B | HB-098 | Postmeiotic segregation increased 2 (S. cerevisiae); PMSL2 | N | N | 7p22 | TCGTGGTTTG GCGTGGAT | CCTAATACAT CGAAATAACG CGTACC | 6FAM-CCAACGATCG AAAACCGCCA AACA-BHQ-1 | GenBank Number AC005073; Amplicon Location: 150898-150982 |
| POLD1 | POLD1-M1B | HB-139 | Polymerase (DNA directed), delta 1, | N | N | 19q13.3 | GGGACGCGGA GGATGC | GATCTAAACG CCGCGATTCT | 6FAM-TCCTCCCACC | GenBank Number AC073646; |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| | | | catalytic subunit (125 kD); POLD | | | | | AT | CTCGAATATT ACGCG-BHQ-1 | Amplicon Location: 123366-123435 |
| PPARG | PPARG-M1B | HB-060 | Peroxisome proliferative activated receptor, gamma isoform 1; PPARG1; PPARG2; NR1C3 | N | | 3p25 | GCGTTCGCGT TCGTTTTC | CGCCCCAAAC GACGAC | 6FAM-CCCGCCTACC CGGACGAA A-BHQ-1 | GenBank Number AC091492; Amplicon Location: 138096-138211 |
| PRKAR1A | PRKAR1A-M1B | HB-214 | protein kinase, cAMP-dependent, regulatory, type I, alpha (tissue specific extinguisher 1); TSE; PRKAR1 | N | | 17q23 | CGGATTTGTA GTAGTTGCGT TGC | ACCGAACACA AAATACGC GAC | 6FAM-CATCCCGACC ATCCGCCCG-BHQ-1 | GenBank Number AC079210; Amplicon Location: 118231-118314 |
| PSAT1 | PSAT1-M1B | HB-231 | Phosphoserine aminotransferase 1 | N | | 9q21 | TGGGTTTGGT TTCGTTAAGT TGT | ACGTACTCCC GCCTAAACCT C | 6FAM-ACGCCCGCTC GCGAAAACTT ACTAAATA-BHQ-1 | GenBank Number AL353594; Amplicon Location: 5511-5591 |
| PSEN1 | PSEN1-M1B | HB-262 | Presenilin 1 (Alzheimer disease 3); AD3 | N | | 14q24.3 | GTCGGGTGGA GAGAGATTTC G | AACACCTACG GCCCTAAAA CGTC | 6FAM-TCGAACAAAC AACATTTCCG AACCAAAAC T-BHQ-1 | GenBank Number AF205592; Amplicon Location: 6663-6739 |
| PSEN2 | PSEN2-M1B | HB-262 | Presenilin 2 (Alzheimer disease 4); AD4 | N | | 1q31-q42 | GAGGGCGTGTA GTAGGCGGG | CCGATACTAA AAACCGAATA AACTCG | 6FAM-CGCAACGAAA ATCTCCGACG AAAAAA-BHQ-1 | GenBank Number U50871; Amplicon Location: 26196-26284 |
| PTEN | PTEN-M1B | HB-157 | Phosphatase and tensin homolog (mutated in multiple advanced cancers 1); MMAC1; BZS; MHAM | N | | 10q23.3 | GTTTCGCGTT GTTGTAAAAG TCG | CAATATAACT ACCTAAAACT TACTCGAACC G | 6FAM-TTCCCAACCG CCAACTACA ACTACACTT A-BHQ-1 | GenBank Number AF143312; Amplicon Location: 1060-1147 |
| PTGS2 | PTGS2-M1B | HB-065 | prostaglandin-endoperoxide synthase 2 (prostaglandin G/H | N | | 1q25.2-q25.3 | CGGAAGCGTT CGGGTAAAG | AATTCCACCG CCCCAAAC | 6FAM-TTTCCGCCAA ATATCTTTTCT TCTTCGCA- | Fiegl, H. et al Cancer Epidemiol Biomarkers |

TABLE 1-continued (supplementary table 1); Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| | | | synthase and cyclooxygenase); COX2 | | | | | | BHQ-1 | Prev 13, 882-888 (2004) |
| PTTG1 | PTTG1-M1B | HB-052 | Pituitary tumor-transforming 1; TUTR1; SECURIN; PTTG; HPTTG | N | | 5q35.1 | GCGTTCGTTT ATCGCGGT | CCGCGACCC TCCCATT | 6FAM-ACTCACGCAA ATCTTAACAA CCGCATTCA-BHQ-1 | GenBank Number AC091842; Amplicon Location: 88212-88281 |
| PYCARD | PYCARD-M1B | HB-228 | PYD and CARD domain containing ASC; TMS1; CARD5; MGC10332 | Y | | 16p12-p11.2 | TTGGAGATTT ACGGCGTCG | ACCCTAATAC GTACCGCCT ACAA | 6FAM-CATCTCCTAC AAACCCATAT CGGGCAA-BHQ-1 | GenBank Number AC009088; Amplicon Location: 85330-85425 |
| RAD23A | RAD23A-M1B | HB-101 | RAD23 (S. cerevisiae) homolog A; HHR23A | N | | 19p13.2 | TATCGATAAC GGGTATGGCG TT | GCAAACTAAA CTCCGCGCTA TAA | 6FAM-TTACTCGACCC GCACACGTAAT CTCCTAAA-BHQ-1 | GenBank Number AD000092; Amplicon Location: 92213-92298 |
| RARB | RARB-M1B | HB-176 | retinoic acid receptor, beta; HAP; RRB2; NR1B2 | Y | | 3p24 | TTTATGCGAG TTGTTTGAGG ATTG | CGAATCCTAC CCCGACGATA C | 6FAM-CTCGAATCGC TCGCGTTCTC GACAT-BHQ-1 | GenBank Number X56849; Amplicon Location: 921-1006 |
| RARRES1 | RARRES1-M1B | HB-322 | Retinoic acid receptor, responder (tazarotene induced) 1; TIG1 | Y | | 3q25.31-3q26.1 | GGGCGAGTCGG ATCGGAA | CGCAAACTCC TACAACAAAC GA | 6FAM-CGCGGACGC TTCACTTCTT CAA-BHQ-1 | GenBank Number AC080013; Amplicon Location: 66080-66144 |
| RASSF1 | RASSF1A-M1B | HB-044 | Ras association (RalGDS/AF-6) domain family 1; NORE2A; REH3P21; RDA32 | Y | | 3p21.3 | ATTGAGTTGC GGGAGTTGGT | ACACGCTCCA ACCGAATACG | 6FAM-CCCTTCCCAA CGCGCCCA-BHQ-1 | Previously described as RASSF1A in Ehrlich, M. et al. Oncogene 21, 6694-6702 (2002) |
| RB1 | RB1-M1B | HB-245 | Retinoblastoma 1 (including osteosarcoma); OSRC | N | | 13q14.2 | TTAGTTCGCG TATCGATTAG CG | ACTAAACGCC GCGTCCAA | 6FAM-TCACGTCCGC GAAACTCCCG A-BHQ-1 | Eads, C. A. et al. Cancer Res 61, 3410-3418 (2001) |

TABLE 1-continued (supplementary table 1); Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| RBP1 | RBP1-M1B | HB-185 | Retinol binding protein 1, cellular | Y | N | 3q23 | CGCGTTGGGA ATTTAGTTGT C | GATACTACGC GAATAATAAA CGACCC | 6FAM-ACGCCCTCCG AAACAAAAA ACTCTACG-BHQ-1 | GenBank Number AC046134; Amplicon Location: 137423-137512 |
| RNR1 | RNR1-M1B | HB-071 | Ribosomal RNA | N | N | 13p12 | CGTTTTGGAG ATACGGGTCG | AAACAACGCC GAACCGAA | 6FAM-ACCGCCCGTA CCACACGCAA A-BHQ-1 | Muller, H. M. et al. Cancer Lett209, 231-236 (2004) |
| RPA2 | RPA2-M1B | HB-103 | Replication protein A2 (32 kD) | Y | N | 1p35 | TGGCGCGAAT TTGAGTACG | CGTATAATCC CACCCTCGTC A | 6FAM-CGCGACTTCT ACCGTCACTT CCTTTATTC G-BHQ-1 | GenBank Number AL109927; Amplicon Location: 71845-71919 |
| RPA3 | RPA3-M1B | HB-104 | Replication protein A3 (14 kD) | Y | N | 7p22 | AGCGCGATTG CGATTTAGG | TTTCTCGACA CCAATCAACG AA | 6FAM-TCCAACTTCG CCAATTAAAT ACGCGAAA-BHQ-1 | GenBank Number AC004948 Amplicon Location: 23978-24056 |
| RUNX3 | RUNX3-M1B | HB-181 | Runt-related transcription factor 1 (acute myeloid leukemia 1; aml1 oncogene); CBFA3; AML2 | Y | Y | 1p36 | CGTTCGATGG TGGACGTGT | GACGAACAAC GTCTTATTAC AACGC | 6FAM-CGCACGAACT CGCCTACGTA ATCCG-BHQ-1 | GenBank Number AL023096; Amplicon Location: 64646-64762 |
| S100A2 | S100A2-M1B | HB-061 | S100 calcioum binding protein A2; S100L; CAN19 | N | N | 1q21 | TGTTTGAGTC GTAAGTAGGG CGT | CGTATCATTA CAATACCGAC CTCCT | 6FAM-ATCCTCCCTT TCTTATCCGC CAAACCCT-BHQ-1 | Muller, H. M. et al. Cancer Lett209, 231-236 (2004) |
| SASH1 | H-SASSH1-M1B | HB-220 | SAM and SH3 domain containing; KIAA0790 | N | N | 6q23 | TGGAAGAGTT TATTTTGAAG AGAGGG | GCGACTCGTT CCTTCTAACA AATC | 6FAM-AAACCCGACA AAAATAACCG CGAAACCT-BHQ-1 | GenBank Number AL513164; Amplicon Location: 97419-97530 |
| SCAM-1 | SCAM-1-M1B | HB-064 | Vinexin beta (SH3-containing adaptor molecule-1 | Y | N | 8p21 | GTTTCGGTTG TCGTTGGGTT | ACGCCGACGA ACTCTACGC | 6FAM-ACGACGCAAT CAAAACCCGC | GenBank Number AC037459; Amplicon |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| | | | | | | | | | GA-BHQ-1 | Location: 86568-86640 |
| SCGB3A1 | SCGB3A1-M1B | HB-194 | Secretoglobin family 3A, member 1; HIN-1; HIN1; LU105; UGRP2 | Y | N | 5q35-qter | GGCGTAGCGG GCGTC | CTACGTAACC CTATCCTACA ACTCCG | 6FAM-CGAACTCCTA ACGCGCACGA TAAACCTA-BHQ-1 | GenBank Number AC122714; Amplicon Location: 80825-80911 |
| SERPINB5 | SERPINB5-M1B | HB-208 | Serine (or cysteine) proteinase inhibitor, clade B (ovalbumin), member 5; PI5; MASPIN | N | N | 18q21.3 | GAAAAGGAAT AGGTAAGCGA GGAGT | ATAAACCACC GCTACTTCTA CCCA | 6FAM-CACGATGCC TCCACATCCA AATCTTT-BHQ-1 | GenBank Number AC036176; Amplicon Location: 51709-51788 |
| SEZ6L | SEZ6L-M1B | HB-184 | Seizure related 6 homolog (mouse)-like; KIAA0927 | Y | N | 22q12.1 | GCGTTAGTAG GGAGAGAAAA CGTTC | ATACCAACCG CCTCCTCTAA CC | 6FAM-CCGTCGACCC TACAAAATTT AACGCCA-BHQ-1 | GenBank Number AL022337; Amplicon Location: 87324-87426 |
| SFN | SFN-M1B | HB-174 | Stratifin; 14-3-3 sigma | N | N | 1p35.3 | GAGGAGGGTT CGGAGAGAA | ATCGCACACG CCCTAAAACT | 6FAM-TCTCCCGATA CTACGGCACC TCGAA-BHQ-1 | GenBank Number AF029081; Amplicon Location: 8848-8928 |
| SFRP1 | SFRP1-M1B | HB-201 | Secreted frizzled-related protein 1; FRP-1; SARP2 | Y | N | 8p12-p11.1 | GAATTCGTTC GCGAGGGA | AAACGAACCG CACTCGTTAC C | 6FAM-CCGTCACCGA CGCGAAAACC AAT-BHQ-1 | GenBank Number AC104393; Amplicon Location: 1133-1202 |
| SFRP2 | SFRP2-M2B | HB-280 | Secreted frizzled-related protein 2; FRP-2; SARP1; SDF-5 | Y | N | 4q31.3 | GCGTTTTAGT CGTCGTTGT TAGT | AAACGACCGA AATTCGAACT TATC | 6FAM-CGAACCCGCT CTCTTCGCTA AATACGA-BHQ-1 | GenBank Number AC020703; Amplicon Location: 71046-71137 |
| SFRP4 | SFRP4-M1B | HB-281 | Secreted frizzled-related protein 4; FRP-4 | Y | N | 7p14-p13 | GTTGTTCGGG CGGGTTC | GCGAAACTCC GCCGTCTA | 6FAM-AAACACGAAC AACGCCAACT CTCAACCT-BHQ-1 | GenBank Number AC018634; Amplicon Location: 76448-76526 |

TABLE 1-continued (supplementary table 1); Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| SFRP5 | SFRP5-M1B | HB-282 | Secreted frizzled-related protein 5; SARP3 | Y | N | 10q24.1 | GCGTTTGTAG TTTATCGTGT GGTAGA | GAACCGCTAC ACGACCGCT | 6FAM-CGCCGCAATA CCTTAACATC CCTACCG-BHQ-1 | GenBank Number AL358938; Amplicon Location: 45204-45296 |
| SLC6A20 | SLC6A20-M1B | HB-079 | solute carier family 6 (proline IMINO transporter), member 20; XT3 | Y | N | 3p21.3 | AGGCGAATAC GAATTGTAGC G | TAAAACGACG CGCCTAACG | 6FAM-CCCGCGACTA AAACTACCGT ACCGAA-BHQ-1 | GenBank Number AJ289880 Amplicon Location: 85407-85541 |
| SMAD2 | SMAD2-M1B | HB-275 | SMAD, mothers against DPP homolog 2 (Drosophila); MADH2 | N | N | 18q21.1 | CGAGGCGGTA GGTTTTTATA GGT | CGCATTAAAA CGATTCCCGA T | 6FAM-CCGATCCCTC GCCAACGTCG TAA-BHQ-1 | GenBank Number AC120349; Amplicon Location: 27348-27425 |
| SMAD3 | SMAD3-M1B | HB-053 | SMAD, mothers against DPP homolog 3 (Drosophila); MADH3 | N | N | 15q22-15q23 | CGTGAAGCGT TTGTTGGGT | TTAACCGCCT TCTCGCACC | 6FAM-TCCTCCTACC CGTTCTACTC GCCCTTCTT-BHQ-1 | Previously described as MADH3 in Ehrlich, M. et al. Oncogene 21, 6694-6702 (2002) |
| SMAD4 | SMAD4-M1B | HB-277 | SMAD, mothers against DPP homolog 4 (Drosophila); MADH4; DPC4 | N | N | 18q21.1 | GTTTGCGTAG AGCGATTTTT TTC | GCAACTTTCC TTTCTCCCGA CT | 6FAM-CCCGCCTCCC GCTCCGAAT A-BHQ-1 | GenBank Number AB043547; Amplicon Location: 119423-119492 |
| SMAD6 | SMAD6-M1B | HB-278 | SMAD, mothers against DPP homolog 6 (Drosophila); MADH6; Hs17432 | Y | N | 15q21.3-22.2 | ATGTTAGTTT AGATATTTTG GCGGTTTC | CGACCCTACA ATAAAACGTA TTCTCCT | 6FAM-AAACCTTATT TACGCAACAA TCAACGCCG-BHQ-1 | GenBank Number AC013564; Amplicon Location: 57206-57309 |
| SMAD9 | SMAD9-M1B | HB-315 | SMAD, mothers against DPP homolog 9 (Drosophila); MADH9 | N | N | 13q12-q14 | CGCGAAGTTT TATCGTTCGT ATTAG | CGAAAACGAA CCGCAAACA | 6FAM-AACTCCCTAA CCGCTTTCCA AATCGACG-BHQ-1 | GenBank Number AL138706; Amplicon Location: 77288-77362 |
| SMUG1 | SMUG1-M1B | HB-086 | Single-strand selective monofunctional | N | N | 12q13.11-q13.3 | GGATTATAGG CGCGCGTTAT T | TCACACCCGT AATCCGAACA | 6FAM-ACCGAAACGA ACGAATACACG | GenBank Number AC023794; Amplicon |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| | | | uracil DNA glycosylase | | | | | | AAATCAAA-BHQ-1 | Location: 156022-156167 |
| SOCS1 | SOCS1-M1B | HB-042 | Suppressor of cytokine signaling 1; SPCS-1; SSI-1; JAB; TIP3; Cish1 | Y | Y | 16p13.13 | GCGTCGAGTT CGTGGGTATT T | CCGAAACCA TCTTCACGC TAA | 6FAM-ACAATTCCGC TAACGACTAT CGGCA-BHQ-1 | Fiegl, H. et al Cancer Epidemiol Biomarkers Prev 13, 882-888 (2004) |
| STAT1 | STAT1-M1B | HB-063 | Signal transducer and activator of transcription 1, 91 kDa; STAT91 | N | N | 2q32.2 | GCGTAGGATT CGGAAGGGTT A | AACAAACCC CAAACCGAA CA | 6FAM-AACGACCCAA CGCGCTCGAA AA-BHQ-1 | GenBank Number AY865620; Amplicon Location: 2091-2179 |
| STK11 | STK11-M2B | HB-183 | Serine/threonine kinase 11 (Peutz-Jeghers syndrome); PJS; LKB1 | N | N | 19p13.3 | AATTAACGGG TGGGTACGTC G | GCCATCTTAT TTACCTCCCT CCC | 6FAM-CGCACGCCCG ACCGCAA-BHQ-1 | GenBank Number AC011544; Amplicon Location: 26084-26187 |
| SYK | SYK-M2B | HB-241 | Spleen tyrosine kinase | N | N | 9q22 | AGGGTCGTTG GGTGTTTGTG | AACATAAACC GCATCGATCC C | 6FAM-CGCCAACGCG ATAACTTCTA TAACTACCC AA-BHQ-1 | GenBank Number AL354862; Amplicon Location: 50529-50613 |
| TERT | TERT-M1B | HB-074 | Telomerase reverse transcriptase; TRT; TPS; TCS1; EST2 | Y | N | 5p15.33 | GGATTCGCGG GTATAGACGT T | CGAAATCCGC GCGAAA | 6FAM-CCCAATCCCT CCGCCACGTA AAA-BHQ-1 | Fiegl, H. et al Cancer Epidemiol Biomarkers Prev 13, 882-888 (2004) |
| TFAP2A | TFAP2A-M1B | HB-314 | Transcription factor AP-2 alpha (activating enhancer binding protein 2 alpha); AP-2; TFAP2; AP2TF | Y | N | 6p24 | CGTTAATTTT TAAAGTATTT TTATGGATCG | CCGACAACCA ACACTTTACG C | 6FAM-CGAAAACCGAA AAAAACATAT CCGTTCACG-BHQ-1 | GenBank Number AL138885; Amplicon Location: 105985-106093 |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| TFF1 | TFF1-M1B | HB-145 | Trefoil factor 1 (breast cancer; estrogen-inducible sequence expressed in); BCE1; D21S21 | N | | 21q22.3 | TAAGGTTACG GTGGTTATTT CGTGA | ACCTTAATCC AAATCCTACT CATATCTAAA A | 6FAM-CCCTCCCGCC AAAATAAATA CTATACTCAC TACAAAA-BHQ-1 | Fiegl, H. et al Cancer Epidemiol Biomarkers Prev 13, 882-888 (2004) |
| TGFBR1 | TGFBR1-M1B | HB-192 | Transforming growth factor, beta receptor I (activin A receptor) type II-like kinase, 53kDa); ALK-5 | N | | 9q22 | ACGCGCGTTT ATTGGTTGTC | ACGAACCCGC AAACGAAA | 6FAM-TAAATCCCGC TTAACAACTC GCGACGA-BHQ-1 | GenBank Number AL162427; Amplicon Location: 88267-88365 |
| TGFBR2 | TGFBR2-M1B | HB-246 | Transforming growth factor, beta receptor II (70/80 kDa); MFS2 | N | | 3p22 | GCGCGGAGCG GTAGTTAGG | CAAACCCCGC TACTCGTCAT | 6FAM-CACGAACGAC GCCTTCCCGA A-BHQ-1 | Eads, C. A. et al. Cancer Res 61, 3410-3418 (2001) |
| THBS1 | THBS1-M1B | HB-247 | Thrombospondin 1; TSP1 | N | | 15q15 | CGACGCACCA ACCTACCG | GTTTTGAGTT GGTTTTACGT TCGT | 6FAM-ACGCCGCGCT CACCTCCCT-BHQ-1 | Widschwendter, M. et al Cancer Res 64, 3807-3813 (2004) |
| THRB | THRB-M1B | HB-247 | Thyroid hormone receptor, beta (erythroblastic leukemia viral (v-erb-a) oncogene homolog 2, avian); ERBA2; THRB1; THRB2; NR1A2 | Y | | 3p24.3 | TCGTCGTCGT TATCGTCGC | GCGTCTACGA ACCGATAACC TAAT | 6FAM-CCCTCCAACC CTCACGACTA TCCGACTTA-BHQ-1 | GenBank Number AC012087; Amplicon Location: 123758-123833 |
| TIMP3 | TIMP-3 | HB-167 | TIMP metallopeptidase inhibitor 3 (Sorsby fundus dystrophy, pseudoinflaminatory); SFD | Y | | 22q12.3 | GCGTCGGAGG TTAAGGTTGT T | CTCTCCAAAA TTACCGTACG CG | 6FAM-AACTCGCTCG CCCGCCGAA-BHQ-1 | Eads, C. A. et al. Cancer Res 61, 3410-3418 (2001) |
| TITF1 | TITF1-M1B | HB-213 | Thyroid transcription factor 1; NKX2A; BCH; TTF-1 | Y | | 14q13 | CGAAATAAAC CGAATCCTCC TTAA | TGTTTTGTTG TTTTAGCGTT TACGT | 6FAM-CTCGCGTTTA TTTTAACCCG ACGCCA-BHQ-1 | Fiegl, H. et al Cancer Epidemiol Biomarkers Prev 13,882-888 (2004) |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| TMEFF2 | TMEFF2-M1B | HB-274 | Transmembrane protein with EGF-like and two follistatin-like domains 2; TENB2 | Y | N | 2q32.3 | CGACGAGGAG GTGTAAGGAT G | CAACGCCTAA CGAACGAACC | 6FAM-TATAACTTCC GCGACCGCCT CCTCCT-BHQ-1 | GenBank Number AC092644; Amplicon Location: 149017-149089 |
| TNFRSF10A | TNFRSF10A-M1B | HB-306 | Tumor necrosis factor receptor superfamily, member 10a; DR4; Apo2; TRAILR-1; CD261 | N | N | 8p21 | AGTTTTTGGT ATTTAGTAGG CGTTCG | CAAACCCCGC AATAACCTCT ATATC | 6FAM-ATTCCGCCAC CCATCCGTCC A-BHQ-1 | GenBank Number AC100861; Amplicon Location: 53847-53923 |
| TNFRSF10B | TNFRSF10B-M1B | HB-307 | Tumor necrosis factor receptor superfamily, member 10b; DR5; KILLER; TRICK2A; TRAIL-R2; TRICKB; CD262 | N | N | 8p22-p21 | TTTTGGCGGT TGCGTTTC | CTCATTTCCC CCAAATTTCG AT | 6FAM-ATCCTAACGC GAACAAAACC CAAAAACAA-BHQ-1 | GenBank Number AC107959; Amplicon Location: 131919-132001 |
| TNFRSF10C | TNFRSF10C-M1B | HB-308 | Tumor necrosis factor receptor superfamily, member 10c, decoy without an intracellular domain; DcR1; TRAILR3; LIT; TRID; CD263 | Y | N | 8p22-p21 | GGGAAGAGCG TATTTGGCG | TCCCCTAACT CCGACGACG | 6FAM-CGAACATACC CGACCGCAAA TAACCA-BHQ-1 | GenBank Number AC107959; Amplicon Location: 165904-166026 |
| TNFRSF10D | TNFRSF10D-M1B | HB-309 | Tumor necrosis factor receptor superfamily, member 10d, decoy with truncated death domain; DcR2; TRUNDD; TRAILR4; CD264 | N | N | 8p21 | GGGAAGAGCG TATTTGGCG | TCCCCTAACT CCGAGGACG | 6FAM-TACCCGACCG CAAACGACCC G-BHQ-1 | GenBank Number AC100861; Amplicon Location: 115508-115632 |
| TNFRSF25 | TNFRSF25-M1B | HB-080 | TNF receptor superfamily, member 25, TNFRSF12; DR3; APO-3 | N | N | 1p36.2 | GCGGAATTAC GACGGGTAGA | ACTCCATAAC CCTCCGACGA | 6FAM-CGCCCAAAAA CTTCCCGACT CCGTA-BHQ-1 | Formerly described as TNFRSF12 in Ehrlich, M. et al. Oncogene 21, 6694-6702 (2002) |
| TP53 | TP53-M1B | HB-217 | Tumor protein p53 | N | N | 17p13.1 | TTTGTTGTCG CGGGATTTC | CGAATTCCGT AAATCGCCC | 6FAM-TAATCCGAAA TACGACGACC AATCGAAAA C-3'BHQ | GenBank Number AC087388; Amplicon Location: 66667-66749 |

TABLE 1-continued (supplementary table 1): Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| TP73 | TP73-M1B | HB-177 | Tumor protein p73 | Y | N | 1p36.3 | GGGTCGGGTAGTTCGTTTTG | CGATTTCGCTACGTCCCCT | 6FAM-AACCTCCGAACGAATACGCGAACGAA-BHQ-1 | GenBank Number AF235000; Amplicon Location: 3977-4058 |
| TSHR[d] | TSHR-M1B | HB-141 | Thyroid stimulating hormone receptor; LGR3 | Y | N | 14q31 | TTGAGGGTTAGAGGCGGGTA | ACAACGAAAATCCTCCTCCAAAAATACA | 6FAM-AACGACGACTTCGACCGCACCG-BHQ-1 | GenBank Number AC010072; Amplicon Location: 103024-103110 |
| TWIST1 | TWIST1-M1B | HB-047 | Twist homolog (acrocephalosyndactyly 3; Saethre-Chotzen syndrome) (Drosophila) | Y | N | 7p21.2 | GTAGCGCGGCGAACGT | AAACGCAACGAATCATAACCAAC | 6FAM-CCAACGCACCCAATCGCTAAACGA-BHQ-1 | Muller, H. M. et al. Cancer Lett 209, 231-236 (2004) |
| TYMS | TYMS-M1B | HB-248 | Thymidylate Synthase | N | N | 18p11.32 | CGGCGTTAGGAAGGACGAT | TCTCAAACTATAACGCGCCTACAT | 6FAM-CCGAATACCGACAAAATACCGATACCCGT-BHQ-1 | Eads, C. A. et al. Cancer Res 61, 3410-3418 (2001) |
| UNG | UNG-M1B | HB-082 | Uracil-DNA glycosylase DGU; UDG; UNG1 | N | N | 12q23-q24.1 | GTTTGACGGAGGGCGTGTA | ACAACGACGACTATTTTAAACACGTAA | 6FAM-CCCGAATTTACCGAATCAAAAACGCGA-BHQ-1 | GenBank Number AC007637; Amplicon Location: 4765-4860 |
| UQCRH | UQCRH-M1B | HB-224 | Ubiquitinol cytochrome c reductase hinge protien | N | N | 1p33.1 | TTCGGTTTCGGGTTTTAACG | CCCATATAAACGCTCACCGC | 6FAM-CCCGCACAACTCGAACAAAAGAAA-BHQ-1 | GenBank Number AL122001; Amplicon Location: 120731-120802 |
| VDR | VDR-M1B | HB-068 | Vitamin D (1,25-dihydroxy vitamin D3) receptoR; NR1I1 | N | N | 12q12-q14 | ACGTATTTGGTTTAGGCGTTCGTA | CGCTTCAACCTATATTAATCGAAAATACA | 6FAM-CCCACCCTTCCTACCGTAATTCTACCCAA-BHQ-1 | Muller, H. M. et al. Cancer Lett 209, 231-236 (2004) |
| VHL | VHL-M1B | HB-191 | Von Hippel-Lindau syndrome tumor | N | N | 3p26-p25 | CGGGAGCGCGTACGTAGTT | CTCCGAAACATTCCCTCCG | 6FAM-CGAACCGAAC | GenBank Number AF010238; |

TABLE 1-continued (supplementary table 1); Complete list of all MethyLight™ reactions.

| HUGO Gene Name (If Available) | Reaction ID | Reaction Design Code | Aliases | Cancer Specific? (Y/N) | 14 CIMP and 5 Toyota Markers? (Y/N) | Chromosomal Location | Forward Primer Sequence | Reverse Primer Sequence | Probe Oligo Sequence[a] | Source |
|---|---|---|---|---|---|---|---|---|---|---|
| | | | suppressor; VHL1 | | | | | | GCCGCGAAA-BHQ-1 | Amplicon Location: 632-725 |
| XAB2 | XAB2-M1B | HB-115 | XPA binding protein 2; HCNP | N | N | 19p13.2 | GACGGATAGG TTTACGTTAT TGATTTT | CGCATCTTCT AACGCCTCTA TTC | 6FAM-ACTTCCGATC GCTAACGTCG TCGAAA-BHQ-1 | GenBank Number AC008763; Amplicon Location: 60446-60523 |
| XPA | XPA-M1B | HB-102 | Xeroderma pigmentosum, complementation group A; XPAC; XP1 | N | N | 9q22.3 | CGCGGAGTTG TTTGTTTCG | CAACATCAAT ACCCGCTACC G | 6FAM-CCGCTCGATA CTCGCCCGC A-BHQ-1 | GenBank Number AL445531; Amplicon Location: 26708-26771 |
| XpC | XPC-M1B | HB-100 | Xeroderma pigmentosum, complementation group C; XPCC | N | N | 3p25.3 | GTCGGGTGCG TTATTCGC | CTACGCAATT CGCGTCCC | 6FAM-ACCGCGCGTT TCCGAACCAT ATTACT-BHQ-1 | GenBank Number AC093495 Amplicon Location: 81528-81625 |
| XRCC1 | XRCC1-M1B | HB-092 | X-ray repair complementing defective repair Chinese hamster cells; RCC | N | N | 19q13.2 | CGTTGTTAAG GAACGTAGCG TTTT | GCGCGAAACT TCGAACCTTT | 6FAM-CCAATCGCGC CTCTCCAAAA CG-BHQ-1 | GenBank Number L34079; Amplicon Location: 4045-4154 |
| COL2A1 | COL2A1-C1B | HB-057 | Collagen, type II, alpha 1 (primary osteoarthritis, spondyloepiphyseal dysplasia, congenital) | N/A | N/A | 12q13.11-q13.2 | TCTAACAATT ATAAACTCCA ACCACCAA | GGGAAGATGG GATAGAAGGG AATAT | 6FAM-CCTTCATTCT AACCCAATAC CTATCCCACC TCTAAA-BHQ-1 | Widschwendter, M. et al Cancer Res 64, 3807-3813 (2004) |
| ALU | ALU-C4M | HB-313 | Interspersed ALU repeat sequence | N/A | N/A | N/A | GGTTAGGTAT AGTGGTTTAT ATTTGTAATT TTAGTA | ATTAACTAAA CTAATCTTAA ACTCCTAACC TCA | 6FAM-CCTACCTTAA CCTCCC-MGBNFQ | Weisenberger D. J. et al Nucleic Acids Res 33, 6823-6836 (2005). |

TABLE 2

(supplemental table 2). New CIMP Classification Panel. The first five
reactions are methylation-specific, bisulfite conversion-specific
markers that together form the new diagnostic panel used for CIMP
classification. Putative DNA methylation sites (CpGs indicated as
"CG" in the sequence) are indicated in bold in the oligonucleotide
sequences. The sixth reactions is a non-methylation-specific,
bisulfite-conversion-specific normalization reactions used to
calculate PMR values.

| HUGO NAME | RXN ID | PURPOSE | FORWARD PRIMER | REVERSE PRIMER | PROBE |
|---|---|---|---|---|---|
| CACNA1G | HB-158 | CIMP Marker | TTTTTTCGTTTCGCGTTTAGGT | CTCGAAACGACTTCGCCG | 6FAM-AAATAACGCCGAATCCGACAACCGA-BHQ |
| IGF2 | HB-319 | CIMP Marker | GAGCGGTTTCGGTGTCGTTA | CCAACTCGATTTAAACCGACG | 6FAM-CCCTCTACCGTCGCGAACCCGA-BHQ |
| NEUROG1 | HB-261 | CIMP Marker | CGTGTAGCGTTCGGGTATTTGTA | CGATAATTACGAACACACTCCGAAT | 6FAM-CGATAACGACCTCCCGCGAACATAAA-BHQ-1 |
| RUNX3 | HB-181 | CIMP Marker | CGTTCGATGGTGGACGTGT | GACGAACAACGTCTTATTACAACGC | 6FAM-CGCACGAACTCGCCTACGTAATCCG-BHQ-1 |
| SOCS1 | HB-042 | CIMP Marker | GCGTCGAGTTCGTGGGTATTT | CCGAAACCATCTTCACGCTAA | 6FAM-ACAATTCCGCTAACGACTATCGCGCA-BHQ-1 |
| ALU | HB-313 | Normalization control | GGTTAGGTATAGTGGTTTATATTTGTAATTTTAGTA | ATTAACTAAACTAATCTTAAACTCCTAACCTCA | 6FAM-CCTACCTTAACCTCC-MGBNFQ |

Example 2

Cancer-Specific DNA Methylation Markers were Selected

The initial (original) definition of CIMP was based on concordant methylation of Type C loci, and specifically excluded markers that showed evidence of age-associated methylation in normal tissues, referred to as "Type A" loci[1]. Therefore, applicants performed a first screen of all 195 unique MethyLight™ markers available in applicants' laboratory against ten colorectal normal-tumor pairs (TABLE 1; under Methods above) to eliminate markers that did not show evidence of tumor-associated methylation. To avoid bias either for or against markers associated with CIMP, five tumors previously characterized as CIMP+ (see Methods above; "Tissue Samples") were used, and five CIMP– tumors, and only those markers that failed to show tumor-specific methylation in either of the two groups of tumors (FIG. 1) were eliminated. It is important to note that this initial filter did not introduce a bias for or against CIMP. It merely eliminated the 103 markers that would not be informative in subsequent analyses since they are not tumor-specifically methylated (see Methods above "Selection of Type C Markers" and FIG. 1).

Three criteria were used to select markers for further evaluation. The excluded markers represent the 105 markers shown at the top, while included markers refer to the lower 92 markers in FIG. 2. First, any marker, for which the highest PMR value among these 20 samples was not at least 2 was excluded. Second, any marker for which the mean PMR for tumor samples was at least twice that of normal samples was included. Third, any marker for which all normal samples had a PMR<2, and for which all tumor samples had a PMR>2 was included. Both the second and third criteria were applied separately to both the CIMP+ tumors and CIMP– tumors, and to all ten cases collectively. A marker was included if it passed at least one of the two criteria in any of the three sample comparisons. This resulted in a collection of 92 reactions that passed this first relaxed screen for tumor-specificity. Among these 92 reactions were five methylation markers (CDKN2A (p16), MLH1, MINT1, MINT2, and MINT31) that have been commonly used to define CIMP status.

Example 3

CIMP-Specific DNA Methylation Markers were Selected

Figure 2:
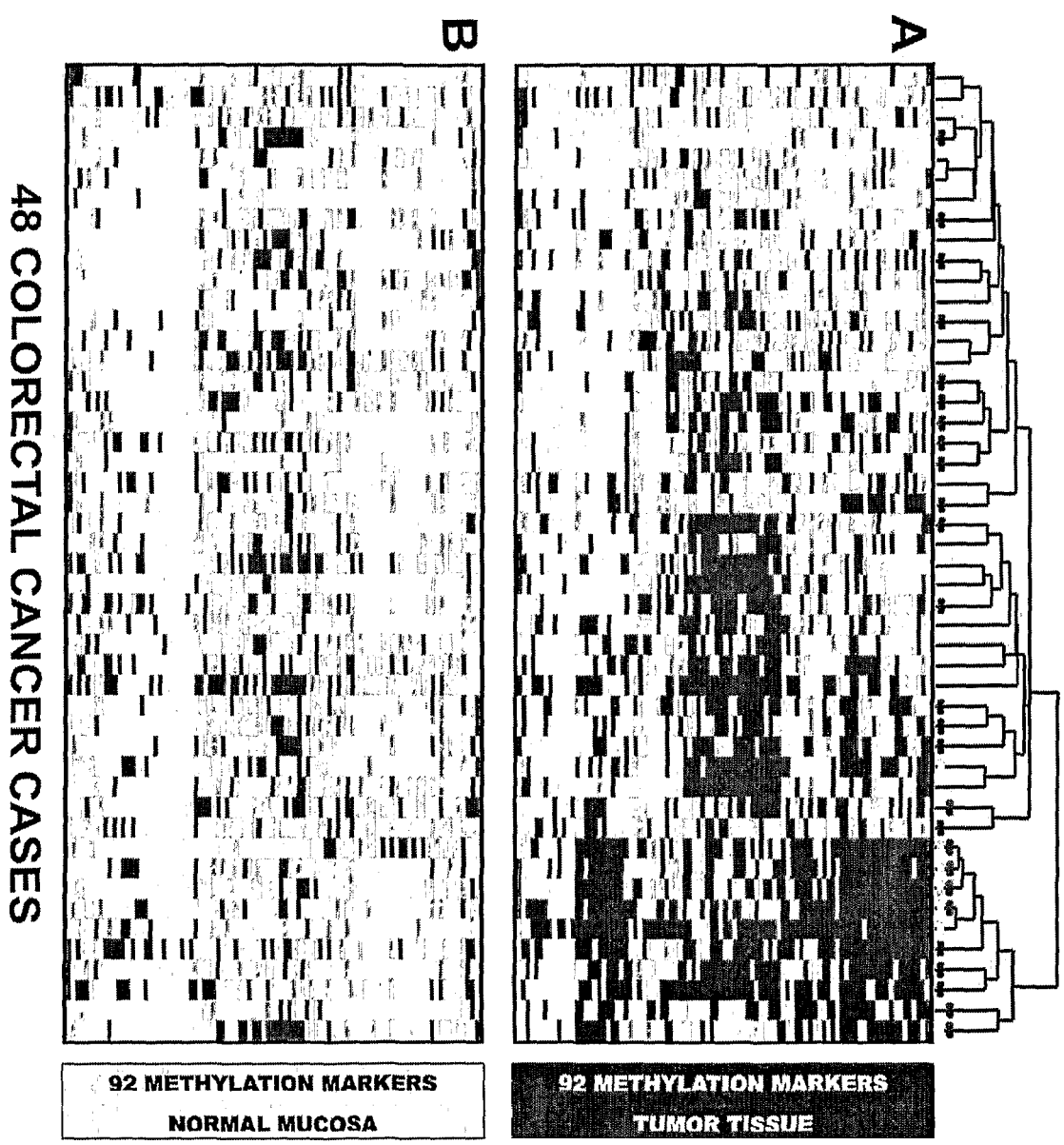
FIG. 2 shows identification of tumor clusters. Hierarchical cluster analysis of DNA samples from 48 colorectal tumor and matched normal mucosae and 92 methylation markers, performed as described in Methods (Example 1). Clustering of the cases was based on the tumor methylation data shown in the upper heatmap (Panel A). The resulting dendrogram of the cases is shown at the top, with tumors containing KRAS mutation indicated by a red rectangle overlaying the branch, while BRAF mutations are indicated by a green rectangle, and MSI-H cases are designated with a blue rectangle. Clustering of the methylation markers was performed separately for the matched normal mucosal samples (Panel B). DNA methylation quartiles are shown from very light blue-white (lowest), through light yellow (next lowest), dark yellow (third lowest) to dark red (highest methylation quartile.

Applicants next determined the methylation status of the remaining 92 tumor-specific markers in 48 independent colorectal cancer cases, and conducted a hierarchical two-dimensional unsupervised clustering of the data in order to assess if distinct subsets of methylation behavior among groups of tumors would emerge (FIG. 2). A well-defined subgroup of tumors is evident on the right-hand side of the dendrogram. Other cluster analyses, such as an index of the number of methylated loci, a Gaussian mixture model, and partitioning around medioids (PAM)[7,8] all yielded similar results (see Methods). Although applicants argue above that the initial screen that gave rise to the 92 markers used in this cluster analysis was unbiased with respect to CIMP, applicants sought additional evidence to support this contention by repeating the initial screen in FIG. 1 using only CIMP– tumors, and then repeating the cluster analysis using the resulting 50 markers. This analysis identified the same clusters as the entire subset of 92 markers. Therefore, tumor-specific markers that were selected using only CIMP– tumors were able to correctly resolve the distinct cluster, indicating that the CIMP cluster is not an anomaly caused by a bias introduced by the inclusion of CIMP+ tumors in the initial filter. Since many of the classic CIMP markers, such as CDKN2A (p16), MINT1, MINT2, MINT31, and MLH1[1,2] are more frequently methylated in the distinct subset of tumors on the right side of the dendrogram, applicants conclude that this cluster is similar to the CIMP+grouping originally identified on the basis of bimodal distribution of methylation frequency by Toyota et al.[1,2].

It is interesting to note that a different subset of CpG islands located near the center of the tumor heatmap in FIG. 2 appears to be more frequently methylated in tumor samples that do not belong to the CIMP cluster, but nevertheless show increased methylation in tumor samples compared to their matched normal mucosal counterparts. Inclusion of such markers in panels used to define CIMP could reduce the classification power of the panel, and possibly even lead one to conclude that CpG island hypermethylation is a continuous trait in colorectal cancer and that CIMP does not exist as a distinct feature[3].

Since CIMP+ tumors form a distinct subgroup of colorectal tumors, it will be important to accurately identify these tumors without having to perform cluster analysis, so that the etiology and clinical correlates of CIMP can be investigated. In order to select the best markers that could be used to identify CIMP+ tumors, applicants used the cluster routines described above to classify tumors as either CIMP+ or CIMP−. Applicants then applied four different selection algorithms to these classifications to find the markers that best identify CIMP for each algorithm (see Methods above "CIMP Marker Selection"). This resulted in nine top CIMP− predicting markers, which were selected for further study. Applicants also retained the five best additional Type-C markers as a precaution, since the CIMP marker selection described above was driven by a relatively small number of CIMP+ tumors.

To select the best possible five-marker panel from these 14 markers, applicants evaluated all 2,002 possible five-marker panels by determining each panel's bimodality, which is an intrinsic trait of each panel and does not rely on prior CIMP definitions (see Methods above; "New CIMP Classification Panel"). Applicants also considered the MethyLight™ reaction performance characteristics of each individual marker (see Methods above; "New CIMP Classification Panel"), since the robustness of the assay can significantly impact successful implementation in studies using challenging paraffin-embedded, formalin-fixed tissues. The five-marker panel that best satisfied the reaction performance criteria, and retained a high ranking (86$^{th}$ percentile) for bimodality among the 2,002 possible five-marker panels, consisted of CACNA1G, IGF2 (a non-imprinted island at this locus), NEUROG1, RUNX3, and SOCS1 (TABLE 2 (supplemental table 2) above).

Figure 3:
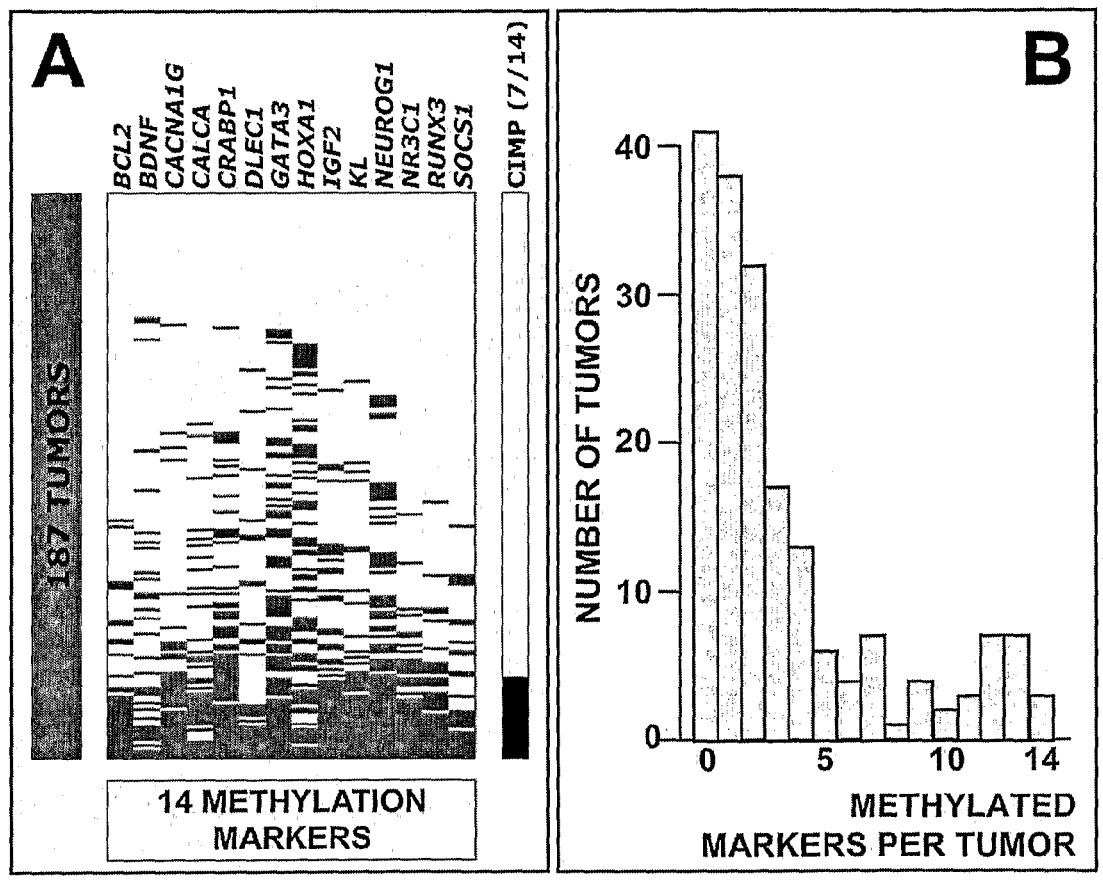
FIG. 3 shows independent testing of 14 methylation markers. The best nine CIMP markers and best five Type C markers were selected based on the data in FIG. 2 as described in Methods (Example 1) and tested on an independent set of consecutive 187 colorectal tumors. Panel A: Dichotomous heatmap of the DNA methylation data, with tumors with increasing frequency of DNA methylation sorted to the bottom. Methylation markers are arranged alphabetically. Red bars indicate PMR≧10, whereas very light blue bars indicate PMR<10. The optimal threshold for CIMP+ based on minimizing the within group sum of squared errors was 7 or more methylated markers out of 14. CIMP status defined as such is indicated for each tumor in black (CIMP+) or gray (CIMP−) to the right of the heatmap. Panel B: Histogram showing the distribution of the numbers of tumors with different numbers of methylated markers.
Figure 4:
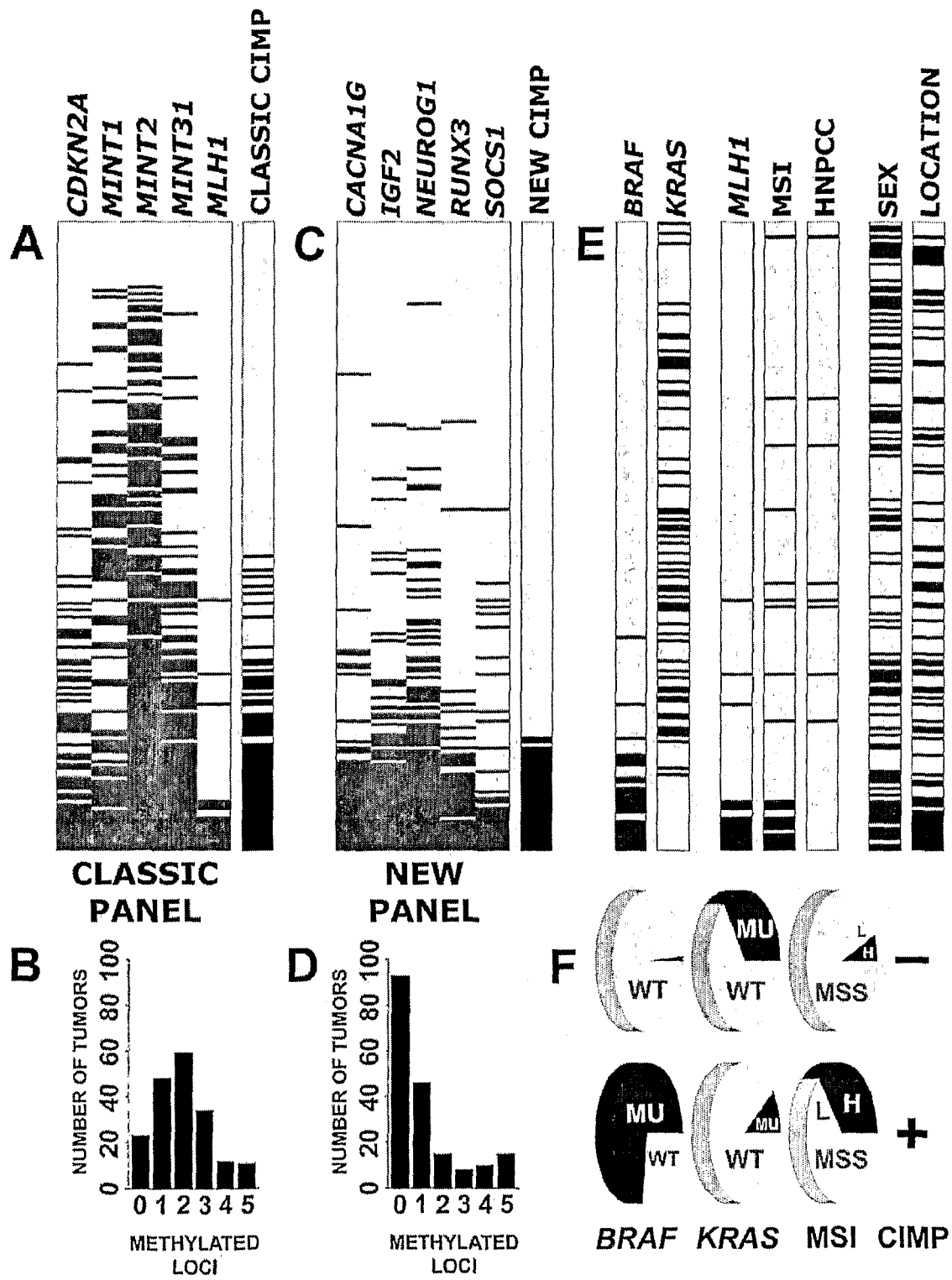
FIG. 4 shows comparison of CIMP panel performance. The 187 tumors shown in FIG. 3 were screened against two sets of CIMP markers as described in the Methods (Example 1). The data are represented as in FIG. 3A. The alignment of each tumor is maintained across panels A, C, and E. Panel A: Dichotomous heatmap representing DNA Methylation data using a classic set of CIMP markers. Panel B: Histogram of the methylation frequency distribution for the set of classic CIMP markers. Panel C: Dichotomous heatmap representing DNA Methylation data using a newly developed set of CIMP markers. Panel D: Histogram of the methylation frequency distribution for the new set of CIMP markers. For both marker panels, a tumor was considered CIMP+ if at least 3 of 5 markers were methylated. CIMP status determined by each panel is indicated to the right of each panel heatmap, with light gray indicating CIMP− and black indicating CIMP+. Panel E: Covariate status of each tumor is shown on the right, with the presence of BRAF and KRAS mutations indicated with blue bars and wild-type alleles indicated in green. Microsatellite instability (MSI) status is indicated as MSI-high (MSI-H) (blue bars), MSI-low (MSI-L) (very light blue bars), and microsatellite stable (MSS) (green bars). Cases consistent with Hereditary Non-Polyposis Colorectal Cancer (HNPCC) are indicated by blue bars. Female and proximal colonic location cases are indicated with blue bars, while male and distal colonic location cases are indicated with green bars. Panel F: Pie charts illustrating the relative frequencies of BRAF and KRAS mutations and MSI status categories for CIMP− (Top) and CIMP+ (Bottom) tumors are shown on the lower right, with color codings as described above.

Applicants used three methods to compare this new candidate diagnostic panel to a classic CIMP panel consisting of five traditional CIMP markers (CDKN2A (p16), MINT1, MINT2, MINT31, and MLH1) (FIG. 4). First, applicants determined that 99% of the 2,002 five-marker panel combinations described above showed a better bimodal distribution than the classic CIMP panel, whereas our new panel was among the top 14% of panels. Second, applicants compared the cross-panel classification error rates among various panels compiled from the 14 markers analyzed in FIG. 3 plus the five traditional CIMP markers that comprise the classic panel shown in FIG. 4 (TABLE 3 (supplemental table 3) below).

TABLE 3

(supplemental table 3).

| | Panel-19 | Panel-14 (w/o Classic) | Panel-14 (w/o New) | Panel-9 | Classic | New |
|---|---|---|---|---|---|---|
| Panel-19 (19 CIMP Genes) | 0 | 1.1 | 2.1 | 3.7 | 13.4 | 2.7 |
| Panel-14 (w/o Classic) | 1.1 | 0 | 2.1 | 3.7 | 14.4 | 2.7 |
| Panel-14 (w/o New) | 2.1 | 2.1 | 0 | 2.7 | 13.4 | 4.8 |
| Panel-9 (w/o New & w/o Classic) | 3.7 | 3.7 | 2.7 | 0 | 16.0 | 6.4 |
| Classic Panel | 13.4 | 14.4 | 13.4 | 16.0 | 0 | 15.0 |
| New Panel | 2.7 | 2.7 | 4.8 | 6.4 | 15.0 | 0 |

Cross-panel classification error rates among various CIMP classification panels, expressed as percentages. For each panel, the threshold distinguishing CIMP+ from CIMP− samples was chosen by minimizing the within group sum of squared errors. For the panels of 5 markers, samples containing at least 3 methylated markers were considered CIMP+, 4 methylated markers for panels of 9, 7 methylated markers for panels of 14, and 9 methylated markers for the panel of 19. If all panels are capturing the same information, then one would expect to find relatively low cross-panel classification error rates. The new panel of five markers outperforms the panel of classic CIMP loci in every comparison. It even gives lower classification error than the classic panel against a panel of 14 markers that includes the classic panel, but excludes the new panel. This suggests that the new panel captures the group concordance better than the classic panel.

Example 4

Assembly and Evaluation of CIMP Panels

To obtain further insight into the relative performance of these 14 markers in the classification of CIMP+ tumors, applicants analyzed a third independent set of 187 tumors using these markers, and observed a strongly bimodal distribution of tumors by number of methylated markers (FIG. 3).

The new panel of five markers outperformed the panel of classic CIMP loci in every comparison. The third strategy that applicants used to evaluate the performance of panels was to compare their associations with characteristics of colorectal cancer that have previously been reported to be associated with CIMP+ status. It is assumed that if this association reflects an important underlying biological relationship, then a superior CIMP classification would result in a stronger association. The relationships between the methylation behavior of the two panels and BRAF mutation, KRAS mutation, MSI status, HNPCC status, sex, and proximal colonic location are represented graphically in FIG. 4, while the statistical analyses using the new CIMP panel classification are summarized in TABLE 4.

TABLE 4

Distribution of covariates by New CIMP Panel.

| VARIABLE | | OVERALL | | CIMP+ (3-5 loci) | | CIMP− (0-2 loci) | | P-value |
|---|---|---|---|---|---|---|---|---|
| | | N | % | N | % | N | % | |
| TOTAL | | 187 | 100% | 33 | 18% | 154 | 82% | |
| SEX | Male | 103 | 55% | 13 | 39% | 90 | 58% | |
| | Female | 84 | 45% | 20 | 61% | 64 | 42% | 0.05 |
| SUBSITE | Proximal | 57 | 33% | 19 | 59% | 38 | 27% | |
| | Distal | 118 | 67% | 13 | 41% | 105 | 73% | 0.0005 |
| | No Info | 12 | | | | | | |
| MSI | MSI-high | 21 | 11% | 12 | 36% | 9 | 6% | |
| STATUS | MSI-low | 19 | 10% | 4 | 12% | 15 | 10% | |
| | MSS | 147 | 79% | 17 | 52% | 130 | 84% | $3.1^{-5}$ |
| HNPCC | Yes | 8 | 4% | 0 | 0% | 8 | 5% | |
| STATUS | No | 179 | 96% | 33 | 100% | 146 | 95% | 0.35 |
| MLH1 | Yes | 16 | 9% | 13 | 39% | 3 | 2% | |
| METHYLATION | No | 171 | 91% | 20 | 61% | 151 | 98% | $2.6^{-9}$ |
| BRAF | Mutant | 26 | 14% | 24 | 73% | 2 | 1% | |
| MUTATION | WT | 161 | 86% | 9 | 27% | 152 | 99% | $1.6^{-21}$ |
| KRAS | Mutant | 55 | 31% | 3 | 10% | 52 | 35% | |
| MUTATION | WT | 123 | 69% | 28 | 90% | 95 | 65% | .002 |
| | No Info | 9 | | | | | | |
| MEAN AGE (SD)* | | 65.5 (12.9) | | 68.6 (12.7) | | 64.8 (12.9) | | 0.13 |

P-values are for likelihood ratio tests from logistic regression with CIMP status as the outcome. For the variable HNPCC we report the p-value from Fisher's exact test.
*Four CIMP− subjects are missing age.

Of particular note is the extremely strong relationship between CIMP and BRAF mutation ($P=1.6\times10^{-21}$). The Odds Ratio for this association is 203 (95% CI 41, 995), a far stronger association of CIMP and BRAF mutation than any reported so far in the literature[5,9], and is a further indication of the classification accuracy of applicants' new five-marker panel.

Applicants' tight definition of CIMP appears to exclude tumors with KRAS mutation, which has been reported by others to be associated with CIMP[5,10]. To investigate this further, applicants determined the KRAS mutation status of the tumors clustered in FIG. 2. KRAS mutant tumors are distributed across the dendrogram, but show some minor clusters, which appear to be less homogeneous with respect to their methylation profile than the major CIMP cluster (FIG. 2). Interestingly, in this analysis, all of the CIMP+ tumors, with one exception, have either a BRAF or KRAS mutation.

To further investigate the association between KRAS or BRAF mutation status and methylation behavior, applicants investigated the individual associations of the 14 markers shown in FIG. 3, plus the five classic CIMP markers TABLE 4 (supplemental table 4).

All 19 markers were significantly associated with BRAF mutation. Three markers (CDKN2A, CRABP1 and NEUROG1) were positively associated with KRAS mutation after exclusion of BRAF mutant tumors, indicating that a separate KRAS-associated CIMP subgrouping exists with an overlapping set of methylation markers. The biological significance of the very tight association between the major CIMP and BRAF mutation is not clear, but it is interesting to note that transformation of fibroblasts by fos or ras oncogenes involves upregulation of DNA methyltransferase DNMT1 expression and increased global DNA methylation[11,12].

Applicants find that microsatellite instability (MSI-H), with the exception of one tumor, is fully explained by either a confirmed HNPCC association or CIMP+ associated MLH1 methylation (FIG. 4). Since MLH1 methylation-associated microsatellite instability generally does not occur among sporadic cases outside the context of CIMP, it appears that the underlying basis for mismatch repair deficiency in sporadic colorectal cancer is a broader epigenetic control defect that affects MLH1 in some but not all CIMP tumors. Therefore, an accurate classification of CIMP+ tumors will be essential to understanding the etiology of sporadic MSI-H colorectal tumors. CIMP and BRAF mutation are highly associated with the serrated pathway of colorectal cancer development[9], and therefore an epigenetic regulatory defect may be implicated in the genesis of serrated neoplasia. Dissecting the separate clinical and etiological features associated with mismatch repair deficiency, CIMP, proximal tumor location, and BRAF mutation status will further elucidate this mechanism.

Figure 5:
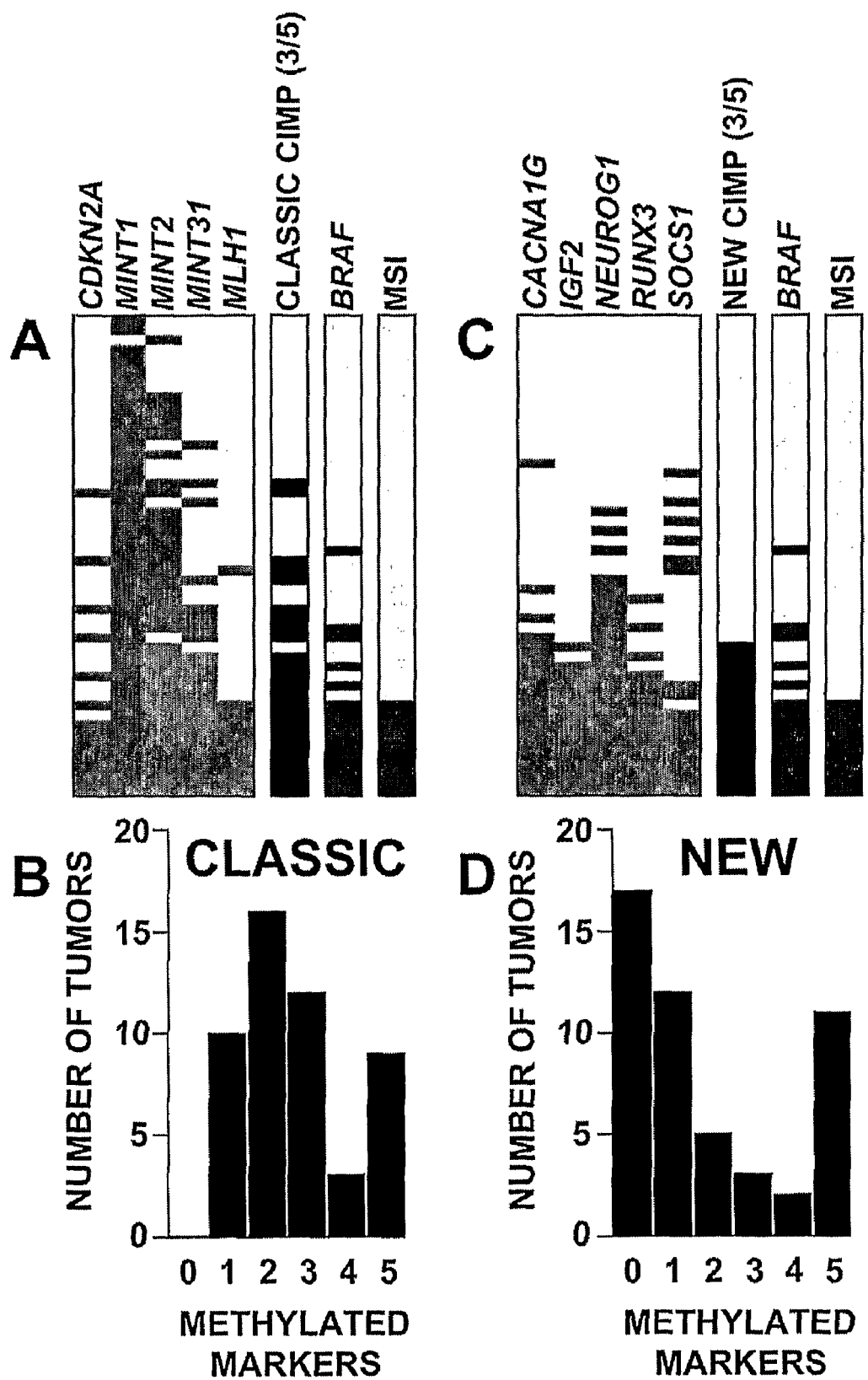
FIG. 5 shows a final independent test of CIMP panels. The classic and new CIMP panels were screened against 50 colorectal tumors obtained from the Mayo Clinic and Foundation, Rochester, Minn. These tumors were selected to include 40 MSS cases and 10 MSI-H, non-HNPCC cases to most efficiently compare the associations of the two panels on a modest number of tumors. Panel A: Dichotomous heatmap representing DNA Methylation data using a classic set of CIMP markers. Panel B: Histogram of the methylation frequency distribution for the set of classic CIMP markers. Panel C: Dichotomous heatmap representing DNA Methylation data using a newly developed set of CIMP markers. Panel D: Histogram of the methylation frequency distribution for the new set of CIMP markers. For both marker panels, a tumor was considered CIMP+ if at least 3 of 5 markers were methylated. CIMP status determined by each panel, BRAF mutation status, and MSI status is indicated to the right of each panel heatmap, with black indicating CIMP+, BRAF mutant, and MSI-H status and light gray marking CIMP−, BRAF wildtype, and MSS status.

Since the panel of tumors shown in FIGS. 3 and 4 contributed to the development of applicants' new CIMP diagnostic panel, we evaluated the new CIMP panel and the classic panel on a fourth set of independent tumors (FIG. 5). This analysis confirmed that the new panel outperforms the classic panel and easily recognizes a distinct, heavily methylated subset of colorectal tumors that encompasses almost all BRAF mutant, and sporadic MSI-H colorectal tumors.

In summary, applicants have provided definitive evidence for the existence of CIMP as a distinct trait among colorectal adenocarcinomas. Additionally, applicants have developed an improved method for the classification of CIMP (See TABLE 5 for representative preferred markers). Furthermore, applicants have found that CIMP underlies almost all cases of sporadic MSI-H colorectal cancer and tumors with mutation of the BRAF oncogene.

TABLE 4

(supplemental table 4). Methylation frequency by KRAS and BRAF status.

| Reaction | Overall (N = 187) N | % | KRAS−/ BRAF− (N = 98) N | % | KRAS+/ BRAF− (N = 55) N | % | Fisher's exact test p* | KRAS−/ BRAF+ (N = 25) N | % | Fisher's exact test p$ | Heterogeneity test p# |
|---|---|---|---|---|---|---|---|---|---|---|---|
| BCL2.M1B..HB.140. | 34 | 18% | 11 | 11% | 3 | 5% | 0.381 | 18 | 72% | 4.5E-09 | 5.6E-11 |
| BDNF.M2B..HB.258. | 32 | 17% | 11 | 11% | 7 | 13% | 0.798 | 13 | 52% | 3.1E-05 | 4.4E-05 |
| CACNA1G.M1B..HB.158. | 39 | 21% | 11 | 11% | 5 | 9% | 0.788 | 20 | 80% | 5.2E-11 | 3.2E-12 |
| CALCA.M1B..HB.166. | 37 | 20% | 10 | 10% | 9 | 16% | 0.311 | 16 | 64% | 9.7E-08 | 1.9E-07 |
| CRABP1.M1B..HB.197. | 62 | 33% | 15 | 15% | 21 | 38% | 0.003 | 23 | 92% | 6.7E-13 | 1.1E-12 |
| IGF2.M2B..HB.319. | 48 | 26% | 14 | 14% | 10 | 18% | 0.644 | 22 | 88% | 4.9E-12 | 3.7E-12 |
| KLM1B..HB.175. | 40 | 21% | 11 | 11% | 5 | 9% | 0.788 | 21 | 84% | 4.2E-12 | 2.5E-13 |
| NR3C1.M1B..HB.067. | 37 | 20% | 5 | 5% | 6 | 11% | 0.204 | 25 | 100% | 1.7E-21 | 7.8E-23 |
| RUNX3.M1B..HB.181. | 34 | 18% | 3 | 3% | 4 | 7% | 0.252 | 24 | 96% | 3.4E-21 | 5.7E-23 |
| GATA3.M1B..HB.327. | 74 | 40% | 26 | 27% | 22 | 40% | 0.103 | 25 | 100% | 3.0E-12 | 9.1E-12 |
| HOXA1.M2B..HB.268. | 69 | 37% | 36 | 37% | 15 | 27% | 0.285 | 15 | 60% | 4.2E-02 | 2.2E-02 |
| NEUROG1.M1B..HB.261. | 66 | 35% | 17 | 17% | 22 | 40% | 0.003 | 24 | 96% | 1.5E-13 | 3.6E-13 |
| SOCS1.M1B..HB.042. | 28 | 15% | 11 | 11% | 2 | 4% | 0.137 | 13 | 52% | 3.1E-05 | 8.0E-07 |
| DLEC1.M1B..HB.225. | 28 | 15% | 9 | 9% | 3 | 5% | 0.539 | 14 | 56% | 1.5E-06 | 1.9E-07 |
| MINT31.M1B..HB.162. | 82 | 44% | 29 | 30% | 24 | 44% | 0.111 | 25 | 100% | 2.0E-11 | 6.7E-11 |
| MINT1.M1B..HB.161. | 77 | 41% | 41 | 42% | 15 | 27% | 0.082 | 17 | 68% | 2.5E-02 | 2.9E-03 |
| MINT2.M1B..HB.187. | 141 | 75% | 68 | 69% | 43 | 78% | 0.264 | 24 | 96% | 4.4E-03 | 1.1E-02 |
| CDKN2A.M2B..HB.081. | 55 | 29% | 13 | 13% | 20 | 36% | 0.002 | 20 | 80% | 3.1E-10 | 4.4E-10 |
| MLH1.M2B..HB.150. | 16 | 9% | 3 | 3% | 0 | 0% | 0.553 | 12 | 48% | 1.2E-07 | 7.3E-10 |

*comparing proportion KRAS+/BRAF− to KRAS−/BRAF−
$comparing proportion KRAS−/BRAF+ to KRAS−/BRAF−
using Fisher's exact test

TABLE 5

Representative preferred markers.

| HUGO RXNNAME | RXN ID | PURPOSE | FORWARD PRIMER | REVERSE PRIMER | PROBE |
|---|---|---|---|---|---|
| 1 CACNA1G | HB-158 | CIMP Marker | TTTTTTCGTTTCGCGTTTAGGT | CTCGAAACGACTTCGCCG | 6FAM-AAATAACGCCGAATCCGACAACCGA-BHQ |
| 2 IGF2 | HB-319 | CIMP Marker | GAGCGGTTTCGGTGTCGTTA | CCAACTCGATTTAAACCGACG | 6FAM-CCCTCTACCGTCGCGAACCCGA-BHQ |
| 3 NEUROG1 | HB-261 | CIMP Marker | CGTGTAGCGTTCGGGTATTTGTA | CGATAATTACGAACACACTCCGAAT | 6FAM-CGATAACGACCTCCCGCGAACATAAA-BHQ-1 |
| 4 RUNX3 | HB-181 | CIMP Marker | CGTTCGATGGTGGACGTGT | GACGAACAACGTCTTATTACAACGC | 6FAM-CGCACGAACTCGCCTACGTAATCCG-BHQ-1 |
| 5 SOCS1 | HB-042 | CIMP Marker | GCGTCGAGTTCGTGGGTATTT | CCGAAACCATCTTCACGCTAA | 6FAM-ACAATTCCGCTAACGACTATCGCGCA-BHQ-1 |
| 6 ALU | HB-313 | Normalization Control | GGTTAGGTATAGTGGTTTATATTTGTAATTTTAGTA | ATTAACTAAACTAATCTTAAACTCCTAACCTCA | 6FAM-CCTACCTTAACCTCCC-MGBNFQ |
| 7 COL2A1 | HB-057 | Normalization Control | TCTAACAATTATAAACTCCAACCACCAA | GGGAAGATGGGATAGAAGGGAATAT | 6FAM-CCTTCATTCTAACCCAATACCTATCCCACCTCTAAA-BHQ-1 |
| 8 COL2A1 | HD-005 | Bisulfite Conversion Control | GAAGATGGGATAGAAGGGAATACATCT | CTCCAACCACCAAACCTTCATT | 6FAM-GGCCCAATGCCTGTCCCACCT-BHQ-1 |

Example 5

Use of the Colon Cooperative Family Registry (CFR) for a Population-Based Study of CIMP Further aspects of the present invention provide a foundation for a population-based study of CIMP, by providing a novel panel of very carefully selected methylation markers representing the CIMP subgroup, and having utility to classify CIMP.

Specifically, as described herein above, particular aspects of the present invention provide novel methods and compositions for determining the relationship between CIMP status and other molecular features of the cancers including, but not limited to BRAF mutation, KRAS mutation and MSI status.

Additional aspects provide novel methods and compositions for determining the relationship between CIMP status and other variables including, but not limited to age, sex, tumor location, family history, race, country of origin, tumor characteristics (including, tumor type, tumor grade, invasive margin characteristics, lymphocyte infiltration characteristics, direct spread, lymph node spread, venous spread and type of residual adjacent polyp, if present).

Yet additional aspects provide novel methods and compositions for determining, between subgroups defined by CIMP status and BRAF mutations, effects of selected risk factors including, but not limited to body mass index, smoking history, alcohol intake, dietary folate intake, folate metabolic enzyme polymorphisms and history of hormonal use.

Overview of the Colon Cooperative Family Registry (CFR)

The Cooperative Family Registry for Colorectal Cancer Studies, referred to herein (and as known in the art) as the "Colon CFR", is an NCI-supported consortium initiated in 1997 through a competitive RFA. This consortium is dedicated to the establishment of a comprehensive collaborative infrastructure for interdisciplinary studies in the genetics and genetic epidemiology of colorectal cancer. The cooperating institutions are collecting epidemiological information and laboratory specimens from families who represent the continuum of risk for CRC. Families are recruited through the participating Registry sites, and as of July, 2002, the CFR registry included data and biospecimens from approximately 7,773 probands plus selected close relatives, both affected and unaffected, and, in some centers, additional unrelated controls.

The CFR is an international consortium of six research institutions and an Informatics Center. The participating centers are at the: Fred Hutchinson Cancer Research Center, Seattle, Wash. (P.I.: John Potter); Mayo Clinic, Rochester, Minn. (P.I.: Noralane Lindor); University of Southern California, Los Angeles (P.I.: Robert Haile); University of Queensland, Brisbane, Australia (P.I.: John Hopper); Cancer Care Ontario, Ontario, Canada (P.I.: Steve Gallinger); and the University of Hawaii Cancer Research Center, Honolulu, Hi. (P.I.: Loïc Le Marchand). The Informatics Center (IC) is located at the University of California, Irvine (P.I.: Hoda Anton Culver).

The six Registry centers use standardized instruments and protocols to collect family history information, epidemiological and clinical data, screening behavior, and related biological specimens (blood samples and tumor blocks), with a strong emphasis on quality control (QC) a and privacy measures throughout the collection, processing, and storage of data and samples (see below for key components). The CFR investigators have substantially enriched the resource beyond the scope of the original RFA by obtaining two collaborative supplements, one to characterize colorectal tumors for microsatellite instability (MSI), and the other to establish lymphoblastoid cell lines for particularly informative registry participants.

The Colon CFR also developed a relevant core questionnaire that is administered to all CFR participants, including cases, controls, and affected and unaffected relatives. This standardized instrument contains core questions asked by all centers, covering established and suspected risk factors for colorectal cancer, including medical history and medication use, reproductive history (for female participants), family history, physical activity, demographics, alcohol and tobacco use, and limited dietary factors. Centers are allowed to customize questions for local usage, in particular for different language usage and brand names, and to add additional questions of interest. The method of administration of the questionnaire is allowed to vary by center and has been administered by face-to-face interview, over the telephone using a Computer-Assisted Telephone Interview (CATI), or by mail for self-administration. Detailed question-by-question manuals for administration were developed for further standardization.

In addition to the risk factor questionnaire, which includes a section on consumption of selected food items, all centers except FHCRC and Mayo also administered a detailed food frequency questionnaire. Australia used a version developed specifically for Australia. The other centers used a well validated food frequency questionnaire (FFQ) developed at the Cancer Research Center of Hawaii (CRCH) (Stram, 2000). Expertise in dietary assessment has been a strength of the Hawaii group for many years. The CRCH's Nutrition Support Shared Resource consists of faculty nutritionists, dietitians and computer programmers and includes an extensive food composition database to accommodate the diets of several US ethnic groups. This database contains more than 3,200 food items and more than 100 components (nutrients and non-nutrients) and is continuously updated with information from standard sources (such as the USDA), other sources (such as international organizations), local recipes, and special food analyses. This resource was used to develop a food composition table for the CFR FFQ which is the same as the one used in the Multiethnic Cohort Study.

The different sites of the CFR are collaborating on creating a virtual data-analysis group to take advantage of the expertise across the collaborating centers and to avoid duplication of effort. The group will develop data-analysis strategies that are suitable for the Colon CFR study population, will divide development and analytic tasks according to specific expertise, will oversee analysis for Colon CFR studies, and will contribute to the final interpretation and write-up of findings. The data analysis group includes Drs. Duncan Thomas (USC consortium), Kim Siegmund (USC consortium, and co-Investigator on this application), John Hopper (Australasian CFR), and Li Hsu (FHCRC). Drs. Hopper and Thomas serve as co-directors of this unit. They report on their activities to the Epidemiology and Analysis Working Group.

The University of Melbourne Consortium (J. Hopper, Ph.D., P. I.) recruits clinic-based families from family cancer clinics and population-based families from cancer registries and electoral rolls. During Phase I (1997-2002) 250 clinic-based families were recruited in Brisbane, Melbourne, Adelaide, Sydney, and Perth, Australia, and in Auckland, New Zealand. Clinic-based families included those with HNPCC or HNPCC-like family histories. In addition, 627 population-based CRC cases selected from the Victorian Cancer Registry in Melbourne, aged between 18 and 59 years at diagnosis, and their first- and second-degree relatives have been recruited. Also, 260 non-cancer population-based controls selected through the electoral roll and their first- and second-degree relatives have been recruited. Epidemiology/family history questionnaires were completed on all respondents by either in-person or telephone interview. Tumor blocks and blood samples have been collected on approximately 800 cases. Blood samples were collected from approximately 3,800 cases, controls and their relatives. There were 1,351 population-based probands selected and eligible. Of these, 141 were deceased and the physician refused permission to contact 85, leaving 1,125 (83%) that they were allowed to contact. Of these, they were unable to contact 174, leaving 951 probands who were selected and eligible. Of these 951, 324 (34%) refused and the remaining 627 (66%) joined the CFR. There were 1545 siblings of these 627 probands. They had permission to contact 840. Only 2 of these 840 refused to participate. Of the 705 siblings whom they had no permission to contact, they have proxy questionnaires completed by a participating relative for 675.

University of Hawaii Cancer Research Center (P.I.: Loïc Le Marchand, U01 CA74806): The Hawaii CFR site has focused on recruiting multi-case CRC families in the multiethnic population of Hawaii. This approach was originally selected in order to increase the study's efficiency by enriching the sample for genetic risk factors. All new incident CRC cases diagnosed in the state of Hawaii in 1997-2001 (n=1, 800) were screened through personal interview for family history. Those with a positive history of CRC among first-degree relatives were invited to participate in the CFR, along with their first-degree relatives. In addition, 60 multi-case families identified in a recently completed population-based, case-control family study of CRC were invited to participate in the Registry. These families were prospectively ascertained through contact with all CRC incident cases under age 60 years diagnosed between 1987 and 1996 among Japanese, Caucasian, Hawaiian and Chinese residents of Oahu (where 85% of the population of the state reside). Pedigrees have been expanded to include second-degree relatives for some large multiplex families. Epidemiology and family history questionnaires were obtained from 950 participants. In addition, 155 tumor blocks and 767 blood samples were collected. For probands, there were 2,245 selected and eligible cases. Of these, they received permission to contact 1,988 (89%). Of these 1988, they were unable to contact 41, leaving 1,947 cases. Of these 1,947 cases, 140 refused, 57 were deceased, and they lost contact with 54, so 1,696 (87%) completed a family history screening questionnaire. Of these 1,696, 1,397 were not eligible for the CFR by virtue of their family history and 51 were not selected for further recruitment, leaving 248 eligible and selected for recruitment. Of these 248, 64 refused, 8 were deceased, and they lost contact with 1, leaving 175 (70%) who participated in the CFR. The total number of siblings was 879, of whom 852 were eligible. Of these siblings, 439 (52%) participated.

The Fred Hutchinson Cancer Research Center (J. Potter, M. D., Ph.D., P. I.) identifies colorectal cancer (CRC) cases through the population-based Puget Sound SEER (NCI) Program. During Phase I (1997-2002), all incident CRC cases diagnosed between the ages of 20 and 74 in three Washington state counties and their first-degree relatives were ascertained. Age and gender-matched population-based controls were ascertained from two population lists-controls under age 65 years were recruited through driver's license lists; controls 65-74 years were selected from Health Care Finance Administration (HCFA, currently CMS) files.

Epidemiology/family history questionnaires were completed on all respondents over the telephone using a computer-assisted telephone interview (CATI) format. Tumor blocks were collected on all cases and CRC-affected family members (diagnosed less than 5 years prior to recruitment). Blood samples were collected from all cases, all family members in high-risk families, a sample of family members in non-high-risk families, and a sample of controls. During Phase I, 1,831 cases, 4,325 family members, and 1,531 population-based controls were enrolled. In addition, 1,570 tumor blocks and 2,713 blood samples were collected. For probands, initially there were 2,959 eligible. Of these, they received permission to contact 2, 733 (92%) Of these 2,733, they were unable to contact 22 and 364 were determined to be ineligible, leaving 2,347 selected and eligible. Of these 2,347, 267 refused, 185 were deceased, and they lost contact with 64, so 1,831 (78%) participated in the CFR. There were 2,225 siblings who were eligible and selected. Of these 2,225, 173 refused, 7 were deceased, and they lost contact with 66, so 1,979 siblings (89%) participated in the CFR.

The Mayo Clinic (N. M. Lindor, M.D., Principal Investigator) recruited 479 probands from high or intermediate risk families from the population-based Minnesota Cancer Surveillance System (MCSS), selected from 4,471 incident cases diagnosed over a four-year period from 1997 through 2000. Cases were surveyed for family history and high/intermediate risk families were defined as those with two or more cases of CRC, those with known familial adenomatous polyposis (FAP), those in which the proband was diagnosed under the age of 50 years, and families reporting an hereditary non-polyposis colon cancer-like (HNPCC-like) tumor spectrum. In addition, a random sampling of respondents from the MCSS was conducted until 215 randomly selected participants were identified and recruited. An additional 245 high- or intermediate-risk families were also accrued from two non-population-based sources: other Mayo Clinic Rochester patients and the North Central Cancer Treatment Group. Recruitment of high-risk families was extended to parents, affected and unaffected siblings (up to four, aiming for same sex, oldest sibs); if a parent was affected, aunts and uncles on that side of the family were also invited to enroll. Overall, 2,469 relatives of CRC probands were enrolled (provided informed consent, blood specimens, medical record access, and completed the epidemiology risk factor questionnaire). Unaffected relatives of probands can serve as controls. Spouses of individuals with cancer were also recruited as another type of control. Tumor blocks from 633 CRC participants (probands and affected relatives) and 161 non-CRC were collected and tested for microsatellite instability and immunohistochemistry for the main DNA mismatch repair gene proteins. For the population-based probands, there were initially 5,002 potentially eligible cases. Of these, the physician refused contact for 115 and 428 were deceased, so they had permission to contact 4,459. Of these 4,459,748 refused, 83 were deceased, and they lost contact with 1,776, so 1,852 (42%) completed the screening questionnaire. Of these 1,852 cases, 8 were deemed ineligible and 1,308 were not selected for further recruitment, leaving 536 selected and eligible. Of these 536 cases, 52 refused and 2 were deceased, so 482 (90%) participated in the CFR. They invited 844 siblings to participate in the CFR. Of these 844, 572 (68%) agreed to participate.

Cancer Care Ontario (S. Gallinger, M.D., P. I.): The Cancer Care Ontario site is a consortium that includes eight Regional Cancer Centers covering the entire province of Ontario. During Phase I, 8,818 incident CRC cases, diagnosed between 1997-2000, were identified from the population-based Ontario Cancer Registry. Family histories were obtained on 3,780 cases and stratified by risk (high-meets Amsterdam criteria for HNPCC; intermediate=HNPCC-like and/or other specific features such as young age, multiple polyps; low=none of the above). Recruitment (at least one core element) was successful for 70 high-risk families, 845 intermediate-risk families and 430 low-risk families (which is a 25% random sample of this larger latter group). In addition, 2,679 first- and second-degree relatives of registered probands were recruited, and 890 non-cancer, age and gender-matched population controls using residential telephone lists and 1,021 population controls using the Ontario ministry of finance property assessment file for year 2000 were also recruited. Blood samples have been obtained for 1,052 probands, 2,080 relatives, 1,289 controls, and 1,372 tumors (mostly CRC specimens from probands) have been processed. For probands, there were 8,726 eligible cases. Of these, they received permission to contact 7,229 (83%). Of these 7,229, 24 were deemed ineligible and they were unable to contact 164, leaving 7,041 who were eligible and selected. Of these 7,041 cases, 2,960 refused and 301 were deceased, leaving 3,780 (54%) who completed the screening questionnaire. Of these 3,780 cases, 1 was ineligible and 1,929 were not selected for further recruitment based on their family history, leaving 1,850 selected and eligible. Of these 1,850 cases, 217 refused, 27 were deceased, and they lost contact with 7, so 1,599 (86%) participated in the CFR. They invited 1565 siblings to join the CFR and 837 (53.5%) of these siblings participated.

The University of Southern California Consortium (R. Haile, Dr PH., P. I.) includes the Universities of Southern California, North Carolina, Colorado, Arizona, and Minnesota, Dartmouth Medical School, and the Cleveland Clinic. From the population based cancer registries of all but the last of these sub-centers, this group contacted 33% of CRC cases diagnosed in Whites over a one and a half-year period. In addition, sixty-six percent of CRC cases in African-American, Asian, and Hispanic families plus all CRC cases diagnosed under age 50 years over the preceding three years were contacted. These cases were screened for a family history of CRC. Sixteen percent of single-case families and all multiple-case families were invited to participate in the CFR. A total of 633 families from these population-based sources were recruited into the Registry. The majority (about 60%) are from multiple-case families and a substantial proportion are from racial minorities. These are supplemented by 120 HNPCC (Amsterdam criteria positive), or HNPCC-like families from the Cleveland Clinic. USC serves as the coordinating center and Dartmouth the data center for this consortium. Unaffected relatives of probands are selected as controls. For the population-based probands, there were initially 5,684 potentially eligible cases. The physician refused permission to contact 103 cases, so they had permission to contact 5,581 (98%) of these cases. Of these 5,581, they were unable to contact 191 and 656 were deemed ineligible, leaving 4,734 eligible for a screening questionnaire. Of these 4,734,413 refused, 927 were deceased, and they lost contact with 291, so 3,103 (66%) completed the family history screening questionnaire. Of these 3,103,105 were ineligible, and 1,943 were not selected for further recruitment based on their family history, leaving 1,055 selected and eligible. Of these 1,055 cases, 325 refused, 75 were deceased, and they lost contact with 22, so 633 participated in the CFR. There were 746 siblings. Of these 746, 96 were excluded (deceased, cognitively impaired, language barrier and other reasons). Of the remaining 650, 247 refused and they lost contact with 14, so 389 (60%) siblings participated in the CFR.

Informatics Center (H. Anton-Culver, Ph.D., P.I.). The NCI has designated the University of California Irvine's Epidemiology Division as the Informatics Center to support the CFR. The Informatics Center:

The CFR Informatics Center (IC) has designed and maintained a secure, data processing, storage, and retrieval system that contains the core Cancer Family Registries data with the flexibility to integrate data generated through additional studies into the core schema structure;

The IC has provided guidelines for data standardization, established methods for data transmission, developed computerized validation checks, monitors quality of data, and prepares data for reporting;

Provides statistical and study design support for the CFR investigators and generates reports for special requests and descriptive summary statistics;

Helps facilitate CFR-wide communication, coordination, and administration;

Developed and maintains a secure web site to provide relevant information to CFR members;

Developed web-based software tools allowing CFR members to query database for family characteristics, view pedigrees, download files, and create tables and charts using data from the CFR database housed at the IC; and Developed web-based software to enter, process, and tracking investigator applications to use CFR data and includes automated notifications to management when new applications are received, as well as notifications to applicants, SC and AC members and others regarding the steps in the application process.

| 47675-189 Sequence Listing Table | |
|---|---|
| Grouping | SEQ ID NOs |
| Forward/Reverse Primers (14 Select) | 1-28 |
| Forward/Reverse Primers (other genes) | 29-67 |
| Probes (14 Select) | 68-81 |
| Probes (other genes) | 82-99 |
| Amplicons (14 Select) | 100-113 |
| CpG Islands (14 Select) | 114-127 |
| Genomic DNA (14 Select) | 128-141 |
| CpG Bisulfite Up (14 Select) | 142-169 |
| Genomic Bisulfite Up (14 Select) | 170-197 |
| CpG Bisulfite Down (14 Select) | 198-225 |
| Genomic Bisulfite Down (14 Select) | 226-253 |
| Gene Coding Sequences (14 Select) | 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334 |
| Protein Sequences (14 Select) | 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335 |

| Gene | Sequence Type | SEQ ID NO |
|---|---|---|
| BCL2 | Forward Primer | 1 |
| BCL2 | Reverse Primer | 2 |
| BDNF | Forward Primer | 3 |
| BDNF | Reverse Primer | 4 |
| CACNA1G | Forward Primer | 5 |
| CACNA1G | Reverse Primer | 6 |
| CALCA | Forward Primer | 7 |
| CALCA | Reverse Primer | 8 |
| CRABP1 | Forward Primer | 9 |
| CRABP1 | Reverse Primer | 10 |
| DLEC1 | Forward Primer | 11 |
| DLEC1 | Reverse Primer | 12 |
| GATA3 | Forward Primer | 13 |
| GATA3 | Reverse Primer | 14 |
| HOXA1 | Forward Primer | 15 |
| HOXA1 | Reverse Primer | 16 |
| IGF2 | Forward Primer | 17 |
| IGF2 | Reverse Primer | 18 |
| KL | Forward Primer | 19 |
| KL | Reverse Primer | 20 |
| NEUROG1 | Forward Primer | 21 |
| NEUROG1 | Reverse Primer | 22 |
| NR3C1 | Forward Primer | 23 |
| NR3C1 | Reverse Primer | 24 |
| RUNX3 | Forward Primer | 25 |
| RUNX3 | Reverse Primer | 26 |
| SOCS1 | Forward Primer | 27 |

-continued

| Gene | Sequence Type | SEQ ID NO |
|---|---|---|
| SOCS1 | Reverse Primer | 28 |
| CDH13 | Forward Primer | 29 |
| CDH13 | Reverse Primer | 30 |
| CDKN2A | Forward Primer | 31 |
| CDKN2A | Reverse Primer | 32 |
| GATA4 | Forward Primer | 33 |
| GATA4 | Reverse Primer | 34 |
| GDNF | Forward Primer | 35 |
| GDNF | Reverse Primer | 36 |
| ITGA4 | Forward Primer | 37 |
| ITGA4 | Reverse Primer | 38 |
| MINT1 | Forward Primer | 39 |
| MINT1 | Reverse Primer | 40 |
| MINT2 | Forward Primer | 41 |
| MINT2 | Reverse Primer | 42 |
| MINT31 | Forward Primer | 43 |
| MINT31 | Reverse Primer | 44 |
| MLH1 | Forward Primer | 45 |
| MLH1 | Reverse Primer | 46 |
| NEUROD2 | Forward Primer | 47 |
| NEUROD2 | Reverse Primer | 48 |
| OPCML | Forward Primer | 49 |
| OPCML | Reverse Primer | 50 |
| PENK | Forward Primer | 51 |
| PENK | Reverse Primer | 52 |
| SCGB3A1 | Forward Primer | 53 |
| SCGB3A1 | Reverse Primer | 54 |
| SFRP2 | Forward Primer | 55 |
| SFRP2 | Reverse Primer | 56 |
| TFAP2A | Forward Primer | 57 |
| TFAP2A | Reverse Primer | 58 |
| ALU | Forward Primer | 59 |
| ALU | Reverse Primer | 60 |
| BRAF | Primer 1 | 61 |
| BRAF | Primer 2 | 62 |
| BRAF | Primar 3 | 63 |
| COL2A1 | Forward Primer | 64 |
| COL2A1 | Reverse Primer | 65 |
| COL2A1 (2) | Forward Primer | 66 |
| COL2A1 (2) | Reverse Primer | 67 |
| BCL2 | Probe | 68 |
| BDNF | Probe | 69 |
| CACNA1G | Probe | 70 |
| CALCA | Probe | 71 |
| CRABP1 | Probe | 72 |
| DLEC1 | Probe | 73 |
| GATA3 | Probe | 74 |
| HOXA1 | Probe | 75 |
| IGF2 | Probe | 76 |
| KL | Probe | 77 |
| NEUROG1 | Probe | 78 |
| NR3C1 | Probe | 79 |
| RUNX3 | Probe | 80 |
| SOCS1 | Probe | 81 |
| CDH13 | Probe | 82 |
| CDKN2A | Probe | 83 |
| GATA4 | Probe | 84 |
| GDNF | Probe | 85 |
| ITGA4 | Probe | 86 |
| MINT1 | Probe | 87 |
| MINT2 | Probe | 88 |
| MINT3 | Probe | 89 |
| MLH1 | Probe | 90 |
| NEUROD2 | Probe | 91 |
| OPCML | Probe | 92 |
| PENK | Probe | 93 |
| SCGB3A1 | Probe | 94 |
| SFRP2 | Probe | 95 |
| TFAP2A | Probe | 96 |
| ALU | Probe | 97 |
| COL2A1 | Probe | 98 |
| COL2A1 (2) | Probe | 99 |
| BCL2 | Amplicon | 100 |
| BDNF | Amplicon | 101 |
| CACNA1G | Amplicon | 102 |
| CALCA | Amplicon | 103 |
| CRABP1 | Amplicon | 104 |
| DLEC1 | Amplicon | 105 |
| GATA3 | Amplicon | 106 |
| HOXA1 | Amplicon | 107 |
| IGF2 | Amplicon | 108 |
| KL | Amplicon | 109 |
| NEUROG1 | Amplicon | 110 |
| NR3C1 | Amplicon | 111 |
| RUNX3 | Amplicon | 112 |
| SOCS1 | Amplicon | 113 |
| BCL2 | CpG Island | 114 |
| BDNF | CpG Island | 115 |
| CACNA1G | CpG Island | 116 |
| CALCA | CpG Island | 117 |
| CRABP1 | CpG Island | 118 |
| DLEC1 | CpG Island | 119 |
| GATA3 | CpG Island | 120 |
| HOXA1 | CpG Island | 121 |
| IGF2 | CpG Island | 122 |
| KL | CpG Island | 123 |
| NEUROG1 | CpG Island | 124 |
| NR3C1 | CpG Island | 125 |
| RUNX3 | CpG Island | 126 |
| SOCS1 | CpG Island | 127 |
| BCL2 | Genomic DNA | 128 |
| BDNF | Genomic DNA | 129 |
| CACNA1G | Genomic DNA | 130 |
| CALCA | Genomic DNA | 131 |
| CRABP1 | Genomic DNA | 132 |
| DLEC1 | Genomic DNA | 133 |
| GATA3 | Genomic DNA | 134 |
| HOXA1 | Genomic DNA | 135 |
| IGF2 | Genomic DNA | 136 |
| KL | Genomic DNA | 137 |
| NEUROG1 | Genomic DNA | 138 |
| NR3C1 | Genomic DNA | 139 |
| RUNX3 | Genomic DNA | 140 |
| SOCS1 | Genomic DNA | 141 |
| BCL2 | CpG Island Bisulphite Up Sense | 142 |
| BCL2 | CpG Island Bisulphite Up Antisense | 143 |
| BDNF | CpG Island Bisulphite Up Sense | 144 |
| BDNF | CpG Island Bisulphite Up Antisense | 145 |
| CACNA1G | CpG Island Bisulphite Up Sense | 146 |
| CACNA1G | CpG Island Bisulphite Up Antisense | 147 |
| CALCA | CpG Island Bisulphite Up Sense | 148 |
| CALCA | CpG Island Bisulphite Up Antisense | 149 |
| CRABP1 | CpG Island Bisulphite Up Sense | 150 |
| CRABP1 | CpG Island Bisulphite Up Antisense | 151 |
| DLEC1 | CpG Island Bisulphite Up Sense | 152 |
| DLEC1 | CpG Island Bisulphite Up Antisense | 153 |
| GATA3 | CpG Island Bisulphite Up Sense | 154 |
| GATA3 | CpG Island Bisulphite Up Antisense | 155 |
| HOXA1 | CpG Island Bisulphite Up Sense | 156 |
| HOXA1 | CpG Island Bisulphite Up Antisense | 157 |
| IGF2 | CpG Island Bisulphite Up Sense | 158 |
| IGF2 | CpG Island Bisulphite Up Antisense | 159 |
| KL | CpG Island Bisulphite Up Sense | 160 |
| KL | CpG Island Bisulphite Up Antisense | 161 |
| NEUROG1 | CpG Island Bisulphite Up Sense | 162 |
| NEUROG1 | CpG Island Bisulphite Up Antisense | 163 |
| NR3C1 | CpG Island Bisulphite Up Sense | 164 |
| NR3C1 | CpG Island Bisulphite Up Antisense | 165 |
| RUNX3 | CpG Island Bisulphite Up Sense | 166 |
| RUNX3 | CpG Island Bisulphite Up Antisense | 167 |
| SOCS1 | CpG Island Bisulphite Up Sense | 168 |
| SOCS1 | CpG Island Bisulphite Up Antisense | 169 |
| BCL2 | Genomic Bisulphite Up Sense | 170 |
| BCL2 | Genomic Bisulphite Up Antisense | 171 |
| BDNF | Genomic Bisulphite Up Sense | 172 |
| BDNF | Genomic Bisulphite Up Antisense | 173 |
| CACNA1G | Genomic Bisulphite Up Sense | 174 |
| CACNA1G | Genomic Bisulphite Up Antisense | 175 |
| CALCA | Genomic Bisulphite Up Sense | 176 |
| CALCA | Genomic Bisulphite Up Antisense | 177 |
| CRABP1 | Genomic Bisulphite Up Sense | 178 |
| CRABP1 | Genomic Bisulphite Up Antisense | 179 |
| DLEC1 | Genomic Bisulphite Up Sense | 180 |
| DLEC1 | Genomic Bisulphite Up Antisense | 181 |
| GATA3 | Genomic Bisulphite Up Sense | 182 |
| GATA3 | Genomic Bisulphite Up Antisense | 183 |

-continued

| Gene | Sequence Type | SEQ ID NO |
|---|---|---|
| HOXA1 | Genomic Bisulphite Up Sense | 184 |
| HOXA1 | Genomic Bisulphite Up Antisense | 185 |
| IGF2 | Genomic Bisulphite Up Sense | 186 |
| IGF2 | Genomic Bisulphite Up Antisense | 187 |
| KL | Genomic Bisulphite Up Sense | 188 |
| KL | Genomic Bisulphite Up Antisense | 189 |
| NEUROG1 | Genomic Bisulphite Up Sense | 190 |
| NEUROG1 | Genomic Bisulphite Up Antisense | 191 |
| NR3C1 | Genomic Bisulphite Up Sense | 192 |
| NR3C1 | Genomic Bisulphite Up Antisense | 193 |
| RUNX3 | Genomic Bisulphite Up Sense | 194 |
| RUNX3 | Genomic Bisulphite Up Antisense | 195 |
| SOCS1 | Genomic Bisulphite Up Sense | 196 |
| SOCS1 | Genomic Bisulphite Up Antisense | 197 |
| BCL2 | CpG Island Bisulphite Down Sense | 198 |
| BCL2 | CpG Island Bisulphite Down Antisense | 199 |
| BDNF | CpG Island Bisulphite Down Sense | 200 |
| BDNF | CpG Island Bisulphite Down Antisense | 201 |
| CACNA1G | CpG Island Bisulphite Down Sense | 202 |
| CACNA1G | CpG Island Bisulphite Down Antisense | 203 |
| CALCA | CpG Island Bisulphite Down Sense | 207 |
| CALCA | CpG Island Bisulphite Down Antisense | 205 |
| CRABP1 | CpG Island Bisulphite Down Sense | 206 |
| CRABP1 | CpG Island Bisulphite Down Antisense | 207 |
| DLEC1 | CpG Island Bisulphite Down Sense | 208 |
| DLEC1 | CpG Island Bisulphite Down Antisense | 209 |
| GATA3 | CpG Island Bisulphite Down Sense | 210 |
| GATA3 | CpG Island Bisulphite Down Antisense | 211 |
| HOXA1 | CpG Island Bisulphite Down Sense | 212 |
| HOXA1 | CpG Island Bisulphite Down Antisense | 213 |
| IGF2 | CpG Island Bisulphite Down Sense | 214 |
| IGF2 | CpG Island Bisulphite Down Antisense | 215 |
| KL | CpG Island Bisulphite Down Sense | 216 |
| KL | CpG Island Bisulphite Down Antisense | 217 |
| NEUROG1 | CpG Island Bisulphite Down Sense | 218 |
| NEUROG1 | CpG Island Bisulphite Down Antisense | 219 |
| NR3C1 | CpG Island Bisulphite Down Sense | 220 |
| NR3C1 | CpG Island Bisulphite Down Antisense | 221 |
| RUNX3 | CpG Island Bisulphite Down Sense | 222 |
| RUNX3 | CpG Island Bisulphite Down Antisense | 223 |
| SOCS1 | CpG Island Bisulphite Down Sense | 224 |
| SOCS1 | CpG Island Bisulphite Down Antisense | 225 |
| BCL2 | Genomic Bisulphite Down Sense | 226 |
| BCL2 | Genomic Bisulphite Down Antisense | 227 |
| BDNF | Genomic Bisulphite Down Sense | 228 |
| BDNF | Genomic Bisulphite Down Antisense | 229 |
| CACNA1G | Genomic Bisulphite Down Sense | 230 |
| CACNA1G | Genomic Bisulphite Down Antisense | 231 |
| CALCA | Genomic Bisulphite Down Sense | 232 |
| CALCA | Genomic Bisulphite Down Antisense | 233 |
| CRABP1 | Genomic Bisulphite Down Sense | 234 |
| CRABP1 | Genomic Bisulphite Down Antisense | 235 |
| DLEC1 | Genomic Bisulphite Down Sense | 236 |
| DLEC1 | Genomic Bisulphite Down Antisense | 237 |
| GATA3 | Genomic Bisulphite Down Sense | 238 |
| GATA3 | Genomic Bisulphite Down Antisense | 239 |
| HOXA1 | Genomic Bisulphite Down Sense | 240 |
| HOXA1 | Genomic Bisulphite Down Antisense | 241 |
| IGF2 | Genomic Bisulphite Down Sense | 242 |
| IGF2 | Genomic Bisulphite Down Antisense | 243 |
| KL | Genomic Bisulphite Down Sense | 244 |
| KL | Genomic Bisulphite Down Antisense | 245 |
| NEUROG1 | Genomic Bisulphite Down Sense | 246 |
| NEUROG1 | Genomic Bisulphite Down Antisense | 247 |
| NR3C1 | Genomic Bisulphite Down Sense | 248 |
| NR3C1 | Genomic Bisulphite Down Antisense | 249 |
| RUNX3 | Genomic Bisulphite Down Sense | 250 |
| RUNX3 | Genomic Bisulphite Down Antisense | 251 |
| SOCS1 | Genomic Bisulphite Down Sense | 252 |
| SOCS1 | Genomic Bisulphite Down Antisense | 253 |
| BCL2 | Alpha isoform mRNA | 254 |
| BCL2 | Alpha isoform protein | 255 |
| BCL2 | Beta isoform mRNA | 256 |
| BCL2 | Beta isoform protein | 257 |
| BDNF | mRNA | 258 |
| BDNF | Protein | 259 |
| CACNA1G | mRNA Sequence for alpha 1G subunit (isoform 1) | 260 |

-continued

| Gene | Sequence Type | SEQ ID NO |
|---|---|---|
| CACNA1G | Protein sequence for alpha 1G subunit (isoform 1) | 261 |
| CACNA1G | mRNA Sequence for alpha 1G subunit (isoform 2) | 262 |
| CACNA1G | Protein Sequence for alpha 1G subunit (isoform 2) | 263 |
| CACNA1G | mRNA Sequence for alpha 1G subunit (isoform 3) | 264 |
| CACNA1G | Protein Sequence for alpha 1G subunit (isoform 3) | 265 |
| CACNA1G | mRNA Sequence for alpha 1G subunit (isoform 4) | 266 |
| CACNA1G | Protein Sequence for alpha 1G subunit (isoform 4) | 267 |
| CACNA1G | mRNA Sequence for alpha 1G subunit (isoform 5) | 268 |
| CACNA1G | Protein Sequence for alpha 1G subunit (isoform 5) | 269 |
| CACNA1G | mRNA Sequence for alpha 1G subunit (isoform 6) | 270 |
| CACNA1G | Protein Sequence for alpha 1G subunit (isoform 6) | 271 |
| CACNA1G | mRNA Sequence for alpha 1G subunit (isoform 7) | 272 |
| CACNA1G | Protein Sequence for alpha 1G subunit (isoform 7) | 237 |
| CACNA1G | mRNA Sequence for alpha 1G subunit (isoform 8) | 274 |
| CACNA1G | Protein Sequence for alpha 1G subunit (isoform 8) | 275 |
| CACNA1G | mRNA Sequence for alpha 1G subunit (isoform 9) | 276 |
| CACNA1G | Protein Sequence for alpha 1G subunit (isoform 9) | 277 |
| CACNA1G | mRNA Sequence for alpha 1G subunit (isoform 10) | 278 |
| CACNA1G | Protein Sequence for alpha 1G subunit (isoform 10) | 279 |
| CACNA1G | mRNA Sequence for alpha 1G subunit (isoform 11) | 280 |
| CACNA1G | Protein Sequence for alpha 1G subunit (isoform 11) | 281 |
| CACNA1G | mRNA Sequence for alpha 1G subunit (isoform 12) | 282 |
| CACNA1G | Protein Sequence for alpha 1G subunit (isoform 12) | 283 |
| CACNA1G | mRNA Sequence for alpha 1G subunit (isoform 13) | 284 |
| CACNA1G | Protein Sequence for alpha 1G subunit (isoform 13) | 285 |
| CACNA1G | mRNA Sequence for alpha 1G subunit (isoform 14) | 286 |
| CACNA1G | Protein Sequence for alpha 1G subunit (isoform 14) | 287 |
| CACNA1G | mRNA Sequence for alpha 1G subunit (isoform 15) | 288 |
| CACNA1G | Protein Sequence for alpha 1G subunit (isoform 15) | 289 |
| CALCA | Transcript variant 1 mRNA | 290 |
| CALCA | Transcript variant 1 protein | 291 |
| CALCA | Transcript variant 2 mRNA | 292 |
| CALCA | Transcript variant 2 protein | 293 |
| CALCA | Transcript variant 3 mRNA | 294 |
| CALCA | Transcript variant 3 protein | 295 |
| CRABP1 | mRNA | 296 |
| CRABP1 | protein | 297 |
| DLEC1 | Transcript variant DLEC1-N1 mRNA | 298 |
| DLEC1 | Transcript variant DLEC1-N1 protein | 299 |
| GATA3 | Isoform 1 mRNA | 300 |
| GATA3 | Isoform 1 protein | 301 |
| GATA3 | Isoform 2 mRNA | 302 |
| GATA3 | Isoform 2 protein | 303 |
| HOXA1 | Transcript variant 1 mRNA | 304 |
| HOXA1 | Transcript variant 1 protein | 305 |
| HOXA1 | Transcript variant 2 mRNA | 306 |
| HOXA1 | Transcript variant 2 protein | 307 |
| IGF2 | mRNA | 308 |
| IGF2 | protein | 309 |

125
-continued

| Gene | Sequence Type | SEQ ID NO |
|---|---|---|
| KL | Transcript variant 1 mRNA | 310 |
| KL | Transcript variant 1 protein | 311 |
| KL | Transcript variant 2 mRNA | 312 |
| KL | Transcript variant 2 protein | 313 |
| NEUROG1 | mRNA | 314 |
| NEUROG1 | protein | 315 |
| NR3C1 | Transcript variant 1 mRNA | 316 |
| NR3C1 | Transcript variant 1 protein | 317 |
| NR3C1 | Transcript variant 2 mRNA | 318 |
| NR3C1 | Transcript variant 2 protein | 319 |
| NR3C1 | Transcript variant 3 mRNA | 320 |
| NR3C1 | Transcript variant 3 protein | 321 |
| NR3C1 | Transcript variant 4 mRNA | 322 |
| NR3C1 | Transcript variant 4 protein | 323 |

126
-continued

| Gene | Sequence Type | SEQ ID NO |
|---|---|---|
| NR3C1 | Transcript variant 5 mRNA | 324 |
| NR3C1 | Transcript variant 5 protein | 325 |
| NR3C1 | Transcript variant 6 mRNA | 326 |
| NR3C1 | Transcript variant 6 protein | 327 |
| NR3C1 | Transcript variant 7 mRNA | 328 |
| NR3C1 | Transcript variant 7 protein | 329 |
| RUNX1 | Isoform 1 mRNA | 330 |
| RUNX1 | Isoform 1 protein | 331 |
| RUNX1 | Isoform 2 mRNA | 332 |
| RUNX1 | Isoform 2 protein | 333 |
| SOCS1 | mRNA | 334 |
| SOCS1 | protein | 335 |

Amplicon Table

| HUGO Gene Name | Amplicon Sequence | Accession No. | Amplicon Location | Amplicon Length |
|---|---|---|---|---|
| BCL2 | CCGCATCCCGGGACCCGGTC GCCAGGACCTCGCCGCTGCA GACCCCGGCTGCCCCCGGCG CCGCCGCGGGGCCTGCGCTC AGCC (SEQ ID NO: 100) | Widschwendter, M. et al Cancer Res 64, 3807-3813 (2004); GenBank Number NM00633 | 672-755 (in GenBank entry) | 82 |
| BDNF | CGCACCGGGCTGGCTCCTCT GTCCGGCCCGGGAGCCCGAG GCGCTACGGGGTGCGCGGGA CAGCGAGCGGGCG (SEQ ID NO: 101) | GenBank Number AC103796 | 3794-3866 | 72 |
| CACNA1G | CTTCTTCGCTTCGCGCCCAG GCTCCGGTTGCCGGATTCGG CGCTACCTTCGGCGAAGCCG CCCCGAG (SEQ ID NO: 102) | GenBank Number AC021491 | 48345-48411 | 66 |
| CALCA | GTTCTGGAAGCATGAGGGTG ACGCAACCCAGGGGCAAAGG ACCCCTCCGCCCATTGGTTG CTGTGCACTGGCGGAACTTT CCCGACCCACAGCGGCGGGA A (SEQ ID NO: 103) | GenBank Number X15943 | 1706-1806 | 100 |
| CRABP1 | TCGAAATTCTCGCTGCTGCG CATCTTCCAGGTGCCGGCGA AGTTGGGCATGGTGGCGGTG GCGGCGGCGGCAGGTACGGA CA (SEQ ID NO: 104) | GenBank Number AC011270 | 122142-122223 | 81 |
| DLEC1 | TCGCTGCGCACCCAAGATAT CTCGCACTTGCTCACCGGCG TCTTCCGCAACTTGTACTCA GCCGAGGTCATCGGCGACGA AGTGAGCGCAAGCTTGATCA AGGCCCGCGGCAGCGAGAAT GAGCGCCACG (SEQ ID NO: 105) | GenBank Number AP006309 | 19959-20088 | 129 |
| GATA3 | TGCACCGGGACGGAATCGTC CACCCGACCCGAATGAATTG GCAGGAGCCGCGGCCACATT TAAAGGGCCAGAGCGCGCGT (SEQ ID NO: 106) | GenBank Number AL390294 | 51880-51959 | 79 |
| HOXA1 | CTGCCCACTAGGAAGCGGTC GTCGCCGCCGCAACTGTTGG CGCTGACCGCGCACGACTGG AAAGTTGTAATCCTATGGTC CGA (SEQ ID NO: 107) | GenBank Number AC004079 | 78138-78220 | 82 |

-continued

Amplicon Table

| HUGO Gene Name | Amplicon Sequence | Accession No. | Amplicon Location | Amplicon Length |
|---|---|---|---|---|
| IGF2 | GAGCGGCCCCGGTGCCGCCACCGCCTGTCCCCCTCCCGAGGCCCGGGCTCGCGACGGCAGAGGGCTCCGTCGGCCCAAACCGAGCTGG (SEQ ID NO: 108) | GenBank Number AC132217 | 108633-108720 | 87 |
| KL | AGCCTGGCTCCCGCGCAGCATGCCCGCCAGCGCCCCGCCGCGCCGCCCGCGGCCGCCGCCGCAGTCGCTGTCGCTGCTGCTGGTGCTGCTGGGCCTGGGCGGCCGCCGCCTGCGTGCGGAGCCGGGCG (SEQ ID NO: 109) | GenBank Number AB009667 | 2062-2189 | 127 |
| NEUROG1 | CGTGCAGCGCCCGGGTATTTGCATAATTTATGCTCGCGGGAGGCCGCCATCGCCCCTCCCCCAACCCGGAGTGTGCCCGTAATTACCG (SEQ ID NO: 110) | GenBank Number AC005738 | 75342-75429 | 87 |
| NR3C1 | GGGTGGAAGGAGACGCCGCAGCCGGAGCGGCCGAAGCAGCTGGGACCGGGACGGGGCACGCGCGCCCGGAAGCCC (SEQ ID NO: 111) | GenBank Number AY436590 | 1786-1861 | 75 |
| RUNX3 | GACGGGCAGCGTCTTGTTGCAGCGCCAGTGCGAGGGCAGCACGGAGCAGAGGAAGTTGGGGCTGTCGGTGCGCACGAGCTCGCCTGCGTGGTCCGCCAGCACGTCCACCATCGAGCG (SEQ ID NO: 112) | GenBank Number AL023096 | 64646-64762 | 116 |
| SOCS1 | CGAGCCCGTGGGCACCTTCCTGGTGCGCGACAGCCGCCAGCGGAACTGCTTTTTCGCCCTTAGCGTGAAGATGGCCTCGG (SEQ ID NO: 113) | Fiegl, H. et al Cancer Epidemiol Biomarkers Prey 13,882-888 (2004); GenBank Number DQ086801 | 2808-2887 | 79 |

SEQUENCE LISTING (335 sequences)

SEQ ID NO: 1 - DNA, 20 bp, artificial sequence
  BCL2 forward primer (6FAM--BHQ-1)
tcgtatttcgggattcggtc

SEQ ID NO: 2 - DNA, 19 bp, artificial sequence
  BCL2 reverse primer (6FAM--BHQ-1)
aactaaacgcaaaccccgc

SEQ ID NO: 3 - DNA, 23 bp, artificial sequence
  BDNF forward primer (6FAM--BHQ-1)
cgtatcgggttggtttttttgtt

SEQ ID NO: 4 - DNA, 16 bp, artificial sequence
  BDNF reverse primer (6FAM--BHQ-1)
cgcccgctcgctatcc

SEQ ID NO: 5 - DNA, 22 bp, artificial sequence
  CACNA1G forward primer (6FAM--BHQ-1)
ttttttcgtttcgcgtttaggt

SEQ ID NO: 6 - DNA, 18 bp, artificial sequence
  CACNA1G reverse primer (6FAM--BHQ-1)
ctcgaaacgacttcgccg

SEQ ID NO: 7 - DNA, 23 bp, artificial sequence
  CALCA forward primer (6FAM--BHQ-1)
gttttggaagtatgagggtgacg

SEQ ID NO: 8 - DNA, 19 bp, artificial sequence
  CALCA reverse primer (6FAM--BHQ-1)
ttcccgccgctataaatcg

SEQ ID NO: 9 - DNA, 21 bp, artificial sequence
  CRABP1 forward primer (6FAM--BHQ-1)
tcgaaattttcgttgttgcgt

SEQ ID NO: 10 - DNA, 19 bp, artificial sequence
  CRABP1 reverse primer (6FAM--BHQ-1)
tatccgtacctaccgccgc

SEQ ID NO: 11 - DNA, 28 bp, artificial sequence
  DLEC1 forward primer (6FAM--BHQ-1)
tcgttgcgtatttaagatatttcgtatt

SEQ ID NO: 12 - DNA, 22 bp, artificial sequence
  DLEC1 reverse primer (6FAM--BHQ-1)
cgtaacgctcattctcgctacc

SEQ ID NO: 13 - DNA, 20 bp, artificial sequence
  GATA3 forward primer (6FAM--BHQ-1)
tgtatcgggacggaatcgtt

SEQ ID NO: 14 - DNA, 18 bp, artificial sequence
  GATA3 reverse primer (6FAM--BHQ-1)
acgcgcgctctaaccctt

SEQ ID NO: 15 - DNA, 23 bp, artificial sequence
  HOXA1 forward primer (6FAM--BHQ-1)
ttgtttattaggaagcggtcgtc

SEQ ID NO: 16 - DNA, 26 bp, artificial sequence
  HOXA1 reverse primer (6FAM--BHQ-1)
tcgaaccataaaattacaactttcca

SEQ ID NO: 17 - DNA, 20 bp, artificial sequence
  IGF2 forward primer
gagcggtttcggtgtcgtta

SEQ ID NO: 18 - DNA, 21 bp, artificial sequence
  IGF2 reverse primer
ccaactcgatttaaaccgacg

SEQ ID NO: 19 - DNA, 25 bp, artificial sequence
  KL forward primer
agtttggttttcgcgtagtatgttc

SEQ ID NO: 20 - DNA, 15 bp, artificial sequence
  KL reverse primer (6FAM--BHQ-1)
cgcccgactccgcac

SEQ ID NO: 21 - DNA, 23 bp, artificial sequence
  NEUROG1 forward primer (6FAM--BHQ-1)
cgtgtagcgttcgggtatttgta

SEQ ID NO: 22 - DNA, 25 bp, artificial sequence
  NEUROG1 reverse primer (6FAM--BHQ-1)
cgataattacgaacacactccgaat

SEQ ID NO: 23 - DNA, 21 bp, artificial sequence
  NR3C1 forward primer (6FAM--BHQ-1)
gggtggaaggagacgtcgtag

SEQ ID NO: 24 - DNA, 17 bp, artificial sequence
  NR3C1 reverse primer (6FAM--BHQ-1)
aaacttccgaacgcgcg

SEQ ID NO: 25 - DNA, 19 bp, artificial sequence
  RUNX3 forward primer (6FAM--BHQ-1)
cgttcgatggtggacgtgt

SEQ ID NO: 26 - DNA, 25 bp, artificial sequence
  RUNX3 reverse primer (6FAM--BHQ-1)
gacgaacaacgtcttattacaacgc

SEQ ID NO: 27 - DNA, 21 bp, artificial sequence
  SOCS1 forward primer (6FAM--BHQ-1)
gcgtcgagttcgtgggtattt

SEQ ID NO: 28 - DNA, 21 bp, artificial sequence
  SOCS1 reverse primer (6FAM--BHQ-1)
ccgaaaccatcttcacgctaa

SEQ ID NO: 29 - DNA, 21 bp, artificial sequence
  BCL2 forward primer (6FAM--BHQ-1)
aatttcgttcgttttgtgcgt

SEQ ID NO: 30 - DNA, 20 bp, artificial sequence
  CDH13 reverse primer (6FAM--BHQ-1)
ctacccgtaccgaacgatcc

SEQ ID NO: 31 - DNA, 22 bp, artificial sequence
  CDKN2A forward primer (6FAM--BHQ-1)
tggagttttcggttgattggtt

SEQ ID NO: 32 - DNA, 19 bp, artificial sequence
  CDKN2A reverse primer (6FAM--BHQ-1)
aacaacgcccgcacctcct

SEQ ID NO: 33 - DNA, 21 bp, artificial sequence
  GATA4 forward primer (6FAM--BHQ-1)
gatggtggtcgcgtgaagtta

SEQ ID NO: 34 - DNA, 23 bp, artificial sequence
  GATA4 reverse primer (6FAM--BHQ-1)
ttccctccatatacgaactaccg

SEQ ID NO: 35 - DNA, 23 bp, artificial sequence
  GDNF forward primer (6FAM--BHQ-1)
cggtagttgtcgttgagtcgttc

SEQ ID NO: 36 - DNA, 23 bp, artificial sequence
  GDNF reverse primer (6FAM--BHQ-1)
aacaaccgccgctactttaaata

SEQ ID NO: 37 - DNA, 17 bp, artificial sequence
  ITGA4 forward primer (6FAM--BHQ-1)
tgcggaggcgtagggtc

SEQ ID NO: 38 - DNA, 19 bp, artificial sequence
  ITGA4 reverse primer (6FAM--BHQ-1)
caaccgaaattccccaacg

SEQ ID NO: 39 - DNA, 22 bp, artificial sequence
  MINT1 forward primer (6FAM--BHQ-1)
gggttgaggttttttgttagcg

SEQ ID NO: 40 - DNA, 23 bp, artificial sequence
  MINT1 reverse primer (6FAM--BHQ-1)
cccctctaaacttcacaacctcg

SEQ ID NO: 41 - DNA, 18 bp, artificial sequence
  MINT2 forward primer (6FAM--BHQ-1)
ttgagtggcgcgtttcgt

SEQ ID NO: 42 - DNA, 18 bp, artificial sequence
  MINT2 reverse primer (6FAM--BHQ-1)
tccccgcctaaaccaacc

SEQ ID NO: 43 - DNA, 25 bp, artificial sequence
  MINT31 forward primer (6FAM--BHQ-1)
gtcgtcggcgttattttagaaagtt

SEQ ID NO: 44 - DNA, 17 bp, artificial sequence
  MINT31 reverse primer (6FAM--BHQ-1)
caccgacgcccaacaca

SEQ ID NO: 45 - DNA, 21 bp, artificial sequence
  MHL1 forward primer (6FAM--BHQ-1)
aggaagagcggatagcgattt

SEQ ID NO: 46 - DNA, 21 bp, artificial sequence
  MLH1 reverse primer (6FAM--BHQ-1)
tcttcgtccctccctaaaacg

SEQ ID NO: 47 - DNA, 27 bp, artificial sequence
  NEUROD2 forward primer (6FAM--BHQ-1)
ggtttggtatagaggttggtatttcgt

SEQ ID NO: 48 - DNA, 18 bp, artificial sequence
  NEUROD2 reverse primer (6FAM--BHQ-1)
acgaacgccgacgtcttc

SEQ ID NO: 49 - DNA, 18 bp, artificial sequence
  OPCML forward primer (6FAM--BHQ-1)
cgtttcgaggcggtatcg

SEQ ID NO: 50 - DNA, 20 bp, artificial sequence
  OPCML reverse primer (6FAM--BHQ-1)
cgaaccgccgaaattatcat

SEQ ID NO: 51 - DNA, 34 bp, artificial sequence
  PENK forward primer (6FAM--BHQ-1)
ggttaattataaagtggttttagtagtcgttaag

SEQ ID NO: 52 - DNA, 24 bp, artificial sequence
  PENK reverse primer (6FAM--BHQ-1)
caacgtctctacgaaatcacgaac

SEQ ID NO: 53 - DNA, 15 bp, artificial sequence
  SCGB3A1 forward primer (6FAM--BHQ-1)
ggcgtagcgggcgtc

SEQ ID NO: 54 - DNA, 26 bp, artificial sequence
  SCGB3A1 reverse primer (6FAM--BHQ-1)
ctacgtaaccctatcctacaactccg

SEQ ID NO: 55 - DNA, 24 bp, artificial sequence
  SFRP2 forward primer (6FAM--BHQ-1)
gcgttttagtcgtcggttgttagt

SEQ ID NO: 56 - DNA, 24 bp, artificial sequence
  SFRP2 reverse primer (6FAM--BHQ-1)
aaacgaccgaaattcgaacttatc

SEQ ID NO: 57 - DNA, 30 bp, artificial sequence
  TFAP2A forward primer (6FAM--BHQ-1)
cgttaatttttaaagtatttttatggatcg

SEQ ID NO: 58 - DNA, 21 bp, artificial sequence
  TFAP2A reverse primer (6FAM--BHQ-1)
ccgacaaccaacactttacgc

SEQ ID NO: 59 - DNA, 36 bp, artificial sequence
  ALU forward primer (6FAM--BHQ-1)
ggttaggtatagtggtttatatttgtaattttagta

SEQ ID NO: 60 - DNA, 33 bp, artificial sequence
  ALU reverse primer (6FAM--BHQ-1)
attaactaaactaatcttaaactcctaacctca

SEQ ID NO: 61 - DNA, 22 bp, artificial sequence
  BRAF Primer 1
gtgattttggtctagctactgt

SEQ ID NO: 62 - DNA, 39 bp, artificial sequence
  BRAF primer 2
cgcggccggccgcggcggtgattttggtctagctaccga

SEQ ID NO: 63 - DNA, 23 bp, artificial sequence
  BRAF primer 3
tagcctcaattcttaccatccac

SEQ ID NO: 64 - DNA, 28 bp, artificial sequence
  COL2A1 forward primer (6FAM--BHQ-1)
tctaacaattataaactccaaccaccaa

SEQ ID NO: 65 - DNA, 25 bp, artificial sequence
  COL2A1 reverse primer (6FAM--BHQ-1)
gggaagatgggatagaagggaatat

SEQ ID NO: 66 - DNA, 27 bp, artificial sequence
  COL2A1(2) forward primer (6FAM--BHQ-1)
gaagatgggatagaagggaatacatct

SEQ ID NO: 67 - DNA, 22 bp, artificial sequence
  COL2A1(2) reverse primer (6FAM--BHQ-1)
ctccaaccaccaaaccttcatt

SEQ ID NO: 68 - DNA, 28 bp, artificial sequence
  BCL2 probe (6FAM--BHQ-1)
acgacgccgaaaacaaccgaaatctaca

SEQ ID NO: 69 - DNA, 22 bp, artificial sequence
  BDNF probe (6FAM--BHQ-1)
ccgtaacgcctcgaactcccga

SEQ ID NO: 70 - DNA, 25 bp, artificial sequence
  CACNA1G probe (6FAM--BHQ-1)
aaataacgccgaatccgacaaccga

SEQ ID NO: 71 - DNA, 30 bp, artificial sequence
  CALCA probe (6FAM--BHQ-1)
attccgccaatacacaacaaccaataaacg

SEQ ID NO: 72 - DNA, 27 bp, artificial sequence
  CRABP1 probe (6FAM--BHQ-1)
accatacccaacttcgccgacacctaa

SEQ ID NO: 73 - DNA, 29 bp, artificial sequence
  DLEC1 probe (6FAM--BHQ-1)
taatcaaacttacgctcacttcgtcgccg

SEQ ID NO: 74 - DNA, 32 bp, artificial sequence
  GATA3 probe (6FAM--BHQ-1)
aaatataaccgcgactcctaccaattcattcg

SEQ ID NO: 75 - DNA, 26 bp, artificial sequence
  HOXA1 probe (6FAM--BHQ-1)
tcgtacgcgatcaacgccaacaatta

SEQ ID NO: 76 - DNA, 22 bp, artificial sequence
  IGF2 probe
ccctctaccgtcgcgaacccga

SEQ ID NO: 77 - DNA, 21 bp, artificial sequence
  KL probe (6FAM--BHQ-1)
cgaacgacgcgacgaaacgct

SEQ ID NO: 78 - DNA, 26 bp, artificial sequence
  NEUROG1 probe (6FAM--BHQ-1)
cgataacgacctcccgcgaacataaa

SEQ ID NO: 79 - DNA, 25 bp, artificial sequence
  NR3C1 probe (6FAM--BHQ-1)
gtcccgatcccaactacttcgaccg

SEQ ID NO: 80 - DNA, 25 bp, artificial sequence
  RUNX3 probe (6FAM--BHQ-1)
cgcacgaactcgcctacgtaatccg

SEQ ID NO: 81 - DNA, 26 bp, artificial sequence
  SOCS1 probe (6FAM--BHQ-1)
acaattccgctaacgactatcgcgca

SEQ ID NO: 82 - DNA, 20 bp, artificial sequence
  CDH13 probe (6FAM--BHQ-1)
aacgcaaaacgcgcccgaca

SEQ ID NO: 83 - DNA, 18 bp, artificial sequence
  CDKN2A probe (6FAM--BHQ-1)
acccgaccccgaaccgcg

SEQ ID NO: 84 - DNA, 24 bp, artificial sequence
  GATA4 probe (6FAM--BHQ-1)
cctatcccgaatccgtcaatcccg

SEQ ID NO: 85 - DNA, 24 bp, artificial sequence
  GDNF probe (6FAM--BHQ-1)
cgcgcgtcgcgctcttaactaaaa

SEQ ID NO: 86 - DNA, 26 bp, artificial sequence
  ITGA4 probe (6FAM--BHQ-1)
cctacaaccgcgcgtaaacaaaaacg

SEQ ID NO: 87 - DNA, 31 bp, artificial sequence
  MINT1 probe (6FAM--BHQ-1)
ctacttcgcctaacctaacgcacaacaaacg

SEQ ID NO: 88 - DNA, 19 bp, artificial sequence
  MINT2 probe (6FAM--BHQ-1)
cttacgccaccgcctccga

SEQ ID NO: 89 - DNA, 22 bp, artificial sequence
  MINT31 probe (6FAM--BHQ-1)
acgctccgctcccgaataccca

SEQ ID NO: 90 - DNA, 31 bp, artificial sequence
  MLH1 probe (6FAM--BHQ-1)
cccgctacctaaaaaaatatacgcttacgcg

SEQ ID NO: 91 - DNA, 28 bp, artificial sequence
  NEUROD2 probe (6FAM--BHQ-1)
cgccatacgaaccgcgaaacgaatataa

SEQ ID NO: 92 - DNA, 29 bp, artificial sequence
  OPCML probe (6FAM--BHQ-1)
aacaactccatccctaaccgccactttct

SEQ ID NO: 93 - DNA, 21 bp, artificial sequence
  PENK probe (6FAM--BHQ-1)
aacgcctacctcgccgtcccg

SEQ ID NO: 94 - DNA, 30 bp, artificial sequence
  SCGB3A1 probe (6FAM--BHQ-1)
cgaactcctaacgcgcacgataaaacctaa

SEQ ID NO: 95 - DNA, 27 bp, artificial sequence
  SFRP2 probe (6FAM--BHQ-1)
cgaacccgctctcttcgctaaatacga

SEQ ID NO: 96 - DNA, 29 bp, artificial sequence
  TFAP2A probe (6FAM--BHQ-1)
cgaaaccgaaaaaaacatatccgttcacg

SEQ ID NO: 97 - DNA, 16 bp, artificial sequence
  ALU probe (6FAM--MGBNFQ)
cctaccttaacctccc

SEQ ID NO: 98 - DNA, 36 bp, artificial sequence
  COL2A1 probe (6FAM--BHQ-1)
ccttcattctaacccaatacctatcccacctctaaa

SEQ ID NO: 99 - DNA, 21 bp, artificial sequence
  COL2A1(2) probe (6FAM--BHQ-1)
ggcccaatgcctgtcccacct

SEQ ID NO: 100 - DNA, 84 bp, artificial sequence
  BCL2 amplicon
ccgcatcccgggacccggtcgccaggacctcgccgctgcagaccccggctgcccccggcgccgccgcggggcctgcgctcagcc

SEQ ID NO: 101 - DNA, 73 bp, artificial sequence
  BDNF amplicon
cgcaccgggctggctcctctgtccggcccgggagcccgaggcgctacggggtgcgcgggacagcgagcgggcg

SEQ ID NO: 102 - DNA, 67 bp, artificial sequence
  CACNA1G amplicon
cttcttcgcttcgcgcccaggctccggttgccggattcggcgctaccttcggcgaagccgccccgag

SEQ ID NO: 103 - DNA, 101 bp, artificial sequence
  CALCA amplicon
gttctggaagcatgagggtgacgcaacccaggggcaaaggacccctccgcccattggttgctgtgcactggcggaactttcccgacccacagcggcgggaa

SEQ ID NO: 104 - DNA, 82 bp, artificial sequence
  CRABP1 amplicon
tcgaaattctcgctgctgcgcatcttccaggtgccggcgaagttgggcatggtggcggtggcggcggcggcaggtacggaca

SEQ ID NO: 105 - DNA, 130 bp, artificial sequence
  DLEC1 amplicon
tcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacg

SEQ ID NO: 106 - DNA, 80 bp, artificial sequence
  GATA3 amplicon
tgcaccgggacggaatcgtccacccgacccgaatgaattggcaggagccgcggccacatttaaagggccagagcgcgcgt

SEQ ID NO: 107 - DNA, 83 bp, artificial sequence
  HOXA1 amplicon
ctgcccactaggaagcggtcgtcgccgccgcaactgttggcgctgaccgcgcacgactggaaagttgtaatcctatggtccga

SEQ ID NO: 108 - DNA, 88 bp, artificial sequence
  IGF2 amplicon
gagcggccccggtgccgccaccgcctgtccccctcccgaggcccgggctcgcgacggcagagggctccgtcggcccaaaccgagctgg

SEQ ID NO: 109 - DNA, 128 bp, artificial sequence
  KL amplicon
agcctggctcccgcgcagcatgcccgccagcgccccgccgcgccgcccgcggccgccgccgcagtcgctgtcgctgctgctggtgctgctgggcctgggcggccgccgcctgcgtgcggagccgggcg

SEQ ID NO: 110 - DNA, 88 bp, artificial sequence
  NEUROG1 amplicon
cgtgcagcgcccgggtatttgcataatttatgctcgcgggaggccgccatcgcccctcccccaacccggagtgtgcccgtaattaccg

SEQ ID NO: 111 - DNA, 75 bp, artificial sequence
  NR3C1 amplicon
gggtggaaggagacgccgcagccggagcggccgaagcagctgggaccgggacggggcacgcgcgcccggaagccc

SEQ ID NO: 112 - DNA, 117 bp, artificial sequence
  RUNX3 amplicon
gacgggcagcgtcttgttgcagcgccagtgcgagggcagcacggagcagaggaagttggggctgtcggtgcgcacgagctcgcctgcgtggtccgccagcacgtccaccatcgagcg

SEQ ID NO: 113 - DNA, 80 bp, artificial sequence
  SOCS1 amplicon
cgagcccgtgggcaccttcctggtgcgcgacagccgccagcggaactgctttttcgcccttagcgtgaagatggcctcgg

SEQ ID NO: 114 - DNA, 1101 bp, Homo sapiens
taacctttcagcatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggtaggtgcacttggtgatgtgagtctgggctgaggccacaggtccgagatgcgggggttggagtgcgggtgggctcctggggcaatgggaggctgtggagccggcgaaataaaatcagagttgttgcttcccggcgtccctacctcctcctctggacaaagcgttcactcccaacctgaccgataacgcctgccatctaaaagtctttaacttgcttgc

SEQ ID NO: 115 - DNA, 1401 bp, Homo sapiens
tcccatcacgcagctctgggtctcctccaggccttccctcctctacttcgtgacttccccgggtccctttttccctggtggtgccggctgaccttctgggttgtgggatgggggagaaaactccccaagagtaactccaaatcgtcccttctaccggaggggaggaaagaaggagactggcctcgtcccacaactttggggtgggggatcccccagtcaactctctcccgcggacgggcagctcctgcaccaagccccattcccagcgcttgcctacctcggggtccacacaaacctcacgggtccccggcggcggagtcacatcgtggttccgattctggctccagcgcccagccccggtccccgtcgcggtgctgctccccgccggccccacagcagcggtgggtgtctcattaaagccccccgagcaggaggtggaggggcgcaccgggctggctcctctgtccggcccgggagcccgaggcgctacggggtgcgcgggacagcgagcgggcgggtgcgcccgggcgcggcggcggcagcggcggggacccggagctccaggctgcgccttgcgcccgggtcagacattatttagctcttcggttgagcttcgattggtcaaacggcgccgccccccccccccgccccccgccccccgctccccgctcgcccgcgctaccgatacccgttcgaggcggccgcttaaagggaacgccgcgtcttttcctcgcgcggggaaccgaggggcgcccggaactccccgctcccccggggcctgtcctcacctcctcccctagggccccgcgacatcgccctgcgagtcctgcgccctcctggggcgccttggacaggacgcccgcggcttcgaggggtgttccagccccagcctcagccccggggaaccccgcgtcccgcgccctctgcagaaaccccggctgtgggcgctggggcgggagggagcgagtgagaatcgcacgccccgaggtctcgctcccctagctttcaactctccccttcctccccatcccagcacccaagttctctgggagagggcgtgcgtttcccgggccacagacacaccttcccgcaccttcctgcactacggagcttgcgaacgcgagcacacaatgaaatcgcacagagcatgggggctattggtttactctgctgccttaaacacgccggcttaaacagagttcgcgcactgacctctctagagtttgcctaataggaattcaatcaagataataacagcattttttattgatgaacgcccccagataacgttacaccaagttacttgttccagccaggaagcccaggcaatgacagacctcgctaaagccacacgctttctagccgaccaaacagaaaaacggaaagagaaagaaagaaaac

SEQ ID NO: 116 - DNA, 1968 bp, Homo sapiens
aggagattgcggtcccccctcctccgtccccgcagcttcctccccaccgcccccacccaccccccaccaaactcggaaaccaaacccagctcgctaaccggcgcgggcagagtacagctcccaggctcccgaagcttcccacatctggaggatgacgaccctcccctgaccacatctggagggcgtccagctgcgagccagcggggcacagctctcttctcctggcctggatccccacccccccaacccaggaagactgaggtgtgtgtacgcaggtggggtaagcccgggttaccgacgagacctgctcgcgtctccgctcccactctggtgccccctcccctccctggcagccccccccccatccgcctaccctccgggctcacttcgactcacctggcggtgggtcttcttcccccccgacccccggcggtgcggcccgtcccccttctgaccccgcgcctggccgtcgtgccccgaaggatatgggttacagaccgtgcggagacaccagctccgcgggcggctgtcctggctcaagtagaagaaaaccaccggggccagcgccgggtacggcagcccctccgcctcggagtccgcgctgcccgggtccttttctgctgaccccggccccggccggcccccggcccccgacaggtcgttgagccgcatgaagctccggggctgtcccgactcctcggcgcccgctccatcctcctcctcgtccatcctctggccagccggggccccgggcgatccggagaggggcaagcggcgcccctcagaggaggtgtcctcacgcaacccgggggccccggcgggggcacatctggtgggctctagggcgcaagctgagcccccgggagggccagttcagcccagctccccctgcccgcaggggcatgctgcccgcggggcgccggggcgcagggaaaccccgcccggcgcgagtcccgcttcccctgcgcccctggggcttcccgggccagccggccggctccccctcactttgttccggcttcttcgcttcgcgcccaggctccggttgccggattcggcgctaccttcggcgaagccgccccgagagggcgaacgaaaaggggggcagcggcggagggcgggggtccggggaggggcgccccctcttcccgcggcgcagctggagccggatctaaggggtcagcatcgtcccggctccgcgccaggcggcgggggaggggaggagggatctctttaggggtgggcttggagggggtgggggcggctccttcccccgccccgccgcgggctcactgtccgggaggggcgggagacagtggggggcagtcccgggcgggagtggaggcggagatgccgccgccgcagccgccgcggtggctgccgctgccgtagctgtcgccggcgccacagcctcctcctccggccgagacgcggagcgagcgagcgaaagcggcggcgaggagccccgcgcacaccacagctggatccctcacttcaacttcaagcctcggccccgcccccagacagccccgcagccaatcgccggacgccgccggccccgagccgcgcgcccattggccgtccgccgtggcagtgcgggcgggagcgcagggagagaaccacagctggaatccgattcccaccccaaaacccaggaccgcccctctcccctccccttgcccctgggtccgctcccgaaggctggagccaatcagactgctgcccagaccgaacccactttcctattggccattggggtctttgggactcccttggagggagcccgaagaatcagagtattcggcgcggggtcctggcgtagggccgcaggccccaggcatcctttgtccacgacccctgatttgggcagcagccggaggacggagctcagctctgggcgggcctggggaagaaaggagacaggcggcacgggggtgagggttgtcaccagggggtcccagagcgaaa

SEQ ID NO: 117 - DNA, 746 bp, Homo sapiens
gcgttacttgttggtgcccccaccatcccccaccatttccatcaatgacctcaatgcaaatacaagtgggacggtcctgctggatcctccaggttctggaagcatgagggtgacgcaacccaggggcaaaggacccctccgcccattggttgctgtgcactggcggaactttcccgacccacagcggcgggaataagagcagtcgctggcgctgggaggcatcagagacactgcccagcccaagtgtcgccgccgcttccacagggctctggctggacgccgccgccgccgctgccaccgcctctgatccaagccacctcccgccaggtgagccccgagattctggctcaggtatatgtctctccctccctctccctccattcgtcattttctcactccctttcctcctctccctctctctccgttagtctcttcatcagatagtctctgttagtccgcgatttataccagctcgtgccctaggttggatcggacagtctcaatcccccggctcgctcttcctgctcggctgcggactccagtcttactctctcgcactgcacacaggcttaggccagtctcgggacactcaggctccccagggaccgcgcacagagcctgaggcaagagaaactttccgcagacggtgcgatcagggacggcgtctggagcccagcagtcccagggaaattggttcagaacctggaacagagcggatgggtggcaaataggcacgacgactgagg

SEQ ID NO: 118 - DNA, 2098 bp, Homo sapiens
ttggagaaggggagggagacattctgtcactttttaaataagtggtagcaccggtgattatttttccatctggttaaccaaatgcaatttttgcccatgcaaaaaacgaatgtacaaccccttgcttcaatccaccggttcatccctgggccgatgcatggagaaataaaaaaaaactcttgcccttgaggactaagagagggcaactagtccattttcccagccagaacctgccttgcttttggaaagactccgccgttcctttaaggaaccaggccgaaggcgggaagggagaggtgacggggccatcgggactgctaaaactgtatccagagcgtacccaggcggcccagggacccgggcgggcgcgggggatacggcgggaaaggaatgcaagagctgcggcttcacctgcgacagagaacctggcggctcctgcaacctcctcctcctcctgcgccgcctgcgcttggcgctgcaaaccgctgcaaaagccactgctgggaacgcggcgcaacccagagcccgctctttaagcgcggctgttagcaccccgggaggcagcgtagggatggggttgagatggaatgaaggtaatactttgtcttgagccaggggcaactaggatgcacaaaccccctctgcaaacagccagtgtacacaccctgcaaggaaggcgcgccacaggctgcaaagggagacacaggttcctccagcagcagtgggccatgggcaccgagcggggacacggggacgctgtagtggctctggggcctcaccctgcacttgcgtccgtccacggtctcctcctcaaagccttctccgaccttgaagttgatctcagtggtgcgcaccgtggtggatgtcttgatgtagaactgatccccgtcctggcggatctccacgtgcggcttggacgcagccgctacggccactttcctcagcatggcgttcacacctgcgcagggtgcaccacaggcttgggtcacggggcctcgccgccagtctcgggaccggtcgggcactggtcataccctaactttagaaaggggccttaaaattgatccactcgtttccctgccctcgcccttgttttcgagatgagagactgaggcacagagagggtaagtgactttcctcgagttgcacagtgaattcgtggcagagcctggtcccaaatttgagtctccaaatttaagtccctgatcctccttgctctccagtaatctctcctcgctatgatctagcacgagataaagtccgcaccatcgaggagggcgccaaacattcagcaaacgttcgctgaacgcgtgggttccgggatctctaccagcttctccgagacccggtgcgcctgggagacaaggcgatctattgccccggggactccctcctgcctgggctccccaacttccaccccctccaggaccggggcacttccgggaccagggcacctccgggccgcatctccccgtcggggcgcgccctctgcaccagcttacccagtgccttgagcagctcgtcgaaattctcgctgctgcgcatcttccaggtgccggcgaagttgggcatggtggcggtggcggcggcggcaggtacggacagcggcggcgcagcgggcacactctgagctcgcaaggcggagactggcgctttgcgcccagcgctgcgcgccttgagtcactaggagagcgcccccaaccccgccgggcttctggccccgccccgccggccctgcccccgctcccccgcagcccctactcggtatgcgctcaactcccagcccagttgtgcctcagcctccagaggtgcgggcacccgctctccaactggggagcctccacctccctcaggacacccacatcccgctttaaaatgggtggtgggagagggttagctgaaacaagatgggcttggaggggataactgttgaagctgggcggtgtggacttgggttatgattctacttttctctctacttttgaatatgtttgaaaatatccataacataaacttaaagtggatagcgagcggggccatcaggggatgggacccactcttttttcacctccggtcgtacctactgggtgtgcccaga

SEQ ID NO: 119 - DNA, 1105 bp, Homo sapiens
caataaatatgatgagtgaatgaacagttgcttaacaaattaaagaatggatgaaggtaggtagttaggtacaaggttttgcagataggcctggctgtgtcaattaaacctttcttcatgggtcctcacacttagtaagctcacttttaaaaggacaatgctgaagacacaaatgtttacaatgaccacagcgatgacgggatccgagagaaaggcaaggcggaaggggtgaggccggaagccgaagtgccgcagggagttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcaggtaacgtggcggtggcgtcgcgtctgcggacggtgccggggtctcagcgctcggcacgcgtcagcacctgccaggtgccaggcgctgttccaggatctggggctgcagttgagaaacagcccatcatgccgaagtgggcccgacattctagtggaaggacgctctatccatacacacacatgcgcaaataccacacataccacacaacgtgcggcatatatctgtagcacctgtctatatttctctagacacatacgttatatattgcatatatcaatgaacgactgcggcagaccgctgaatagttgttccatggagaggataaagccaaaagtcacccggctttggggtgcctttgtatcacaaaccacaatcttgactgggccattcatgcgcagattttaggaagcgtgtc

SEQ ID NO: 120 - DNA, 3476 bp, Homo sapiens
acatttcactaatctttctacagggatagtgttttaaaacacgacgaccctcacacaccaaggtgaagttgaatattgttgttgttccttcaccgcatgaaaggaatccttcagaacttactttcagggacggcttcttctatctcgaatttttgcatttgtagggaattttatggggtagaggagcgaagagggaacaatgtctccaattcaaataaaaccccaaattaagctctcagccccatcggtgggatagcctgcgggggaacccactccctctcctggcagcattgccctgggggcgagcagagagtggatttggagtcttcttttcccgcctgacccctgctcgcccgagcagcattttcgggccagcggctgcagccacccgggcgccgctaggggatgcagtggctcaaaggaccgagcgggcggtgcaggttggaacccgcggggcggaccaatcgcggctcggccacagcctcgcccgctgattggtccctccaggccccgcccccgctcgccccgcccctctcgctggggcgcctcggagccgcgtgccctccgccccggggtgcccattgcgcagagcgtggcctggagacccgcgagccggggaaggtcgccgtggagtcccgaccagaggccggggttggggtcggtgcagaccgagggctggtttccttgactgtgggagaaacgccgggagccggagtaagtagggctccgggcggggcgaaaggaaaagttgggtccctagagtgaagaccgagttctttctgtccgtctacactgagcgtactcggggaatgagttagagccagtctcttcctcccctccccccttctcatccctcactgttgccactcaagtcaaaagcacacattgattacaaatattaggtctggaaagggcagctgcaacagctgaagcgtgttcactctgggggcttgagagcgcagaaggctcgggaaagaggtgacaatgacaacaaaattgacgcggacgctccagtcaaaggcatctcccctttatccgatgactcaccctcttaggaagtcggcccgagaggcaaatctcaaaataccttgacatgaaacattttgtttttctgatcaatttaacgcgcacgtttccccacatcgatgcgctctcccaaacaccctgcattagatcctaataatgatccatgcgtgcctattttttaaaagtctgaaaaagaaaattctgcccatcgaaatgaacttcatgaatggggcaggctggctgcaccgggacggaatcgtccacccgacccgaatgaattggcaggagccgcggccacatttaaagggccagagcgcgcgttccctcccgtccgcccccaagccccgcgggcctcgcccaccctgcccgccgcccctccgccggcggccgccctctgcggcgcccctttccggtcagtggaggggcgggaggaggggcgggggtgcgcggggcggggggagaagtcctggagcgggtttgggttgcagtttccttgtgccggggatcctgtcccctactcgccagcgccaggctcctcccccccggcgcggatgacactagaacctccttaagttgcgtcgcgccacagctgtctgcgaacactgagctgcctggcgccgtcttgatactttcagaaagaatgcattccctgtaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggttggtactggtgactttttttttttttaagtttgattttttgcccccaaccacttgggaggacctaaatcaattttaaaaactcaactctcctcttttggaggttttctaggggctgagaggacggtcccgggaccggtgtccccgagggagggacttgccctccaagtcgtaacagtcagccctgggacttgccctccaagttgctcagccagccccggctcccgcgagccgggctgcagggacgtccccgagagccctgcgggctccgcggccgtgtccccgcgctcccgtgcgggtctcgggtgcgctgggcgggcgggcggcgcgaggggaggttgtgccactccagcaactcaggggctcatccaggtctcccattctctcccttgcaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacggtgagtgcgcccggggtgccggggctcccgccggccgcttcagccgtcccggctcggggaggtcgggagggacctgagggcggggagaggtcaagcgaaagcccccatctgccgttcctggttcatttacaaaaaaattggggcccggaaatgggcgaggaaggcctctggctcgtcgcgagagtgtgttttgaaagagtcgcagcaggcgcctctcccggctggtggccctggggcctggcgctcacctggcgggcgccaggccgcagccctccgtctctgcgcggctgcaggttttggggtggggggtctcgggatgtccccaagcgcggggtgccctggctctgcctccgcgggtccgggctctctgggcccggtagccggcgccggacaagcacggctggaacccggctcttccaaaaaacctggcgttccctgttacccgctagctctttctaggcgggtgggcggggtggagggggccctctgccagcgtccctcaattcgcacattttcagaaaggccccagagacctatttattcacacccttctccttgaccttttcccagagctagtgcctttggtttttagacaggctcttacctcctggcttcaggaatggaattctgatgctgaaggggtt

SEQ ID NO: 121 - DNA, 2101 bp, Homo sapiens
aaaagtctgcgctggagaagatgtctccgatgcgggggagcgacaggcttcttggtggctggcgtggagaggggacaaggagttattatacgtagccagggccaggctctggtgctcctgtccatatgagtggtgaatgtattgaggcgagcccaccgcgcccccagcataaccctggtggtggtggtgatgctggaccatgggagatgagagatttccagagtaaacagcgggagcgcactgggggtacccaccacttacgtctgcttcctgatttaacgcgtaggggctgtaaggcgcactgaagttctgtgagccatagcttggaccacaacttgagtgggagtaggacacccccaggttcccggaagtctggtaggtagccggctgggggtggcgatggtggtggtggtggtggtggtggggcgaaccgatctgcacccccctgcccactaggaagcggtcgtcgccgccgcaactgttggcgctgaccgcgcacgactggaaagttgtaatcctatggtccgaggggtaggctcgggctgagcaggtccccgagtcgccactgctaagtatggggtattccaggaaggagttcattcttgcattgtccatctgtcactgagtgacctggtcctgcgaagcccggcgtgactgtgccaactttctcacttcctccatggggccggagaagaaaaatgatatgaatgtacagtgcgcaagagggggggcgggagggcggaggacgctggaggaggggcacgtgacggtgtcagccaatggctgagcctcctgcaaaagtttgccggcttccgcagtgatggatcaccgttttagtggcatttaaatccccggcgctccgccgtctaggtgacgcgcagtcgcccccccaggcagcctaggcggcggcagctgctgcggcgactgcaaaggccgatttggagtgctggagcgaagaagagcaaaagctgcgttctgcgcgcgcccgactccgctgcccgccccgccaggcctccgggaggtgggggctgggaggcgtcccccgctcccgccccctccccaccgttcaatgaaagatgaactggcgagaggtgagaagggaagagggctcccggctctctcggggcgggaatcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggctcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattcgacttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcacagggccggtccacagctccaacatagtagctgaactcccttcgttgcgttcctctttttctggaggggaatgttagaagagagagagagcttccttttataaccttcctcattctgctgcacgtctagagtgggtgtgggggctggcaggtgggaggggcggtggacaaatggctgatggtggacgggacactttaccccaacgacacctcctcccctttccaactggctgtgtagttgcttatgagaaccttcaagtccttccctagagagacacatgcaaatctga

SEQ ID NO: 122 - DNA, 4005 bp, Homo sapiens
aaattcccaatttcatatggagaattttctttaactacccctcctcacaaattggtcccccaagctagctggcccctatttgagacctctttctctatgttcccaattgcatggagcaacttctctcatcccccaaacctgtaatctatttttctggagtctcgagtttagtcattaatcacggttcccacattaacggagtccccggggtcccctcctccaggacacccattcgctaagcccgcaaggcagaaagaactctgccttgcgttccccaaaatttgggcattgttcccggctcgccggccacccactgcagcttccccaaccccgcgcacagcgggcactggtttcgggcctctctgtctcctacgaagtccccagagcaactcggatttgggaaatttctctctagcgttgcccaaacacacttgggtcggccgcgcgccctcaggacgtggacagggagggcttccccgtgtccaggaaagcgaccgggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcggtgagctccccgccgcgccgatcccctccgcctctgcgcccctgaccggctctcggcccgcatctgctgctgtcccgccggtgctggcgctcgtctccggctgccgccggggaggccggcgtggggcgcgggacacggctgcggacttgcggctggcggctgcgctcgctcctgctgggcgccccgaaatccgcgccactttcgtttgctcattgcaaagatctcatttgtggggaaagcggctggagggtcccaaagtggggcgggcagggggctggggcgagggacgcggaggagaggcgctcccgccgggcggtaaagtgcctctagcccgcgggcctaggactccgccgggaggcgcgcgcggagcgcgggcgaagtgattgatggcggagcgaggggggcgaggggggccaggggggcgcgagattccgccggcggccccttccccttggctaggcttaggcggcggggggctggcggggtgcgggattttgtgcgtggtttttgacttggtaaaaatcacagtgctttcttacatcgttcaaactctccaggagatggtttccccagacccccaaattatcgtggtggcccccgagaccgaactcgcgtctatgcaagtccaacgcactgaggacggggtaaccattatccagatattttgggtgggccgcaaaggcgagctacttagacgcaccccggtgagctcggccatgcaggtaggatttgagctgtgtttcccgccctgatcctctctcctctggcggccggagcctccgtaggctccaagcctggcccagattcggcccggcgcagccggccttccgcgcgtcccgcacctggcgggggctccggggctccggcgcggcaccggggggcgctcgggatctggctgaggctccaagcgccgcgtggccggctcctcctgctggggcaggtggcggctgcgcgccccgcccgagcccaggggccccctcagccgcaacaaccagcaaggaccccccgactcagccccaagccacctgcatctgcactcagacggggcgcacccgcagtgcagcctcctggtggggcgctgggagcccgcctgcccctgcctgcccggagaccccagctcacgagcacaggccgcccgggcaccccagaaacccgggatggggcccctgaattctctagaacgggcattcagcatggccttggcgctctgcggctccctgccccccacccagcctcgcccccgcgcaccccccagcccctgcgaccgccgccccccccccggggccccagggcccccagcccgcaccccccgccccgctcttggctcgggttgcgggggcgggccgggggcggggcgagggctccgcgggcgcccattggcgcgggcgcgaggccagcgaggcccgcgcgggccctgggccgcgggctggcgcgactataagagccgggcgtgggcgcccgcagttcgcctgctctccggcggagctgcgtgaggcccggccggccccggccccccccttccggccgcccccgcctcctggcccacgcctgcccgcgctctgcccaccagcgcctccatcgggcaaggcggccccgcgtcgacgccgcccgctgcctcgctgctgactcccgtcccgggcgccgtccgcggggtcgcgctccgccgggcctgcggattccccgccgcctcctcttcatctacctcaactccccccatccccgcttcgcccgaggaggcggttccccccgcaggcagtccggctcgcaggccgccggcgttgtcacccccccccgcgctccccctccagccctccccccggcgcgcagcctcgggccgctcccctttccgcgctgcgtcccggagcggccccggtgccgccaccgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccaggtaagcggcgtgtgcgggccgggccggggccggggctggggcggcgcgggcttgcgccggacgcccggcccttcctccgcccgctcccggcccggggcctgcggggctcggcggggcggctgagcccgggggggaggaggaggaggaggaggaggacggacggctgcgggtcccgttccctgcgcggagccccgcgctcaccctggcggcggagctgggggtggggtgggggcgtcgggaagggccgagggaggtgtgaggtgtctgcaggggcgacttcccggtcggtctgtgggtgcagggggtgccgcctcacatgtgtgattcgtgccttgcgggccctggcctccggggtgctgggtaacgaggaggggcgcggagccgcagaagcccaccctggtatgttgacgcggtgccagcgagaccgcgagaggaagacgggggtgggcggggccaggatggagaggggccgagttggcaggagtcatggcagacgccacattcgcgacatctcccccacaccccctctggctctgtccgcaacatttccaaacaggagtcccgggagagggggagaggggctgctggtctgaggctaagaagggcagagccttcgacccggagagaggccgcggcccctgcccagtgggcagcgtggaagtttccatacaaggaggtgggaag

SEQ ID NO: 123 - DNA, 1955 bp, Homo sapiens
aatgagatttactcaaaattggaaacttggtgtttggtttttcaggagaacaatcaacgactgtgatttgaagttcaccagggtattctgagagatctaatcaaagatagagtgctggtttgaaattattaaaaggtaacagtaaaagggagagcaaaaccccagtcccaacgcaacccataaatctactttgtcttcctcgaaagaggggcgcgggtgggcgcgtctccccgcgagcatctcacctaagggggaatccctttcagcgcacggcgaagttccccctcggctgtcccacctggcagtccctctaggatttcggccagtccctaattggctccagcaatgtccagccggagcttctttgggcctccgagtgggagaaaagtgagagcaggtgcttccccagcggcgcgctccgctagggcccggcaggatcccgcccccaagtcgggaaaagttggtcggcgccttttctccccgacgaagccgctccagggctgctctcagaggacgcgcggcaggcaaagagaatgaacctgagcgtccacgaaacgtcctgcacggctcccgggagctgggagaaacaggtgcctttctccgacgtccgcgggcgacgcctgccgcaccttgcccgctgccgcgcccctcccgggcacccctcgccctcggcgcccctgcccccacccccagtgccagggcggaggcagtcccggctcgcaggtaattattgccagcggagcccgccggggagcgggggtgggcgcgccggcggtgggcgggcgggcgcggcggggcgcgggcataaaggggcgcggcgcggggccccggagcctggctcccgcgcagcatgcccgccagcgccccgccgcgccgcccgcggccgccgccgcagtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggacacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggtgagtgcgaggggccaggcggagggccacgcaggggagacagagggcctccacaggggccagggggaagtgtgggaactgagtctcccccagacgaggcttcacttggacacgtgtatgtggtcaccgggggaaactgagcagttctgacttcccttggaaggcgtggaattaggagagaaatcccttagtgggcacacgagtgagtgccccttggagtccatctgtggaaaggaagcggtgataggtttccgcagtgaggaaagaaactcctttctctgggtgt

SEQ ID NO: 124 - DNA, 2091 bp, Homo sapiens
gggtcagttctgagccagtcacaaaggaggttttgtggagttcagaaagtgcaaaaggaaaggccgtctaggggcgggcaggaggggcgctgggctgagggccggagaaacagaccaagagacatccgccgcgagggtgcggcgacctaacaagcggctcaggtatccccgactgctttaaagctcccgcttcctccctccgcctggagagggggtcccgaggcggcagctggggccccatctattgcctgctgactaggggagggggaaagtaacagtgtctacaaagggcctagtggtaaggaatgaaacagggcgttgtgtggagcaagtctttgggcaggcttgggaaggagaaaacagggtcgccggggcggtaggtgaagtcttcggaggcggctgggctactggggtcagagagcggggaggcggcggcggcacctgagccccaggactccgcgtcgctggcggggcttgggggaccgggcaggcaggggacgcactgcggcggcaggaggcgctcccgggcaccgcctccgggcagcccttgatccgccaggcgcagtgtctcggccagagcccagatgtagttgtaggcgaagcgcagcgtctcgattttggtgagcttggtgtcgtcggggaacgagggcagcacgctgcgcagtgcgtccagggccgcgttcaagttgtgcatgcggttgcgctcgcgatcgttggccttgacgcgccggctcctgcgcagcgagtgcagcagcgcctcggagcggacccgcgtccggccgcggcgccgccgcctctcctgctcgtcgtcctgtgcccctggaacctcagacgcccgggagatattgggcgcgcccctgcgggccggcgcgggcggccccgaagcggaggctgcctgttggagtctggcacagtcttcctcgtcggtgaggaagccggataggtcactgccgctgctgctggcgcagtcgaggtcggagatgcaggtctcaaggcgggctggcatcgttgcgctgtgcaggaccgacggacagatagaaaggcgctcagagcgctgcagcccggactgagggcagagccgccagggcgcacttacgttcccaacagcctggggttgttactctgtgccagttgcgggtgcgagagcctggaagggtgcaggggcgcacggagaacttggcctggcctcctcgcctcgcctgcaggggccacgcgcccggccggtctcctgagtgatgtcgccggcgatcagatcagctcgtgtgagcaccgagtgtggcacacgactggcctcaggaccccttaagtacccggcgcaacaatgggcgcccccctcccttgccacctccgcccccgcggcagcccgggtgaatggagcgaggcggcaggtcatccccgtgcagcgcccgggtatttgcataatttatgctcgcgggaggccgccatcgcccctcccccaacccggagtgtgcccgtaattaccgccggccaatcggcggcgtcgcgcggccccgggagtcggctcgggctaagctggccagggcgtctccaggcagtgaaacagaggcggggtcggcgggcgattagcggccgaggcacgctcctcttggggcgggctgggcgcccctcgctggggtgggacggggaggcggggcgcgagcgcgaaagtgtgagccgcccagtgagttgcggaaacctggagggtacttggagtttgggttcgcatcccctctccagctgcttagtggtcgcgtgactttggacgagtaatttaacttccctgagcattgctttccccacctgtaagatgagacaaaagtttaccctgtggaggatgatcagatataatgtttgtggaacactaaatgtgcagcatccgctgaacagggtgaaaatcattttcaaatagactggagagtggccatgccagaggcacagggcgcagggcaaggataagtgtcgctgctccgttcaggctgatgaagaaacgggaaagaatctgaccttcatctggggagtgcgaagaggagagtggaaaagaggatcgggtgatttcccaggttgccttgagtcttggtctcacccttccct

SEQ ID NO: 125 - DNA, 3003 bp, Homo sapiens
cgcccgtgtcaggagctggcaagcgatgtcacctgtgggggcgcaaaagttacctccccaaaccctaaacccacacagcacaacctttcccagagtcacaaaaatcataatctgtgccgcacaaggtaggaggctcggtcccggcatcgtccaagccttcccgacgcggcgagctggggaagggagctggggcgggggcttcccgcacgggcacccctcgccccacggccctctcctttctcaggacggaccacgagttcccttccccttggactgagggggaagctcctaacaggaacatctgtagggagttgaacgctggcattttaaagctgcctgtattttgttttatttgtaggggcaggggtcctatgaacgtgatagggtgagcaacgcacagagtcgagggcagcaaatgtcaagattcgggggtggggcctgcaccgggaacttggacgcgggccctggccggggtggaagaagaggtcaggagtttcggaaggggggctatatttcgccagcaacttactatttcgcctgcaacttgcttttaagcctgccgccccctgctttccttaatcataataataaaaaaaaagtgcaaagaaatccagctcgctggaggttttgcatttggcgtgcaacttccttcgagtgtgagcacattgggcgggaggggtgggggttgaacttggcaggcggcgcctccttctgccgccgccgccgcctcgcagactcggggaagagggtgggggacggtcggggcgcgggggagggtgggttctgctttgcaacttctctcccagtgcgagagcgcggcggcggcagctgaagacccggccgcccagatgatgcggtggtgggggacctgccggcacgcgactcccccccgggcccaaagtacgtatgcgccgacccccgctatcccgtcccttccctgaagcctccccagagggcgtgtcaggccgcccggccccgagcgcggccgagacgctgcggcaccgtttccgtgcaaccccgtagcccctttcgaagtgacacacttcacgcaactcggcccggcggcggcggcgcgggccactcacgcagctcagccgcgggaggcgccccggctcttgtggcccgcccgctgtcacccgcaggggcactggcggcgcttgccgccaaggggcagagcgagctcccgagtgggtctggagccgcggagctgggcgggggcgggaaggaggtagcgagaaaagaaactggagaaactcggtggccctcttaacgccgccccagagagaccaggtcggcccccgccgctgccgccgccaccctttttcctggggagttgggggcggggggcgaagcgcggcgcaccgggcggggcggccacgccaggggacgcgggcgtgcaggcgccgtcggggccggggtggcggggcccgcgcggagggcgtgggggcagggaccgcgggcgcccctgcagttgccaagcgtcaccaacaggttgcatcgttccccgcggccgccgcgcggcccctcgggcggggagcggccgggggtggagtgggagcgcgtgtgtgcgagtgtgtgcgcgccgtggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaagccccgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagaggtaagaagcgaggcgggagggggccggggcgcgctcgctcccccgaggtgccgctgggaccggagacaactcgggggccgccgcgggagcctacaaacttttattagcctcggggagtgggggtggggggctggcaagggccgggcgacggtgacgaaagggcagcgcgcgggtgacagcgctggcctcttcctctccctccgccggcgtcccctggccgggccgagggggaggaacctgacctcggacggcgagcggagccctgtcgaactgccgggggcttcgagcctctcattcctcgcgggaatcctggcctcttttctccccctagtgtcccctttccctccaagggggtcgcccgacacccgttttcgtggtgaacgctaagccgcgtctgaattttactcgcccgaatatttgcacgccaccccggcgcgcccgagcgcgagcccgggctccggggaggccccggcggcgcctggcttgaggagggcgtgcggggcgcgtgagggtgcacacgcggggggctgacagcccgcaacttggagactgcggccggggccggcgttatctgttagaagtgggcgtgtcggagagagaactcaacaggtctggacgtacttctcttttaacctcgcacttttttctcttctccacccccgccccgcaagggcttgctctttagcgtttgttgttaattcgcgcctgaggtttctaagtggccccttttagaaaaagaccccctgtaaccgtaatggttttgtgctgcgatttttacaagtgctagtttgacgtttggggttgcagacttgataattgcaaccttgtaataccacttaagaccctctggcatggttcattagggccaattaatgtggctgggttatttgcaacttaaactgggggataatgtcgcttgagggagcgttttcgtttt

SEQ ID NO: 126 - DNA, 4313 bp, Homo sapiens
ttaatttcaaagactccttttaagctccaagtgacagtaaaacctccgatctgacgattaaagtcacacgggcctcccgcccctcccggcgagatttcccccactggtattttaagatgtcacccgggagacctcaaagagccactcttcctttttttcccatttagagtcgtcttaatgggagcagggacggcctcagcttccagccacctcgggcagcaccacccccagccgccggcccttcctgccctgcccttttctcacggcagctgtgagaggtttaggggaaaaccgaggcgttttcgtttcatctcgctgcccccttaaaaaaatgaaaatgaaacagtcgcctactccctggcataaagaaaaaggtcctctaaatggctgggggctgccagggttaggggtcccccaatctcaactcgccattcgggacgcataatatccccgagcaaacgtctggagagcagtgccccgatcccggcctagcgccgtccggtaaaatttcggaagcccgagggtgtgagcaggaagcttttgcgaagcggcgcgggaggaggggtgctggaggcggagggtaggccctttcaccgttcgcaccccacccgcggtgtccttgcccctgtcccgggatcctcttctccgttacccgcagggctgtatctgagcgatccgggttaggggggcgcaaaaccccatccgcccatttccgcaccaacgtctctacgcaaggcgccccaaaacccaggtggagcggggcaaccccgttaaaagtcattcctgcagggcgcatccaaaacggaacgccgaggtcccggagccgagcgcgcagccagactgaaccgggtgcccgggtgtcgccgcggcgtctcgggcacctcccatccccactgctcccgaggctctggctcccgcagctcagacgcccggagccccagggccggcgccctcccgccccgggtcccgcactcaccttgaaggcgacgggcagcgtcttgttgcagcgccagtgcgagggcagcacggagcagaggaagttggggctgtcggtgcgcacgagctcgcctgcgtggtccgccagcacgtccaccatcgagcgcacctcgggccgggcgcgccctccgggccccacggccgcctgcgcgctcagcgcgccgctgttctcgcccatcttgccgccgccgccgccgcaggggaaggccggggagggaggtgtgaagcggcggctggtgcttgggtctacgggaatacgcataacagcggccgtcagggcgccgggcaggcggagacggcgcggcttcccccgggggcggccggcgcgggcgcctcctcggccgccgctgccgcgagaagcgggaaagcagaagcggcggggcccgggcctcagggcgcagggggcggcgcccggccactactcgccagggcccgcccgctgcgaggcctcgctggcccgacggccgcccgcagcctgcccggctagtcccgcatcctcggcgcgcggccccgcgtgcggccgcccctcgtggctgtcccggctgcctgggccgcggcggggcccgcgcggggctgtgccgctgccgccgcctcccgccccgaagctcgcccgcggccgccccgactccgcggccgcagccccagaacaaatcctccagaatcaagtggcggggccgcggccgcccgcgcggggttagtacccccggggcccgcggggcggggctggcggagcgacgcgtcgcacagccaatcggcggagcccccatcgcgggcacctcggtggcgttcgcggggaggaacggggcctgccggaggccgcccaacggggaggggcggaaggcgccaccccgcggaggaggccccagtgccacagcccagggcccccgagagctctgggagcccggggcaaatgctagaaatttgcttagaacgtccgggtcccacggaaggcgcccttgccgccctctctcgggtcgtagctccctgacgctggggcgcaaccccttcgctcctcctccccgctggccgcggccgggcttccccagctcttgctgcttcgggcctgtgacttctgcaaccccgggctgggggccgcggggtctcagggccggtgacgccgcactgggagccgccccaaagaggttactcacctccctcgtcccgcacattattctgacccaagagcctccaccccacacgggattttgcgcgtcgtccacgcccggccggcggcctttgctgctcccagccctgcgcggctttggtcccagcctcggtggcccctgtgccaaaccggggacaggcggaagggagtctcctagggaccctaagtagcctggggccaacaacccctttcctctctgctctcccctcaaaacaagtttcaggatcttgcaggcctcgcggcgtcgttcttcgttgtggcggcctgtggctctttgaaaaacacgacgaggcctgcaaaatgcgtttttctttttttcctttacgcatgtaaccacggtcctgcatcgtgaaacggtacgcgcgtcggtggcaaaagaaaaacagcagtggctgcaaagctaagggccctcgctttcagaggagagaattttctttctccatgcgggtggaaagtggcctctgcgggtccaaccccacttcttcttgggcccgtgcgctccggctgcgccgcagggaccgcggacagcttcgccaaggcactgcctgcccgcccggctccgggtccccgctcccactcccagccgcgtggcccaacctctcctgggcttcactgcaaatcaccccttcctctcccgcctcctaagtctgtcgagcagacctaggggccggctacagttgggagggcaacgggaaagatcaagccacaatcattccgaattatcgccccagacacctccctagactctggggaacgaacgcgtgctgagcctccccgccgctttggagacggggctagattttcgttgcctccggctctcgacaggtgcaaaacaatgaattccaagcctcggaagcaaagaagcttaggatccgacggtggccgcaagatctcatcatggatctgacccctgctcagcgcgcgccatttcgtcgttgccaaacgaaatcaagccccgcgtgcgctccaggggcgaaggactctggactcaccccgaccaccgggagagctggcccctacccacctcgggacctcacagcacgccctcaggccgtgtcgaaaggaaggacggcaaaggtcccttactgaaccttttaagagagcctgcgcctggcagttgtcgattgcggacccaggcccgcgcgccctcggacgcgctggcacgagcagcagaactagaggaaagcgagtgatccagcctgggcgctcccacctccgggaacgtctccgagaaggcgcagcgcgtcgtggccaggtagggccctggccgggggcgggcaacacgtgctgccctcgagcaggttgcgggaccatgacccgctgtttcaggtggtggtaaattccatttgtcgaatggtttcggtttgcaccgtgccctttgcttgttcctccgcctgatttctccctctccgcttacgatgggttcacagacaagtttccagagaatgagggactcttgtgggccctggcacctggcgcagggcccggcacggctccggctctccgtagggcgctggctccccgtgggcaccagatccaagggaccagggcggcggggggagggggggcgggtgcaggcccttgggtccccagaccaaggtcgcggggccgcctggcaggcacagtggcgggagccgccgctagttggcgcccgcgccctgccagccgcggaggtgcgggcccggccgggctacagatgcgcgccagctgcggccccgggtgcaggcgcggcgaccgcccccgaggagctgccctttccttgccatccatgcggccaggtctcagacaaaccgatggctttgtgtcaaaccaaggccgccttcctcacctctgataagatggacgccttctgtcttcgcgttttcaggcacccggggaagacccacagaacaggctagcttgttcccaatttccacctgcttcctccccatcccggaccgacaaaaattgtcgtctgtttgatgggagggagaactccgactcccccacctggggcatgcagacaccctcgcccttccccagttggcatggaccgtcgtcttttctccctcttccatcagatcgatggacaaacaggccagtttctccccagtggcccccacctaagagcaccctaagttgtccacagcagggctaggaagcagaaggtcag

SEQ ID NO: 127 - DNA, 2481 bp, Homo sapiens
tccccagcctcagtttcttccgcagccgggtagtgggagcgcagggagggcagtcgaggccaccagggaccttgcccggccccgcccagtttccgaggaactgggccggggtggaggcgcccgcgccgccaggggttcctctgaagcctgtggtcaggccgccgcttcccgggaagcccgagccaagaccagagaccgcggccggccggggcttcgggacagcagggcgggcgactgagggcgtcgacggcgggtggagcaggggctaggagggggtctacgggtggggtcaggctcagggttggggacaccttctgtggcctcctagggggatctggctgcaggggaggagaggacagggctctgcccccggcgggtgtggagacagctggggcggaggagggtgtgtcagggcgcgtcccaagagggcctggcggcagaaagtggaacccgaggtagcggggcaaaatcggggtcgccaagtccgaaggaggggtccgagaagtggccggaaggcgcagggtcggggccagagcccctcgagaggcgggtgctggggcaggtgcgaacaggcgggcagagggccccgcgggagggtccagaagagagggaaacagggccgaagcggtcctcgccggacgccaccgcggaaagagaaaccaaaagtggagctgggggcggggccggcagggggcggggcctcccgccgtcgccagccccgcctccgagccggtttaaaagactggcgcaggggcgggcgccgaacagagcgagctgcggccgtggcagctgcacggctcctggccccggagcatgcgcgagagccgccccggagcgccccggagccccccgccgtcccgcccgcggcgtcccgcgccccgccgccaggtgagccgggccctgggcgaggaggcgggagggaggagggaggggagtccagggcagccaggagtcgggcgagcctcgggggctgcagaatggggtcgcggccgcgatgcccctgaccctcgccggccccacccaggccgccccccgcgcgcggggctcccgcagcacagcctttctccggccctagcccaaatcgcccagaccaggcgcggatcccagcctggccagcaggcggcgggcgcggggcggcgagccggggccggacggctggagccagaaccggctgctctccacgcccccctctcggtgctgcccggaggccggactccgcctccaccgagcccccacccgccgggaagagctccgcggagtacagagcccattttctagctgtgtccactgaggctgaacggatccgcgcggacttggtgctccgtgctcgccccctagggccgggtccgccgggagcgccgccctccggagttgtccggccggcgcacacctgcccggccccgcagcgccccagctcacctctttgtctctcccgcagcgcacccccggacgctatggcccacccctccggctggccccttctgtaggatggtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgcgtgcggccgctgcaggagctgtgccgccagcgcatcgtggccaccgtgggccgcgagaacctggctcgcatccccctcaaccccgtcctccgcgactacctgagctccttccccttccagatttgaccggcagcgcccgccgtgcacgcagcattaactgggatgccgtgttattttgttattacttgcctggaaccatgtgggtaccctccccggcctgggttggagggagcggatgggtgtaggggcgaggcgcctcccgccctcggctggagacgaggccgcagaccccttctcacctcttgagggggtcctccccctcctggtgctccctctgggtccccctggttgttgtagcagcttaactgtatctggagccaggacctgaactcgcacctcctacctcttcatgtttacatatacccagtatctttgcacaaaccaggggttgggggagggtctctggctttatttttctgctgt

SEQ ID NO: 128 - DNA, 198235 bp, Homo sapiens
attaccaagaaacaagagtctccttctaaggtggtttcacctgtaaggcaatcccttagcctggtccctgagggcttcattagagtagggtcctggtgattttactggcttgttaagaaggcttttcaaagtcttgtgtaatgatgatgaatggcagggcaaaatcatgttaacacattataaacaattccaggcacaaccagtatctcacactgtactttatttttcttcacaatattaactagacagacaaggaaagtttaatggcaatgtgactttttccaacaacacaaacaaagtgccattatagctaatggtggccaactggagacttactttaccttaaccatgtaaagtatccttaccgtattttttatgtgtacagtgttgcagaatatcagccacctcttaaaagtatcaatcttaaaaagagccatggaaggtaaaagtatgaaaatcttgataacaaaagctttcaatacaaaaacacttattgtacacttatttttatttaaaacaaaaataaccccagtaactcaaaacaaaagcaaaccttggttgaaaacttaagaaggtataataaacaaaaccaccaaaagaaagcttccccaaaagaaatgcaatccactgtcactcttgcaaattctaccttggagggaaaaacttaatgaaatgagctatctggagggcccacggcagattttccaaaaggtttaggtgcatggatttactcagtatctacactacagtcttatttattaatagtctcagaattttcttgattgagcgagcctttccatcctccaccagtgttcccatcttctgtgctcagcttggtatgcagaacaaccttgttgttgataggatgtttgcttgaagttatttttctggggcagtccagatgaaccggtacagtaccattcatgctccatctgattttctttgcatccagtgagatgcatatttcatgattgtccaaggtcatggttgtccaaagacatggaacagaatgattcactgggtaagactaaaggacttgtattatcactctccaattcagtttcacattgcttaattttataaaatttttttctgtattgtacataataaacatttagaaacagatgtccctaccaaccagaaggttgtcattaaatatcctgttagttaaaactgcacatttattgtttaaatacccattagacatatccagcttgaaatttataccattgcactgccaaacggagctgcactttgagccatgctgatgtctctggaatctaaaggtcgtaccacaaacttcaaaatgtttctcatttgtcacacaaggttcttcgcagaggcatcacatcgaccccaatacaggtccttcatacccttagttctggttattctgaaaacttccaactccctgatccaaacttgggaatgttttacatttaaaaattcttcctccctcccacccctccaacaaatgtcctttgtcccataataatttaaaaaaaaaatccctgaaagatccaaattgaataacaataaagatctgattggaaccttcataagcttgacaatgtagaattgtatttcttaaaaagtgtgtaaccacatttgtctgggctgcaaaagacaccacagaataagatcagaatagaatttcaactgactccctaatttccttagaatggcttgtatttcgagcctttcctgtttttctctgatagagtaggtgtacattactaactataagtgataagaaagtctaaaaacagccactgccttaaaagtacagttggaattaattagagtttaagttcacatttataaactatttgttttaggataagttcaattacaaatagagactatttgcaattctgttcactcaatagatcctggaggtgaaagctagacatgtgttgggattgccctgattatttacatttaatcttgattattataactcctctcgatttataatcacttcctaatttttcccactgggccagagctacatctttagatgataagcatttactaataaaacaaagatcacatataaatggaaggccacatctgaacacagagaggtaagtgagctgtggagagaatgttggcgtcttgtttgaactaaattgaggtgcttccttaattctgtgactttattccaaatcttaagcctgccagagttttctgcccctgccaaatcttcggagacgacccgatggccatagaccctgtcagctgtcattctggcctctcttgcggagtatttgtgcagcgagggactgggagggccgaggaggttctcagatgttcttctccttttggggctttttttagagcccttgtccccaatttggaaagtgcatatactctatttaactctgaccctggccagtgtaaagaggagtacatacagaggactgttttttcattcataaagagcagttaagatgcagatgtgaatccctcttcaatacaaaatagggatggttctctgttgcccaactgcaaaataattagatataatgaaaaaaaagaagaggagaaaaaaatgactagttgaggcttttatatacattcattgcttctaacatgtttttaacaataaggaaaatgcaacatcaactactcttagagcaagtgcagccacaatactgtacagttctggggccaagaggctgggcacatttactgttattaaaaccaggtaacaaaaccccacagcaaaaggcagccagccagcaattagcccccgtgacctcttaatatatatacatttttcaaatactctgtgaatcccgtttgaacaacaacaaaagacaaaacaggctttatattaaaaacgtccacgttcttcattgttacttctaaagcagcttggaggatcttaccacgtggagcatactgcaaactgactccattaaaatgattttggcaggatagcagcacaggattggatattccatattcatcactttgacaatgtaaacctttcataaaataatattttgcttaaaaattagaatcattcaaaggtctgatcattctgttccctgaggcccgccggggaggtctggcttcataccacaggtttcctgctttcttggtggagcgtaagcaccactgcatttcaggaagaccctgaaggacagccatgagaaagcccccgcggaaggagggcaggagggctctgggtgggtctgtgttgaaacaggccacgtaaagcaactctctaaaggtcaaaccaccatagatttgaatctgctggtcatttgccatctggatttttaactgaatgaatctcatgggtttaaccaaacatgcatgtaatcctgaataccatgaattaaatgcggaattgcccagggacgaggaaaccttcaagaaacaaggtcaaagggacaacagatataactgtcacaataaacaattctgttgacgtggaaatgcacatgacttggttgaaacaaagctcctcagtggccagtgacatccaggtttttcttaggtagctgagactcagggcttatctcaccttctcagaatgcttttgaagaatcaagagataaaaatctcaaacagaaaacgatcacctttgctcacaaatagtgtataggccataactaaatacaattaaaaacaaaaaaacgctgagatgcatgtatttttttaaagcagctttcgaaatatcaaccacagcattaaacattgaacagagtacattccaaagttaatacagataaatggtatataatgcaataatgccacagagttattccatcaatgtttcaaggctgattctaaactggaagaaaaaaaaatttcctagtttatttgctgaagatgtcacttcttttgttacttctttatagttccccaccattgattttttttttaatgccccaggatgtacagataacccccatattccacacctggaactttttttttgtcaggttttcaaataaaaccaaactacagtgacaagataatgttttacatgtaattccatagacaggggtcaattaatccatgacacctcacttcaatgcttcttttaggatttgtgaccctctccaaagtcatttaaagccttgctttaaactcacaggtgggccaaggccacacagccaacgtgccatgtgctacagccaaaatgggccgtggccattgcctctcctcacgttcccagccttcaccatgtccttctgataggaagggcccagggcctctgttccttccctctacagtgatacatgtcttaagaagggtcgtggctcccatgctccacgtgaaaacgggcctacctggagggccccagggtgacaggcccagccacacccctctactgctctttcttgacagtggaattctgagctccatcagcttccagacattcggagaccacactgccctgttgatcatccctggaggaggccagtgagggccccggctcagttccaggaccaggcctccaagctgggacacaggcaggttctgcggacttcggtctcctaaaagcaggcacttgtggcggcctgatgctctgggtaactctagccttcctgatgcggaagtcaccgaaatgttcacttcctcaagttccagaggattctgtttcttactcagacagagccagtattgggagttggggggtgcgtatccaaaatatatgaatatacacaatcagggcttaaggtactggatgatattgtataaattgctaaaatgcttttctcggcacaattggtagcttaaaaaaatactttcctatgatttaagggcatttttcccatcgctgtccttcggcgtggaaatctcagtgggtactaggtccatctgaagttcccaactcttttcctcccaccaggtatgcatcatgtgagtcatatgcaaagagtctcttcttcaggccagggaggcatggacttccccccacaggaaccctccctctgttaatatcacagcccccagggcaaagaaatgcaagtgaatgaacaccttctccccagcctccagcagccagaaagccagcttccccaatgatcaggtcctttttccatccgtctgctcttcagatggtgatccggccaacaacatggaaagcgaatctatgtttacaggcacagaacatccaggtggagccacacgaagcggtgcttggcaattagtggtcggatttccaaagacaggagttttgatgggactgtcttaaataaataaatctttttttcttaataatgtaaaaaataaatgatatttccctttggcagtaaatagctgattcgacgttttgcctgaagactgttaattgttgtgtgtgtgtgtgtctgtctgtgtgtgtgatgtttatatgtgtgttattttttcttaaacagcctgcagctttgtttcatggtacatcactgacaatgcatattatttctactgctttagtgaaccttttgcatatttgtttggggcaggcatgttgacttcacttgtggcccagataggcacccagggtgatgcaagctcccaccagggccaaactgagcagagtcttcagagacagccaggagaaatcaaacagaggccgcatgctggggccgtacagttccacaaaggcatcctgcagttgggggagaggagggaagaaaaagaaagagtattagagagagagcagagaatgccaccccacagagaaagaggcatcctgccagggcagcctgggcaccttcagaagggtgagaggggaaaaggcaaatgctctttggaggccatgattcagaaaccactgttttcattaattcaaggcatatttattgagaccctctttacgtgccagccatcttagagatacagcagtgcataaaatagactaaaagttcctacttcacgaagcttccattgagtggaacagtatagacagcaatcaatataaattatcacatggtgtaggagagagtgctaagggccgaggagaaaaacagcagaggcagttagaaaatattagaggttttgcaattttagctagcatgcccatccataaaagtaataaaatctagcaatgatgatgaccgtcacactcctcgattgagtgttgacatcttatcaaatgtctgacatgcattattttagtctttgtaccaaactttttctttctttttttttttttagagacaagagtcttgctctgttgcccaggctgcagtgcagtggtgcaatcatgacccactgcagcctcgaactgttggactcaagagtgatcctcctgcctccgcctcctgagtacctaggattaccatgcttggctaatttttaaattttttgtagagatagggtcttactatactttccaggctggtcttgaactcctgggctcaagtgagtctcctgcctcagcctcccaaagttctgggattaaaggcatgcgctttctcatccagctaattctttgtaccaatcttatgaagttattttatttgtttctgttctgaagatgaaaaagctgagaatcgcagggaataagagactttttaacaagtggcagagccaggctttgaacccagatagaaaccagcacccttctctctgctgatgccctggcgtggctaacggcagctctatgagagcatttggtcagtcaagggctcagtcagtggaggggccaagggcggccttgactggtgcagtgccaacctctaaggtcaaggttctcctggggaaagggagctgtcagggggtttctcttgggggtggctagactggacgaccacaactctgcatttactcaaattgtggatctcacaaggcaggagatcaggggtgtgtcactggatgtgcaggtccctgagagacaaaaagtgtctcccttccattcctatctctccatctcaagtcgggtctgtagtgtgttgtagcaaagtctaccctctggatgggcttggattgagcaaatcaccaattgctcatttcctagattttggggagattatgtttcacatttgggtccaatgagtatttggacaactttctgaatgaatatttgaatatataaatcagtaaatgaattctttttacttctgatttattcaggatgaagaagaaaacaagaatagtttcacattattcccaacaaccctgactcaaagcacacagttttattacaggaaacagtaacataccatgaccctggacatcgctgttgggaggggctccaacagtgcacagaggggttccctttctctggggcaagggctgtagcagtgggaccagggattctctttgtctccctcatgctgggcatggttgtggtgcactataggtgcgtagtaaatgtttgttcacttaagctttctgaatacaatcattggtctttggcttaatgctttacccaaatgcttatgaatctgtttgaaattactccttctatatgtaacagcctctgagaatcctgaggtagtcttgatgaggatttaaagcattgttagggtaactttccacattattaaatatagatttatacaattattttcatgatatataaaatgtgccatactttaaaaaattcatgtttatagtgtttaaaacttttgctattataaacaatatcatgatatatttttgtatataaattcttgtctatttgttcagttgcttttttgaaacaaactcctagaagtgacctcagttaaccagtcatcaatattgcttccagacatcatgaagggcttgccttgagccatcctcacattctcatggattgccctccaaccaatgccaccttttacaaaaggcaggcaagaatttagggcgagggtcacactgagagtgatcctgtcccccaggggacatttggcaatgtttggaagcatttttagtggtcatgatttggggtgagggtgctactggtatctagtgggcagaggccgcggatgctgttcaacatcccacaatgcacagggcagccccccaatgctaacagggccgaggctgagaaactctggtttataagatgctctgtaatcacagaccatagaagaacagatgacccatcctgtgtgtcaacagcattggtcaaatcagcacaatcagctagcccagaccagcgactgctaacccagtgggccttctgcatctttggaggtccttggttaacttttaccaggagagggcgcaagggctttcttcttctttttaaatatctattgttaaacatttctaaatttcagtgttagaaaagcgaggcaatagacgtacataaaatgtgtgtttagtgctcttagcacagagctaaggcacaatcatgattgtctgccaagatgcacacccctctccatataagcagggatcagtggggcaggaaggagtcaggacttctccacaagccagaactctgcctcttccagggagcaacccaagacatcacagacacggctgcaaatgtcaactagtcctcccatccatgcttctctctctgagggatgggtaggctgaaacccccaatagcccagccaaaagacaccccaaatttgtcagggcactggcaataggttgtctgcaatttggcttgacattgagaaggtcagtggccgggctctgaatccctttagtaatcaacagagttttgtgtggcaaaatctgaaccagactaagcccctgatcatttgtcctgtctggacctgaagccatcctgggaaaccggaggatgcagggacatactccagctggcattttctcccagttggtctggcacacagtgctggagagcagaagaaatgctgtcccaaatatccccacctcctcagagctggaataattccctctcaccaccctcacccccacacaaataacagtgcttctcatgaacctaacaggccatttctgatatgcattacgtagaacaatgtcatttctagagtgagatgagctaaactagcagctcttggcccaaagcctcagcatagagatgctgttgccatcccagggggctgagaagggcatgggacttggaggaggagtgtgggtgaaccctggctttgatattttattagtttataaccttcagcagataacccagccccgagcctcatttacttcatccatagccataaaattcattattgtgaagattaacgtaggtcactcaaagccatttgtaaattggatacagaaagtgagctcgtggcagaacaaacaccttgctcttgtctgtcctcttgcagacctgctccgcacctactcaacctgcccttcccccaagaagttctgctgagcctgccgttttgcagaagcaatttcctctcttagctttctgatctgaggatagtccgtaatttctataggaattatgaattaaaatgtatacatcccgtgttctggtcaaagatgggaagtgataatacaatgcctacctatctgtccttctttacacattattagagtgtagggctagagggcaagtcatttaaccccctggaggttggagctggcctctaaactttgcccttctacaattccaaagtgcaaaggagaccctgcggcttcgggactaaaatgacctgaaagcttctttcgtagaaagtcttcctgatttttcaaacatcctgattggggcgatttccgaagtctgtttgaacagtctgtcattatttgtttgagtttgaaagctgttttaaataaacacatgctcattttatgtattaaaagcaacaaagagggaaaaagaaaacctgggtcgtcatgtgattcggacaaaatcccagtctatatatttaggaagctctgtgtcccttgctcatgtcaggactggcaagggcttacccgacttcacggatcacaggttcacacggaaaggctggcaccggctcctcctatgaggaggagatgggcagggcctcagctctggtggctctgtccacagtggcttccccataaatttccaattcagaggccacagaggatctgagttccacccagggctggcccaaggggacaggatggctaaactcccagccgcagccttgctgcaggtttggaaccaggccaggtaggtgtggacgggaacagaccagggtcaagactcctaaactcagcaaaggtgtcctcacccctccgggccatggagcactcccacctgggaggcagccatcctccaacattttccttttccgttcagaaccttcaagaatttttttttttttttttttttgagatggagccactgtcactcaggctggagtgcagtggctcccaggttcaagcaattcttctgcctcagcctcccgtgtaactgggactacaggtaccctctactacgcccggctaatttttgtatttttagtagagaaagggtttcatgttggccaggctggattcaaactcctggcctcaagtgatcctcccaccttggcctcccaaagtgctgggattacaggcatgagccaccacccctggtccacttcgagaaatttcacgtaaacctaaaatgagaattttttttaaaaaaggtcagattgtcaagaatggaagagaaggttaattctaagtgctgaaaagaatggcatgcggttggggatatgggcgggggtcccaaaataacccttatgcccaggtaaaggtaaacatggagaccttttgaatttggtaatgcatatcaaaaggcttttaaaaagcttttgttagtaatttcacttccagttatttattttggaaaaataataaagtgcacagattatgtataatagcataaacctggaaacaaatgtctgaaaatagatgactgacagcgcgtccacatgatggagtgctgttcagcattaaaagtcataccctatagttattggcaagaaattgtgttcctaaggtcatattgagtaaagcaggacaaaacggtcagcaaaacacgattccacttctgtaaaaacctaacatatacatgtgcgcgtttacaaacagaaaaaaataatataaaggaaaacgcaaagatgttaacagtgattatcgttgaaggcagaagtaggcatgaggacatggcatttaagaggctattctgatttttttccttagctgtcttttctaattcaatacaaacatgtatattactatttatgaaatatatttcaatatatactacatagaataatgttacattctaagtgcttacttaatctgaaaaaaatccagactccataatttgacagacaaaaatgctgggagatgatgtctagtagtggggagacatgggctcccaggcagcagccatgacctagaaccatgcaacaggcccccggttaagtgagggcctccttagaccctggcccagaagaactctcatgagctctgcccctcagaccaatgcctgcaataagaggttcaggccccgagctcagtgtgtgttctcagctctctatatactggggaaatttaatatggcttggctggctataagcaaattcgaaattcagctacattccacagtctttgagctgactatgcatgcagacgttatacaatcgaagggaattctaagggagaaaagccaccctgtccccaaagagcttacactctagagagaggtaatgcctctatgtgcacatttgaactaaactaaatcaatgggtgccgccattttgttcctgcagactgcagagtctcatcggcagtaagaagaaagtaaaaagaaaatcagaccatgccaatgggaaatcaaacacagctatcgaatgactttgatattttctatttttcatgagtttataattttgtctccatggggacctctggggatctcttctctcatgacaactttagggttaggaagaaaaaaggaaagggagaatcactgtaacagaaaactctgggctggaaggaacctcaaagtatgttcagattccctgaattggtttaataatgtctaataaagatattagctctttttttaaataggtgaggtgagtgaaactttgacaggtaaagcaaattccttacagtgtgtattcataaggaaattcgtggtggacaggagcgtgaaggctgggtttcacctgcctcctgcatgtcactggttagaatgctggcaagcagctggttcttctctctacccagggaacctcctccctgcctccctcaacttgcttcctcccatcccgaccttcctctctgccccaacttggactccagcccaaaacaagtctcatctgggcttccaagtggtgctgaagaaagttacccaaccttgcaggcaggtgctgctggaaattcatggtctctaaactcagtgagttctgacaccacctagcaattctttattctttgtcagatcttttctgttccttttgatgactgttcccaacagccaccacttgtctcacacatcttcctcaccttttggcagtgaacactgccttttacttctctgagaaaactgggatcattgggcaagaattaccacagctttccaccctggcccatgcacaaatgtccatttctgcctgtccttccctgctcctctccacacttcaccctgattccaccatctcccattgcttcaggaaccttcctccgtcaattgtccctgctctcaattacaatttcaatcgcatccttcctttctgacctcaggtatcctcaaaatgtctgtgctgatgcgtgctccaccctaaccattatcttctctgtctctgccctcctagaaaagctgccaagccacactcattggctcacttcccacccacatttgaacccattcagtctggcttcttcctatactgtgcctctgaaaccacccccacagagaccaccaataccctccatgtggctaaattcactgggtgtgaggttgtatcttagtaggtgctctgatgccccggacaccaagaccactgagggtcttccgtgactctgctccctttgggctacctccttcctcctgaagaatttcctctctgtctccctcaggggcacctcctccctggcctattctgataagttctcgatgctgcccatcaggcttctgtctggacattttcttttctctctttgaccaatctctttcactctcttggtcttatataccacccctatgataatgttcctaacatctttatatccagtctcactttctcccctaactggcaaatacttattccaattgctttctaagacatcccctagggagttcgatcaacctgccccaaactcaagctatcatcactccctccatcaagcctccctctcttcctgtcttcaacctggctatggcatcaagtaaacctacagcctcagagtctcctagatgtttttctcttcctcatgccccatattcattcaacagtaaatcccatggccataggttagactcccttagaaacagaccctaagacaaagatttgagtgcaagtggtttatttgggagatgatgctaggaactctaaggggagcagggaagggagagaaaaaaaggaaaagactcatgcatgagttacctcatcaagcaagttattgctaccggcaaacagagcttactcctgccagggaaatctgagggccggtgtagaccatgcatctcttgttaacccactgagggactagggagctggggtatttatacaccaactcctgctattcattggttgaaggttgctcctatggaatgtcaataccccagcactcctagctggccatgtcacaggtgaagtaccaatcaaggaaatagatacagatgccacatctcttatagctggaggtgaagttagtgagcactgaagtggtaaaggccaggggacaggacagaacagggcagtagatgcactgccaattttaccacctgaacacttctctctccctttaccttctctccccaggatcactgctgtgatttccagtctgatctctctgcctctgtctgagtcttgtgctttgcctgtaaatctcttctgtgtactgcagccagagtgatccattcagaatcaaatctgttgcttccatgcttaagtctaaggttcccaatgctctggctccaacctagttctcctgctcagcttgtcactcttaagtcaactttggttcattcagagattcagctcaatcattttctgcaagcaactttctccaaatccctaggttgagctaaataatcctcggctgttccctgttcacagtattatacgaagatcatctgtttacatgtctgccttccccattcaactattagcacctggaggtgcaggaccatgttttatttatctttggatccctggagcatgtgtctgtcatacgttaggaactcagcaaatgtttgtggagctgaaacaaactgatttgttttactatatggcagatttttcaaacatcctaatagataatatttttttaaaaggggagtattcagagaccaaataaaggactggcttagataaaattcagtgctttttttttctttcagcagcagcctctagtgtcctcctcccagggactgatggttagccggttcccaaggacacagagggatctgactggtcagtgtccctgctatattggttagtaaatattatcacccccactcacaggtgcttgattctccaagaaagggagtagcattttccaaactcatttggcccctaacccctctgtcaaggagactgctgctatgtttggagtattaggaagacaaactttgacaagtgctgcctaagagggtgaaaggacaatagcagggcattggcaagaggggcagcattggtgcctgtggtgcagggcaggggagacgaccagaggtcaaaggctgtttctagacatctatgcaaacgtagagaccactgggtatgtcctgatcctagattccaccaagagggctggagactcattggcaatactatctgtgactactgcggccacacagaatctatgacatgcaaccgtcaggtgagagagaacgccaggagaaagagaaaggacatgaaggaggaagtggggtagacagacacttgtcttgcagaaagagcgctccatgaagccaagcaagattctcctgacaccagagttggctcagagcaagagggggagcaagccgcactggcggctgggagtggtggccggcagagcacacgcaaggaagtgaggacttttttctacctgaataaagcagctggtgaggaagtgactccatttccccccttatcatcggctcggcaggatttcctccacagccacattgtgctgaatgagtctagagggttccgtctgcagagcagtgtggctttggcagctgcatgcttgcttctgtcccctgtgactcttcctcccgcaccctccctttactcccaaaatattgtttccgggtttgggggaaaaggaaagggaaaaaaataacccttgagcatataactgaaggacacacagctgcctgggccggagatggtgaagaggcacgggagcgtgagaagcacaaggatttgccttcctccaggctggcgaaggctgctccccaaagccatctccagtgcctgggggttgatcttggaggaactctgggtccagggggaggggctggttgaaacatgggccaatgacattcgtgaaacctaatctccatgtcatttggatgtaacaagaaacctgctggagacatggcaggagatgaaaaacccaaacaaaacaaaaacaaaacttgcccgcttaccacagttggtccagggaagttctggtgtgttctgttatgcaaatttagctaagaatgcaaatcaggcaggggccctcaggagctggggaggctgaaaaatgagaagcccaaatgggtgcttcctttctctggcattattttcacagtttgaaaataatgtgcaaagatggcttatgccatgggccagggcagaggaagcttggccccaaccacctgctaatggagacttcagccggagctggctattccagagatggacctcagaggattccttagtctaattaccttctgggctggggtagaagatggtgtctggagggaagcacagaaccaagttccctactgccgcactagctatgcaaatactgcagggcacctgtgggctcatgtccctcctgcaagaaggtgtggtcagtccagtaattcaaaagacgtacttctgaaataggtggagaaatgcatttatagcaaaaagtgctaaaaatatgttaatagttatgctatttggttcaccaggttagtgtaataaaccataacaagagagactaaaggccgtatctatatgaccttgaaatctcatcttcagcgggcttattcattcagtaaccaaactatttttgtaaggtgctgagtatttagcttaaagctaaataagacacatgccctgccctatagtaactgcttggtaatattcccagtggcttccatgggcctgataattttcttagtactgaattcaaagcactttgtgtcttgtctgcaggcccatttgcccagcagtggccttgccaggagagaacaggcccatgctcctgtcctcattttaaggcacacctgaagaggccctaaagaaagggcctatatacacacaggcctcagtcacctgctttccagtgttttggctttaaaacgaagtttcttcatttttcttcctaccttcctcattccattaccttcttttggctagagcttccgagggccctgcctgttgtggtgctcagccctctcttgttttgggcttatgctatttcactgtttcggggggaagtatcaagcataaagtgacaaacttaacacttttatgatattgtgttggacatgaaaatatgtccagcaaaaaacttaattattataactcaacaataaaaacgtaagtagctaaattttaaaaaaggccaaaggattctggtagacattttaccagtgaaggtacacaaatggccagtaagtgcatgaagagatgcttcactatcattagtcattagggaaatgcaaatcgaaaccacaaggagagatcacatccactagagtggctctaattttaaaaatagataataacaagtgttggcaaggatgttgagaaattgaaacccctgcacatgactggtgggaatgtaaactggtgcagccattgtgggaaaacagtttgctgattcctcaaagagttaaacagagtcaccacatgacccagcaattcaactcctagtacacccaaaggaattgaaattgcacgttcacacgaaaacttgtacacaaatgttcacatcagcattattcataatagccaaaagtggaaatgacccaaatatccactaactgatgaacaaataaacaaaatgtggtctacccacataatggaatcttacaactcagccaaaaaaaggagcgaagcattgacacatgcaacaacatggatgaccctcaaaaacatgaggccaagtgaaggatccaggcacaaaggccacccactgtctatgagtccattgacatgcaatgtccaaaataggcaaggccatcaagacaaaaagtggattagaggttcccaggagatggggagacggggagactagggagtcattgctaatgggtacagggcttctttttggagtgatggaaaagttctggaattagctaagggtgatggctgtataaccttttgaatatgctaaaaaccaatgcgctgatcactttaaatggaattttatggcacgtgaactatatcccaataaaagagcttaattatgttccttacacgacatgaagagggactaaactatttttataccatatggaattccacagaagtactggcttgtgatggatcctcggctcacaagtgtaatgaggaatgagacgctgctggttagaaaatgtgcaccactgtcattctccaaaagaaaaaaaggaagaactgtagtaggaggtggcatggtttgtgttctggatgagaagttaggggtcggatgcatgagcagcaatcggggcactcctacttgtaaggtgagcagctcacttcacccctgggaccttcaattttcctcatctgaaaactccgccgtagcgaacctctaagaagtctctctccgctctaccatctgggcttacctagttagtgaccttattcttcaccctttctcgtgcatccttgaggatgtgacttgggttctgttggtgcgtgccagagctgtgttactgtaactattgcagaggatctcctgcttcctctctgtgtggtccatctcttccatccgccacttctccactgctcttctccccacctggcctcagaccctcctgctgtgagttaggaggaggcctttcttggcacagcactgaagctgtgacctctgatgtgcctctgtgcttccaatctctttgcttttatgagcataatccaagttatttgtcccagaccccaacccccatatgcccacaaagccctctgcctctcatgccagttttaattagaactggtgacatcagtgtggcttaaagtagggagcaggtgggaagctctgattatattcaataccgaacaggactctccactgcctgacaggggctggggattccacaggcagactggcgtttggaatagatccaccaactcttttttcttgggatctggagccacacatgtggctctcctccccaccccacgccactgtccatacctgtctccgtatgtgagtagaacataatcactgtgtgctccacagggattggcgacaggcaaatatgctctacttgtcggtcatgatttgggccaagcgtgccgtggctcctgtacctgccatgtgactcgtgaacacggggcatggcccaggctgcctccctctatttttgtcactgcaagagttaattcatgaaaatacgccaaaaatgggaactgaaagcagatgcttgttaagttctgcagcttggcctaatcgctgtcatcaggacatcgctgctgggggcagtgaggggagggagtccttcatttattaaacgtggagggccagagttaggggccaaatgtttggttttcacttgtttaaatcagtaagtgttgactgaggctggtggtgtggggagtacaaagaacctgcatgtcctaataggaatttgctgaaagtggcctcagacctggaggagggtatgtagaagaaaaagagcaaagcagactaggctggaggatgcggcatcctcagccagctgggcactgccagcctccagccctgccttgtctggcacttgctttttgggactggttaagaaatcagcctgggcatcttttctggaagctccacactgcattagctccagggagccctgatgacctaccgcaggcccagacatctgtcgaggaccagatgcaccccggatggtgctggttctgttgttcttggtttggggcaggtaagtcacaaatggctgaaacttcacagcctgcttacatcccactcaaaagcaccccaacgtataatagtcttactcagatcccagctccccagttctgcagctcaatgggtcattctgtgaccgtcaaagtgactgcgatgatcctctgagaagcccatgggagaggcttcttatccacaccatcaatctaccgatcaggaagagaagaacaattacatcctctgtgctctgggggacaaggggagctgacggatggtggtgaactcctcagtgagctccatatgggcatgctaagaaaaatctgctttcattttgtagtttatgatttagttcagttcacctggaaagactcaacatgaataaaaccagatgcatttcaaggaacactgcttggctctttgacaatcctcttccttcctcatcagacagtcttcctgtgcccagggaagacagcagacctctctatcacaaggaaaatgcagtctctgtcagtggcagcagctgttagtaccaggacaggtaaatggtgggccaggtcagcctgtggttctggatcctggctcattaacatatggacaagatacgctggcgtggcctctcatctgaatagctgtttacggcgaaggacctctgacagtatgctttctgttgcaagaaggatactgctgtatatagaactagagagagaagcaaaaacagaaactcagagagagaaacgggagacccagagacccagaaagacaaagagaaagagaaaaagagaagctgaaagcaatcatggatgagttttaagtgagtggaggggctgaaatatcttccatcagcacaacctacaggggcacagttgacagctggctgacctgacccaaggacacgctctcacagtgaagccagtgaagctggcctcctgggggcaggagcaaggtcagaacactacacgtgcccactgtacaaggcctgtcagcattgtcagcagtgggcacttaacacgagaaaagtcgtgcccctgggagatccacttccaaggcaactgtcacttcccgtcaaacgctcaggaccggtcagacacttttgcagcttgcagcggcgagcctgggggaccctgcctgcagaagggatgcaagtatgtgctggctgcattgcaaatggaatttgaactgtgctacggggcctttatacaccgactattcctcaggcaaaaatggcagagccagaatattccaggtgggactggcagctgagtggtcagtggccatgcctatgcatgtgtagcactggcagaaccttgctgccattgcagaaaccttggagcgagttggctcaggttgcattcagggatgcaaacatttactgaccgcctgagttgcacacagcattgtgcagagtgctgcaggggagatagtgagcttgactccatgacaatgagctccttaaggcaggacatcatgctcatcacccaaatcaggtactcagtaaacgctcttccaatgggatgactcagagatatgcacacctaaggtcgtaggaataagctcaagtttgggctggtgaaggcttcaagagaaattttaggtcaagcaaattgctatttccactgaggaaaccccttggccaatcttggatccacaggcaacatgtttttcatagtataattggcgctaactttggatagctcgttttagctctttctttcctctagctttgatctatcttttggacatatctgaatcgagcaatccaaccataggcaaaccactttaaaaagtatttatttagcatctacttctggctaggcactaaatctgggatgacaagagatatttaactgtggtgccaaagcccattaaggtggcttttacaaacaactctagacagaagagactgccatcagaaaggtcacacaacttgctcaaagtcactcagctcattgcagcaaagccggggttcgaatccaggactatatgactgccaggcatgtaccttttcaactatattttgcttctcccaaaggaagcagaaaagacatacaagatccaactccggctcccccggagcaataaatatgagaggctaaacaggaagtcccgaggagtgacagggaacgctcaagaaatgtaccaagagtgtttaagatgggctggaaggcggacagaaagtgagacaggagctgaggcctcaggacttcaaataaaagcaagaaaaccaaggatggtgtttcagggcaaggaagtggcatgggagtttggggccaccctggtgggtcctaaagcaagccggtgtatgccgtcaggggtgagtcagagcgaatggggccacatcaacagaaagaagaccctgtgaccatggagaaaccaccagtcacaggaccttccccatcacccccgcccccgccgccctgggcactgtgcaaggctggatcccacgggaacgtgtgcggcacactctggaagcccttgactgtggtctggccctgttgctagggctgcacgtgccatctcaagagtattttaaaatgttgtatgatatagactcaaatccccaaagagaaattctttccatattattcaggaaaagccctcctatttacagggctgcttcacagggaattctagaatgtgaaagagaacaaaatttccttgagtcacaaaaacaaatccaacttgaggcctaatttagaatattaaaatatgtggccccagagcttccacagtggcaactggattttgatcctttcaagtgatcagctcaactattcttgctggaccaaaagtggttgtgtctgcaacgtgcatgaacaagagtggctccacaccacggacagagcataagccctcaaagaagagacccagggggatacagggggcttccctggccactcgccccactgcccaagagatccagggggtgggggggcttctctgggccgctcgccccactgccccgtcacctgcttcttgcatggtctctctcctcctggaggcacccctcgtgactcctcatgactggaaacagcttttctctactcacatttaaaaaatcttcataatttaacaaaggcagatacctttaaattcctaggaacctacctgccaagtgttttacaagaacctagctctgctcaccaagcatttaatcctttaatgttcgatgtgttactggaaggccagaagtttgcaaggcaagtttgtgattgttgcagtcagacccaacaagccaaacactttctttcagcattttggcagttgcatgctgagagggaatgtgttcagtgcaacatctctaatacaccaaattaaagatgaacaaacaaaaaagcagaatcacagcatccttcatgcacagtgactataagctcagctctgtcctcagcacacaggatgcccaagaccctgctctgtggggtagctgaacagcgaggagttggtgggagacaaaaaatggctggacacggcccaggtccccaagatcccccaaacctctctcccctgccttcactataacccagacaggactcccgtcctatctcccaaatcccttttccctgccaaaattccctttatttttttctccttcactttgtcctttgctttcctgttccctccttgtcttgcattttatcagctgaagttcattcctcagctccgatccccacaacccgttctccatttgcctgttgtagtctaggacagaaaactcagagcctgaatttcctggaagacactaattccccactccctcagatacataaagaaattaagtgttggccgagtgaaacaagtgagacttctgcagccgcagccagggcttggccatagctgcgagggaccttccagcccgcctcctggcagaaggacgctggtcgtggacactgatggggaaatggcggctgtccctgagccccccaagaaatggagcgaggtaactagaggcagtgtggttaccatttgaccgtggaagtctgacaggacgccaggcctgcgatccacgctggagtcagccagaggcccgctctacaagcctcctttaacccttgaggagttaaatgctggcattgtggttatgggacaactggagagggatttgtgttggataaaggagcagaataaaaacgtctaaatttcatcttttctttgtgtgttttcacctctgccaaattcttggaattcttatgtcttacaattttatgtgcttttcatttccgtttgaaccagaaacatcatttaaatgtctttggaggtaatcctaacctactgaaacaccccgagaaactgtgaaaaaagtattaggatcacgcctggtgggttttaagaaatttttgatccccaggcataagttcatggttgatggaatatagattcaaacaggtatgttttactaacttggtacaccacctgaagaaagtgattttattaagggtaactttaaatgcgaaaaaaataatttcactgccatcatgtctacaataccttttggcgagaaaacaagaattcggagcttttaatgtttggcaatggaacacatcctttggaggggaggagtcccaggagagctcaacccctggctctgaagctcatcatgttatcctagatttataaccggataagctggtctgttctgatgtcttggttctatcacaagccacacaatggcaagctgtggggtctgagtgtcgacgcaccctttctcagttcctccacttgtggtccagggattcacctttccaggctttgagagcctcatttgtaacaggaagagatgccccatggtcctctaaaggtccttggtgacactcaagtgacatcacttttagattctgggactccgttttatgtttgtgcatcaaaagcagggaggatgaaaagggtttgatacagttggggcactgggagaaacaggtgcctgcagccctgctggcttgcattcaaagtcgcaatgtgccatcacatttattaccggtgcaaatagaggcttgaatcctagaggggattttactagaagaagccgggacgtgacctgccgtaatatagaagctaggaatgttcttgatattctagacatcaaaagaaacacaagccaaaatcttcatggcaccagacattagaatcccaggcagggtttgtaaagtcccaactatttctgcttaagaatctacccaagagatactccgacagctcaaatggcatgaaaaacatattccaataacactgagatgattttatgaaaaattaagggatgtcttctctggatgtgtcctacttctcagccataaacaatatccattatttatggtaacttttgatgataagttaataccccaaccaaaggagtttatggttttcatccctattcctcgggcaatggaaccatacatcactcaagattacagtgttattccctttggatgcccccaggagatatttcttgtatctcctagaataccctcttgaaccaaaagtttccacatttaagtcttttctcagaatgtttcattctccatgcccgacccctccctgcttggaaaatgcagagaaaatccatcagtcatttttgggttatcagactgtgacaaatttgtttttcaagcttcagaagattgttgaactgcgcttccccgctcccccccatttcagataactcaaaactggtttggatccgtgacatcaaccttggcatgtatgaagaacgaggaatgaggactttgccttgtttggaaccaaaagagaagaatatccattttctctctctctctcttttccatttttattaagtcagtattttttccttttagccagatgatgtatacttttaacattccaggaaaaaagtgtcagtgatatgcgagtcataataaaagaaaatcaaaagaaatgcaattacaagggacagggaactgtatcatttttaatataaaatgcccagatgaaaatctaatttaaaaaattaccagcaccatataaatgagaaaagaatataagaaaacatttgttattttaaaaattagcttaatccttaatctttctggctcttggactttcaactttatttttaaaggccaaaaatggtctttcggtgctggatcaggagtaaacctctcaatgatgcaatgagatactgtgaagtggcaacgaatttccctggcctctggcctgctgcctggaatgtagtaggaaaaaaaaaaaaagttgttaaataaaaacagtgaacaaacaggatgaaataataaccttctcattctccttattatagaggtatctattacaaacaaaaacaaatattcacatggcacgctgttgttgagaaagtgcttccatatagatcatctagtgtggtcctcccaacaagccacagataagttattactgctgtcacccctcttttagagatgaccaagaatacgtaacttttccaaggacacctagttaatcaattatgaaaccagaactcaaacccagaattctgacataaaatatcctgcctttccactcaatcacgcggcctccctaaatgtagctatgactcccagctaaacgggcctgcccagagccacgaagtcataagtgtgcatggagcagcgacgtgcttatgctgacacctctgtctctttgataacgtttacattatgagaaaagaatcaagctcatttatgtcagcagtccacaacctttttggcaccagggacgtgttttgtggaggacaatttttccacgaatggggtgggggatcatttcaggatgaaactgttccaacacagatcatcaggcattcggttcccataaggagcacacaacctagatcccttgtgggcacagttcacaatagggtttgcactcctaggaaaacctaatgtcgccactgatctgacaggagccggagctcaggcagtgatgctcgccagctgctcacctcctgctgtgcggccctgttcctaacaggccacagacccataccggtcccgggctatatgtataagttgcaactgttggctggtgccagacgactttcgcttgttctgtctctgtttctcttctagcccagggagatgtcattctgttaccctcaacccatgtgaggggaagctggaactattcacgtatttacagggagagtccgaataatcatgcagtaacccagccttcctttcaaactctttgcttgatgtaatcgccaattttcatttcaggcctgaaaaataacactgttatgacagtgaccggcagatgattaacagtgaagaagagaggagatgtcactaataatattgatttttaaccctttctctagtttttgtttggaacaaacacagtgcttaattatatggctctctacagaaagggttctcctgacatgaggcatttatttatttatttatttatttatttatttatttatttatttattttgagacagcgtctccctctgtcagttacccaggctggagtgcagtggtgcgatctcggctcactgcagcctctgcctcccaggttcaagcaattctcctgcctcagtcttcccgaatggctgggattacaggcacccaccgccatgcctggctaatttttgtagtttttttgtagaattggggtttcaccatgttggccaggctggcctgaaactcctgacctcaagtgatcctcctgactcagcctcccatagtgctgggattacaggcgtgagccaccgcgcccagcctgacatgaggcttttaggtacagaaagagaagtttcctttgtccagatgcaattttcccctattttgcttgggtcagcctgaaaacgaaagaaagagagtgacctggtggcaagatggctaaggtttctctcttcttcagcaacacccagctgaagagtggacaccagtgaatgcactctgctcctatcttcaatactgtgggcccaggagggctgaaagaaaagcagaaaaatcactttcctgcccaacgggcattgtgatggttttttttcttttattgctaacgtacgtcttctcttgtttttctttccctctgcgtctgaggttgccattccccactttctctccgcattttcttggctccctccagttttctctggagtgacttttccctttctctgtgaaaccatcacttctatgtattttccgtgtcccatgaacatgccacaagttctagaattagactctgctcagccttcccgtgagctgttttagtctgatattccagcagtctccaggtaggaaaaaagaagtcgatttaaatatgaattcctataaggctgaagctaagctaacacattctggagaccttgtggcagaaaaatgtccagaaatattggactataacataagatttgatgcttaagaatgagttatcaggtttgggggtgagaaggggtattaggtctccaacctccactgggctactcctgtcatatttttcctagcaagacaggcaacactcctcaaaggttactaagctgcgcctccaccaagaaggaaaatgggactcctttcaccttgagctctctttgtaccttcagcaaatgacttctgaagtcatcttgatctcctcttctataatgcaatcaggggcattccctgcttctctgtcatctctctaattactgaaagaaattttcccccttcttgtgtttttttctataattagcctcatagattggtcaaattcgtctgtccagatttccccccaaaattcccttctccacactgactgcggtgaccctaagctacttttttgcctatggccgggctacctcccctaacaccaatctaccctgcaactgactaacatctaacccagcagaaattactgggcatctgtaacatgactggcatgatcaaaaccctggggtggattcaagagaaaaatgcaactactcctttccttctatgaggtcaggagcaagcaatacaagcaagaatgtcctggtggcagaaggggtggccatgacggttcagagaagggcgagttcactcaggcaaggggggcgataatagatggggggcgataacagatgaggggctgggggcgaggggaggggacagcataggctacagggggaggataaatgtgtgcatagggaatgctaatggcttggcccgactttgtgggtttcaaaacaaaatctcatggaaaagataatttaaatgaaaatcggagcttattaattttctgtaggcccagcccaatttctcatagttctcagtcatgttggtacatgctagtttccgtggcagcctaagataaagctcttaatgcgatgtgagtcccttagagattagcactattataaatataaatgctcaaacacaagcaagttgaaaccaaatgccccccaaacactggctttctgttatatgaaggtttccagtggtgcactgaacccttggataaatgagctagaaaacagagagttaaatgggctcattggctaaatctcatggccgggctccttcatgggagggaagaaggaaacttagtagctgctccttacctatttaatctatagcagttggcaggacagttttggaggacaatcagagaaatgccctcagaacttcgagtaggggattgagcagggcatccaagaccctgatcaaaacagagggtctttactcaaagccaacctgcaaaacaccttcttgttctcactgctttgtatgacttccaagagactcactaacaactagtcataaatagacatcaaggagtttgtttatctaactaagagaaaacaatgtttgagttctttagaaacatgcatttgacaccacaccaatgtgctgctctgggagcagaatcggagcctgcttccttggggctggtgttttgatgtggtcattatttgctcagcagagcctctacttggcaacacctcgtttgcccaattctaggtatttgaaattttaaaaacatatctcttttaagaaaattctaaaatgaaagagtttttttaaaaattaattcgtaaataccttccccaaagttattctaaaatgcctgagactttaaagaaccatatctaagtcaagtctggtgagggcaaacagacatgacaatgaccaaatctattctttaattttctaacatttgtgtacaaagccaaacaatcaacatacatacagagtgctactcctaaatcttcttgctactaaaaaataaagggccaaccaagtattcccaggaggcaaaacaatagcttatcatgtgcttgtcctcagtgcctactagagcctccttttctcctggaagacataatgacttgggctgggtgaaattgtacaccacctatgagagcaggatgctgggttgatcaggtgataatgcttcaccatatcttcaatttttgtattttccacctatttgataatgggtccttcagcggagactacaagacgtgagtatacccacataacttcagctcagatttctgacggcgtccaacttgcttgcacgaatatccactgcctgcccactctctctcatctgagaaaactatttgactcagcttttgcctctgcctcccacttttcaccctctccagaatgctcacagctcacccatgctagtagcattggagaggaaagagcacacacattagagtcagacagatctgtgcttgaacctcaactctgcaaattactagattcgtcaatgagttgaatgagttatcagttctcctctcgttctctgcaatgcttaaatctaactcatgttagatgagttatttaacctccctgagcctaaatttatgaattcataaaacagagaaaaataaaaggctgtagttgtcgagtggtcaggaggatgaaatgacttctgtgaagtgcctggcagcaaaggcactaaaattcagtcatgactccctctcattcctctctcatttttgcattgaactgtcagagatggcaattttcctttcctaggtaccttctttatttacaagtagcttacagaaaatgcatatatgaaaggagttgtgtgaaacttttgaagccagttaagctctttttgcagagtccgtaatttttaattttaggatcttattttctaacatctttagtcaaggtaagttcttaaagaaaaaattcaaatgaagctcaatacctgtatattatcagctaggggcctggaagtagagttctggagttagcagaagtgatttcttgaaatcgtcagggcagagcggccagccaaatcctgagactcatcaaggcaggatttcctacccaacagcaagaacatcggaccttgtactaagccatgaggtccccacctggaatggtccattcagaattctctacacagacctggccactccaaaaagccagtggtgagtccagaggagggcagctgaaatgggacaaactaggcttctagaagacaatgatgactctgggaagggcaggcctgaatgtggattttgggacattcatgaagtcttcatagtacagaaaggattaagctataaccctattgtgaagcctttaggctcatgactcttgaatctcttttgaacctcaaaccctagtttgcgaccaaacagatctgcatatccatcaggtacatcaaacccaacacagcacaaagggaactgattacaccttcccaaaatctgcctctaagggtctaatcagcccccttgacagccctcagcctatatcctagcagaaaaaccggggtgatcctcaactcctccctcttcttttcctatggacacaccatcactgtcatctccaccttacagaagtctcttaggatgtctcctctttctggtcttacagaagccacttctgttcaccccactgcatggcttacctagacagtggcaagaagctcccaaccgatcttccctcatcttgccccattcagcttccctctggagtattcccagggtgtctgctagacccacaaagcagttgcgtccctctctcttatccaaatgccctgagtggctcctgttatccacagggcgagctggccctgacccacgcttccagactcccctctccccacacccactgcttgccttgaactccatgtgattactggcagcatcagctgcagcctcgttcctctacagatcctggctcacatgcatcctcaggctgggatgccactctgccttttgcacacctctccacactcagctcaaataccacctcctctgtgaagcctttcttgaccaagcccccacctccccatcatgcccttttcttattctgccccctcaaggctcaccagtgaactcactgccacctgtctctctcctccttgggggcactggctacattttcttcatcttggttttcccaggttctgatagtgcctggcaccttgtaaaagctgtgtgcatgtttgcagaatgaatgagtaaacacatggaaattaaaactatttaaacaggtccataaagattgtgttatgctcaaggaagatggattcattacacatctcaaaagaacctcaggaccttctgggactggaatggcaacaccgtgtggggtaaggagcctagaacgttcagttatgttctcaagtcgtcacagcttcaccttacccaagatatctaacatctctgagcctcaacttattcatctataagaataagaggacgctacaacatcaaccacaaaggctggggtgagaacgacacgggctcatgatgccaaacgtctggtggaggtcggcacagggcgggcagaggtggcaaatggcagtgtcctttgtccccaatcaacagaactgagctgaacatgagactctgagaaaggctcgggacagcagggccacagcacgtctcctggcctccagggacagtcaacttgaggaggcgacaaatctcatttgcaaaggtgagaaactgtacagcaagtcaacagtatcggatgagtcacgagacaggacgtgattgatgtcgggtgggcgtggaatgtgctgtgcattgcgtggggagggcccttagtgggggtgagcttggtgggaaaaggagggtctcggagggtccagctgctggggtggaggccacaggggcccaggagtgcagggtgggcgcggtaaagagactgccgttgttgcctttaggctgttctgctgctctctgcttccccctgttggcttgggagggaagagtagggctgttggctgagacggacgttagagcgagcaggtgagaagaggctgggaggaaccggcaatgcagcgaccaggagcaggtggtggagcggggaagagagagggagggctgcttggccagatgccaggcactctgccaattgcaggccctgcagatcttgccccgagctcagggtcaccttgaaccctctcctttctttctccagagtgcttgtcgcaccctctcccttcctggggccctcactcatgttctccttggaggttagaggcccatcctccctctcccaggacccttccccgcctccccagccagtgtgggccattggtgtgaccaaggtgaggggcacttggtgttcttgggactcttgttctttttcttgcttgagggcatttctcaagtaagaccagagatcattttagccctgagtgtcccagttaatattcatgaggcttgctgagaagccaaaaaaaaaaaaaaaaaaaggcttggacggcatcagacgggctggcaggggaggggggtgttcaaagaggagaagaaagcaagagccaacatagagtcttgcccagcaatagcatggaagggagtggcagcccattgtccctcaggaaaataaactgcaaataacttttcccgtttgtgtcaatctagtgctttcaacttacaaactattagtaggctttagaacttagatcaattgacattctgggtcaggtaattctttgttgtggggaggacgggctgccctgtgcactggaggatgtttagcagcttctctggcctctgcccacgacatgccagcggaaacccttgtctagtgtgaaaacccgaaatgtctccaggccgtgccaaatgtcccctggaaggcaaagtcatccccatggagaaccactgccttagattattgttaggtgctacccaaatgcccaacacctgtactggcccctccagtctcaccctcatctgagcactgcaagaacgtcccaccctggcgtccacctcccccgtccacctgatgtttacgtaaacagaaacagaagcttctttcagaagccaaggaatctcctcccaagtccagacgttgtgggttgggggtgggggtgcaggaatgcctctaactctgctcagtaactgcaaccccatggacttcataatggccaaggggactccacacccaaagccctcattccccaatttcctgggcagccagggatccaggtagaaacgcttgcccaggaggcgtctctctggtggaggagtaaaccttggagaatttgccctccgttttcttccctcgctttcttctccattttctctcccaggagctagctggtgagtagctaccgcagctactcatgtgaacatgaatctggggccaccctttttcaaatttcaacagcaagtcctggaactaaacaagaaagcctttgcacaaataaacaattaagttaattgtgggtctgacaaatattttgttttcccgaggaattaagtatgcatctggggttaggcttctgggctgagcctcttgtgtaaaaaaccagaaggcaagaaactgaaggaatatggtcaaagtcccttattttaaaatcaaggacactgagtcccggagaggtgaactgcctgtcagcacggaaaacaggaccagacataatcatggtaccttgttccaagtgaagttacctaatgctcccttcccatccaaacaaggatttgggatatgccgcccaggagggtggtcccaaaggggatcctcagaggatgcatcactaagtatttctgtaccccaggaggtggcttatttcatggaaacccttcacctggggctgttcatagaaccatgcacgcggcagttgaaaaggggcacctacgccttgctctgtgacattgttttcagtgaaaattagcgttcgctgttttcagcgttaaccttaaactccagctggctttatctcctctcacttattataattgtaacgcagtgcactgtgtaaaggtcacacctgtgtttatacgccatatgccatcaaaataccatgaagagaacactatgtggtctctatcagaagatcaaaagagaaggggtgagaagcagaccttcctcctaattcagggcccttcagtccttcccaaacactgaaataggcccatgtgcaccactgctcccgcaggagtttatgtctaggccaagtacgtgctgtttattgacagagaaacaaataccgctcagcacctgtccggtttcagagtgatgagggagtttccaatctggatctgagaaaacttttacactgtacccaaacattctttttcttttcttttcttcttttttttttctgaagccaaaattagaacaaaaacaaacatatacagagttcggcgtagcaggaaaaagaaactcagctcaagacatttcataagaaaagctccaagtccatctatactcacctggcctggaaccctgggattcatttgattgaggagggtcacaagctgtaccccagaggctcgggaggcaccactcggtaggaagaccctcctggtttctcaagctggaggagcagactgaaaggatgtttggggagtgaggaagtaataggggagtggatgcagaaggtattttgttgtctaacctagtggttccttgaggcgtattaatgagtaatattcatgcaccttctccttctgccaaggcagaaataacctggtactttttacctggtggccgagtgacctggccctaccagggacttcactaattagcatagtctctcatagcctggccttgggactggctgtcacacgctctcctccacaccagccatcagttgctctggaccctccgagacccccaggcagcctgacagccagtgagcagaaagacctgactccttcctggggccccttcctccagaggccccccacgaagctgtgctggccctgtttaggcagtggacacaagcctgttccaaccccagaatccaaggtctaagtcatcttcaataaggtattgcctgaaaccatgtgggataaaaagcttcttcctttaaaataaccttcaatgaagccaggccattactggaacttatcatatataatgacacacaaaatgccaagagaaatttatagcgccgcctgtctgcccaccatttaggcactggtgagtcattaattcatgagagatttatcagtttataaaagatgctagataagttaatttttaaaaatcatgtgagtatagatttatgctcaggttatctactttaaaaaaaggatctctcttgggctgtttttccaaagcagtgcaattcacgttaaccccccatcccactgcctccagcccatgccctagagagctgctgaaggacactggagtctgactagaggcagggctgggcccactgagtgtcaccaaaatcacaaaaacacaactgaaagagaactgttcttaaatactcatgtaccataaaaggggaatttccagaggtctctgatattagcaatttgcccttccattcccttcctctctagtttcaagatgagatgatgacaaaaagactgactagtgagaaaaagcatgaaactccatctacaaacgtgcaaaccgacacagagcaaacctgcaggaatttccacacccggtcttctgatttgccttgaaaagggggaaaaagagagaaaggaagcgtaccttcgcctccactaagacatcaacattaactctgttttcttaatttcacacgaacatcactgcgtctggagtctatgttttatttttcctgttaggcaaaagcaatttttcccaagtaaaagttctgaaacggatttcttttagaagcagagataactgggaattttctcaaaactagtacaagtatgaatgtttctccttttactttccatttttacaaatgcatttagggccaaatgcactggctaattttgatagaatgtaacagagacaggagaagcagtccatctcagtgagtgagtggacatttattaggcattcacttttcacaggcctgggatattaggtattgcgggggtgttgtattcaggaaatagaagtcaaaatccaattgagtagggaaatgagccaaacagaaatggacacaaagacaccaaaaacacctacaaaaacacagatgaatgtgcagaatcagctggagtttctatgagctgagctgaatctgctcaccttgcaaagatttccccgcacagtggggactgcccacgcgtacgcatttcttagtttctgctggccaactcgaatcgttttcagcggggtcatttacatcgtgtccactttttctggtttccaaactcaacccactttattatcttaagagttttcattctcagtatcatttacatacaacaaaatgaatatatcatgtgtacagttttatgaatattgacaaaggcatacatccctttaactcactcccctatcaagatatgcagcatttccatcctcccagaaagagcccttggagccactttgtttttaaattatttgcatctgaatatttttgagtggagattatcaaagccaaatgtgtgggaagaaagcctaatcattaatcatctactacaaatacaggtagtaaaggttttgaagatggtgcgtgagcctgcacagacaagtctgcgggattgggtcctgttatgaaatgccaaaggggctttttagcgacaggcacgtgggcccctctcagccgccctgtcggcactcagatacgcaactaagaccgagtgggtttcttttctggttttgttctttaggcatcagagtttacatgtttagaaagagggaagttgaggctgaatagtcacatccaccatattctcataggggcaaatgttctctgattaggagggctcaaccacagtgcagagtcccctcttccaaaattctgtttcaacaccgagaggagttcacatgaccaggcaaattagagattttcttagcatttcctgtttcccagatttcagaggagcccttcagggaatgtctggcccagggtagcacattcaggatgagggaaaaatggttatttttaggtccctccaaccatcacattcctccctgtctccacttgggcactctgttgttctagtgacctgtcaaagggatgggggcggggctgcgagaaaaaagccacatcgcttcctttggggtgggggtaagggtacccctgctccaggggtcctaaactgctcactagcccttctgctggagagggaccagaggtggaagacctgccagagtgagtgccaggcagctctagacttctgggtattcatttctcataaaaggttgcagtatttcctggacacctgaattctatgtcttcacggcaaaaacaattcaaaatgtcccaaaacattatgcaggaaggagtttttaattttttttaaatcacttttccaaaatggtaccctgaggtgatcctgtcttcaatctcccagcaatgaaaacaatgtggttgaaaagttgacagctttcaacccttgaaaaggtcacctccctgcctcacaccctctcgtaagtattaagagcataacggatattttgagtcacatgtattgttctttgttcatttgcatttggtgaaatcccccccttggaccaatttagtaagcagtgccttgggcttccttggtgattgttctcttgtcttctgtatattttttcctgtgaaaaaaatttagactcagccagtgaaatgaagttgcagcctctgtcactgatgctttctttttgctcagatgatctttccatctcgcttgggacagaattccttcttctttgcaacgaatgaagaccttcgaggctcagctgaggcccttgtactccaagactttctgaaagctccctcgcccctccccatctgaccttctgttggactgacatacttctccatatttcagcctcagatggcttggtgttcaccactagactgtgttactgaaagttaatcaagggtcctagggccatttacaaagtgggactgtaagagaaagtctagctagatggaaatgtatcctaaatacccccaagtcccagcacaggggttcccatcaacaaaaagcctcacctccaaatacattgctgaggacgcagggccccgtcttcccacctgacgcactacacaccacgtcagctgtcacaggaggtctgagtgctttatgaagctgcctgctttctctcttacctccatgtgtaagccaaccactctggctttcagaaacatatttctttctctatgagtaatttaaaagtgactcatcctcagcctcaccagccggtccatgtgacctgcagtgctggttgagtgttatctatagatgtgtaaaccaaagcagttcttagaacacagattccccctcccacgtgctgttgatttccctttgctacacagggagggaacgatgtcagacatgagcagccagggactgcccgctccgcactcaaatctggaatgtgtccattagaggaaacaaaggccatcacccagtgacagaaaagaagagacaggcaaaaggcctaatatatttattttagtattagcagaccatcaagaagctctgagaaaactccacaaaaattgaagacgatgatgacccatataaacaaaaaactgctcaaagttctttttctgagccagtagaaatttagacctcatgaaacagagatgacacccacacccaccccaaccaaaaccccaccaacacgtcttcattgctcaatcagaaacacattcctgggatctgctgtggtttgtcttgggaactcacatatatgaacatgtttttatttcttcaacttgcctttattccaccatcaccaaagaatggtgtcaggcccagctcggggacactactggtgcaggcaggcacgcgggtgacacagctggccagcattctagatcgtgtttcttacctctttctcacttcctattttctattaaaccaaatctgaactcatttgcctgctttgtgaagaccttcataatccagctactgtcgcctgattttctagcaccatctatgctcttggcacaattaatccttggctaccactagggcagcatcctcactgctcctccaaggaagacaccagagccttcatttccatgccttcaccctcccaaacccccaaactctgccctccttccttctttccttccctccttccttccttctttccatccctccttccttccctccttccttcctttaaattgagaaacttttgctctgtcactcaggctggagtgcagtcgcaattatagctcactgcagccttgaattcccaggatcaagtgatcctcttgcctcaacctcctgagtagctgggactataggcatgtgccactatgtctggctagtttttgtagagatggggtctggctatgttgccaaggttggtcttgaactcctcggttcaagtcattggtccacctcggcctcccaaagtgctgggattacaggtgtgagtcaccatggctggccacccttccttaccactgtctgtatctttaccttctgggagcactcttaccttcatcacccaaatcttaacccattcttccagctcagctcatcccacctgaaaatctccttaccttcctcacctgaccattcaagctgtcactaatgtctacatctcctaaacttctccaatagttcatcacatctgctcttcagttttgttttgctacctaatatatcacttcttatattttccaatattgtttgattgcaagttcttttgggaggggtatcacatatttcactcctattggccccacagtgcctagccctataacagcagatgaagcaacctttagattgaaacaaatattattttaatattgccaaaaaggtgtaataagcaaggtcttactaaacttttggccagctgttaaatttgattgcatgttgcctgaaagagaaactttactttttatcctagtaggaagttatgtggagaggaataatgtattggatattcagtaaaatgaaaaaaaacacacaacaatagtcatttatatagcactgtgtacaagcactgatctaagcacttaacaaatatccattcatcttaaacttcatagtgactttaaaaagtaggcactattatattccccacttcacacatgaggagatcaaagtattggagggaagttgtccaaagtcacatagtggctaagctagactcaaactctggcaatctggcaatcagactcttcagagtctgtgctcttagtggctgtgctatattcctgttaataggtgtgtgcttttatatggcctttttcattgaagcaaagaggagcttatcttctgtatggataccatgttacagttatgtgtactaaatccatcatgagtcaagtccagtgtaaagaaaactgatggtgagatgtcatcttccagggaagcttcagaaagaagtatggtggtggtatgggagctgaacaaatagagttttctttgaaatgaatggagtaaaatcttccagtccgccctcaggaccctgtgatatggtaccacccttccatgctctgtagaaataagagatttgaacctctgggcaatctttaggtaggcttgctccagaaaaatattactacatacccaagagaatcttcccaaatcctactttctcaacataaactcaatacaactcaaatcacagctgccattagatttgcttacaaattttaaatatgatctggcagccccagacatggtatgcctgagaactccagattaggtacaagaagaaaacctcatcctggtggtcaaatcacggcaggaagtgatgccactgacaattattcctgtattagcagttgcttaagtaccatgaggcttttagggggaaagactgggaggcagtggttggaaatgaagcccattattaatgtagtcaagctcttcagctggattcaataaaataaaaagccctgcccagaccagtgtctgtagtagaagatgctaaagagctgtttttcaaaaatctggctttattgaatccaggctttatacacagcattccttcttcctgaatggctgaaaaatcattccatgcatttgaaaccactggaggagaaatgaacttaagccatggcaagaaagcacagttagatttaaggcgtgaacgtcagcgttcaaggtaatggaaaccttggtagccctgtagatagattttcaagagagactgtgaaatcctcaagtcaattaatagaagaatatttttcacaatagcaaagacttggaaccaacccaaatgtccaacaatgatagactggattaagaaaatgtgaatgctagatgacgagttagttggtgcagcgcaccagcatggcacatgtatacatatgtaactaacctgcacattgtgcacatgtaccctaaaacttaaagtataataataaataaataaataaataaaaatagaagaatatttttattaattcaattcaggttcaaaattattattgggcgcctaccatgtgccagcccccatgtggtgccctgcaaggctctaaggataccaagatgaataaacacaaccactgctcaggaggaatttacaacccaagggaggaaacaggagctcagggctgacaaccatggagggaagtgtcttggtttggatgaacctcattgggtgtgactctgttggtctctgtccctctctctgggtttgctgctgtcacttttcatggctctggctctgtcttcattgttctctgactgccttgtctccatcttccaggcccctagctgcagacctccctggcttggggagccgcaggcatcttctgtgtttatccctccaaccacatccctggccaatggctgcttctgcttccataccctgctcagcaggctcatccacactcatcaggaatcctggagagacctctcctatcccaaacctctctcaggctaaatggctacacaaccggaaaaggagccgtggagaaactgactccttgggggtgaaggcctcgggcctaggtgttttacagtcacctgtgcaacaaacatttacaaagggatgcaaagggcccagacactggcgggagacaaaaagagattgagcaagactctgtcctcaaggaccttaggatctagagaaggcttgcaggggaggggggtggaatctaagcccgaggggatgtccgaataacaaacaagctatatgacaatgttgaaaacagagttcactcccaggttgggtctaattgagccagacagtcattgtcaaaaatcacatgccccaaatgggcagagttcgtttgctggatcgctttaaagctgtgccgtctgccttgaagcaagtccactgtcattttgttaaacaagggtccttcatccaatactggttatggccagggttgcagacccacaggacacaaagcctggccctcagtatgaggaccagctgctggctggcttcctcggagggggactgtgggcttggggggcactcacggctttatagactgcccagtcccatgccccagagagaggtggttggcaggaagaaatgtgacaccaggaagtgctaaggagaaagacaaggcagctcccagagtggggagaaggatccgctgtggaggaggagaaacttggccaaccttggaatgggccttggaagacgagaggatttggactgggggatgtaaggcgaggagtcaagccagctccaggaccctggacggggcagggacggcgtccctggaccctggacagcacgcatatcctgactggggaacgaggtacctgcagaagccacactgtcactggctgggaggacaccctgcagttgactgcgccagctctcactggccaagcccatacgatatcatgatcagatcatggaaaacgtatacatattaacagggaaccctggtgaaatacattttttggaaattatttaggagacaaacagtataataatgaactggtgtcccttagaacagtgttaaacaggagtgagcattaacacacccctccaacactgggcagatgctatcactgtattgacttggagtatgacagcttaccgacgggatatgaggtatcacataggttaagtttggttagtaaaacattaatgattgcagcattagaaatgatgcattcctgacaagggacactatcgtcttatacaggtttctttatcatattggttgactgatgtacttccctcccctccttctttccttttgtctttccttccatggagcactgaccaggtgctaggcactgggctagatgctgagactacacggcagaatgagatgtaatccctgctttatggtcgcatgctccagccagggagaccaacagctaacaaattctaatgttgcaacatgagaaggtgctggagtagagggatgtgggaaaggtgatgggagcacgaaggaaggtggcttctgttttgaatgggttttaagaggcctcctttggtgtataattctataataaatatgtctcattgctagggggttggctgtctcttacagtcacctatttcctgtctttctcgccttccttcattcatctatctacctccctttctctttcatctatctattcatctatcatgaatatcatctattcatttatctacttctttttctctttctctccatccaacatccatcatccatccatctagccttctaggacattttaaatacataacttttctctctaagtcagatttctcttcttgctataggaaaagcctagctaccaaggatcattttgctaaagtgaaggctgacaaaggagatttagaattccttctttgggcacatttaaaaataaaataggactggggccaggtgtgatggctcatgactatcatcctagtgctttgggaggccgaggcaggaggatcacttgagcctaagagtttgaaaccagcctgggcaacatagcaagacctccatctctacaaaaaaaattaagaattagccggatgttggctgggcgtggtggctcctgtctgtaatcccagcatatggggaggccaaggcgggtggatcataaggtcaagagatcaagactatcctggccaacatggtgaaaccctgtctctactaaaaatacaaaaattagctgggtgtgatggtgcatgcctgtggtcccacctactcaggaggctgaggtaggagaatcatttaaacccgggaggcagaggttgcagtgagcagagatcacaccactgcactccagcctgggtgacagagtgagactccgtctcaaaaaaaaaaaaaaataaataaaggaattagcaggactgaggcaggaggatcacttgagcccgggagtttgtggctgcagtgacctatgatcatgccactgcactccaggctggacaagagagtggggccctttctctaaacaacaacaacaacatgattgttgccatctggctggaatgggcaggtggttctgcctaaaggcagaggggcctattggagaatgtgtcaagagtgcccatgcctccttgttccatccattgccaatgtaccaaggatcattttgccaaagtgaagtctgacaaaggaggtttagaattccttccctgggcacatttaaaaacaggactggggtcaggtgtgatggctcatgggcaggaggatcacttgagcccatgagcttgagaccagcctgggcaacatagcaagacctccatgtctacaaaacaattaaaaatgtcctaagtccccttggaccaccagcagctgccacctgtcaacactggaactgatcgcccaggccaaatgttgaggtggggactgaggccctggaggatgcacatccatagtctctgaggtcattctttgctggctgcagttctaacacggactgatgactctgcatggagagtcacaggaggcttatcgtcatccatagctgacgtccacagccagacatccacgagatgctcaaactcagaatgctatgtggctagcattttccaatgcctaaagcttctgatctgtttccaactggggggaaatgtggactgctccgtttattggtatgtctggcctctgtcgcctaaatttccaaagattccctcatcttctgtgaagtataaagtcctcctggaatgccagggctttttaggcggtctgcatgttgtaggaagagaaaaggtgacctgagggtgggatctagaaacattgcactttccctattggaatccaaagtggggagccattctcaacaactaactagcaacaacccaagtcctcaggattgaacacgctcagcggtcatctgtctttatcttggggtcttaactgtatttgatgaaagctgcttattggcctaacagcattgaataaacaggcaaaattcccagcctctggctgactctcctgaagtatctccagccttgattctgagaatctaacatgggcttcccagcactacaggcacaggcaggcacctgatcatccctggtgacacttatttcctaatcgattccatggagggcttcttttgggcggtcagaaacaacaggcccttgttttctaagttaaatgcagacagaatagtttttccccttcgtgtttttctttctttctttctttctttctttctttctttctttctttctttctttctttctttcttccttccttccttctttcctttccttcctttctttctttctttctttctttctttctttctctttctttctttctttctttttctttctttctttttctttctctctctctctctctctttctttttctttctttcctttctccctctctctccctccctgtctccctccctccctccctccctcctctctttcttttctcttctcttctcttttttttcttccttccttttcaatggagtctcgctctgtcacccaggctggagtgcagtggcatgatcttggctcactgcaacctccacctcctgggttcaagcaattctcctgctctagtcacccgagtagctgggactacagtgtgtgtgacaccatgcccagctaatttttgtatttttagtagagaagggggtttcaccatgttggccaggctggtcttgatctcttgacctcatgatccacccgcctcggcctcccaaagtgctgggattacaggtgtgagccaccgtgcccagcgcgttttctttaaggggtagatgccggtggccgtcatcaaagtaattctaatgctatttaaaattcttatctcttgagaagaatagagatgatcctttaatgttcttttacacatttttcaatgttttccttgcaactgtaacaagcaaactcatgtcatcaatagccatattatgaccgtaatcagtgatcagtatgtggaaggaagcctaacttggtgactaacagcacacacatggctttaaacctggctcagtcacttaccactgcatgaccttgcgcaagctgctaaatgcctctgtgcctcagtttttttcatctataaaatggggctaatgatagtgcatacctcattaggttcttgggagtataaaatatgttactatatacgacatgcttaaaacagtgacgggcacatggtaagtgtgagctctcatactaatgaatgaataactcattgaactaagcaacaccaagcagacaaggcagcatctagaaacttgggttttcaatgggctacaataatatagcaatgagcttggaatggtgccttgtgcatagtcagtgttcaatgttagcaactcgtaatatggacacctgggccccacttttgcttggaactgttttatatgaccttgacttaatccatccaaagctcagctacattacattttgcttcctttcttccatctttggtgtttatgcggaaaagacccaaccccaggtcagagaaagtcctccactaacactgtgagatgcaagtcacattcggtatatgaccagtaaattgggtcccactttggagttcttctcccatttcattatccttctgcaaattttccttgtgtctgccctttatatgtgctcaagacttcaaatcatggggccatctgcactctttaaaactttcattcagtcgtacttctattttgcacataaggaaacacaagtacaaacgataatgtgcaaagcaggtatgaaattaatcaggcttgtcatggacggtcactgggctcacaagctacaggtcgcacatgggtgactgtcaacagttggctggacactgatagagagttacaccaatcgagtgtcttcttccaaaaacttagaatcaggtagacgccaatgttttcttaggtattcttagtaaatagacttttttgagcagattagaaaaggaacgatttatttttgaaataatgctagtaaaatatataaattcagcttttatgagattttcttactgttataatgttttcctctattctgaattcaaagtgaacttttaaaatgtctaaaaaccatgctttgcctaagtattcataagccatgtgtgatacgtgtccatcatttgacaatggccagagtttactagtgtaattttcaagtatcagtccctgtgccaggttaatggatttaagaaaaaaaacaaaaaccaacaccttaatttctaagatctggccttttaaccttttaggaaatgaaaggatttaaatagcctgctgatatatctcatagtgtgtctaccctgcaattccactagcacggtgtgaatgagcctgattcactgctggagtgagggaggttaggagatcctgataaactcagataacatgtaaagaaaatgcttagcaactggtggcccaggagcattcagaaggcttgcaagggcaaagcacttataatcatgaaatgagaagggatgttactgacaataaccaactgattgataacatctagttataatagagtctagttaagtgcactcacaaaacagctatatgatgccacaggtaaaatgaaactttgaaagaaagctagtccatatatggtaaatatgcttcaagctgtaagagataaaaataataaatatggccaggcacatagctcatgcctgtgatcccagcacttgggaggccaaagctggaggattccttgagccttgaagtttgagactagcctaggtgacagagcaagaccttgtctctacaaaaaattaaaagaaaaaaattatctgggagtggtggcacaggcctgtagtcccacatactcatgaggcccaggcagaaggattgcttgagtccaggggtttgaggctgcagtgagctatgatcacaccactgcactccagcctgggtgacaaagcgagaccccatctctaataaatagatacatacataaatatatacacaaattagatagaatatcaaatacatttgttatatatcagagttagatttcaactctgacctgtaattgggctaatacctataaggcacaggatgattctgactcccatgattcagagcatgttgagcttagcatggtcttatgtattaatagtttaaaaacacagtgaatgaacacaatcctaatgaacaatttctaaagatggacagagcacttcacctggtaattacttttcacatcctttcattcacgtactcacttgctgcacagctactatctcctcactcgtgagtattattcctcacttatctgtctgttgagcaagaacaacgcagacactaaacaccctgatgctgcttggtcctgaagaactggtgagatggatctggctttttcatcagaatattattattttcccacttgagtctttggggactcaacaatcatgccctgagagtaggcatcaaaatggtaaacagtgaattcccggccgggcgtggtggttcacgcctgtaatcccagcactttgggaggccgaggcgggtggatcacaaggtcaggagatcgagaccatcctagctaacacggtgaaaccctgtctctactaaaaatataaaaaattagccaggtgtggtggcgggcgcctgtagtcccagctactcgggaggctgaggcaggagaatggcgtgaacctgggaggtggagctggcagtgagccgagatcgtgccactgcactccagcctgggcgacagaggaagactgtgtctcaaaaacaaaaaacaaaaaacaaaaacagtgaattcccatctaaatgaccaactctacctgaaaatgtaaaagtattcaatgagatcatgaaggcagaaaagtcatgatgcaccaacggatctcaactccgcattcattcctcctttaggtcagctttgtcttcacttgcaccatagcctgcattcccattgattgactctacgcaggatgtctataaatagtaattaaaaactgaaaaaagacatcatattgtttaacttgaaataacctttcaaaaccacaaaaagtttagctccaatatagaagttgtgatcaattctcctttttgttttattccagaaagaaactggcacataatcgtaattaaaaactgaaaaaagacatcatattgtttaacttgaaataacctttcacaaccacaagaagtttagctccaatatagaagttgtgatcaattctcctttttgttttattccagaaagaaactggcacatgtaagatgaagaaaaattctgtttccaacatatattttgctaggctcaccgttaaaatacacacaagccaaaaacaccgactctacctgaacattttgggggttgtttaaacatgtttgttttcttagtgaagctaaaaatgtttttccctggtgtttttgaagagacatttagactaaaataaaaataaaaataaatgacatgtataaaaagttatagtcatcagacctggagcagaattcggaaagcggatggaggaagtgaattttaagacctgtgcagcagttttcctattttggttgctctaaatagacgtggaaaaacaaatcgaaagaaaaaagcccatctctctccaccctgtacaaatgagatataaaaactgattcctcatctggagttaagctcaggaatagattaatgtatgtccatgcaatattttttctgttattatagatcaaatgctattactatgaactctaataggacaagacttcttgtttgtatcagacttcttatcatttggtatattctagacatgactgagcttaaaaatcttagggggatgaaaaccacaaagaaatatttattgtagaatactgactataatcaaatttgacttgcagtttccttttaagtgagaaaaacataataagaatttcagtatagaaagggtttcctcacttggataattggaatgaggcccatggctttggaaaatctctgaaaatattaggctaagtttcttgtgtttgtgaatttttctggagagaggatacatagctgtaatttaattatcaaaggatgcacacacacatctataatactatatgtatatatgactatatatagacacatacacatatgtatatttactcatttaattcttaaaacctctatgaaatgagtactcttttgttcctcattttacagataataaataaacaaagattacctacttcctaggttagcagttgtttcacttaatgctaagggacccagccaagactatgaacccaaaactcaatgagaaacacaattgaaactcagaatttctagtacgcatggacgggtggatgaatggatgtctcaggtcttttattgttgttttttttttcttctctgctcctctttttctgatgtatgtggatggctctcctgtcaatttacaacctagtctaatgttaaacaccaactcatacttgtcttttctgagacccaagtaaaaaatggtacattcattttctgttataaagagcataaagaggctgggcatggtggctcatgcctgtaatcccagcactttgggaggccgaggcgggtgtatcacctgaggtcaggagttcgagaccagcctggccaacatggtgaaaccccgtctctactaaaaataccaaaactagccgggcgtagtggcaggcacctgtaatcccagctactcggggggctgaggcaggagaattgcttgaacccaggaggcggaagttgcagggagtcgagatcatgccactgcactccagcatgggggacaagagtgagactttgtctcaaaaaaaaaaaaaaaaaaaagcattaagaagttctacggtcttccctcaatctctctgtcatctcccccaaaacactaaattttgtggaattccattaagaactatatagcatactcctaaaaacacatgtctgccgttttcacctaagatgccacactgacccacaaatccaggttgaggggtatctgtcttgacattgtttgaagtctaccacattttgtcaaaagccaccttcctcaaatattatcgtcattcgcaagccccccacaagcacttcctcagtcactctccaaagcttggataaagttcattccctggaactttgggcaaccaaatcactagcattcatgaaaaaatactggaaaagaaggctcagccctaaacactgaataacttctttgttgaccctcaaaagatacaggcaaatttaaagattgttccatttgtcaattgattaaaaaaattatgaaacataatttaagttagacgtgggagtggtactagccaaatgctatagtcgaattagctaaccatctgttgtactgcctagagactttcacatatattatttccaaaagtcatattcaaaacatctagcaaccagcatagtgtgcacctaggccaatcagactaggcttcagccagctgtaagcagccagcacagctgggcaacctaggtgaattccagccctgttagttcatgtaaggtccccattggtgctaaacctgttttaccaatggatttaagaaggaacccaaagtgtgaaaattcaggcttcaggaagtgaaggggtggcctggatcaatcagctggtaaatgatagagaggagattcaaagtcagatttcccaacccttgctctctcctcctcccactacacaggtgcccaaaaatactctcagggagacaaagttgtctggagctccacgccacatcagacagcaaagctattgggactactcaggagacaatctatttagacaccttcttaagagtatcaggagcctgagagacgggcatcctctgatctccagctttctacggggctcacacctctctgaatagtttcactgtaatcttctctgctgcctgtgacatgggaggcactcacactggagatgtgacttgttatgatggaaggatacatgacttgggatgatgggaaggtgggtgaaaattgtggatggaattttcaagcaaagggaaatctaaaaaatgatctcagcttgaactcccacagcgtggtttggttgcctgcttccctagacgagctgttctgttcgctctggtcaggacttggcatggtctattgaaagaattttcctttattagcatggggagcaatggcaggatggaaatgagtgttttgagaatgcttgagataaaatcactggcagactattcaatattttctataatgatgagacctaacctaacaaattggtctgtctctcatcctctggccagtcctttctgacactagagacccagtgggcctgaggagggcagcctaggaggccaatgtgggtggtcaggcacctggggaccagggttccaaaaccctcctcctgtcggctcccaatagggtgtttgcctgcctagaccgtgtcaggcacagagtcagcatttgttcagggactgcttgttgattgaatgagtgagtgaacgagtgaaagaaaggatgaataaatcaaacagtgaataagtcagtgaataaaagagtgagtgggtggtagtagcgggtaaatgggcaagggcagtaatagtcttttctttcttttttttacaattgatacatagtaattatacatatttatagagtacatgtgatattttgatacatgcatacaatacctaacaaatcagagtgtttaggatactcatcacctcacttatcatttctttgtgttgggaacatttaaaatcttctcttccagctattttgaaatatataataaattgctaactatagccaacttactgtgctattaaacacaataacttattccttcatctaactgtatgtttgtacccattaatcagcctctctttatcacctcccaacccttcccgaagaacttgatgtttttcttcttttctttttttttttttgagacagggtctcactcccatcttctgggctggagtgcagtggtacaatcacagctctctgcagcctcgacttcctgggctcaggtgattctctcacctcagcctcccgagtagctgggaccacaggtgcacacccccacgcccatgtaatttttctatttttagtagagacgggttttcatcatgttgatcaggctggtctcaaactcttgggctcaagtaattcacccgcttccataggggtgagtcactgcaccctgccaacatttttcaaaagtaaaaaataaattaaaaaaaaagtctttagtggattgctgagtcccctctgacaggaggtaccaaatgtgcttttcctgaggacaggggaagagttcactattcagccatacctttgcatattttacaaaattcacttctaccaaggatgcctctccacaaaatgaggagtagcacaaagaacacctaagaaaccaggcctgacccagggcctctgatgctggggcaggttccccgcgtgctaatatcccaggggaccctgttgcagttctctgaataccggctgtgagctttccaacttcagctgagtcccagcatcctcctcacaccacttatcctccttgcctgtccctggcgcgtttagacaactggaatctttgctgacattttaaatgggctggctacttctccagcgtggaggcacctagcacaaggtgtgatagatcagtatttgttgatgagtaacaaagttattctggcaaattggacttttcccctgaaacgttttggcttttacatttttaatgatgggtcaagaaacagcccccaagaagaaggggcggagatagggggtaggaccctgcctgaagcttccaagctgactctgtttgcagtcacttaattcactagggagggctggatctgcctccctgtggtggactctccgcatctccagaaagtgcaggggtggagaattaactcagcccccctcctccccataagagccccgccaggtcagcctgcatgaggagggcacgtgcacacctccaaaaggactggtgcagccacttccctaagctcacagtcccagtgtgagctcagggcccagactcggggcctctggtgtttcaggcgtgagccaagtcccctgagcaagaggcctcatgataaatcagttggagcctgggggccatgaaagcattggttatggcagaaactaccagctcgtcaccgtttatgctgctttgcttaaaaatgacaccgcgtaagggattttgccaattcccaacctcgggagatcacccaccacctggctgtggtccgccgctgaacaggaaagcactccgagatgccaagagactaaaaggctcgtaactgttgtttagaaatgaaaatggccctaaattataaccagagatggaagcgcgtctcaggggagggcggggcgctgtgtaatcgagcctcccatgcgcaaggcggatacaaacggtttatggatgtgggcgaaggttctcagagcaaagaatgtccatttccatcagattaaaatacagtttgggaaaacaattacctgcctgagatcctgggaaagtaaaacttcctggtttctttgccaggaagaacgattgtaaaacaagggctgagaatctcccaaacaagattttagaattttatccaaacagctgcagttcacctttgaggagccccagactcacttgggtctgatggatgttgcaacaccaagtttgaggtctccccagcctggtgccaagagtgggccccaggggacaaacagagaacagttgctctcttaatcggagtagaaaacaaaactccctccccttcccacccccaacctccctgctttgttgtgaaattgtcactgcgcctttgaggagtgattaaaatcccagccatgaccaatttaaagggcaggttcccaggcagggaagggaaaggggttcaaggcaaaaaaaaaaaaaaaaagtcagttgaagtgagtttatggaggatttggggatcacaaaagtcatgggacttgagtcaattaaaattaatggaaaagcaccaacatgcaatttaaaaaataataataaaataaagcagtaaggatatttctggcttgctctctgcttccattcttgagcctgcttgggaatcttggagcagacttcctgaagcacagcatgagtgcccaatggctgttttaacctattttcctgcccttcacacacaaagattctgcaatggagagtgggaatgaatggtccacccacccctgaacatttcctgtgagttgggaatgcgctcagtaaggctgctggagtggagggaaaagaaaaggtgtctgagttctctagacatgggcagaaaaggagagaatttgagacaggctgagagaaagctgctccggttggcagcattgccagattctcagacacaccgtacattccagcccccgaaaaggccatcctgagtccctctagggcccctggggctctcatctcatcccaaatatttggaactgtctgtgcctgctataatacacaagagccccttcccatgttttctcctggtgctatttgtaaaggtgaggaaaggtaacgataccaaaggagttctaatcctatgggcttggttcccagaaagccctatgttgcggtgcggaaggcaggtaaggaggcgaaggttcccaactccacctaggggagggagcatatctcagcaaaggactcagtctttacccagcctgaatcttacctgtggtccttggatggacactcacattgattaagtcaagagattccgatcaagccctctcatcctcattcctacggtggggatgataatagtacctaactcgccggtgagagttcttatgacgatgaaatgagttgccaggtattatagtgtttagaatgcagcatagcacacagtagctcaacagatgctcgatttcattgctgttgtaagtgtccttattctctgattgatcattcatttagctttctcttttctcactcaatgagacttctgcagtattgtgatgaatgtcttatagctatccctttcatgaaagacctcagagccccaagttacaaaagcacatggccatctacgcaatctatcaattaagcactatgcttcacctgattaggaaacccttacctttcggcatcattccttcttccctttcattttcctcccttcttctcccttccaaacccactacacatgcctagctgatattttattaacccctgacggcttatggaaaatgtgttttagccataggaacactgatgtcctatagccaagttgcttttctgaatcagacaccagctccctagccaaatggggaagagcagggaagggagatattaaaatcctttgctaaagcagaagctctgggtgttgctaggaagtcttgctcttcagcaaaaactgcagcaggaatcccttctcctcctttgtgaaacggaaaacaaacggcttgctccgattccccggctctatgggggctgctgagcagcactgcttcccctggagagagaaggtggaggcagaagctgtccgcccaccccaccccagaccgcccatcccaccccaggcttaatctccatggcgttttccactttcccaggctgaccacggcaacgtgaatgcttcgctgccagccagctgagtactgcccttggtgagaactctgcctcggagaagcagggggaactgaagctgcattgtaggatagggggtctccagccaatgctcctagaccccctactagtgatggggctctcaaactactagtgatggggctctccatcatcaaggtcccttagccctccagctcccgggcctctcagggctcctacggtagctgctcctatgggcagacacatcccttttcctattatagttacagcaaaaacaataagcagtaaatccaccaagggtcctgtgggctcccacagaccaacattcccacaatgcccagtggaaacgtgtcagtgtacagacgctttgattcattgtgatccaaggggcttttcatgcctttaaaaacaaatattaatgtggagaagatgctttgtttcaccatgcactctcatggctcacgacggaggccccaaatgtaaagctttcaggacaagcaagtgcaacatgcaagacagaccagtcatttttacctctgccaccagaaatgaaaaagcgttttctccttgtttggctgcaggttactaatttggaggatgccagttttagagttcatctcagtttgacttgtaaatgaaaggtggaacctagccaaaattacccctgtgtggctgctggccctggcacgcctcgcatacccctctttcctatgttgaggtgggacagtcactgaaatcattagaaagagcaactaggaggtgcaaaacaagccctggaaggcagtaaagctctgtgagcaacacagaatctctctctcttagctttgcgattgggaccttcacctgtagagaggatcccaagcactggccgtcagaatcacccagggcgcttgggaaaaatgcagatgcctggacccgtcagtgagcccggacctctgtgtttctttttagctctcctaaaacaacatttcagaaccactgcctttcagcacagcagagagaacgaagttatggggagggttaacttgaaatagagttgtggacttcttctaaggtctatcatcattaagcttcccttgcagaatgtcagacatgtgtccaacttcaccatcatcctatcaaatccacatgacaacctgcaagtacgatttgacgtctctgttttgtggatgaagaaacagaagctaagagacattccagtgaactctggatctggaaatccacggctaggaagcagtctgtctgatgggaagggcagatgcatgcaggttccacagaaggagccctgcctcctcttctgagcctctcttggttcctcacgtccaagtgcagggtcagagatggggcaggcacatcgtccttttgctggggatctccaggcacctgctggggggcacctccttacttcaccacctctggccagcccttgatttcttccttctccctggttccaatcttctccccttatcttgctctgccttcctctttcctcctttctcttttcccagagagtagttagtctcaatcttgcaaacacagtgaaatcacttggagagcactgggtcttatccttagggagtgtggcagaattgatttggggtgtggcttggacaccagaacttttaaatactccaggctgattctagtggacagccaaggttggaagctgttccctatccagagctgtcagccacagcctgcacaatcaggagattcacctggacatgctcaggctgaagagggtctggccaccagcccacggtttgaaacagagccctgtgaagaaggatcaggtggtcccagtgccagtccagccacatctgtactgagaaaacacagagctaccaccagctgaccgcatggagcgaggatcctaacacctgatggacaaaatgcgtccttggctggcctctgcagagaagggactgtggaaaaacatatgctgctcccttgagaccgggggatgtccacagggtgggtgacaggaagaagagagagcagctaccacagccaccctgcatattaaacagcctgaaacaaggggtggctgtgcaaactccattctcctgccataaattagaccataaaacaggcttcattggcccattctgcaaatcaactctgcagttttattacacacacaaacatgcataccacatgtaggacaaaaaaattttgcatagagttctgctttgcactaatctctttaaggaaattttacagacggtaaataaaacctcatgtccctacctggggtatttgcctgaagataagagcaactcattgcaaaaggattcctgctgtaagacagactgtagcccatcaggggagagcaggatggaaacagaggcttcctgaaatacttgaagggttctgcaaactgttgaagccacggtactgcctggagcactcagcaccgagctgggcatgcctaggtcactgacgaatctctgtcaatgcacaaatgagcagatgcatgtcacactgatggtggggctcagacccaccccttgctatggacaaggaagtgctggggaaggaaaacaaacacaaaaccttccacccgaagtaagatcagctggcagatgagcgtgcagaaggggtaacagcaactcatggagggcaagccaccagagagggcaggaaatgacccctctggacacctccctcttggctgtgggctagcagtgagggagagaaagaagagggcaggtgtctgctcctctattgctccaggagaggaaaatgccccccacccccacccaggagttggtgttgtggctcacatcacagcaggcttcatggaagttgagctattatggcgaagagggtgaggtggggcacagagctgtttgggacacaggacttgctctccccatgggcatgggacagctgttcctcatgagagacagctgcagatggggcctccgcgcttggccatcagctcagctgtgcccgtgggtacctcagagggccaaagcagcctctagatgagagaaaattcaaagacaacaagaagtaaaccaattctgaaaaaggcgactgaagacaagggctggcaatggcatcattccatgtgtggaaggagttcagaagaaaggaaacacgccatcgccttctgcatggggcgggggcggggggcttaaacagatgtctgagaattgtatatggacatctgtaatcacacagtttccatagtaaacatttgcctggagagaattcttttgctctcttctttttcccatctcttgtgtacattaaacagtgcaatttatgttagcaagaataaccacacacctctctcaccacccttctttgagtgtatcttaaggcagcactccattatgctgtggaaggagcctgcatggggccctgccctcaaacataccatccccaggaccacagtggcacagacgcatgacagagcagaagagaaaaaggccccgcaaagaaacagaatggtcccaatcctgaagtgtttgattacaactcaactgagtacctgcaggagacagagctaccaatcagagcagggactcatcggctgctggttgagaggccaacgctggccttggccatggataaggagccttgaccaactacctaagaagaccttgggaatgcacgtgtgggctcagcttgacaccgacccactcttctaacttcctgtattcagattctgtgctcaccaagctgcctctgcagcatatctggcttcctaggaaaacttccctgcagagagagcatgggctggccaggcaagcatgaatattaatctgaaatattctcattacagatgaatacactggcattcttgtttgaacacctatatagttggcttttaatgggtgtcagcccctaagagatggatctggcctttgagggatgaacagatcagatcttcaagcatgccaggaggaagtccatagagctctgctttgcaccaatctctttagggaaattttgcagactgtaaataaaacctcatatccccatctggggcatttgcctgaagataagtgcaactcattgcaaaaggattcctgctgtaatacagactgtagcccatcaggggagagtaggatggaagcagaggcttcctgaaatatttgaaggcttctgtaaactgttgaagccccccgaccatgatgaattcagcaagtaatgccatccttgaaggcgccttgagggccatactcttagtcttcccctgatgacatccgagtaagttgttgaaagtctttcttggccacttcttgaatttctacccttcttcttgaatgtagactgtagactcagaaacgaccctgagttttccagggtctggatgtctgaatgtgatcaatgtggccccagaagcagtgggcatcttggttccactccttagcgacactgccaacttcacagctgataatcactcctgacctgctaaatcctctggtcctgtccaattctgatccaatcagactgaaagccaggcaagaaaggctaaccagagggagttatgagagatgcttgctctcacagaacacaggctttggttgggaagacataacatatacatgaaatggtcaaacatattcagtgtcacaaatgaaaatacagcccacactgatcaagaagtgagtaggccagaattgggtggcattaatcttaaaaggatttctgaaggaagtatttctatggaaaagcagtgtcgtgataaaaggacaggtcttcaggtcaattctttgggttctaacgtctgactatttgtgatttcacaaagtatggtcaaggctaggtgagtggggtaggaacaaagtgcttgacatacagagatgctaaaaaaagtgtccttacaaatatccctgcaagggaaaggatgagaagagacaagaagaagaaaatctgaagtgtttccttcagggctagctgctttccatatggtatctcatttgattctcacagtcacactgtaagatgtttattatcctttgcatcttacaaagaagaaaccaaaggtcaaggttaagtaacctatctaaagtcattctgctgatctgtggcagagtctaggtagtaaccctcactctgtgtcaggcattattctaaatgttttatttgtattaattatttcggcttcacaaccctatgaggtaggtactatccttaaccccacttactaaggaggaaactgaggcacagagaggttaagtaacttgcccaaagtcaacacagctagtaagtaacagagccaggacttgaacccaggcaatctgggtcctgagtttggaatgctaaccactttactatctttttccattacatatgccatactgcctctctttgaagaatatttatgaacagacaaaactgtcaaaacagcttggagctttaggatgaatattttaaatattataaatccctcactcgtaggggagtggttgtttgatatggtttctgctgatcactcagtaatctatccaagacagtgatgtgcacagactattttggtttcagttaatatatagcaccatataaacattgactcaactggagagcctgaacaataaattatcactagctcaagtgctaaaatagcacttgcttttctctgtgcctgagcatgctatctatttatactttgcttacttctgtggagttcaaactgctttatgcacatttcatcattgctgtacttacatggatttattgtctttattatacacatgtgactaatgtaccacacaacgcttaatatttactacaggaatctcagttttcaactagctttttaatctatgggtattactgactgcctttaatttataattagtggaagtctgctaacaataaaaaccatagcattttactgtttatcttttagctcaattcattttgtacatgatatgaccattcttgttcttgagtatgaaccatatattattttctggcctttctttacaattccacttatggctgaccttgaaccagaataggtctgtgattttactttccaaagtccaatacatgtatttttcttttgttcatgttgatatctgcattggcacacgtgaatttccaaatttggtcttcaccttttcagttttcataggcaaaaaataaatttggatgatgcaatagtcagtaaagaactccaaacaaaggttttcttgactagctggaggatatatggaaatccctaactgtggtgtatataaactgtaaacccaagtttatacattgtcaggagttaatagaacttaagatttagtagcattctttagtactagattcataaagagaaatgaagaaagaattgtcatttgatgtttttgtcctgacaaataaaaatagccaactgcttagcccacagctggggcattctgttttcttttgtcttcttttcatgtgaatatccatcttcattattgaaaacagaaactccaaccttaagcatttccctgtttttgcaaaaaggatattatatcaacagtcccttttaagaacaggaagttatcgtttcattctacacaagtccctacagttttcatcttgccctggtgtgtcatctgtcagtgtgactttaggaaggtgagacaggtatggccagatatgagagatttttaaaagtcacagtgtcaacaatggtgttataaggggagtgtttagtaacagagccatttattttaggaatgtttttgtaccctggtaatcctgatatgataaggctttaacaaggtcaactaagtaacctgtagtcaatatcctcattcaagagaggtcagatgcttggggactcacagctgtacagatgtactgtgtgcccttttatctctcccttatgcacatgccgttctctctacctagataagtgggcacctctacctctatgatttctctttcaggactccgtgtagttatcatttcctctaaaaagcctttcctaaaaccaagttggatgtctgttttgtgggcacagccccctacacccaccccacttatcctaatgggttgaaaataccaggaaaaacttcagataaagaccatgccccagtaaatagctgaataaagaacaggtgaagggtgtcagaaaagcaagaaatggagacagaggcttggaatggtcttcctagtattgttgttgttacctctacatggccaccctgggggtacacgtggagctgtggaaatctctaaaatcaaaaccaggccaggcttagaattagttcgactaatacagattacgttacttgaatgttttcaaatgcagattttgcttttttatttttctttgctctttatctcattaaaataaacagtggtatggcattcccatttgaaccaggtccagctctgaaagctggagcagtcttcagatggcatgctccatttggcccctgctcatagggctggcgttcagaccatggaaatatcagcagaatcgaatgcacttgggcagtttccataaactttgtaagtatacgatcaaagttaagacaaatgggaaacacagaataattaataacaatggtgagtggaaaatgctagcaagccataacaatccaaagcatgttttctatctctttttaagcagctatctgtcttacccacaaagacactgcctgaaaaatgaattcaccagctctatatctgaggcagaatgacatatggaaatagtacagtctttggcgttagacctgagtttcagtgctagctctgaaacttacttgctggctgcatggctttagcaagttccttaagatggcagggcctctgcttcctcatcaacttttacaattttggaggtttagagaaaatataagtacaagtgtttagcacatcataggggttcaataagggatgactagtgccatcatcattatcttcaacactactgaagaaacagtaaaataatcagtttggaaattatgaatgaccctaaactgaattggagtttaattatataggtgatagaaataaagattggaataagcaaattagaacataaactggaaaatatttaacaaatgtaagaaagcaaacttttgaataatttaattatactcattttaccataatactatgtatacatcaacaaatcttaatttgtattaatttgtaataatattaatttcaatttataatactcataatccttaaattatatattagctgaacagtatattatatatccttccagaaaatgctatgaatatacatgcatttgtatatgtatctaatttttttctcatcaataaaataatattatccatacagacttccactttttccctctacaataaatctcagacattttaaaatgtgagttcatatgtatccatcacctttcttaatagcagcattttatttcatatcagtttaccaatttagccagtaccctacacagacatttctttttttccccaagttttttttttttttttgctgcaaaattaaaatacataatgctgtaatagacatccttacacataggtagaaaaaacttgtagaagtgaaattaccaagacaaaggctatgtaaacttagcattttcaaaattaaggtcaaagcgctctccaaaaactttacaagaatttaccctcccattaacagcatataaaaaaaaaaaaaaaagaaaaagaaaaacaacctaggcttttttacacttgcttctcccaactctctctgtctaggcttgtcccagggcagaaggtacaatccagtcatactaataactgatttaaagggtcaccattcagcatttagccataattcatgatagttccttgtagttatcttctgttgttgcttagtctgaaaccataaacaacgctggaggtcaaaaagttcctgcttgtcctaggttaggtatatcaagttcctctagttgaaggtcccttaactatgtaggaagagctcccccacccctaaaagaaaaaagcaaaagtaaaccaaaccaatcacagataaactgagtcaagtcatcttgtatgtactgaatgtttttctgcgttaggctcagcactagggggcttttcatacattatctattttaggttctacgtatttttgaggaagccccccagattgccgaattatacctgggaaaacgagaactggtgtcccaccccccacccaccgcatccaatgaagtgctgctttcaatcagcaaaaacaggccatcccactatcagccagaaatccctattaacagccgtttctgagataactgatgttctccgtgtgactctgaggcttggtgagatatttaagtgtcttttaagtcattagaagagataaatatgtgttcagtatagttgtggtgtcaagtatattttgttgtatttgaattctataaaaatctgttgtggaaaagtggtctattgggtattcccagattaaatagaatgttgaactaaccagaatacgtcactcttctagctgcctgggggtttactgcacttaagataaactgggatttaccatattactcagccctgatcttggcatcataaatcttctcttcacttcactctcactgtcacactgagcgaaagaatagaggccccctctcccaggataaaaaaatgtgaaaaagggtaatttcccatcattctccctaaaaagaatcccatgtaagactgttgaatccaccctaaataataatctccaaattaacaattaccaccctgagatgagagcaaataaaaaattggattggaatgcagagcttgacaaaatgattccatgccacgggacattctctgtgatttgcgaatacaaatgatagcccattctttatttaaaacatcttttctaaggtcaggtttttgaaacttaatctacatcttctctctaaattaataaggttagatcccaagtacaaaggaatgtcccatgaagtatcagaagctggacaccaatagtattgtgagatataagtcaacatttaaagtccacttttcactttcagatggcagggacacaactgccacccagcccatgctccctgcaagggaagaagggattctcccttcctgagggtcaagcccctggagattgttctcaaccctagaaaccatgggcctgccccagtaagtgaaagtcttattttactttatttattttttaaaattttactttaagttctgggatacatgtgcaccatgtacaggcttgtgacataggtaaacgtgtgccatggtggtttgctgcacctatcaaccatcacctaggtattaagccccacatgcattagctatttgtcctgatgctctccctctcctcgcccaccctcaacaggctccagtgtgttgttcccctccctgtgtccatgtgttctcattgttcagctcccatttataagtgagaacatgcagtgtttggttttctgttcctgtgttagtttgctgaggatgatggcttccagcttcatctatgtccctgcaaaggacatgatcttattcctttttatggctgcatagtattccatgatgtacatgtaccacattttctttatccagtctatcattgaggggcatttgggttggctccatgtctttgcgattgtgaatagtactgcaataaacatacatgtgcatgtatctttataacagaatgatttatattcctttgggtatatacccagtaatgggattgatggctcaaatggtatttctggttctagatccttgaggaatcgctatactatcttccacaatggttcaactaatttacattcccaccaacagtgtaaaagcattcctatttctccacagccttgccagcatctgttgttttttgaagtctttattttatttatttttattttagcaactataataacttggtcttctaaggacagacccatcttcaactgaattccacttctgaggcagaaaaaactttgtgagattccagtatattcaaaaacagttaatttgtattcagtagtgtcactaacctactcatatgaaaaaacactttgtgtgtatgaaatacatcacactttaagtagctgaggtgggtttctggtgaaatcactcattgtaggcatccatgcataagcagctgcttactgaagaagttaagccagccttggagttcaggataagccctaaaggtttctgatgtgttaagtggagattctgaaatctgtgccagagagtaggttttaggccggtgcatttgcaaatcactggaaaaagcagtgcatttgaaccccctcaggacagactgttgcatgtgattaattaatctctgaccaatcagaaataactaagcgttgaggctgaaatatgaaattaaaaaagaaaattggcctagtcttcatttcttttgcattattaaaaaataacctacaaatacgtttgttacatttaaatcatctacagcctgagtgcctccttccttcatttgacaaactactcattgaactactatgtgcagggtgctcacctagggcttgggagcactgtcgggactatgacaggcatggtccctgctttcatggatctcaaagaataaacaagcacagcattgactgtatagaaatattcagagaattaaagtagggtgataggagagggaatgattgggtgttccaggggagcctctcaaaggaagtgacatttaagctgagatttgaaaggcaagaaggagccagccctgggaaagttaggggcagtacaatgtaggcagaagtcacaagtagtggaagatcccaaggagggagcaacctgatgtgtttggaggatcaggaagtcagttcgagtggcccacaagcaatgggggagtgtgcagttggtgagagctgaggcttgagaatcagtgcgaaggcagtgtaagattttggaaatcagatcgagagcctggatattattctaggatgacgggaagtatttggggtgataagacaagctaaaaagcatggcccatacatcttttccacaaagaccccaaactagagagatggccaacaagatggcaggtgtcctgaggtgcacgtctatcccttggtgcccctcacccaaagagccagactcttgaaagcactgatggcagctggctccttggaatgacatcaccaggggataccacggccacagcacttgccattgcatcagctccaacctggtcaagacctacatcatcaagacctcctccttcacccctgccccagcatccagacttaatacagcttctcactcctccccagaaatgcttccctgtctacttctgcattttcaatacacagaagggttttgtccccaagcactgacagattccatacttctgtgtaactaattttggccaaaaatattttcaatatctttgaaattctgaatgcgtttcatcaaggaaacaagggtaatcaattctacagccatacttgtttcatgtatgaagagaaaaactcccaaataacaccccgtgatgaaatgtcacactcaaccattaaagacctatttttagcaaagtcaaccgctgagttctcagccaaatgaaaggtcatgtgttatctgagaagcacatgttactgtggtcatcaaattgctaatctggggcaaggtattccatggaagatgcctgttatgaaaggagagtgtactgtagtgattactgctattcagaaatgaggatcaatctacaaaaatgataaggagaacatgaacttaacaactacatttcaaatgatgttttaaacatgtccattaaagtgacatttgtgtgtgtctgtgtgtgagtgtgtgtgttaagaactcttaacatgagatttgcttattctttattcctgttgaagggcaactccccatttctctcttcccctaggccctgacaaccaccactgtgttctcggcttctgtgaatttggctactgtagatgctcatataagtggaatcatgcagtatttgtccttctgtgactggtttatttcactgagcatgatgtcctcaagaatcatccatgtagttgcatatgaaaatattcttaaggcggagtagtatgtatgtgtgtgtgtgtgtgtgtgtgtgtgtgtatacacacacacacatacaaatacacacacacatatatatacacatacatatatatacacacacacacacattttccgtatccatgcatctgtgaaatgacattccttgatatatattattagtggacaaaaatgtgccctgaggtttcagtatggtggtccatatatcaaacatatggttctaaaatgatatcatcacatctagcatggtattgaaaagactgatgtagatttatttcctcactagtatgaccttaagcaagatatattatattcctaaatcttggttcttcatctgtaaaaaataaaaataatcatattcatctttcacagggctgctgtgatgattaaatgagataaaccacacaacacagcatatgacatagtcactgatattcaatacatatgagttcccttttcctttagctctctgctcccacagtaatccaaatttttggcaagctaatagtttttatttttcgatacagttattagcaccatccaatcccatataaaccacaaacaggctggaatttttgtctatttgtttgatgctgaagcagaaaagtgtctgccagatagtaggtgctcaataaatagccattgaatgaaatgaatgaatgggaagttacactggaatgaggctgaatgtgaaggtcagtcaaatatcttagcagaattattggatatgtttttaatggaagagatacatttttaaacttttttctttttttttttttgagatggagtctcactctattgtccaggctggagtgcagtggcatgatctcggctcactgcaacctctgccccacaggattcaagcaattctcctgcctcagtctccctagtagctgggattacaggcgtgcgctaccacgcccagctaatttttgtatttttagtagagacgggatttcaccatgttggccaggctgtaataatatagtgattattatagtatactctatactgtagcatagagattgaggttggcacatctcacatatgactatgaatacccaatcattatgcttatgaactacaaaaaaatcagcagataacttacaagtgcagccatgttacaaaataattaagtataaaaaccatctaataaagacagcagtggtcccactaaactctgtgatattttaaccataaacaaagcattaatgggaaaagtctgatcccaagggttcctggatcagcagtaggtcagtgatacccaggagagcaggaaccatggcgtataaggcttgccttggactcagcttcaggatctgagagtcggcctggggaagtcctggtaacctgcaaggtcacctctatagaagagccagtggtggcaggcatcgcctctccagctcttccagcttattttcccatgatagtgcagtgatatatcattttagaattatgattctagaattatgtagtcacatggagggggcatacccaacatcacagtggatggaaatcgaccagagtgaccccagaacaccaagaaaacatcatagtggggatggaaacctcccttgctcacaaagctggggattgggagctaactctgccaccaacaagctgtgtagctttgggtaagtcattgaatcttggtccagcaggccttggtttcatcatctgtcatttatcaatacaggccgctttcatctctatctcctcacttcagaagtcccatgcctggactgtggcggccctggctggtatcccttcccatgccttgctgttttggaaaagttacatgtgtagaaactacagatggtagtaggggagacaataaggaagaaaaagtcactccttcaccttcttttaaagtactatgctcacaactgctcacatctggcacacttcaatagcaatcacttgcaaggtccaaaaatcttgaaccatgaaagtgaaagaaggagctttatcttcaaaaggaaaattaaagacctggagaggaccacttgggacctttttattacacctagataatggcaggtattattgctctatgcagcagtatgtttttatgaatagactaacacacacccttaggctgtaaaatagtgctttaggatataacatgttgattcagatacaaaataaaatactgtttgtattgtaggcttttaatgaaaagtctaaaaacacacctatttaacaaacctctatttttatagggcctgcctaaaaaagcctgctttaaaaaaaatctaagtatgggtggtctcacacctagaagtggcacaagaatcctttgtcagacgacgtgtcttaatttttgccatggaaaatgtggtcaccataattatagcccagagaaaataaaaggtttttaaaattccatgcaggaggggaataagagtttgttagcattcaataaaactataatttaaccagcttttaggtacagcggaatcagcagttaaattacagcactggacaattctctattttaccttgtggctatttgtcgaagtgtcttatttcctcttggagacctaagctccttgggaacaaatgccaagttatctgtatccctgtaacctctaccagacctggtacacggtttgttttttgtgttcaatgaaccacaaagaatctttcaggaaaaatcacttgagaaatatttcagagtaagaggaaatcaatgcataacttgttaaaaactattttcttaggctgaaagatatttcaaatacacattttaaaaggttcatttatggaaaaagttcagttgtgcaggctctgaaatgagatttagccaagaaaagcatcaatactaattaagtattgataaagaaggaggggggagtttagctaggtaacttagtcacttggttactaaaaccttcttctcgatggaaagaaaccattagagattgagcgactcatattgaaggaggagctataatgcaatcgtttctctctatgtatggtcttttttttggctttgaaataaaagggtcaaaggtaaatgagcctattgaaaattaatgagagctgaacgctgcatgctgttaatatgctcacttaactcaggcatcaagaaagaaccgtgcggccctttatcatacgggataaaatacaaaagcctttatatacaatttttgtttgtcaattaaaaataactaaataaaaattttaaaaacttttttaaataaaagctttccaggaaggttgggcgcagaaggacctgaagtttcctgcacatggaaacatcatagttatgagtttttctcagcttggatttcctgtatttctcagatttcttaactccacagtgcaacttactttccctctaaccatgaatatgcatcaatcagaaattccaatattttagcatctgaactccatcttcctaactgcatctcatcatcagaagtagccaaaaaaaggtcttcttcaaatctatcttcttcacgttttgatttcttgcaacagaaataggatgacgataaatacaggtgagagaaaataatgttttcccgaaataggtaagaaagttatggcttgttgacatgtggctgccaaacacacatgggtggaaatcgatttgaagggtttgggtctgtgtaaagatgctgcatgaccttcagagtccaacccggctaagcgccccctgccacttcctagctgtgtgaccactgacaaatcgttcactttctttgagctgctgtctcctggtctgaaaatggagcaaatgctcgtacctgctacaggtgttcagggctcagacagtgcaagtcacaagcttatagcagcaccgtgtctgtcatgtggtgagaacccactacatggtggctatttctggtgtcatcttctgcagcaatttgtcctgcttgaattgtgcagaatgcaatcaaatgccaaactcttcttgcattttcagtgacaatcctctggtgacagctacctcagaggacggtgtctgtgaggcgccagtcactcctacagttgactcccccatgtccacgtctgctcaatcaggggaacggtcacagcaggaacagaaaagggaagggagagaggaaaggagggagggaaaaagggagagaaaggaggaagaaaggaagaaggaagtgagggaggaggaagctttcataagatgatgtaatattcaatttcccatcctcattctttgccaatcgtcaccaaatattttgaattcaaatgaaaagcatgttagtcagacattgaggggtgaacctgtcccctgtgagagagcatagttttgttggcaaatgggagtggagagtagaaaagaaatataaaacaaacagagactccagttaaactgatctgtcttcctcagtctggtgtgggattttctccattgaaaatttctgtttcttaatattgtatcataaggtggattttatttgagcttttcaggttatttggtctttcttttgtaagaaagtagtttatttgttttcacaacaaagcagagtggcttctggttgaggaaggagagaactatgagttgaaggaagacggttttgcatgactatgctatgcccctgtatacgcaaagatgtagagacacacacacacagacatacacacacacacacacacagagacacacacagacacacacaaacacacacagacacacactgacatagagacacacacacagacacacactgacacagagacacacatagacacagagacacacacagacacacactgacacagacacagagacacacacacagacacagagacacacacagacacacactgacatagacacacacagacacccattgacacacagacacacatagacacagagacacacacagacacacactgacacacagacacagagacacacacagacacacactgacagagacacacacagacacacattgacacacagacacacatagacacagacacacattgacacacagacacacatagacacagacacacattgacacacagacacatagacacagagacacacacacagacacacactgacacacagacacagagacacacacacagacatacacagacacacacagacacaaagacacaacagacacagacacacacactgacacacagagacacacacacacagacacacacagacacagggacacacacagacacacactgacacagagacacacagacacagagacacagacacacactgacacagagacacacagacacacagacatacacagacacacatagacacagagacacacacaaagacacacagtgacacacagacacagagacacacacacagacatatacagacacacacagacacagagacacacactgacacagagacacacacagacacacactgacacacagacacagagacacccacagacatacacagacacacacagacacacactgacatacagacacagacatacaaaagacacacacactacacaacacatgcacacatagagacacacaaatgcacacacacaacacacacacagacccatgtacaggcacagacacagagacgcagacacacacaccacacacatcacatagacacatacacagacacgcacaacacacagacacacacaacacacacactacacaacacatgcacacagaaacacacagacaaatgcacacacacaacacacacagacacatgcacagacacagagacacacacatatactacacaacatgcacacacaagacacacaggcacacagacacagagacacacacaacacacacagacatgcatagacacacacaacacacacagccataaacatacaaacactacacaacataggcacatacacagagacacacgcagacaaatgcacatagacaacacacacagagacacatgcatacacagacacagagacacacacaacacacagacacatgcacagacccacacacacagataccacacaacacacacacagatacagacacaacatagacacacatacaacacatgcacagacacatacacagagacacacacatacacgcagacacatgtacacagacatacacacaggtacagacacgcagacacactacatatgcacagacacacagacactggcacagaaacacatggagatgacacagacataaacacacagacgcacacgtatacaccatagtgaggctcatcccacttctgtgctgtgagtggcataatctcttatttcctttttcaatcaagaaaccctgacatttccaaccaccacacatggggtaaatacggtagcacggaccaaaaccgtaacaaacaaaacaacgcgcacacatgcacacacacacacgcacacacacacacacgaaggatattttcaagcaagccagtctctcatgaacttttcaaggctcagctcgtaaccttagttccagacgtatacctctgactgtttccaacatgttcctgttttgtttgtttgggtttacttgccttcgttctgcaggaagccctcacagatatgacagggtgatttaattctgcacaaacctcgcctccctcagttcttagaatgaagatagataccactaccggtattcttagagttagacttacacagcctcccacaccaaacagagtgaagcagaacccacatttcactggaatccttacttttaggtatttgcaggtttttctttatgacacaggaaaccaaatatgaggtaccattgcagatagtaataaatgggcttctaaaatgttcccagtggctggcagaacaataactgatttatatcccaaaaggggcaatacatctgaccccttacactttgtaaaggaaaggaagattctagacactcttttgtcaggtgttcaaatttattcaggacaacagattgtcaaagccatctttgaagggactggcaaaagtttctccctacactcccgcgtataagacagtcaagagccaaaaatgatagagttggcagtgggccatgggatgggaaaacaaatcaagctttattttttgttttgttttcttttagagccagggtcttgctctatcactcaggctggagtgcaatggtgcaacatagctcaacacgggtgggagaaaactcatcaactcctgggaaaaagtgattctcccacctcagtttcccaaatagctgggacacgcctggttaattttttaatatttttatagagatggggtctcgctaggttgcctaggctggtcttgaactcctgggctcaagtgatcctcccacctcagccttccaaagtgctgagatacaggcatgagccactgcgcctgggccaaattgagctttgaatgaaggggtccattcctatggagctaatgaatccgctgcatcctcagctccagcaggcacgggatgtttgaaacaagccaggcataacctgcaccaaatgggcaatgtgcaggcagcattacggagcagaagtcaagtgacaggctggggggtccacggtcttgatgatttctgctcctgctgctacgctgatagccagtttactgacgtacacatagagaccactcttaaccgcaggctgaattgtccctaccaagctatctgcaccttgagcatataacaaaccattgtgagaaaagttaaatttttttcacccaattctgacatttaagactttctgtaagatggccaaaatgtcttaagacccaaattcctgaaagtctttcaaaagacgctagtcaattcatccttataaccctcccttttcccaccgcccctaatagaaagtaccttgggggaatctcctttggttaatacataagtaaattaaggagatgactttccatgattttacggaatcagtgactcttaaataaatctctttaaaaaggaaataaatgtgtcttcatagtagaaggatttatgcacatgtatgtttgttgtggcactattcacaatagcgacgacttggaaccaacccaaatgtccatcaataatagactggataaagaaactgtggcacatatacaccatggaatactatgcagctctaaaaaaggatgagttcatgtcctttgcaggaacatgaatgaaactggaaaccatcattctcagcaaactatcacaagaacagaaaacctaacaccacatgttctcactcgtaagtaggagttgaacaatgagaacaacatgaacctagggaggagaacatcacacactggggcctgttagggggtgggggtctaggggagggatagcattaggagaaatacctaatgtatgtgacagggtgatgagtgcagcaaaccaccatggcacgtgtatacctatgtaagaagcctgcacgttctgcacatgtaccccagaaattaaagtataataataataataaattctacaatgaaaaaaaggaaataaatgtattcctttggctgggcacagtgtctcatgcctgtaatcccagcacttggagaggccgaagcaggcggatcacttgaggtcaggagtttctgaccagcctggcgaacatggtgaaaccctgtctctactaaaaatacaaaaattagccaggcatggtggtgcatgcctgtaatcccaggtacttgggtgcctgaggcaggagaatcacttgaactcaggaggcggaggttgcagtgagacgagatcgggccactgcactccagcctgggcgacagagcaagactcagtctcaaaaaaaataaaatattcctacattcacataacatttgttagaatactggcagcacaattttatgacaactacttcactaagatttagaagacctggtctgactcagaacaactgaggccacttacctaacctgtctgtacctctgttaactcattcctaaaatggtgaggcctggacaagacggtttgtaagataattttcagctctaacattttgtgactatatatttatgcagattctacttgtaaaagacacgctgttagatgccacagagacaaacatgcaaagacatgatctgtacctcgttctgtttacagtattattgcttggctgtatttccaaacttccatcataggctactttgattaggcatcaaatttctatctttctttaactctctttgatgtttagaggttcttagacaaatggggatcagtaccatatgcacaggctttgcctaaacatctttatattcaccttcactctgtgtgtcttgtgcagccatggttttcttggcacccaacaccatcaggggctctctaaacaaggactatgttggcctgccctgctgtgtcttgggaattctataatatagcttaattcttgcccccggagtggatttcttctcctctcttctccctcaagaacaagcgtcctggcctacagcctgcagcctggggactggcgacctgcttgaaaatctgtgcatgtcggacctgtcagcatccaggctggggaaaacaggctgcccttgagcagaacagctttgctaatcaatcacgcttcaggaaagtgggtggtttgtatgtgaggcccactttgccaggaccaagccccttacgaaaacgtctgagtgtgaattaaaagaaagaaaacagtctaccttctgcatccattgcgggagggccagacaaggttttatttaaaaaaactcctcttttctgaagtctgaaagcaagaccctgggcttaaagagaattcctccgtcaagatttactagaggctatgatcaggagatggagctctcaacctggatgccaatgacatgtgtaaaacaagagaaaacttcagggaggttccccacctattcagaaattagaaattaactacttatatatttttaaaaagagcctcctgaggtgatatcatatatgattgtgattgtactagcaaagcaattagcaagttgagcacatgtatatctttagaagctaagccagatacaagatacaagtccctactagtaagatgcgattaatgggacaacgtcaagtttattgtcacagggctgggtatatattctggctattacttgttagttggggcaagttaggtaacttctctaagcctttaaatacattcatacatatgcacacgcacacacacacacacatacacacacataatggggccaattatactttcaactcatagaattgttctgagaattgagatactaaaagcaaactaagtgtttctatgctgtaaacacaacagaaatgtaaagtattgttataacagacatacttgtatttcttcaaataatgtacacattactttactcaaaattatttgatttctattctagctttcatgttttttgttattttaggagtgagtttctaattaattcagtttatatgcatttcctatctaaagtcttttcacattttcaaagctcctgcacgagtgacagaaaaacacaagcttaaaatatctagagaaacagcaccacagaaataggatagatagataattgagaaggcatctgccctctatccagcacagggtcagtactacttctggtacttaccctgctcacatatgaactgactaatatacaagattatctattggagcattatctgcaataccaaaagactggaaataaacaggtgtccatcatcaggggctggttaattactccatgggtagtaaatagttacataatgacatctaatgaatttctcatcctgaaattgcttccacattgactctgggcttggccccatgacctgcttttgccaatggaacattaaccaatgggattcaagtagaagcttaataaaacctccacagcggggccaacccctctctgtttttgtgggacccagtcgccatatgaagcagctggggctggtttactcaaggcacatattccaactgaggtcagactctcccaacaacctgctagtgaggccatcttagaccatctagccccaaataatcacatccatatgaacaaatccaggcaaaagcagcagtaaaaaacccttggcagatctcaggccaaatagttcacccatagaattatgactaataaaagggttgttgttttaaaccactatgttatggagtaatctgttatgcagctaattgataactggcacactctgatatctccaaaacgatgcaatactaggaagtattatactacctaggaagaaaggaaaagcatgcattctatgtactgacatggtacatctcaagatgtaccatgataagatcttacatggtaaaatctcaagatatactgttaaattaacagggcaaacagtaagctgccttttgtgtaagaaagggaaaattttaaaatgtgtatatgttattttgcatggatgggcgctggatatatactcaagaaattaatagacaatggttccttattctgatggaagagcgagtagtgaattgggtggatggggacggaggtgctagcgagactttccaataaacacctttctaaactgttccagtataggaaccatgtgactaatacctatgcaaataagtattttgaaaaagggaaaaataaggctaatacaagatagaaatgacaaagcttgaaaaagttgaatttcaaactgacgattataattctgctatgcaaccatccttcatcaacaacagccttcctttgaaccggaataatcgtttctttgtaacacatatgattatttgtacacctggctgtcttccctgctagattgtaagtgctttaaaagcagggaccatatctcatgcatctttgtctcttcagcaagtggcaagcatcttgccgggcacagaagaaagccttgctcaataactgtttgttgagtcaaaaaaataaacaaaaacattcggacctcactaacagtgtctgttgttaatgctgatgagttcaataaaatcttcaacagcctagcttctatctgtacacatcctccacacaccatctttcaggaaaatggtgagcattcctcatgatctgggctcatgaatgtactctgaactactggggagagtatatacaaaagctaaattcgaacactacgaaaagaaaaatgcaaaacaacctcctctatttaaaaaaacaacaacatttgactagagggggtctagaaaaagaaaagaagaaggatcttttattatttctcataagtaacacatttgactactgtggttggaataagcagccccgctcccaccccctgcttgcaaagcaaactaagccacccgaataagtggaccatggggatatagaggcagaaaactcccggccccatccccaggcctccagagaatttgacactcaagccacggtggagaggttttctgttatgagtttagcatttctaagaaagaggagaccacaggctttccctgtagtccatttcaagagtctgatagctctcactggaaatcttcacttcctttgaacttgtaccttcctgctgtgcctcaggcctctccctcttctgagagttcttgtctccatgtctgatccctgtgaaagtgcaggcatttaaggaggaggtctgggcccccttcacggtggtgtccacacctctcccagggggatgtgctcggtaagtgtgcatgcagcaccatctcagccctgtgcatcctggaccgcaccaacaaacagcaccacacagcttggggaccatgtccagattcacacgcagacgataagcaccgtggccaatacccaagcgttagataattaaaggtccctccaaggataaacacaagtaagagtggaagcaaaggaagtgcacacgcttgtctcaagaaagacagggcatgtagccttttccctaggatctctcatcatcttcgcttctctttctcacatcaaatgatgccaattctttaactttcctaggttccatttcccaatgctttcatcagtttcactgtcttctgcgaggctgaatttccctaattaagggcagtgggagacgctccacatttggagtccctgtgaggcagcaaagatggagagctgagactgaccatccagaatccaggtgtgccttcgccacacagaacaacaagcatcgttgatgcctctagtaagtgccaggtgttgggttagatgctgttggagatataaaaggtggagacatcatctctgtcacttaatgagagtgacactgatcggacaggatttaaagaaggggactctggtgtgggtgggaagagcacagtgggagggttggggcaggggcacggccttgggactagagtaggtggaggcagtggggcggggaggaggaaaagaaggaaggaagaggccggtcagaggaagcccaaaagtggattcctggacacacagtaaaaaggggaggacgacttaaagacggtttccagatgtgggggtctggggagaagggaagcttttacagctgctgacagaggctgacagatgcagagagggctcgtggtgagctggctgaattcggggtaaacaagaggagatttcatgcttcacctcagatgaggaaataggactaggaatacagttttatgattgaagccgtgacagaaaagcctttccaaaggagcacagtggaggagagaactggagaagaggcacggagaccgccaagcgttccaggtgcaggcggcaggagggagcccaggatgccggcagagcgagccttggtctgtgaaccccagggccgatgggcaccggctcatctaattcatttgtgtacagatccacaaaactgcacctggctgtggccgtcagtaagtgctatataaatgcttcataagtgtttgttgaaggaagttgaaatgtagtcgtcagaagagtgagagggaaaccagcgacagagccttgtaagtctaagaaaaagaattcaaagatggtcaagagctaacattgcacagggaattacagtatttccggaagaccaagggcaactctgattgttccagactgcctgggagcaccagagtctgattgttccagactgcctgggagcaccagagtctgattgttccagactgcctgggagcaccagaggtctgggtgggggcaggagtcagtccacctggaacttctgcctccagtgcactgagtctgcacggaccaccagggctgacactgccttacttaatatgggggtgggggaagtccctgcgatatataatggtctcaatttaaattctgtgctgtttttattttagctgtgtaatttggaaacttcaaataaaaagcctgaaaggaaagttggactatttaagcttacacagactctattaatgctatatggttattctacccctgactttggaagaaggagaaactggcatgggaatacacttttctaaaaaaaatactatttaaaaatatgaaagtttatttaacatctaaggaaaggtacttaattagagggacactcaacaagaagaattgaggatctaagtaaatagtccccatctgctcctggtcctaccacctggcgattacttcctcttcttctctgatagattttagccaaccaattttgttttatttgtgcaagttgagaggccacctgttatggaatatacttccacattaaacaaagtgaacatttcctatttctgtgcttcccatatgatttttaaaacacaaagcactcactttcaccttaaacagatttaagaaatgctgactctgatgaacaggtataaacaaggcaatcttttgtttatgaaaattgttaacgacctacccacagaaagacatgccctgcgccacactgtaccccccacccccgcccacccggctccccgatgctggtgaattaatctatccacacgtttttgctcatttccctggctgttaccagctgaagtgaagaaaagacattttacaaggggacatggtatatttgtgctaaaacaggcaccacacaaatccagagaaaggagccaaaaggaaataccaggcagagggaacagcgtggataaaggcaaagctgagaagagggtaagtgtttcgtgttgggggatggtgtatctgggggctggggggagtggggtacagtgtattgggttgaggatttatagccaggaaaactggaaataaaggggaaggagactttgtgaagggttttaactatcgggctaaggaaagctgcattgttcctaacaactgggcaccagtggaagtttagagccaggaatataattgtcacagaggtgctttggactgaataatactgtggctgtaggcagctctgggttgggggttgggaggtacaagcctccaggaatccactgcagcagtgtgggccctgccacgttgtcctgaacaaagtgctatggggatggacacaaacatgaagtgaaaactccagagatcacctgacctccacgtgccactgctctgactgctggaccacagtgatgtttggggtctcctggaattagtgtcagctcagagccagtcaccagtagtccccaaaaggtctgattaattccttttccccagtgcacagtcaccctggcaaaaggctataggtccctttggggaaggctgggagaaaaagcaacagtattaattcttgacagtgtggtagggtccttcgtcaaggagacccggcctcctcttcattcaagggcttctgggtcggtaaattggtgcaagtgtgtgaattgatcgaggggccgtgactctctgttttcagggtgcaagttgggcttttgttcccttcacctagaactcctccacttatacagaccaagtaagggtttagtagatgtccgcctatgtcatttctaggaacgccatgaggacagggttggaagtgggggaaatgaagtgttagtctgtgtacggatacaaagaaagtgagatgatggaactgaagatgactaagatgtggggagccaggactagtggttcccattggcaggtggtctcctaactggcaatgctagggagaagtgtataaatcctcaacccaatacactgtacccaatacactgttagtggcggagggagaggcagagcttggtttgaaatggtgggggattctccaaggtggcatggacatacaggatggaaatgggagacgtgtcaggcctggagatatgggttttggaacaacctgcattaaaattggaaggattagagagagtaggtgagatctccgagacagaggaaacagagcgaggaagctaagacctaggctggggcaaatgtctgaatttacctgagtgggggaagacagagaagctggcatgttggacagagatgactggtcaccaagacagaaggaagaatcaggccgtttaacaggatcaagagggtctagtgtttaaagagagatctttccaactgctacaggaaagtaaaatgttatggctccagacacctgctgaaattggtgcatgatcccctcaaagacagtgtttccttaaaaacctgggaaaagaagagcccctggtgtggtggagggtggcagtagggacagttgggagtgaagctgtgcagtcaggaagaaaccatccagcttgaggaagctaaagacatggggaggagacacagtgcagaccaaaggagcagccaagctaaaggcaacttttttctaggacttcggggtcctaagtaaacttgtgggcagtgaacatgctggaagtgtctggactgttcaggtggagaacaggcagtacaagggacgaaaagcaaatgtccagatggcgattagtggaggccttgggggtggaagatctcagggctcacccctgtggttatcatcttagtgagggggctagtgtggacttcaggcccaaggaagaataatattttattctttacaaaatagtgcatgaaagattagctctgagtctttataatcttatcattggcttcaaatttcaatcccatattatactttccaagtatattttgttaaaatttccttaattcataatattctaatcagcaatgagtttctatccacatgtctatgagcacatatattaatttaaaaatctgcattgctcttgtatgaatgaaatataaagaaactgaacttctaacgaatgaaagacgctggatgaaaagataatattttatctgagtttcagttcagtcatatgtctgagaatgagtttatctagcccataagccttctgctttcctttcagttcttttttttccactgccattcataggttttttaaagatctttccattcacttctgcaggactctgctaaataatgctggttgcttgcagcttagccctaccctggagatgtggctcctcctggcagtcctggcgacccacactttggaccccattcaccatctcattgttctgtgacccacttctgacttctccagcccttttctttatttcatttcacctaagcccaaatagcaagtctcacgctcaaatcctgctctgtccttgctttccgccctgaatctgtccatttgtccttttgcagcttttatttcttcccatctttttcttttcatttctttttttttttttttttttttttttgagacagagtctcactctgtcacccaggctggagtgcagtggtgcgatcttggctcactgcaaccaccacctcctgggttccagcgattctcccgagtagctgggactacaggtgggcatcaccacacccagctaatttttgtattttcagtagagacgggatttcactatgttggccaggctggtctcaaactcctgacctcaagtgacctgcctgtctcagcctcccaaggtgctgggattccaggtgtgacccaccgcgcctggccatatttatttccatctttccaaagactgcagaaatctgccacttgagagaggctggccttgttttctctcgactcaaatctcctcctggttttctaagctcatgaaaatctctatgtgacatttttttatttgcagttttaagctatctatatatttttaagtcttcacctttaaaccttcactgacttccctttgcaggtgcactgtcattttggtaactcaacactgtctgcattttattttggtgcatgggcggggggctctggcttcgatttagtccttcagacacatacagtgaaataaataggtactcgacgatagtatgtgttgttgctgtgtagttcttttgctcctgaacagcaaataccattggacttggcattgtcctactgtggctgcaagctgtgtctcaccacagctaacgccagtgcagaggagccatgccacgcaaaggtcccctgcggcagcaccagcctgaagctcttcagtcatgaaaatcagggaacacgtcattgatgactgtcctggtcctggcacaggttttaccaaaatgcaatcaggtttcgccagaaatgcagtcatgtgactcctttcttctctgagggaggatggtgttcatgaatgcaatggtagcatatgacatttttagttgcccctaaccatgtggccctaaaaatactccatttaggtcaggtgtggtggctcacgcctgtaatcccagcactttgggaggctgaggcaggtggatcacaaggtcaggagttcgagaccatcctggccaacatggtgaaaccccgtctctactaaaaatacaaaaattagctgggcgtggtggcgggcgcctgtagtcccagctactcgggaggctgaggcgagacagaattgcttgaacccaggaggcagaggttgcagtgagccaagagcatgccactgcactccagcctgggcgacagagcgagactctgtctcaaacaaacaaacaaacaacaacaacaaaaaaaacacaaaaaaactccatttagtagctttgaaaattccaagtttcctttaaagaagggaggtaaggaaggaaattatgatgcatttaacagccacgtgaagtagacagtctcattttagagatcagaaaaccaagggtagagagtgagtatcacaataggtggccacaagccacagtgggaactcagggagcttaggtcaggattccaagctttctcaaataaaagttgctaccttggccgggtgcggtggctcacaactgtaatcccagcactttgggagatccaggcgggcggatcacgaggtcaggagttcgagagcagcctggccaacatggtgaaatcctgtctctactaaaaatataaaaaattagccagtcacagtggcacatgcctgtagtcccagttactcaggaggctgaggcaggagaatcacttgaacccagaaggcggaggttgcagtgagccgagatcacactgctgcactccagcctgggcaacggagcgagactctgtctcaaaaaacaaaaaaaaagttgctacctttacacaaaggatgaaaaagtaggaaagagactgcaggaaaggaatgtgagagaggaaaaacataaagaaatttcaaatttgtgaatacacctttcccctaactcatgtgttgttcatgattaggactaagtgctgaagccagaggtgacccaaattcttaggagcagaggaggacagaggcaggcaggtaggccgattcctgctggttctctgtgttacttttgctcccataacctcccctacataggttggtttcagattctccaataaaaatgtatgttaaaactgtaaaaacaataaaacatgcaaatctcttccatttgcagccaattgttaccatgcaggtattcttcctggcaaatattcaaatgtcaccagcatcacgtgcttaatattattttagtcaatatgatttgtgtcaaaatcgcctgaattcagtgattgttggatctcattatcaccaatgtaggtcctcacaccacacccctcactgctgatgaactcacaagaaagacttcatactttaagaactagtattttcttagaaaaggaagaaaaaaagcagttctcagtaaaagataaaccacagagcaactgggttcagatgagttgtacacattaaaccacacacacacacacacataaacacacacacacacacacacacacacacacactatgaaaatgatgttgaggcattgtctaatccacaaatgtgagtaagttcataatttaggagttaaaacgagaaccctactcatgacttttcccggcactgagaatgcactgaagaatgatgaaatcacactccagattaccccatttgttctcctgacagctctgtggaccattatcatatagaggccctttgcttggtgagaccctgaccacttgacattctttctcagagcgggctggtcagagttctctcgacggcagaatctacagggcccacctcaacgcacaaggaagccccaggccctcagggacctctaggtcccaaaaaacagtgtcagataaagaaattaagagggggctgggagaagcactctgtcaaatagaaagcctatccacagaaaacttagggatgaacagagctaagatgggctgatgaccttgaagttgcagccaaaatgatgaggccaggtgggcttgctggccaagaaatgcaatctcaagagtgggccatggctgtgatgcccaagcctttttgtgataaagctaagaaatacgggagaaatggaagggagaggggcagaacagacaaggaagatgggaagcaagaaggacaggaagtgccagcagacaccagcagcagggacgagtgcagaaagtgtcagacaatccatgaattggaggaggacacccagtgaggagggaaaagggattggactgtgccaccatctctgtaggggaggtgagacaaacgtccggtgcagctcggaagatggcctggaaggcctaacccttccacctgcctgactcctgacaccacgacatacacagttatttttaaagtgtttaaaatataaaccacattcatgggaacttgaagtcaggtctcaccctgacatccatccatctgtgtattttcaaggttgactcaaatgttgaaaagtcacctgtgatgtgttgtaccatttgagcttttgacaaaaactataaagaagcaaattaaaccaggagggaaatttctagctgccacactaatcaaaaactgtcgggtaataaaaaaaaaaatcatgctaaaaataaaattacatttcgggccctaaggctcatttcttttcttttttatttatttatttatttatttatctatttttgagacatacgctcactctgtcacccaggctggagtggagtggcacgatcttggctcactgcaacctccgcctcctggtttcaagtgtttctcatgcctcagccccccaagtagctgggactacaggcatgtgccaccatgcccagctaatttttgtatttttagtaaatggggtttcaccatgttggccaggctggtctcaaactcctgacctcaagtgacccacctgcctctgcctcccaaaatgctgggattacagacgtgagccagtgtgcctggcctcctaaggctcatttctataaataatacttccccagaacccaactctagaaagcgataatcatcccttaatgaattctcttttatatatattattgtgatggtcatattattgccccatatttgtcttgatgttttggatttcaaatggacaaggcatcccaccctttcttgcaatttagaggcatcgtcccttggcaagatacagaaagacttgctggtagaaatacgaatcaccatgccatttagaaagcaatctggaaatgtctattccaatctaaaaatctattcttttcttaatcaagtcatctcacgtcctgtaagcacagaaatgtttattacagtattatttgtcatagctacattcaataattcatgctacagtcaatcaaggaatagtacgcagtcatgaaaaaacaaaagagggatttcagcaatctatcactgttaaatgagaaaaagaaagatgcataaagggacatatgatatgatctgatttgtataaaaaacaatcacaacatatatttgtgactacaaaacatttggtaagattgtagaagcataaagtatggaaggacacagacaaggctgatgccactggcaatctagaagagaggaattagagtggaaggagggaagggaatgagaggaaaaaagtaaataagtgaaaaatgaaagcaagtgtccatgataagaaccgcatgggtgctcctatctcatttatgggaaatcatgtgtgtggaggtgacataaacacatggtggtgagatggtccccaaaatatcaatggcttttatttcagggtggtgagattttttttaataaggtgaaatgtttttaaaaataatttttactttattttccttataggtactattggaaatatgtacaaccacatgaattatttacataatcagaaaaaattcattgagagagaaatatgaaaagtcttatgccaggcaatgtatgtccccagaggaggtgcaagcagggagatgaggttgtaaagttaatttagaacctgactaggagggttctaagtgctaggcaaagacaggagcctatcaacatattaacaatagggctgtggttttgtttgtttgtttgtttttggtggtgggttatgagtgatttttttttcttctgtttgcttttctctattttccggatttttctgcaaaaattctatcttgcttttgtaaccagaacaaaaatattatgtaaaaaataacacagtggaagtggaagtggataatcatcaaagtgctgacccccagcaaaagaaatgaaaatccatttatgaatcagtaacgtcaaggtgagtcagtaaggaccccagataaagaagaaacagcgaacactgaaaggaacataggaggccttaaatgttttctaaaaaaaaaaaaaaaaagaatgagtgaaactttgcttaggaagaactgctaaggctcagtggccctctgtaaagtttacactgatgtctgcaaaaacacattcaaccaaatgtcaaagctggttgataggatccaaaaattacagagaactgtaattgctttagagactggcctatttttaccatcaagtctttaagtacagctacatcttggaacccatatcaaggaaaggtacaataccaagggaaaaggcaatagaagtgatagaaaccacagaagtggaagacactgtgctaagatgatgtaaagagccttcctctgcacaggagagacgtgcaccactgaaagcactgcctcaaagaaacactgggattttgcacaccaaaaaaagattccaatgtgattctggcttgattcgttttgcagtgcagtcaacataacaaatctacgatccatgttaggataaattaatttaaaagtttctattcaattgtggttttccttcttctaacagttggcacattctgagaactgccttttgttagacacattcagggggaggatggtggcatcacgttgaagaaggcggcagcaggaggcttccaaaagaacctcccagcttcaagattctctgactcgagatgagacgccatgccaaccaccagattttatgctttctctctctcagatgctccaactgaggtagtttagtaaataaactgtgtttatgttctctagcattcctgaagcagatgtaatataactgaaggcaaacaattttagtaatgcaattcatgcattgccatctaaacaccacgtcatcatgaaactgaaatgtttaccaaataatcaaagcccaagacaaagaaaccgaaaggcattctgtaaggcaaagtaccagccagtacttccaataaaataatttattgagagttatcctggagtggcttgtcagaaaaagtcaatgtgacttggtttctaatcactaaaaggactgtcttgctgttattcccaatggtcaggaaaaaaatgaggagaaactgggtttgttttcatagagtagtagggttttcctaacagagtttcaggataggctggtcagaaggtaagcaacgttctccttccaatgatccccaatagttcacccacatttcccaaaagcatcaaatcttgtcttgacaacctggcaagtgctgaccgccaaatgacaggcctcctccttatgatgttgtgaaataagagtgaccatcctttgagttcagtcccagcttttccactaactggccacgtgtctgtgggcaaatggctttatcagtgttgagcctcagtttccttaagtaaaatgctaaggttagacaaagtgatctttagaaaccttttgatctctggcaatccatgaccctttacaatcaattccaggttttgtttactacgttctaggtttaacacaaaattagacgttgagtgttcactttaagcaaaatggcaaacaataggttagtcctatgggttccttgtactacgaagatgtgaaattcccaagaaaatgtcacagagttgagttcagaaaaatagaagaatggaaaaaaggaaggaagggagggatagagggaaggatagaaagataggccccagaacatgcagaaactgcctccaaggtcagtcagcatccttctctttctctgcatcggtggtgtgttttcttccgtcttccttcttgccttcacaacttctactcccataattctcagtatggccttttcatcaacccaattctctttctttcttcaaatgtggctcaagctcatgtcttttctgtctgacaccagcaagttctgatcttctgttctttctgagtcccctcttggtgtgccacctaactaacatgaaaccagcagcaagtctattggtaggaacagcccaggaaaaatgcccaccagatctcctaaaaccctcaatgtctctccctactggggcacagcagagaggtagagagaagggaaaagctccttcttccctttcttttttttctttcgttccttccctttttctttcaatttaatgttcattgaatatctcctttatgcaaagcattgttcaaagttctttcacatactatttcatcttatctctccacaacctccctggaaatccagagtcttggccaatcaaattctgatcctctctgtgtctctccaccaccatccactcatccccctccactcatcccatccactcatcccatcctccactcatccccatcctccagtcatccccatcctccactcatcccattctccactcatccccatcctccactcctccccatcctccactcatctccatcctccactcatccccctctactcatccccatcctccactcatccccatctactcatccccctccactcatccccatccactctgtcccttgggattgtgtttggttgttctctccaccttggcccttccttcaatcaactgccaattctgaatctcatttctggctcctttttcttctcctgcctttatatctctcctgaacacctaagcctcttcttaactggtctccctgcaaccaggttctcattctaaagcatgagttggttgatatcactgcactcatccaacactttatgtgactccattttctatataacataacctgagttccatcatttgacattaaaggacttctaacttccccaaaccaacatcattaaatcttatcttctgaacataccaggctttttctgattctccaaatatggcttgcaattttactcttgcaggtttttgtttgtgctgttcctaccatgtggaacagccttctctcacctcagtcctagagaaaaatcttatttttcaaacctagctcaagtgctacctcattcctccaagtcaaaagtgattgtcctttctcctgaactttctaaattttagtggcttatggttctaaagttgcctctaggtcacaaagttctggagggcagggatcttctctatttttctttgcattccaacaccatgtatcaaccacagcagaactttttttttttttttttttttttgagacggattctcgctctgtcgcccagggtagaacacagtggcacaatctcagctcactgcaacctctgcctccctggttcaagcaattctcctgtctcagcctcctcacgcagcactttttaagcgtaagcagaaatgaagttgctaaccctgataattaatttaccagccaccattgtcttccaagtgtgcctccgaatttaaaatctacaagcattgatgagggcctactatgtacaaagcactctggcaggagatgcaagggcaagtgagctcaggaacaatgatgtttataatgagccattttaaagacctacctcacctcactatgctaggccaccaaatacaccattatcatgaacacataatccagtttggggatcatcaatccttcagaagccttccttcctcactgaatatactagcggtaaaatccgtatgtttcaaaatgcacccaagaaaagtaggctcagaactccagaaatcggggcctttatttccttccagaagacagagtggttgataaagaagaatgaaggcatttgttactcagcagtactaatcttcaaatctacaatctagtttaacttcagttataatgcgcatttggagccatggaagtagctgaaaaaacaagaatgtctggaaaaactaaaaattttattacctgtaaagttgggctcgtggatgaaaacttttgtaagggatgataattttttgtttgaaagactggtatcaagagcagctgtgcaaatagttctgacgagctcaaggtgatctagaacataagttgaccgtctgtcccagcatgttagggaaagtcccaatttatacctgttgtccctgcacaattattaccattgccccctttcactctgaaaactgtcccagcttgcatgaaaaattttacaaccactgtatcagtgctattgtcagacaccagtagtttctccatacaacatcggtggtttgcataggtctaccagggagcagagaaatggggcagaatccaggcttcctgacaccaaactcaggctctatctaaaagaacatatttcctctaggtttttcgtcatcaactcatccacaggaaaacactttggaaaatggtaaagatatataagccatggtttctgcaagctagcacttacaatcttggggagatgaagcacatacatattcaacaattaaagaggatcagatgaattcatcatatggtgctaatgacatggttcaaatgacaatttcaaaaggagctagaaaaggtgaaaaaccctctaagagcttcagacttcagggaaggtttccggtaggtgatggatcctgaaagatgtcttcaaggagaaaaaaaaaaaggcgtttttctttgaaaaaataaaggtagaaaaacaaacaaactggcacagcaataagccacttaaataattcaacaagcattactactctgtattcaagaagagaaaaacacaacagcaagtcaagacaaacacaaatggtatatgtggcttttccaaaatgtctcagtgacttaaggctcaacaagcattggatcttggtgtcttgataacctggcaagtgctgtcagatgttcctccttgtgatgctgtgagataaaagtgaccactctttgaggtcagtcccaccttttccactaactggccacgtgtctgtgggcaagtggttttatcagtgttgaggctcagtttccttaagtaaaatgctagggttggacaacggatctttaaatgccttttgatctctggcaacccatgaccctttacaaccaattccaggtttgtttagtatgttccaggtttaacacaaaattagatgtgagtgttcattttcagcaaaatggcaaacaacaggttaatcatatgggtcccttcccactacaaggatgtgaaattcccaagaaaatatcacagagttaagtttgggggaaaaaaagggaaaaaaggaaggaaaagggggatagaggaagggagagaaacagaggccccagaaataaagataaaattgaagccagagcttttatgtaaggctgactacacagtgctcaaggaagtttcagactctcgcaaatgctcccgaagccctgggaatagtggtgagattctaatgcccatgcagggacatgaccttggtcttgcatgaggtagcggggccagaactgagcccctttcctaaatctcaaagcctcaaaaagtcaccctaaccatgaaaaggtggactaaagcactctgcccactgcctcagagataaagagcagaacattcccttgtatccctagctcaggacacctttgggaaatcagaaccttaagcatgaaccactttcagttgtaagatcggaatttatactacctgtgtatctgagtaggggaatcccatgacaataaattaatacaaacacagttctaggatcattgaaagtccttagatctccagaaaagacaaacatatgtccactatgtagaaacgatttcacaactcaggactcacaagattcctatagaaaagaggccgggcatggcagcacatgcctgtaatcccagcacttttggaggctgaggcaggcagatcacttgaggtcaggagttcaaaactagcctggccaacaaggctaaatcccatttcaatacaaaaattagccaggcatactggcatatgcctgtagtctcagctactagggagactgaggcaggagtaatatctgaacttgggaggcagaggtttcagtgagccgagatcgcaccactgcactccagcctgggcaactaagtgagactccacctcaaaaaaaaaaaaaaagaaaaagaaaaaagaaagaaagaaagaaaaaagaaacaaagaaaaggaaaaatatctgaggttgaactgccagtatcaccccccaacacacacacaaataaactgccatgagggacagtgataaagggaaaaaaaaaactttaaatcctaagaactggaaagatacaatctcaaatggagtacaaaataagattgtttaaaaatattatagtgataaagactaaaagccataaggagaaaattaggattacatgaaaaaaagagaataagcagatttgaaaaaataaagtagaactcctagtaatcactcaatggaaaggttagacagtagagtaacacaaaacaggccatcagtgaaccggaagacagccttgagaaaattaaaccaaaatgtaacacaggacttccaagcaaaaatggagaattgaacacactgtatctaatatggctttcacctgaaacgtcactgtaacgagggaagatgaccttttaaaagacataaaaccaccaggacaataggagaggagattttaaataccttttgatctctggcaatccatgacccttttacaaccaattccaggattgtttagtatgttgtaggtttaacaagtaacaagattttagaaataacagtaataagattttagaagacggaaagcagatggagaagcagtgatagaattaacagacaaaggaagctgaatcctcagtgaggagcaggaaagttaggaacaaccagtggatcctccaaaggctcaggaacagatagcaccggtgacctctggaactgtgcggaagggagatgagtcactaaaataagaagaacagggcagggcgtggtggctcacgcctgtaatcccagcactttgggaggccaacgtgggcggatcacgaggtcaggagattgagaccatcctggctaacaggtgaaaccccgtctctactaaaaatagaaaaagttagccgggcgtggtggcgggcacctgtagtcccagctacttgggaggctgaggcaggagcatggtgtgaacccgggaggcggagcttgcagtgagccaagatggcgtcactgcactccagcctgggcgacagagcaagactccgtttcaaaaaaaaaaaataaataaagaagaatgtgagggaaactgtttaagaatcagttagatccctggatcctttccttgaatccaccctgctaggcagcagcctttatcacaactgctaatactggaggtttgaactctgggagaggattttggaattgggagatgccacacatcaaataaaaggaaatatgcatgctgaaggctgaaccctccagtctcattcctcatctcagctcccagcctgggacaggcagggcggcatcttgcagccaggagtctggaagagtgttctctggagaatctgaccattccctggttttcccattaggagactttaggagttgttagcattaggagttctccaacctatgacagaaacattttattctacagtgatgctcagagttgacaagtccctcacgcatcctcagagctttcaatacatctgttattcattcttaaatatggtcagacaatcaggactgcccgacatgcaaggaaagtctctacaggaaagacagagttcaaaacaaacagactgaaaaagacaacatggaggagacagagaccaggagaggcaaagacaatttctgaaaagaaaaaaaaatgcagaaaactaagagaatgacacacatcctgaaaacagaacagaatgcttaaaaaactatttatagatgaaaagaggaaacttaagacggtaacagaaatgaacccaatagatgggttggaaattgaagttaaagaaattgtacaaaaagagtgaaaaaagataaagagatggaaaacaggtgagaaaatatgaaaaaatcacaaaactgtccaggaagttcaactcccaaataatagaagttctggaaagaaagagcagcttacagagagaacacagtcttgacagattgaaagaccacaatgatcactgagtacaacaggtgaaaacagacccacaattagaacagtcatcgtgaaatttagaatatagggggacaggaaaaatcagaggttccaggggaaaagaaaaataaggtaaggcacagaacatcaagaatcagaacagtggcagctttctgatagcaacattgggagattgcgtgcaataaagcaatatcttcaaacttctggggaaaactgttttttaacctggattttcccgtacaagacagacaagtcatcatgtgacacaacagaatgaagacaatttcagacatgtgaagtgtgaatgtgtctctcagggatccattttccataggctactgtaagctgggagccacagaaatgagagagtgtaaagggagttttatgagaactaacacaggaccacaacagagggatgacggcactgaagtgagataccccaggatgatgactggctcagccacaggaccagtcatccagacagggccagcagaccaagagcaaggcatatgaaggctgttaccactgcaccaggttttaattctgatagctgctggaggctgtgcttcctcaaacaatggggtaaaacaagagagagaatccaacacagaagaaaaggcaaagggaagttctagaataacagtgaagacaaatctcaggatgtcagctatctagcaggccgagagagaagtctagctagaaggaaaatgtaggtctccagcagagatatcaccaagaaaagaaggagaactgacagattactaatgtgatcagctttgtggaaaaaggtactgtgagcctatggaagatagaggaaaagtctgtaccaggtacaaagatcaattaaggacatgaaaaaaagacagatattaacttcattgttaaaggtttagctgttaatgccatttattttgacaaaatagtgaaaacactaggggctgatttacccccaaattgtaatataactacactgggagaaagaggggagaggaagctgtggatatgatcatatcagacaggtaaatttttatctactataatataaggttaagatatacataaaattgatgaaacaaaagataacagtatatacattatttagaaatgcagagacatatatatgctagaagaaaaagctaaaatatacaaagttatattctttgagaatagggactggggtaagtaaagtggcattgaattggcttccacagaaattaaggaaccagcacataagtaaatatgcacaaggatgtttatggccacaatgtttgtggtgatgaagcaggattatttccctgaacgcttcatgggtgggaactggagtgcatgggcgctggaacttgccagccactctggcactggcaggggtgaactccactcatgaagacatgctgcactccacccctcacggaggtggagcacgcaggtgagtagatgcaggagccaggtgagtgctttttgggtgctggaaggagcgaattccataccagccccacagcagcgtctggagcagtgcctgcaacccctgaagcccaagaggacaggttacagtactcttttagctctgccatccatggacgccttaagtgctaacagctcagtgggggcggtcagtgtgacacagcattttacacctgcattgtggcacccaagttcttgtccggcgtccaggagaaatgaggtcgcacaaacaaactgaagatggtaaatacagaggattttactgccaatgaaagtggctttcagtaggaaggggagctgaaaaggggacggggatggaaggtaatcttcccctgaagtccagccatccctggccaaactcctgtctgaagctacaccgtcaaactgtccctctgaactcaagccacttctctccaacgtccaactgtagtcttcaacatccagctgcttctcttctctctgccagtggagccagggattttttatgggctcaggatgggaggcagggcaggccatgggtggttttggaaaaggcaacattcgagtgggaaaacagggatgtaaattctccctttggaccatggtatcaggcttttcagcttgagggtggggccctcactgggacccaccctcttctgcccagaatttccctgtctcctgtccctatcagtgacataaaactgaaaacaatctgaatgctcattaatagggagaaggttgaataaactataatatagccataacatggaattttacttagctatttttaaaaatgaattaaatttgtatccatttatctggagattatccttcatgtactatcaagagagaaaaacaagttgtgaaaaaatacatgctgtatgattggattttttttgcaaacaacagtaacaaaacacccttatttaagatatatatgaatatatatgtgcatgtgtttataggagcttggagaaacatgtagaagaatgcataccaagtgttaacattggttaccttggagggacaggaataaaaaaggtagggagatgttaaagaaaaaaatagaacacaaaaaagagagacatgagaaatctgaaaaacacattcagagacatgaaaaagagaataacaaggtccaatatacatataaaagaggactcagatagataaatagaggactgaggagagaaaatattcagagactaggacaaaatttttcagaatcggtgaatgtcaggaattcttagtcttgaatcccaagcaggattgtggtgaaaccgcagatcaccaaagataaaaacaaaaaaaaattttaaagcaatatgagagagagagagagaaccctctaaataaatgacagcctgaagcagactacaccttatcaattacacaaatcaaaaggtaatgaaataatatactcaaatgctgagggaagatatctatgtaaaattctatacctagaaaaattattattcaagaccaagagtgaattaaagatactttcagtcagagactgagatgctttaatattcccaaatccttaatgaaatagctattcaaggatgtacttcagtaagaaggaatttgaactgggactacaggtgcatgccatgcctggctaattttttgtatttttggtagagacgtggtttcaccgtattgcccaggctagtctcaaaactcctggactcaagcaatctgcctgcctcagcctctcaaagtgctgggattacaggtgttagccaccacgcccagctctcaaatataatttttaatgtttgagggtaacaactgtcaaaacaataggacaaaatgtatacattacaaatcagtggaaaacagtgtaagaaaaagtcaagtaatttaatgtgaggcagaataagaagaaaaaacaagtaaagaagtagcatggtatatagaaaacattcaggctcctagtgaattccaaatatatgagtaatcataataaatataaatgactttaacctgttagaagacagaaaacctcagattggattttttaaaactccagctctttacaagaaagaagcctaaaacacaaggattaacataaaggaagagaaagcaataccatagggaaatgctcacaagaacttggtatagtcattagacaaatcagcttgggctgtcataccaaaatgccacagaccaggtgtcttaaacagcagaagtttacttctcacagttctggaggctggtaagtccaaaatcaaggtgctggctgatttcatttctggtgaggcctctctttttggcctacagatggccgccttcttgctgtgtcctcacatggtctttcctcaggtgtacatacagaaagaaaaatctcttccttctttttcttaaaagatcactaatgccattgtgagggccctgctgttctgacctaatgacatgggaagagaacactccacccaataagcatggaatacacagtagagaatgtaactttaattacttcccaaaggcctcatctccaaatattatcacattagaggttggagcttctgcgtatgaattttggtgggacacaaacattcagtttatataagcaatataaacatcaggtggctccttcaggcctctgctcaagtgtcaactaatccaagagctgcccacgactacatgatatagaacagcataactttataccccccagcataactttatctacctcaccttgccttatttttctttatagcactataccacctgacaaattatatattttgtttgtttattatctgtgatctccaaataaaatataagatctctcagatccaagagagtagggactttctcatttgttcactactgtatctccagtgtttaggacattccttaaaaacaataaatgttcaataaatgtttattttaattgaatcagtgaatgaataaatgaacggatctgataaaacagactttacagccaaaagcaatttttttttttttttgagacagaatcttgttctgccgcccagctggagtgcagtggcatgatctccgcttactgcaacctccgcctcccgggctcaagtaattcttgtgcctcagcctctcgagtagctgggactacaggcatgtgccaccaggctcaactggttttttgtatttttagtggagataaggtttcgccatgttggcgaggatggtctctaactcctgaccttgagtgatctgcccgcctctgcctcccaaagtgctgggattacaggcatgagccaccacgcccggcctacagccaaaagcattttgagggataaagaggatcacttgttaatatgaagatatattcaccagaatccttttgtatgcctcatgacgcagtgtcaaatatttacagcaaaaattgaattaactacaagaaagtaacaattcaaaattatagtgggagattttatttatttatttatttatattttattttttatgtctctattgaacttaatacattaaaaatagaagaaaatcattttacatgtattcaatttattattttaaaaattgaggtattcaatgaaaatgtcaaaaatatgcaagaaaatagaatacaggaaagtggtatttaggtggtgtgattgtgtgcctttgcatttagaatgaagtcctctgttattaactgatatatttgagtatttgtccccccgaatctcatattgaaatataatccccaatgctgaaggaggaggtgactggatcatgggtctggatttctcatgaatggtttagcactatccccttggtgtcttctttgtgatagtgagttctcatgacatctagttgtttcaaagtgtttggcaccttccccgtctcctctctcttactccttctctggctatgtgatgtgcctgcacccatttcaccttctgctacgagtaaaagctccctgtggctttcctagaagctgagcagattctggcaccatgactgtacagcctgcagaaccgtaagtcaattaaacctcttttgtttataaattacccagtctccggtgttcctctatggcaatgcaagaatttcttggcctactcctgttcagctaaaatgtcacatccatgaggatcttctttatcctcctgcaaggatgggtgccttggatatgctgtttcatttaccacatttgtgattccttaacacacatgatctgccagaagcatatagtgggagatttttagtacacatctctatgaaattgacagctcaagttttttttttaaaaaagggaaaagatttaatattgaaataaggcattatacaagcttcagctaatgacatgggaagagaattctctacccaataaatagagaatgcacatgaaatgttcataaaaattgaacaggttccaggccacagaacaaataacaaatttcaaagaactgttatcatacagaccacattcttcaaccaaaatacaataaaaaaattgagatagataaaaccacaatccctaaacccaagtacattttgaaatttcagaagcacactgctaaattattaatatgaaatcaaaatgaaagtaaaacatatttaggactgaacaactgaagccctaaatttcagttgaagaaaatgtttagcattgaatttaatattagtaaacaagaaaaattttaagaaagttagagaaagggcaacaatgtaaactcaaaaacaatagaagaaaatcctttttccacacatggttaaagtagcaggaaggcaataataaagacaacaaatcaatagaatcaaaacagaaacaatagagaatagaaacaaaatagaggctgattctttaaaaagactaataaaataggtaaatatttgacaagattgagcaaggaaaaagaaagagcacaaataaacactattaggcataaaatgggtcataactaaatagagtaaagattttaaagcatgagaattcttttctgtattttaaagcaataaatctaaaaacagataaaatggaaaaccttttagaaaaatatgttaccaaagttgacacataaaaatatggaaaaagaacaaagaatcctgaatgtatttttatgagttcagtctaaacctacattgtagaaaaacactaagacaatacaaaaaaaggcaagtattggtcaatctcagttaaagtatcaatgcaaaaaatctgaaaaaaaaaattagcaaaaattccagcagtatagtgtgtgcacaaatatatagtatttctttaatatacatatttgagattatatctatcaaaatatcatgtttatcacacaataaatatacggaatgtgtgtgagatgacccagtaggttttatcccagaagctcaagtaagagtcaacattagaaaatcttaatgtaattccccacattggcaaattaggaaggaaaaaccatataatcatctcaatagatgcagaaaaatcatttaacaaatttaacccccattcacaatttaaaaataaaataaaatacctagccaacagaaacagaaggaagtttctcctaagaacctacaagaaactttaggaacatttcctttaaaatcagcaactagataaatatgtcttctctctcaccactctattcattattgtatgagataccttgctgatgtaataaagcaagaaaaaggagtaagaaaatcagaattagaaatgaagggggaatatgtggcattatttgcaaatgataagattgtctacatagataatccatgagaaactatgaacaattacaagaaataagagggtttggcagggacgctggagacaagattaatatacaaacatccatggcatcagtaacaaccaattagaaaatgtaattttcataagatgtcattagcaatagagatcttacacctgtgaggtacctaggaataaatctaaagaaagaggtgcaaggcctatatggaaaaaaaaattataaaacttcattgaaactcataagacctaaataaacagagatatatctcatgctcaggagtgagaagattccacaatttcaacatcaaatcccctaaaattaatacataaattgaatgaaattcatataaaaatcccagaaaggttttcttcatggatatttgtaaccggttttaaaattgtggtccaaaagcagccaagataactttgaaaaagaataatatggggacttgtcctaccagatatcaagacatatacaatatacttaattatgccataaaattaagacactatagtattggtgtaaatatagataactagactaacgcaatagagagagccccacacatgtgggaatttggtatgtgacagagatagcattacaaactatggggaaaacaaaaactaaactaataggtggttcgcagacaactgttacccatatggagaaaaaaaatagatcactaactcacactatatccaaaaatgaattccaagagaattacagttaactttaaaacatttaggaaaaaatgttttttagacactatttttatggtcttaagtgagggactgacaaaaaaaaatacaaaccataaagtaaaaaagaagaagaaggaaagaagataaaattgagaaatttgatgttaaacattctgtgatgaaggatgccaaaaaacaatgtttaaaggcaataaatagccttggagagagaaaatttctgtaagtattcataatatttagtgaacacttagtactctataaggaaaaaacaacccactacaaaaaagtgagcaaagtctagagtcaggtaatacaaagagaaagaaaaaaatcccaaatgatgaaaaaccgtaggaaaaaccaacactaaacacataacctcataagtaatcagagaaatacaaatcaagacaattaaataccttttcaatacatcagattagcaaattttaaaagcccaacaatgtcaagagtgggagaagatgcagaataataagaattgtacacattgttgctgaaagcaaactgagagcaatttggcaacgcctaccaacctttatgatgtttgtaccccaagacccagtaattccacttcttctgtatctttgaaaagttcaacaaatccacatggaaacaagtccagagaaggtcacaatagaactgtttataaaatgacaacctggaaacatcagttagggagtggatatattatgatatatttatagaaagaaattggtttatgtctgagtcttttcaggttgctataacacaaataccatagactgggtgacttatgtaacatttatctttcagttctgaaggatggaatcccagatcaaggagccagcagatgtggtggtgtggacccacttcctggttcatagaggaccttcccactgtgccctcatacagtgaaggggtaagagagctccgtggggtctcttttagaagggcactaaacccactcatgagggctctacccttgtgacctaatcacctccaaaatcctgcctcctaatagcatcgtatttgggattaggatttcagcatatgaattttgcagggaaagaaacattcagtttataacaatataacagttaaaggaattagctctacatacattaattaggataaatctcagaaacataacttcaagtgataaagcaagttccagaaagatggattattgataacattaccattcgttttttaaacttgcaaaatgatactagttattgtttatgacagtggtccccaacctttctggcactggtttaatagaagacagtttttccatagacgggggtgggggatggtttcaggatgactcaagcacattacatttatcattagattctcataaggagcgagcaaccaagatccctcgggtgcacagttcacaatagggttgcgctcctatgagaatctaatgccgtggctgatctgacaggaggtggggctcaggtggtcatgctggctctcctgcagctcaccttctgcggtgctgccaggttcctaacaggccacggacctgtaccggtccatggcctgggggctggggacccctggcttatgacacataatcacatagcaaaatgcaacaggtatgtaacagtgcaacttctaaagagtgtttactgctgggaaagctgtggaagaatgctgtcagtttggggtcacaaaagaggcttaaactacaacattttctgttaaaaaatatttttaaaatgtggctaatgtcaatatttattaaatctgagttggggtacctgattgtttgctatattattctctgtaaattttgtattttaaatattaaatagttcataatttttaaagttactgtttaaaagggtatacatgatctttttctgcacatttccccaacattttctttttcttttaaaatttaattttattttattttaagcactgggatacatttgtaggatgtgcaggttagttacataggtaaacgtgtgccatggtggtttgctgcacctatcaacccatcacctaggtattaagctccgtatgcattagctatttattctgatgctctccctcctcctgccccctccaataggccccagtgtgtgttgtctccctccctgcatcaatgtgttttcattgttcagctcccacttataagtgagaacatgcagtatttggttttctgttcccgtgttagtttgctgaggataatggcttccagttccatccatgtccctgcaaaggacatgatctcattcctttttatggctgcgtagtattccatggtgtatatgtatcacatttcctttatctagtctatcaccgatcatttccccaacatttcaatctaggtatacagttgtgttggcagtctgggacctgaggaacagtccttgttccaacactaccacgctgagtgactctgagcaaatcagtgaacctctctgggccttatctgtgtgctcatctgtaaaatggggatactcatagtagttatgacttagaggcagtggttaagcgcatgggctctggaattcgatctggacttgatcctcagctctgctacttaccagctgtgagaccttagtcaatttacttaaactctctaagatgtactatcctcatctaaaaatgcaaacagagatagcatctagctcacagatctcttatgagaataaaacaaaaggaataatgaaaatctcttagcagaccatcatcaacaaaataaaattacaaaaccaagagaagatatttgctgtgcatataatggacaagggagtggtgtcaagcatacattacatactccaataagccaataaagaaacaacgaaccaatagaaaaacgggccaaggaaagaaagagataactcatggaggaaatcctgactactcggtatgcaaatgaaaatatgctcaacctcactggtaatcaggaaattgcaactgaaacctgaaacaactatcagattggcaaaggaaaaaaatttttaaatatgactctaacaagtattgaagagaatactgagcattaggaattctcagaccctgctgctgagaaggggcttgcactttggagagcaatttggcaacatccagggaagacgatgtgctaattcatcactttgctactggctacatatccaagagaaactaccaggcatggtgtgcaaagaacatatcaaaaagctagacacacctgtagcattcttccaaaggacatcttaaaattagaaataacttccatgtcctccatctgataactacaacacagcatggaaaatgtatagaggtccatgttttgcaacggacaaatcttacaaatacaatgtagaacacaaactccatgatatcctttatataaagtttaaatacatttaaaaatatatatatatagtttaaggatacacacatgtgaaagataaaaccatgcatggttataatgagcattgagcatcacatttaaactgatgactgtgacgttcagggaaggaaaaagcgggtggaaatggggaaagtctatctcttttttacaaaaaagaacaaggacatgacaaaatagtggtgaatgcacatttatacacaatcttattctctgcattttctgtttgctcgagatctttcacaataaaaaaatactgtgtgatgctcaatgctcattatcaccatgcatggttttatctttcacatgtgtgtatccttaaactatatatatatatttttaaatgtatttaaactttatataaaggatatcatggagtttgtgttctacatttataagatgatatgatttggctgtgtctccacccaaatctcaccttgaattgtagctcccataatccccacgtatcatgggaggcacctggtgggaggcaactgaatcatggaggtgggtttttcccaagttctcgtatattgaataagtctcacaagatctgatggttttataaatgggagttcccctgcacatggctctcttgcctgccctcatgtaagacgtgcctttgctcctccttcaccttccacagattgtgaggcctccccagccatgtggaactgtgagtccattaaaactttttctttacaaattacccagtctcgggtatttcttcatagcagtatgaaaacagactaatacataacctgtcaataaatatttgtttttaggagccccctaaagtaggtaggagagtgttaatatgatcatttgacagataatagaggtgcgggacaaaaagctgacagagtgggctcgtggtctattgtcccataatgtcaacgccctacccttgacattatgatgttcattccactcatttagtaatttacttaatacagggaactggaacttgacgcaacttagggcaggcgggtgaagaagacaacctcttcctttctggaacaaaccacagtttgaggaacacaatgacagaactcgataaaaagggaagaaaccagactgctccagtcatctgacggctcttcaatgaatctgtaattcactcacggagggcctgaccattcactgcgcatctgccgaagaggaggaaggggccggaggaagtgagatcgatggcctccgttccagcatgatttcgcctttccagcaccctatctaaattaagaacagggcactgcgctgcgtttaggggcattagctctgagatcttgtccgggacaggtcccttttctgctctgggctcttcttgtttaaaattgaggagtagactaccatctcgaggccagtgaaattctagactcttcattctgtttttcaggattttttcttttcttttcttttaaaatctgaaacgggagcttccgcatttattatttgcacgtggttttgaggcgcactcctggccacatcacagctatgttctcttgcctctgggaaatacataaaatgcctagcaacagttcctggtggcggctggtccccataaacgccgctggtcggcccccaccccacctctataccacgacccctctcccagcccggggactgtggtatggaggccgagagaggcccattttaaggaagaagcaagacatatgcaccatcccatccaaggagtaaacaggcgggggggaggtgggcgtggcctcgatcaatcacctcccctgaagctgcaccacatgcacattttaggctggaaataagaaagaatttcctggctgtaggaattgttaaataatagggcggatgaccaagggaggttccggaatctcctcttgagatctttaaaaatgcgatacaagatcgcatgtctgagatgatttcttgcagtcctggctagagacagacggactaggtgccttaacgggcctgaccctcctcccaaggcatatgattctgtcttttgctttctcttacccttagcaatatcctcagtgcctcctttatatgttcatccccctggtgaagctcacttactgccatccctcaggctagttttcacccaatccctagcctcctcacacctttccttgttattttatggaaagctggtcaaaggtcagagttgcccaactccccacacatagtttggtggtagcatctgatacccagacaaaacacggcaaggattccaataccagcatattgaagcttaaacaccaaatctggatggaaacagagaattagctgttgctaacaacccattgtaaatgaaaatatgatcttggtaattgattttaaatagttttttttaaaagaacccttggccgcatttcatcaagaatacagagtttcaaaagcgttcattccagggttggattttttttttttcctctttcttctggcttaaaccccaaatggccaagatcccagtctgaataaacaatgtgggtggtgacttttctgtgaggcccagtagaggatgcaatcactttcttattcggttcaacattaaatcatgtgaaactagcctgattactccacacaacttttactccgtaatggagggcaacacaacatgtattctttctctgcttctcagggagaaagaaatgaattctcctaactgggagtgtttaattatgtataaagttcgttgacctcacaggcggctgtcagatgatcttgctaaggcctgtgaacggcatcccaggaatgcagtgatgtgggcagaaaccgagtgagttcatgccaccgaatgctttaaatgggaccgaatcagcagccgtccagaaagactccagcgaaaacagaacttttggataatcagtaatttaatctcacctaagcattttgaggccttcaaaagtgattgttataaatcagaaactcaggaaaaatcccataggcatggggcccataacaacggggtgaagtaattttgtttgctggttattgccacagctggttggaaatgtatgtatttgcaatgttctgtccccgttttagaggtaatgctttctgacttccctgctactgacattaaaagaaaatgatgaagcaatcccattcataaatacatggtggggcctgaaggagtgtgcagagtctatgtttatttacagttttgatataatgcagcctccacatgtgtatgcagtaactatacctacttgtcagtaaatgccttgaaatgtgttcttcctacgcagagggctgggttctcctctttgggctcagggagcggaagggtaccagcaagatgagcgtatggattgtgtgttctcttttgtctctacctggagcatccccatctgtctattgtgaaaggaccaggaaacgctgggagacgggctggcatgtgcttcttggtaacgagagagcagagcccctggagagctgtgggatggctaactgcgggagccctgctactccgggtaggggagaggcgggggcctgtgaaataggtgggcttggtgcttcctataacatttaaattacctgattgggggtccaatattatgttccttcagtagctttctcaccaaacacacattttatccatccaaatattatgctttcggctggtaaaacttcacaggattatattctaaaacaaaactctgctgcattcatgctggtacctttattgttatgagtataaagaaagggaggctggaatttagccaataactttgacaccctgctggaagcaaaatggaaggggcctcccctgagcatctcttagactaacctaaaagtcttgaatctttttccaaatcaatcacctaggttttgagtgcacaatgtctgtctgcatccaattcgagttaattcaatagatatttggaaaacacaaataatggacaaggcaattctggtgacacaaaaatcaggccaggcgcagtgactcacacctgtaatcacagccctttgggaggccaagatgagcggatcacctgaggtcaggagtttgagaccagcctggccaacatggtgaaaccccgtctctacaaaaataaaaaattagccgggcatggcaatgcatgcctgtaatcccagctacttgggaggctaaggcaggagaattgcttgaacccgagaggtggaggttgcagtgagctgagatcgcgccactgcactccagcctgggagacagagagagactctgtctcaaaaaaaaaaaaaaatcagaactctttatcaggtcacattaatcccaactgggaggatttgggtagttttcatgcatggaatcttcccagggttgggggctgaacccttaaaggggttcaataggccaaagggaaatgggaacttaccaaaatctcagttcacactcgcatgcattgtggagaagagagagatgtaattgtcactgagtcctgctattccatggttagggttctataattttatcttgattttttgtttgtttgttttaagacagggtctcgctgtgtctcccaggctggagtgcagtggcataaacttggctcactacaatctctccctcctgggctcaagcaatcctcccacctcagactcccaagtagctgggactacagacgtgccaccacgtttggttaatttttgtatttcttggtagagacggggtcttgccaccttgcccaggctggtcttgaactcctgggctcaagtgatccatccaccttggcctcccaaagtgctgggattaccgctgtgagccactgcacccagcctatcttgtttttatagtccacttgatatttgagggtttccccacagaagcctttctttaagacccatagcatttaatattacactgtgaagtgaacaatcagcaaaaaagaaaaggaattccttctgtcttcccaccctgataaaggaagccttccttcaaatgttcaaaaattttctataaatatgatcatccccatagttacaggggaaatatgcttctagataaaggaatctggacacaaagtaatattctaaatcacttccactcttttggatactacaatttataaaattccatgaaggaaattagcctgatttctcatgaagttccctattgggaaatcactgtgtgccacagttatggaagcaatatctttgtgcatttcccaattccctgcctttgtcggaggctctcatcatctctaaactaccacagcaatttagctatttcttgtctgtagtacgtgctgcattctgcctggtcagaggtaaagatgaatacatgacttgtctctgttatttgagtacataacttgtctctgttacattataagctcttggaaattagagactgatgtacttatctttacattccccagcgtcattaacagggttggtgtccactgaaagaatgaacaaacgagtcagtaaataaataccatgaaaatatctatagcatgggttggaaaacatttccagtgaaaaaccagatagcaaatatcttaagccatatggtctctatcataattactcaactctgatgttgcagtgtgaaagcagacatagacaatacatagcaaatgggcatagctatgttccaataaaactttatttacaaaagcacgtggtgagcaagatttggcccacaggccatagctttctaactcccggtctttggtggttatccttgctgtaaacctcagtatattctttacgcttttacatagcgcttgttattttcaataatgagacaaagtgcagaaaacataaatgttaaagggttgttttggaactctatagcaataaattcacttaaaaaccaatcacaaagcacatatggaaattagctgacccaccaagcatatttcatggtcacctattttgtatattgtattcctttaaagcgaaaaattcttatcccaagaaataagggtagtagttttgccatttacgtcatcatgactgagataacttgatatgataagatctcagagttactgagtgaaaggtctggtgctaggtcatgctgaacttgacactctcctgggaaaggggaagaaatgctcccccatcctgctgtccagcagatcatctggtctctaattttactgctaaaatccttcccgaggttattaatgcagaagatactcctttttcttgataaccctctggaaaatatccagctagaaagagcacaatagaatctcacaagttcagcaaacacacagaaaagtcaagagtaactacgagaatctgatgaaaacaagatgtcccggcctgccaccctggcctgatttgagagtgcctcacccgtcattactcttgtctcgctatcaggtcacctttcgtaaaaaatacaactttgaaaaggagttggatttgaattgtggccgacactaataggatgcaaagtcctaggtcaattgcttggtttggaacaaattcaactagtcctttccaaggtatgaggaaatatacaacaaacaatgtaccaatgagcaccccggctgacattttgtgagatgggtgactccaaggtgtagatcttcaaactgcgtcagctatccacaggttgtgatgaaacagttctacagatttcttctaagaaggaaaaaaaaatgaaatttgagtctttccattatgccaagcttctcctcaacaccagaccaagtaatgggatgaattctgtgccttaagaatatgagaaaacagaggcttggaaatggaaggtgccatgaggcagtcaaaagacctgagatcacatctaccacattcaacccatgtgacatgaggcagattatctgacttcaatgtcacttgatgtcctaattttcaatgcagggctgggaagcacacattattgaggagaaatcagggaacacatgatatagagcccaatttatttcaacaaaccctgagaccccattgtgtgccagtgttggagagtgcaaaacggctgtcagggattctgagtatagcgtaggtgagcattccatggggagagcatcacatattgctttatttgcaacactccagtgcccaactatcctgagttcctctcttctgtttattgaatttcctcccctgccagttcaccacaatcccttattaccagtctctcctcattaaaacatcccccctcacccctgccacaaaacaaggagggcattctcaccgttctccagaacagggctgtagcaaacaacttcacgtatgtgaagtggtatgatttataccagcttaattgatattagataaaatttcaaattgctgaaaatgcatgtggcaatgcacataggaatcttactgcaatctgggtttggggtaagatgtataaaaataaagacaagagtttgaaagagggatcaggtggagaagacaatgaaagggaacggagaggcgctggaatattgtgaaatgccccaaaaagttgtttacagtaatttaggacaaattcctacacctcagttacggtcgtcttcaagtaacatggattgggtaaggtatgttcttcaaggcgaaaatcactgaatatgaagtgcaaattcatcagcatctgcactactcacaatagcaaagacacagaaacaacctcaatgcccatcagtgatagactggataaagaaaatttggtacatatacaccatggaatgaatacttactatacagccataaaaaagaattagatcatgtcttttgcaggaacatggatggagctggaggccattatcctaagtaaactaacatcaggaacagaaaaccaaatactgcatgttcttacttattagtgggagctaactgatgagaacacatggacatatacaggggaacaacacacactaggacctatcagaggatgaagggtgggaggagggagaggatcaggaaaaataactaatgagtactgggcttaaaacctgggtgacaaaataatctgtacaacaaagccccatgacacaagtttatctgtgtaacaaacctgcacatgtaccgctgaacttaaaataaaagttaaatttaaaaataaaaattaacattaaaaaattcaccagcatcccactgtgaagtctgtgcagggaggaggggtaatgtcccagggtgagggctgaaactctttgctcataattctctcctgctcccactccgggaaatcgagcatgggaatctatggagaacacctgatctccatttcctttaaaatagcctcttaggctgtgtttacagaacacaaaccaatggctcaagagaaaaaatatgaataagtcaagggactaatatgacaaattttcaattcaatctaatatcgagatagatgctcctaatgtcttctgaggcttcatgagaacattatctgctcctctcttctggctttcaacttcattattactgaaaacttctacttgaaatacaaaatattggaagagtcactctcaagatttctagaagtttcgcggccgggtgcagtggctcacgcctgtaatcccagcactttgggagaccacagcaggtggatcacttgaggtcaggagttcgagaccagcctgtccaacatagtgagacctcgtctctattaaaaatacaaaaattaggcccggcacagtggctcatgcttgtaatcccagcattttgcgaggccgaggtgggtagattgtgaggtcaggaattcaagactggcctggccaagatggtgaaaccctgtctctaccaaaaatacaaaaattagctgggcgtggtggcaggcacctgtaatcccagctactcgggaggctgaggcaggagaatcacttgaacctgggaggcggaggttgcagtgagccgagatcgcgccactgcactccagcttgggcgacagagcaagactctgtctcaaaaacaacaacaacaacaacaaatacaaaaattagccaggcatggtgacgggtgcctgtaattcctgctactcaggaggctgaggcaggagaatcacttgaatctaggaggcggaggttacagtgagccaagatcgcaccgctgcactccagcctgggtgacagagcaagactgtctttaaaaaaaaagatttccagaagtttcgtttggcagagtaaatggactccccttatcagtatgtctagaataatccaggtaaaatgttgctgcaaccaactgttctaaagttaacttctctggcgtgctacttcagcattgagaaacaggaccagatgagttcatttcatccgtcctaggcagtattctgggcagagcaaacagaaaatctcaaggaaagaaagaaactttcagagcccgctttgggcctctgtggattccttttttaagcgttacaagattggtcctagaccacagatgcaacttttggatgtcagatccaccagacagatgttttcccttaaagctgttgtctctctctcaatctgtttatagcgtgtttccatttcagcctgcaccttccttaagttctcactgctaactgcacgtcctaaaggtttcttgcctccacacacaaaaggctatttttctatcatgtgttctgttttccataaggaatgcacccactcttcgggtgacctgttaacccattactggtgtgtctgcttcctgggtcatcttcgagaaatgtgccaaacgctccatatatatattattaatcccccaagttgtgtggtgccagaaagagttttcttcttagaaataaactactcaggccacatgactggtattagcttcttaaaccaattgagcatcaactgatggactctcataatgtggtcagggttacttattcaaacctgtgttttttggttctgagcttgtagatggtcttcatataagtcagaccaaggaactccatttctatatcaattaagcagattctcagtgccaatacatttcaaccaatagatttcaaagactcatccaccttctctcactgtagatttttccagaatatgattcagactaaaagcaggacagcatctgctgccatttctcatacataaaagtacagggagacaagggagtttcttggtagggatggaataaccctgtgtcctgatggcggtggtggttacaggaatctagacatggggtgagatacacacacacatacaaatcagtgcacataaaccatggtgaaatctgtttaaggcctaatactaacgtcagtttcctggtattgataatgtgatgctatatacatgataccatttactattgttatgcaagacgttaccattcaagaagcaggatgaagagtacatgggccctctctgtactatttttgcaacttcccacaagtctataattattgcaaaataaaactttttaaagttctatgagaaagttactgcctataaggcagtagcttgcccaacttagcccgattgaatttgaagctctaaactgcttctttcttctactcacagtatttttaagtattttccacaactttcctctaagaaatggagtctactgactttctaatctgtgaaaggtatcctttgtcaatatgagagctctagagagtgggtggggtgggatcaataggtttttgaaaagttcacactgggttcaccagcatcctgcattacaacgagcattctaacaaaacagcatctttcagctgttttgtggatgttcccaatgacctagaggtttaaagaggcatcaggtcatagtcccaagtggcaaacatatacatgaggtcattcagtgggagaggagtccgtttgttcttccttctgtctccaagtttttcctcaggacttctcagggctggctcctcatctcacaggcctcaagccaaagaaacaggtcctgtgaaactcatatttaaactagccttccccctgtattagtccgtgttcacgctgctggtaaagatatacccaagactgtgtaatttataaagaaaattataaatcacaatcatggtggaaggcgaaagacatggcggcaaacaagagaaaataacagaacttgtgcaggcaaactcccctttataaaaccaccaggtctcatgagacttattcattatcacaacagcacaggaaagacccgcccccatgattcaattacatcctacccgctccctcccatgacatgtgggaattgtgggagctacgatccaagatgaaatttgggtggggacacagccaaaccatatcaccatcctccccagttacaccctacgttatccattttgttgtctgccacgttcttatttttcggttttacttattgcccatgtggcaccatgagaattgtgtccctttgctcacactgtgtccccagcacctaggacagtgtgttatttgttgactgaaagactgaagaaatgaatgaaacattcctaaagccatggcccattcttagacaatggtgattgtcaaacatgcagatcattattaaatagcctcaattaatgatcatctaggttagtttatgtaggtaatgatcatttttatgtttggctacgagaataaacaagacaaatttgagtgatgtcttcaacactagcagctgagctcaagtgctatggggaatcccaatgaaaagccatgattcctattgaattttctgaccgggctagaaagagatcagtaggcaggtagatagatggggagataggaatgaacatatactcaagtacacatacacacgcacattttctcatctttgaagatgcaacaggattttttttttttttttgagacgaagttttattctgttgctcaggctggagtgcaatgatgcaatctcggctcactgcaacctccccctcccaagttcaagcaattctcctgcctaagcctcccgagtagctgggattataggcgcccgccaccacccccagctaattttgtatttttagtagagatggggttttgccatgttgaccaggctggtcttgaactcctgatctcaggtgatctgcccaccttgacctcccaaagtgctggcattacaagtgtgagccaccgcgcccggccacaataggatcttggtacttcctttatccttgcaagtcaacctgcaaagaatggaaatcttctactaggggaagaaccagaaaaacatcagggagataggttttctgggcataggtaggcagagcactagggagaaggagttccctgttgcggctggtggagagcgtcctgaatggtgtcatcacctccactgtctggactcacaaggtcatgagaggtcaggagtgagggatgccctgtcaccaagccaccattccagtgccaagctggcctccccatcacgtcacatcaatgtttaaaagaggagaggcttcagataatctaccatgcccaagatgtcgtaagaaaacttagagggttatgtttatagacatagtgaaatatatttttttaattactaaccttacatgcatctgctttagcaaggaaaaaaaaattcccccaaaagactccttcaaaatcatgggaataagaaacaaagaggccaatgaccccataactttaaaagcatacatggtgccaagcagcccaaaagttagccttctgataccagagtcagcatgtgctgactgactccccttcatttcacgcttctcttaaaagaaaacaggctggattgtttcagtaaataacaaaaggtcagagaaacgctactcacaacatgagcaaaataactgctcaatctgccaaaatgtttccaaaggcctaacaggcagaaaaatccagtggtgaaataatccacggatctgaccggtgagaaaaggtccttcccagtaaaatctgccatcaggcctctggctcatctttcatcaatgagaaataaaaacaaactacgtcgtcaggttctgccaacattgagatgccatgtccttcacagtaaagcaaggttgtctactacatagtttttagacttctcgccttagattatattttgactttaaggccaagtgtagaaatggtggtcaaataactatgtactcaaaaacgaagtccaaagagtccattttgtaaaatcttctcctgaatgaaacttcccattggtttagctcctacgttcattttatctgcagaatttctccgtggtgaactggatgctaataccattataagagcttcatagagagacagagaataagcacatccgagagagaaatcaggactttgcaccctggggatactgcctcaactgaatctgcatcagtaattcggtgggatattgtctcccccaaggcatccctgctattagccatgtagacaatgccaccactaatggcttattgccagccttgttgcagaggtgggatcttatccatttccgccctccacaggatcttgcgaggtcagtgctcagcacattcactgggttgagtcaatgcccctatattgtacctcattcttggtttaaaaccatagagcagcacttcacagagtattttccatgaaatactggtcctgtaagatgctacttgggtgcaacataattctgattccatgaagaaataagctttagaaatgcttcctactatgactacattccccaatttcagaatcatcatgcatatgggcatattaaagaatcagagaagtcctgcaggaaagaaacctggtgaagttagcatttcccaaatgcttttcagaaaccttttttcaattaacatctattcccatcctcagcaactagtgttttggagagggcatcctggggaacattacctcaaaatagtttccaattcatgtctaatcacatttaatgtgtcactaagtccaattggttcttccttcaccatataagattgtgatcagtcctgtccatttaacaccctactgttaatctcctagtctcaacttaatgcttcatagtatcatagcatcacagaaggatagatctggaagtgctttagaaataatcataaagtaaaggtcaactggccaagtgtggtggctcacacctgtaatcccagcactctgggaggccgaggtgggtggatcacttgaggtcaggaattcaagaccagcctggccaacatggtgaaacccagtctctactaaaaatgccaaaaaaattagctgggcatggtggtgcgtgactgtagctccagctactcgggaggctgaggcaggagaatcgcttgaacccaggaggcggaagttgcagtgagctgagattgcaccactgcactccagcctgggtgacagagtaagactccgcctcaaaaaaaaaaaaaaaaaaaaaaaggcaagctctgaatttaacagaggagttaaccaagacccccagggtgaagggacatgcctaagatgtcacaacatgacacgtttgactcactaaaaaaaatggtagtttcaggcaccactctcttcctccccgtctacttggtgaacaggaattagaggagcaggcccccagtgtggaaggaaagggaagccagtgctgtggagtacccaccgaatgccgcaccgcacacttgcacatacatcctctcacttcaactcagcaagaactctgcagggcgggtattttacagaccaggaagcccaagaccacacagtaagcaagtagctgtgccaggatctgagccaagaacagtttgactccaaaacatatactcctgctagtgtattatactctctctcgacaaggaggccctcaataaaagcacactgaatcacatagtaaactaggaactgcacatctgaagttggtggctgcaactactaccgctactgcaaaggagaacatatagtgagtctttggttttccatcaaaatagcctatcatttgtgaatgtaggaaagagtgaatttttaccattcatgaaaaatgaattaagttaatgaagtcataaacactaattgagagtattactgaatacacaaataatatacctgcaaacttttacaggaccatttaatgttagggcttgttggcttctcctgtcaagtcatttttgatggttggttatttttcatgaaatctacaatgggcacaagcccagttaatatgatgacgatgatgatggtttattttcattgtatacacaaaagcatatactattcaaagccgttggagtcttaatggagaatggaaactttctccagggatagacaattgataaactctaggagtaccctttttcatattcatctttccatatttgcatcttttgaggtacttggaatactgttaagtgatttttcttcccacttactagggatttgctgtcttttgaagaatttctgaaacaaacatgtggtccataagtccaagtaaaatattttaaaaacaacaacaaaccaataaacagcaaataataatggtcacaaatccatgaataatcaaatttaataaaatattgacatgcaaggatttttattgcttattacaatcactaacatgcaacccagcttatggataccacggagttccaatattggtgggtggggacatttttaattttagtatttaaaagttgtaggggagagagaaatggctttcctccaccgctctgggtttcttggctgggttatgaattgacgtaagacaaattaacagaaagaaaccccatatttaataatgtaggtgcacatgggagtcccacaaaatatgagacttgaagaagggtcacacggttgaaactcatttagcatcctgagctatggaacggaataggggcttggggcttctgggggtggtggggacacaagctgtgcgttgatgaggggaggctctgtatggtgggtcaagtgtgtcttattatgcagagaaagtctctcaggtactagaaattatattggaacagtccttggaaaaggagatgatagtctggggtggcatgtcctgagcccctacaaagtcaaccatgactgtgtaaccttaagaaaaagagtgactacccagcactttgggaggccgaggcaggcggatcaccaggtcaggagatcgagaccatcccggctaacacggtgaaaccccgtctctactaaaaaatacaaaaaaattagccaggcgtggtggcgggcgcctgtagtcccagctactgaggaggctgaggcaggagaatggcgtgaacccgggaggcggagcttgcagtgagccgagatcccgccactgcactccagcctgggtgacagagcaagactctgtctcaaaaaaaaaaagaaagaaagaaaagaaaaagagtgactgacactaaggaaggtttttttttctttttttttttgacgtagtttctctcttgttgcccaggctggagtgcaatggcgtgatctcgtctcactacaaactccaccttccgggttcaagcgattctcctgcctcagcctcccaagtagctgggattacaagcacctgccaccacgcccagctaatttttgtatttttagtagagatggggtttcaccatgttggtcaggctggtctcaaactcctaacctcaggtgatctacccatgtcgacctcccaaagtgctgggattacaggcgtgagccactgtgcccagcccaaagaaggtattttatatctgattgtcaagacatttttattcaatcttaagtactgaactttagcattaaagtatgcaaagaagccacaaggatagaattatgtctctaccaatcttttagtcctcaaatataagtaatcctaatattcttaatatcttaaaaaagacaccaatgagatcttcattcacaaagattattagatatagtgaagtaaatatttacaaggaaacaaaacctgttaaaactttaacattcgtgtcacatcttactgacagaaaatttgcttttgaaagccaattttgagttttatttcctcactttctttgagttttatttcctcactttctgcatatgtcctcatatcttagtgggagagctcttaccaaaaaatagtattttacttccttccatacctattgatacggtttggctgtgtccccacccaaatctcatcttgagttgtaactcccacaattcccacatgctgtgggaggaacccggtgggaggcaattgaattatggtggtaggtctttctgcactgttctcatgataatgaatgagtctcacaagatgtgatggttttaaaaatgggagttccctgcacaagctctctttgcctgccaccatccatgtaagatgtgacttgatcctctcctcttgtctgccacgtgagatgtgcctttcaccatccaccgtgattgtgaggtctccccagccacgtggaactgtatgtccaataaacctctttcttttgtaaattgtccagtctaaggtatatctttatcaacagcgtgaaaacagactaatacactttgtaaatttgatggggtcagttctgcattggttgtacataggagcaaccctgcacagagaaacagatcaagtctggaactagaatagagtaggtagcaagcagaaagtagaaggaagagcaagcaaaataaataggttcctaacatctgctatttcccgatttttaaaaagtgaatgcacagacaacagacaccaactctgtacacaaaaacacactttaatgttaactagaattattcctcagatgcacacagtttgcgtttgtttatgcatggtgtagctgccacttacgtagtgtttattacatagctggcactgttctaagcagttaactcataaacgcatttaaagctcacagcagccctatgaggaaaatgctgtaatacgtggcacttagcagatgagcagaaggagccccagaaaagcctgggtaggaaaggacagagcagaggtttgaatccaggcagaccatctccagtccatactgctcacacctgacactacactgatcgcctacgaagtctgctgtacttactctgctgacatgcttggaaaagaaacacattctaagtagttaataatcaatcatttcccatataagaatatattgcaacattcagaaaagggttaaaatattctgtaatcctaccactatatcacattgctggggtagcccaatcaccgcagagactttatgaaagaggtttctgagtcctatttcaaaacatcagtgactagggcaaaacccctccctaaacctaagccgtttacagtataaatttgggaaggaaactatttgagatggccgttggagatttctactagaacaatttgattatttcttttacagtctacatatgaatagttgaatcatttaattgcaggagttaaaagacttgtctgtgtttagaaaaatgagatttttatttgggattccccagtatattagaaagatgattctcagtaaattgtgggcaagaaggaaataatatacatatttgtggctatgagagctaaccagaaaaaaaaaaaagaaagaaagaaagaaagaaactctctggactcgcacagttccaaaaactgctgaatgttgtcttttttttttttccaccctactaagcatttctctcttatcgaggaggattcatttcccacctgtttcttttacgttcttgaaatacatataaagttagtgtttattttctacccactgaaatcttgttcaagttattctttctttggtctctactttcagaagtcacaacttgttttgaaaacattagcatgagagaaggcttctttttatgtaccacaaactctcaactatttagaatgcttgcttcagaggtaaagagatgcctggtggcttttctgctttgtaacaatggccgtgtaaacaacatgactggacaaaaccaaaaatgtgcttagacagagttccttcttcctgtccaggcaaggtggctcacgtctataatcccaacactttaggaggctgaggcgggtggatcacttgaggtcaggagttcaagaccagcctgggcggcatagggaaaccctgtctttgctaaaaaaaaaaaaaaaaaaaaaaaaaagctgggtgtggtggtgcactcctgtgatctcagctacttgggaggctgaggtgggaggatcgcttgaaccagggaggcagaggttgcaggagctgaaatcatgtcactgcactcaagcctgggcaacagagcaagaccctgccttaaaaaaaaaaaatggaattccttcttcttctgatgagtgcttctcatcattggggtcacaattatcaataccagttttttatagcccaacgttatttgaaacatccatatgtttgtgttataaattaatacacgtatttaaaatatgggttatagaaaagataccatatgcagtggtccagaattttgagttgtactgtccttgttcttcacatggggtattagatttcaaccaaaatgaagatcatatcttcaagtagattgccagaaggcaccatactggaagctcacgggtagtgcactctgttcaatgagggcagaaagacagtgacatatgaggtcttccaaaggtgacatggaatgcaggcagagatgaaatgtagaggagaaagaatgcaaagctgcaaaacatgggccctatctgtacttggatctggtccttggattgcagagctcactgctgtgtgcatagacctggcaagtgtacggctgccagtttgattccgatgaagggcatttagaagaatcaaaggatgaaagacaacggaaaggagttaacatcatgacctccattttactgatggcatggctgaggtccaaaagagttaagtgacacagagctagagcagcataaagccagcacttgtcaccttctctagtttcataattcataacttttctgtggtatatgttcctggtcaccaataaaatgggatgacagtgtggacagctctatccaaaccattacttctgataaacaaatcaaactcagggatgctgctggttcagagctgcttcctcctctctggggactggcctatgtcccaggggctcaaaagcatcaccaccttcatttatccttacaatgaaaccttgagggacacgactgtctacacttctaattggaaagccgtatctgattcattcaaatgttcagatcttcaaaaagtaaagtggcctagagtggaatcttaaagttgagagtatggactcagggagatgctgttcattagccaggataagagatgtggtttgaaagagctggacttccttttctcactttgcaattgacctgctgactaaacttgggctactcacttcttaacctcagtctgtcttgaatttcccctgtgcaaaaaaacatgggaagacaatatctaaatgcctctcagggatgttgtgaagaggacctcatcgatgttttaaaccacatggtcctaggaaggtgctatatattaccatcattaaaatcacctgtggttggctgcagccctccccccccgccacacacacaaacatttcttaccaaaaaaaaaaaagtaagaaattaattttcttcttatctgaagggatttcacaaaacttcctattaaagcattaacattctgaaaactgaattcaattcaatgtggcaagggtatgactgataaccaatcttaatcccaatctcttcttccttaaggagagaaagaattttacctgatggttaattaatcaaatatagtcgatgggatacatttagtcaataatattccattttagacttagtttagtcagagaagattagaaaaatggtgtcattgtgcattggttgaatgcttaagttttactagttatattacctcaagctggtaaaatatatatgggaagacaacattatggaaaaaaattattattatttgagaccgagtctcgctctgtcacccaggctcaagtacagtggtgtgatctcagctcactgcaacctccaccttccaggttcaagcgattcttctgccacagcttcctaagtaactgggactacaggtgtgcaccaccacacccagctaatttttgtgtttttagtacagacggggtttcaccatgttggccaggctggtcttgaacttccgacctcgagtgatctgcccgccttgacctcccaaagtgctgggattacaggcgtgagccaccatgcccggccaactttatggtaataaattaagacagtgaaagcgtgacttactcaagggctacatatataaaggtgacagatctgtatgtatctacttaaattcatgcccaacacagcacatgttgggcaagaatttgtgagctagctcagcttacaaatggcttagactaggggcatgtggcaaggggtatggggttctacttacagtttagggtcacaaaatagggcgatccaactctcccacttcacacaaagcctgcccccttctcctgcacatcttccataccaggtcctaatcaatcaacctaaccatctacagagtaagcagagtcattaacagtatgttctactctattaaaaccagacacatggccactaaacaaggttgatctaggacaaccattccattcagaatgttttcaccagtctatgccaaatgggaaaaatgagggaaagtaatgagttctttgaaagttaaattcattcaaaatttttaaaattgtgtaacttattccaaggttatgtccttactattttgtttttcatgttaaatgttcttattttaccagtgagagtaaataatagctgatttattaatatcccattctggcaaaataaaaagttagcatctctgtattggtctttaaaaaaaagaaatgaaaagcattgaaatccaaagtttggctagcactaccttagaatggcttacctgttgctaaaaactcacagagagacccatgcggctactgtgtcatgtgatcaaacatttataagacacaaagcctcatttcaatatgtaatgccaaaggacatcaagaaaaacgaatagacagtttcccaattcagagcaagcaaagtatgctgccatctaaaatcaaataaatgtagattctaaagtactaaacaaacagaaattatgctgtcatttttcaaatggtataaagtattttaattaaaacccagagggcatgcaaaggtataataatccaggagacagagtcacgataacactgtttattggttttcaactttcagatcctatcaatagaagctgtagacaaatatccattcttcgtctgaggacaaatgacagaggatttaaccattcagggaactgaaaagaacacggatggcatcaagcttggccctagctgacagaggctcagaggtagaagatgggagccgaaagagtgaatgctttcattttttaaatgagtaattaagtgatgctctctaaggtcaacagaatgagaaatgaggtttccaagaatttgtttgagaaataagcaatgtcctttaagtggagggacggagcatggagagggaagaggtctgagagaagacacagacgaggctgaatcagggagagaaaccccattgactataaaaggaaggcaataaactgagaaagagtagtgttatgggtcgaattatgtcccctcaaaagatatgttcaagtccccagtacctgtaaatgtgacttaatttggaaacacggtctttgtaaatgtaatcaagttaagaggaggtcgttagggtgggctctaacccaataggactgcgtccttataggcagaggaaaatgccatgtgaggagggacacacagggacacagagggcaagctaaggaccgatggcacttccaggagctggaagaggtggggggtggatccccctgagccttcagaacaagtgtggccatgctggcaccttgattacagacttccagccctcagaactatgagataataaatttctattgttttaagccacccagtttacggtattttgtcacagcagccctagaaaactagtacaaatggtactaccatatattatttaaagatatgaaggtagccacccaaagaactttcaacaaagctgggagggttcaaaggtgtttcctctggaaagtgggaccaaggaaggacaggacccaggcagggctgttattttttattaaaagccttctgtgttatttggctttttaaccacacagatgtcactctgatcatcttttaaaaagtataaaatatctatgtgatgttatcagaacaaaacctggccagctttcttcatagtggatgacaaactctgaggattgatagccacctcctccacttgttctctggcgttgccctccggtcccccagatccctatacacggtctccggcttcagggggagcagagccgagttgggagggcattggcctggacctcaaagtagcctaaatgtcttggcacgttttgttcacatgcctaccatctccatctcaaaatcaaacacaaattatttttggactttttacgggtttgcgtcatcgatgatggtgattttctctattgacttggatgattaagaaccgactaaagggaaaacagagaacagtggtgagcttgtcactggcttcctttgtagataaaaatgcaaaacaatgcctgacaaagatttcagtaattatgttacatatgatcagaaaacctcacaatagagcttcaccacaaacatttgttcatcacattttattgaacccataaaaagacattctaagtgctccccatggcccagatggaggatcttcgcactgtggtgcaggctgtgacttccctggccgtcagaagtcccatgccctttgctcactctaagaagaatgttcacattgagccctgcagcctgtaatgtggcaaaatgttgctgtcacctcccacatgaacagggctattgatgactgtgggggcctagtgcaaaggcaccagcccccatcacagaaagaaagcgggcagcgtgtaagtgtcccaagcatggccccgagagaaaagcagaatgcaaaaggcaaacgcagtttgcatgcacgcagggcttcgctgaggtctatttgtacccggctccccatggcagctggggagcaccttgccgttggttggcactgaagcagtgccaggtgggtgaaagctgaatgaaatgtctaacagctatcatatggatgaacacgcaggaagcagaacaaaggagcagcattttatcagcagcagaatcctgatggcagtcattgcccaaggggaaaccgtttgcttttattttcatcctggccttcagtttccctgggtaacaccttccagccatcccagtggttaccttacccacctacgtggttatcagacgtctagactcagccaggtgttttcccattccatattgcagggggcaaggtcacctcggaatggacttccaaaggcaggtgggaattacgccaatgagaaagcaagtcacaattcaaatactcgctgtatgtgggaatctatattgaacagaaagaataaaatgactccatttttattctgtgaactctcccttccagaccctcatacagaagagagtgtggatccatttaaggctgactacattcaattgcacacatctgctttctaattgtctcagttaccattctccacagctggccttttctccgtttttgcttttaaaacatcacctctcaacatattgtgaggaagaccaaacccttagactcagatgttccagaaacctgatctattagttgtgttttgaacacgtctggctacttttcatctgcttttttttttcttggtcacatgaacactgctgtaaacaaattctgtagtttgagttatgatatccatcagaaaagcctaacaacactgtagccttcactacaatgcataagcatgaaacacctaattttcctcattccatacatacacacacatgcatgcacatgtacacgcacacacacagcaatgtatcatttgaaaacggaggcatagttccctagcaacataaccaaaaacatggcaatatcttttggatctccaagttctggatttattatgtaaattgtttgaggctcatgattgaaggcttcaagatctcattttatcaaaaaagatcttagcagttactagtccatagaactttccctgacagcagggtacctctgcaaggagctgccctgtccatgagccaggcacgccctggtcagcaggggcggacgatagcacagacagcaaagggccaaccaggccagaacagtgccttaatccctaggaataaacataacccaacttcttaagggtcaggttcgttactaatgaggctctgcgttatgaaacaaactcacgagagaaaggtgatatctagccaattgattttaaaaatggaaaaaaaaaagtggcccatgtcttctcctattctcctggcagataacgggggtagatgaagtgggagaaataagaggaacaataactccttcaaaaagaagaaataaaatgaaaaagaaaaacaaacatgagctggatcaggaaaaaaaatagggcaaaacaagcagaaatgatctttagataagaacagtattacataaaacagcacccataatatgttaaagccactctgcagtacaaatcacttttccacaaagaattaaaagaagaagaacaaatacaaaaatcaattaaggtccagggaagggctccattccttctcgaggggctgcttcttatccaaacactggctgattcatgcaggtactgccaggctgcctcagagagggtattttttatttctgcttgactttgtccatagagtgattttcccattttagtttgcaaggaaaggttaagcaggaggagtagaatgttattccacttagaaaagaatccaacccatcccagggcctcaggctcagtgcttccctttggtgaactagttttccaagagccgacaactagctgcttggttgtgagtgacatgaaacactgcccttcctctcctggaggaagaaaccatcagcatccttccaactgctcccactgggaacaaggcagatggaagaagaccagcacgatgcttgatccatagggagcacgaactagatattcactgaaggagtaaggagcaagaaatagatctctgacccaaagtgataaaacaccaaagccaactgctcatttcattagctgcaagagagccatgcagggcagcctttcctcccataagacaactcagcgtggagttgttgaatgaataggaaaaagggagagctttgaaactcacatagaaataaaaacggtcttaggggataaaccatatttatattatactacctacgccatttaaggaatgtggttatacattttctgaaaaataaaatgtcctatcctgtcttaaaaaactgaatttgtataatattgggtttgcctaaagagtaaagcacatatactaattttcttttttgttgttattttttctttttttttttttattttgagacagaatctcgctctggagtgcagtggcatgatcccaggtcactgcaacctctacctcccaggttcaagcaattctcttgtctcagcttcccaagtagctgggaccagaggctcctgccaccatgcccagttaatgtttgtatttttagtagagacaatgtttccccatgttggccaggctggtctcgaactcctgacctcaagtgatctgcccgcctcggcctcccaaagtgctgggattacaggcatgagccactgcgcccagccaatttttttatatttttagtataggtggggtttcaccatgttgtccaggctggtcttgaactcctggcttcaagtgatccacctgcctcggcctcccacagtgctgggattacaggcgtgagtcactgtgcccagccacatatactaattttctttggagtaaaggcacaagtacattcattgtacaagtacagaatccaggaaaatcatcagaagagctttgacgtaaagagtatttgttacccatcagtagttggtagtgtggctgatcatctccttgaaatgtgcaaacgtgtgtggtaaaagtaaagaatcggaggtagggaacttataccaggctcacaactccacctcctgttcagagtaagtgctgggttgctgaccaaattaggtcttcttggacctccggagcagcccttctgcatttccaggaaggaggtggacaagtggctattttggtctgtctgtccatctggcttgtttgtggctggctagttcaccacccagctcatggtcaggctggaggattgggtacctttgctccgaccagtcagacatcccactatgacacaggccactcactgcagactagagggattcaacaggaaagtcccacggggtaagcaaataccaccactacccaaagtaaaattccaggctaggggtcagtggtgtcctcatcataggaaaaagggaaagtacatcagaatttgacagaggaacaagtaccaaactgctgtccccaaataaagaacttacatcaacaaggaatataaaaatgttatttaggacttctgttctcagatgtttaatacaaaggagagattgttgtgccagggaacaaagtgatccaatatccacaaagccagaattctcctactgcacattttgtttccaaaacactaaggaatacagcaagatttcaagttggagtaaagaagctacttctggaaacaagagaggagataactgaagactttcacagaggggctgaaatccttcccggaaaactgtgctcatcagggaacctcagcctagggggcagcgagggtggacggtgagctgacctatccccagacatgtggaataggtattgggtgtgcggggggtgcagtgcagaatgaaggctgggagttgttaaagctacagaatattctagtagcataccacgggaactcaggaacctcaaacgtttttcaaaaattaacgctttgggctcagagtttcaggcagtccagtgtaattttacttccactgggattgttgccagaaagaaacaagcagtgctccttgactacagatttttaaaacctgttttgttacatgcaggtgtgtgagatcctaaggagacttatttaattaagatgggggtgagggagcaggagggctgatgagtggcccttctcccttgaatggccaccacattggactgtattacagaacaaaaacccaaaagccctaaccagaaagacaactcaagggtgtcaatctgtttctcccgtttctagttcattacttttactcttcactggaagcagtcacatcattgcatcatcactctctcctttactggactgagcatttccagagggtaatgcaataggactgaggtgatggggctgggaaaccaggtcccctggatctaatcttggctccactgtacaatgggatcaatgtcaagttactcctcttcaactcagtatcctcacccatacaatcggaataatggggcctaccttctggactgctgcaaattttttttttagacggagtttcactctcatcacccaggctggagtgcaatagtgcaatctcagcttactgcaacctctgcttcccgggtttaagcgaatctcatttttgtatttttagcagagaccgggtttcaccatgttggccaggctggtcacgaacgtctgacctcaggtgatccacctgccttggcctcccaatgtgctgggattacaggcgtgagccaccacgcccagcctgctgcgaatcttaaatggaatagtatagtaaaacgctcagcatgcagatggccccgcctttgaatccgcggactgcaccttacccgtcttcacatcctccttcatatttgctcatagtagggcctcatattaaaattttttaaagaacaacaaaatgttttatttcctctagtttatttttttcctgataacatgctccctgcctgtgccctaaaccctctccctggcactggactggatgcttcagatcagttgtgattaacattttacacaccccctgtaaaactggacactagcactcaagcattattttaattaacggccagagagtggcaaaattaaatatgagatgacctacctcaatgctccactgtgtctcctacccctggaatttcaaggggcctttgttaaaagtgagtgtacaaaggaaacacaaacaggcaaaggagaggagaagggagcagcagagacagataaaagccaggaaatcacagcccgattccctgcactgtctccaaattactggtgtctttgaacagcttgcatgatattaaatatttttaagaagttacaatccatgacaataaaaactgtagtaaatattaacagaaactgacatcgtagaaatttttaaggggatcatccactaaagaaatacatgatttggaataattccttcctgtgtaatcaatgggaacgaagagatagccaagagatttgtggctcttccagtcaatatgacaccccaaacctcttacttctcctaacttctttggtcaaagatatttacagggcacccatgtggggagtacgctgtctcaagtcctctcgggatgaggcctctgtggcaaggggctgcagggggcccaaaggaaagaacacggactctcaccggtgacccatggaaagaaaccaagtgccaagatctggagaggcgccagggtcctcaagggactgggagaacagctgcgtggcaagtggagaagcacctgtggcactccaggtggctccagccagaactccaggcctctctgtcgccaatcaaaataaacagtgaagcaatcaaagtgagcactcgagtcccatcagcagagcaccacgctaaggtcttgctggcagcagagtttgggaaggggaagggccacaatggcaaggggaaagcaaaagaaagagaagaaagggcccttgttcttgtgcaattattattaaacttggagaaaataacacaataaaaacagctatcagtaatttaatacaggacgatttcctatattgtggtatgtgatcttcatagtcacctgtaaccctgggatatagatattactaacccattaaacatttcatccaagattaaagaaatagagatgaaaccagggcagttaggtcagtctgactccacagttggttttctcagcgattacactctatcacttctttctttgaaacaacctcacacacccatgcatgcacatagaagaggattttataatttaggcgtggggaaggtcagtcttaactatgactcaaaccccagaggctataaaagaaaaaaaactgataaatctgatttcatgaaaataaaaattttctgcatggggaaaaaacaccatcaacaaatgacaaaccagggacctatctggaacatagatcacagacaaaggatatatttctttaatatataggaaatgcctataaatcaatatgaaaagagccaacgaatactaaatcagctaataaagaaaatcaagatagttcataaacacattaaaagatgcataacgactcataacaagaaaaaagctggttaaaaatactagaagggtgaacatcaaaacattttattatataggcaagggtgaggctaagaaggaaggggcaatctcataaactactaatgagaaaataaatgagtacatccgttatgagggacaatctggcactatctatcaaaattataaatgcacctgccctttggccgcaaattccaattccaggattttatcctgcagatcaactcgtatgtgtgcaaaatgatgtctgtaggaagctaatctctgcggcactgattgtactagaaaatgtttgagaacaacctaaatatccaaaaaggagactgattaaataaactatggtatatccctacaatgggctattatgtagacacagaagagaagaggaagctcttaatatattgatatggaacaagccccaaggtatactgttaatcaaacaaagcaaattaaaaatctcaagcagaataggctatcataaatataaaagaaaatcacatagtgtctacatatatatttgtaaatatccctggaaagatacacagggcatgggtgacaggagctgcttttggggagaagtgggaggtaaagtgaggagggaggctcctgtcactgtatacactttgtattttttgaattttataatatgtgcttctattgtctattcaaaaaataaattgtatatataatttattatatattaaatatacagatgacaaacccggaaccaatttggaacataaatctctctctctctctctctctctctctctctctcacacacacacacacacacaaaaatatatatatttatactacatacaaatcaaaatcaggagccacacaaaggcagaagtagcttctggcccacaaggctgtgtgaccttgggcaagctgcttcaccactcaagcaaggtctcagcttcctcatccataaaatggggactggaatcctccctttctcctaaagtttggagaagtaaaggaaggaatatatgtaaagcctttaggtcagtgcctggcacacagtaaatttatgcaagtgtttgttaaataagtctactcggttggtcaaggaagacatctctgaaaagtgccctcaaagtcagattagaaagctcagtaggagttaggcaaggaggagagaagcaggggaaacagagagtgctcctcagaaggagtggcttgtgcaaaggtcaggaggtgaggagatgctcgcactgagggaagcctgggtgactggcacagagcctgggagggcaggggacagcacgatgcaaggccgaggaagtgagagcgtggatcagtcacgacagtttctctgggggtgctcagcaacccatggagcatttatacaggggcattccgtgcttgggtaggttttcctagaaaaatttctctggcaagagtcaggaggacaggttggagagaggcaaaaactgggtggcagagaggccagctggagattgttgcagcaactcaaggaggaaatgatgaggctgtgaactaaggcagtggcagcaggcaggggatggagtggggaagacacaaaggaggtgcagtcagctgggctgtttgacctagatggtggctagaggtgggacagaagaaagaattgaggataattaccagagttttgacctcatcagtttggaggactgtgatgcaactcactgagataagaagatcaagcaaaggaagtggcggagggagtaagatgatgggttaagtcccaaatttgttgaggttgaaacatcttataggtgatctgtagctagctacatgtgtctgaatttcagatgaaggacctgcagtaaatatatatccttgagaggtatcagctaagtttttaatactgaaagttctggactgtggttaagggagctgccaccaatggtccctctggtccacaaaggagactttggagaaggtatgctacctgtaatgcaggtaaatccctgctctctccctccttccctctgtctttctcttcctccctctctcccttcttccttccctttccttctctgtttttctcttctgtctttcttccttccttcctaaaaatataataaaagtctttacaagaggtttccttacatgcttcacgtgaagtaacccatctctgatcagtcccagctaatcagcggcgatgcctttattttctctaacattcctgcattccttttgcatctcttttcacgcatggcggaagccactagaaagctgtcactgttgtgtatgtgcgtctgcacaccaccgtgagtagcctgaagaccttatttttccaacaggggagtaatttacagcctaccaatgaaaaagagagggagggaacaccaagtgtatgcctcatgagtgctgtctagatgtttcttagaaagagcattctgtggttttctcttgtgctcactgtcttcagcaaaaccaacccccagttaaggatgacctaccacatggttttactaagagaccttagaactgatttctaaaagggcatacattcttccactacaaaaaaagtgtgtttaggcaagatttctggaacaatttagccaggtgaggtctggggccaagattcaaggatgccagctttgtaactcactcattcactcacttgctaacatgttcctaaccttgccccagcttcagtttttttcacttataaaattgagacgaactgctggaccatctccaaacctccttctggctctaaaattttgtgagtctagttctgagcaagggtttacattggtttcacgacagtgtggaatactttaacaattcaaaattgccattacacacttaaagcaacttcattttggaggtttgttgatttcatgactgggcaacagaaatattattcacaaactttgtggcaatgacaaatatatttatcccaaaggtaaatctctactattataattcagcagatggtcagttttcaaatttcatatttgccagacaagctttctttttatggcctgaaggaaacataggcagggactcacaggggagggaaaacagtacccaatccatgaaagtattaaatattacatattattattattattcggtctttttttctttttccattttttttttaaatacagagtctttctctgttgcccaggctggagtgcagtggtgtcatcatagctcactgcagcctcaaattcctgggctcaaatggtcttcctgagtcagcctcccaagtagctaggactataggtgcatacacaccaccatgatcggtaattttttaaaaaattctatagagatggggtctcactatgctgcccaggctggtctcaaactcctgggctcaattaatcctaccacatcggcctcccaaaatgctgagattataggtgtgacccaccatgctttggcccattggtctttagctatgtaaagtatggacttacagttttaaaatatgacatggaaagttcggtgtgccaagaaatgggcaatttattttcccacttgtagagattcatgagacttttgtgggacccaccaagaaatatggacaaggaaacctaacaaataacagactctcacctttctctgttgagggacgtgggatcatctagatgaattcagttattacattaaagaaatagtcattaaaatttgccacaagggattttcatctaaatctcaacccatagaaaaatatcaaggagaaagtggccatttttatctaaaagaactttgcttttttatcatgtcagtcacttggtgagttctccataatctgtgtgcttttggtaaaaagcaacatacatcagagtttaattgacttaaaatattgtatcttaaaagatatcatgtaatgtgcccttacaaatcaaaacttgatttgattagtttgaaatgtattattttgaaaaataatgtcagtcgaaattggatttcagcaatatgtttttggtaatcacatgaaggagaatgttaggtatcttccaacatttgcagcatatttactgttaataacacaccaatatagaaattagctatctaatttactagaaactaggtataatttcctagtgttttgagggggtagaaaggaaaatgcacaaacaggtttccacctttgaaatgtatatatatacatctaactacaaaaatttatcttttttcctttaaagtgctcattatactcaacatcactcaaaataagtgaaagggcaaattaaaccataagctgggatcattatttcacctactattttcacaagtatgaaaaaagctgacgagtattcatattgctagcagaattgttaactgttaacgtctatggagggcaatttgacaaaatcaatcgaaatgataaatgtacttactttcagctgcaacaattccatttctaggatctttttcctagagatatacaaaataatgtgatacagagctattcactgaatcactgttcatcctgggaaaaactggaaacagcccaaatgtctatcagtcaggaagtagttaataagtcatcatacagtagtataatgtagccttaacaaagaaagaagaagctcttaacctaccgataggcagtacattccaaaatgcatttaaaaggtatatgcagaacagcatatatgtttgccaccctctgcataaaaagagggaaagtatttacatatatatgtacctatgcatatatccatctatacacatatgtgtatacataaatacaaatatatgtacacacaagaccctgacaacatagattctgcggaaaggaaacccttttcccagaatagaagtctggggacaataggaggaggaggaaagaaatcactgcataccttttgggaccttttcaattttgaaccatgataacatgttacttattcagaaataagctaacaaatttgactaataaattgttcactgataagcagtaaatacatactcatatgtattatcatttaataagaacttgaagaattttttttttttgagacagtctggctctgtcgcccaggctggagtacggtggtgcgatctcagctcattttgacctccgcctctcaagagttcaagcaattcttgtgcctcagcctcctgagtagctggaactacaggcatgtggccaccacacctggctaatttttgtgttttttagtagagatggggtttcaccatgttggccagaatggtctcgaactcctggcctcaagtgatccacccacctcggccttccgaagtgctgagattacaagcatgagccactgcgcctggccaaagaaccatacttttaaaacaccaaaatagttaggccaagattgctcttttttaaagcaaaagagatatatagttaaagacatgaagaataaaaattaggcactcttcctctttcccagtctcttggaattcttataaaataataaattaaacctaacagtttggaggaaaaccaattaaagggacataaatcatcattaaccccttctccagatgaatgacaaagagacacgtgttctaattaacaccgagtaacattgtgtaaagagcagtttgcagtggaaatgaacagatggcaaacaagcaaaagaggtattggagagcaagaaagaaaacttgatctgatgctgaaaacttcaagcaactgaaagaaattatatctcaatgaaaatagctctaaaaggatggatgaactcgccgattcaactttagtttttaggtacatccagttttgctgctttcaatattcagcccccacaaggccaatactattccaatccccatcccactttctgtatttgcaaacaaagccacacaccaaccaaccaaccacctctttacaacagaaagattttctatccctaggcaatgaatggctcagttatttcaaaccaagctagcatttcagttcaacaaaaggttttggacatcatcttggggtctaatgtaacaagagctgacctggaggtttatgctttaacaaccatcccctttctttcctttgaaacagagatttatgacaggaggcagagaagggggcaagatcccagggttgatgaacccctggtatgaaccaccgtgcaggtacgtaagaagttcctccttctgcttcccccttgctcaaaggcaaactggagctaaagtcatggggaagcatagcaccacttcctcttgttttcaagttcatcctgtttttaggctctttttggtggaaacaagagtgccacaagcaatcaagtctcattagctgaaccctcagcaaagaaccagtgactgactccatatgcgggagacttcaacccagctgacagatgctatttctctctgtccctgctgacccaggctggggagacagcatatttcagacaggatgccctcccaagagttgtgatgcaaccctggaaaaaatatctgttcaagatcccaagccaggatctggtttctgccaattcagagtgacagggatcagcggctaagacactggccattacaggaggtatgttgaatttacacatatttaacaatagcagacacttaatattctcgtgtcttttattgtttaacctacatagagcattttaaattgtacattctgtagtgcataatggttggataaaaaacaaaaaacttcgggtaaacatccgagacaattcttgctctccatgtaaaaaaaacagaaatgttttttgtttgtttgatttttgaactccaaataaccactcaaagaaaaaagggagataattggccaatcaggttatctttagctatatcaacaacaacatttaaggctgagaattataagtacaaatgatttgtgtaatctgaatgttcagacttagactgacactttaactcatgtgtttagagaggaatatagagatacagatcataaatacacacacagcaggctgccgtatatattttatataaaacaggcagtttctactaaattacttgaggcattaggattcaaactcaattcccttctctatctgagacagcagactcctctggtctgaggatatttttaaatataaaagctaattatcctatctcactgcctataaattcaatttctatttctgaggctgcttctgttgtagatctcttggtagtccattcacattatagcttgtttacaacccagtctaaaatcacagcaaagacagagattgaaaaaaaaaaaaaagctttttaaccttttaggaagatttgataatgcagcaggattttcataatgatacagataatcaagtccattttctatgaaacaagagtttttaagtggcaaattttatagacaaaatgtagaaagtataaagtagactcatgagtggggctaacgccagggtcggaatgctttctcttggttaggtcttccagcaaaaccaatcaaccaatacacatggaaaatgcatcatacaaacttttcagatcagagctggggctttgccttgtgtcagccgacgaagaactcccaaggccgttctggattgaatctcagcgtagagatatgtaatatgccaccaactttcctcccttctaccggctcctttgaaagagagtccttcacaagcagttcaaggaaaaagcacattaacaatgacaatttacacttaccagctggggtggtgaaggttaaaggcaaaccaaagtaaactgacaatgataaagaacttaaaagcctatgctttaaaaaaaaatactcaaatctgtccttcgattgctaggtcggccgattagctgtacaacccttggcagtctcttgaactctttggacctcatttttcgtgtctatgaaatgagagagttgaacctagcgactttgaggttcctcccagttctaaccggtcatggtttatgatcaaaggctgtggctacacccctgaccacccacccctcacaaagcctcacgcctgactcctccctcttaaggctctgtctatactgcgttgtctgaacttcacaggtgatggtggcaaatgaaggtggcatgacatctttttgttgcttggtctttacaagcatctcagatcaaattaatattaaagagggaaatagacaaatgaaataagactactaagatgatattcttcacaaaggaataaaaacacatattcctcaaaaaggaggggaaaaccacttttggaaactctctggacatttttttccaagaagggacccagggagccatttttacattgtacttcctcaatcctcattcttgaagctctaaatcttcttgttttccatctcccttgagattaggaaggagggagagatattttttctctctatcctctgagttggccaaatctggatgactcctacatgcctctacggtaatttcctatgctatgctaatatctgggacttgctggtaaaccttaattaggtccatctaccatgggagtcaagcttttataaagatactctttttttttttttttttttttttgagatggagtcttgctctgtcacccaggctggaatgtagtggtgcaatcttggctcactgcaacctcctcctcttgggttcaagtgattctcctgtgcctcagcctcccgagtagtggggattacaggtgcccgctaccatgcccgggtaatttttgtatttttagtagagacagggtttcaccatgttggccaggctggtctcaaactcctgacttcaagtgatctgcccatcttggactcccaaagtgctgggattacaggcatgagccaccatatgcagccgattttataatgatactctaaataacacttttcctacactggatatgcacaaagatcaattggtgaacccttcccacccttgtttttgaagcaaacggaactgcagggcaacaagctttccttccacctgccgcggaggacctagtaaaaccccgggtgtggagtctgcagggatttctgcctccaaacccaccttcccccaaatgaagaagctttcaagcatttggttgaatccaagtattcggtgacctgatgggtaaatataaataaaagcttaatttttaaaaccaaaaattctgaatccagctatgcacacgctgtagagtatagtgctgctattacatttgggtcctacattcacgggcccaaacacctattgaccaacacatctaaggacagaaatagattctgccttcacagttttgtgtgtggcccctgcagaagtatttatttgaccactatggtatacatattcactcttttgctctaatatccttttatataaaaaaaaatcaaggccaggtgcagtggctcatgtctgtaatccctgtactttgggaggctgaggcaggaggattgcttgaggctgcagggagccagtcacgccactgcaccactccagcctgggtgacagagtcagaccctgtctcaaaaaaaaaaaaaagggaaataattttcgatcaaggtttatgtaacttgaagaccagtgagttactggagatcatgttaaataaggttagatttcatgaaaacacactcagcaacaacaatgcctttcactcctgccccaccttcactcaacaacagcaagttaaagtggctctccccttcctgtcctccccgggaccactaaaccaaacctctcagtggccaaaggatggaagagaacttggaatgggtgtttccattctggtgctaaatactacacagccgtgacccttttcttgagcacattttgagagtgccccgagtgtcacgaataatgagcttcatattgtcgaaaaataaaaataaaaaggacttgcttaagtagtttcatatgtaaactaacagagtagttattgtttgtaatttccagtttagggtttatccaattatctctctactgtctggaaggccaggcatgggggattccagttacaggaaaggcatctgccatggccaacccttgcaggccaagcaaaccctggcgcagactgcagcagatcccactggggtgcccacgtggtggagggggttacctaggaaaggaaggtctcctggcaaaataaccctagtgtgaggcttaacttactaatttcttctaaccactttgcaagaatctgttatttattgcaggaaaaggaatcaaaatgagctgggagtgtgtgtatggtgggaagggagtgatggttgaaacctgcttcaggtgacagccaacacctgttattgtaaagggtttagggcacaaaggacaccatggggtgcccccaccctactcctcattagagggaggcctctgatggatggtctaggtggctctggggtagaaagacagacttctgggtgagtctaagcttgagacagacagaggtcagcctggtacctctgcagctcactcttgggggccgagtccttgctaagtgacacagaaacctcagcctccccttcattatttttatgaatggcagatctctttaaaacctaggttgggtcacttcacttccctgatccaaactgtctgctggcttctcattacatgcaaacaaaacccaaaatgcttgaaaaagcatctggaaatccatgggggctgttctggtagtcacaggacaattgggagtcattagtggcatttaaggggtggggccagacaggctggacaacctgcagtacatgggatggtctagcacaagccacaaatattctatgtcccccaggactttccagtctcccctggaagggctgaaaagcctacgccattttacctgtcaacacaagggtttcctccatgattttcataaatgctggatttcaatagggaatgatgtactttgttttgtttagaactttactaacacgtattcaccatttcagaaatatcacatcactaaagtcaacaccgattatgtcatttgagtggccaatataacacatctgcagccatctggatttatagctgccacgtttgcagtgatcctacaagtgggtgcaaaacatatgaccacaccattatgtcttccagtgtagtcatgaaatacttcttagttcatgatacatttctccccttttgtacttcctttctattacagttaaggcattgtatggatggtttgtaatgatgtgggtagataggttatattttctacaaatttcatcattgaagagtgaaaagggtgttactaaatatctatcataagaagtgaggttttgggtctggccagggctgctttcctccatctcatttcccgccactttccctccctcccactgcaatacctctttctcccctgttggcatgcccagcctttgtcctggaccctccacctgccccctgtctgggagactcttctctcagagatccacagggctccttcgtcacttcccttcctctgtccctgactctcctttttcttcctatagaatttatcagagctcaacattacatcttctatttaataatttctcgactgtctctagtactagaattaagctctatgagagtgaggattttgtctatcttgttccccagcaccaagaacagtgcctgagacataaaaggcacttcttggccgggtgtggcggctcatgtctgtaatcccaatgctttgggagaccaaggaaggaaaatcactcaaggttaggcatttgagaccagcctggcgagaccctgtctctatataaaaaaaaaattgttaatgagccagtgcagggtctcatgactgtaatcccagtgccttgggaggctgaggcaggaggatcacttgcctgggtgacagagggagatcatgtccttttttttttttttttttaaggtatttattaaccttagtagatgactaaaggaagaaacacacatacaaaagtctggtcctaccaatgggcttagcttccccaggaaccaggaaattttactctcccacccctataaccactgttgcaaaatggctttctcttccactgaccaggtttctcatgcccaccctttgctaggtaaagagtagtaaaagagaaaatggccaatgaaaaggagggggaaacactttttaaaaataactatattttcaggacaggctctgtgtgagatacactctaacgtggggacacgccacagtcctcagtggcccctgcccatcctcccaactcactgtacagaaacactctatggaggccaatatttgattctagaagccagtgtccctcaacccaacttctgcaactccatacccaacaaatgatgctcaaaaacaaaagcagctattttaagatcactaaacactggctggtgatggcaaaactgtgtctttccttattcttttcttcatttttgcttttcatcaggccactgcccctcctacttccttaaaatgaattttactcagaaattatcaggaagaaatactattcaaatcaaaatctcagtagctatttttgtagatcttgataaacttactctaaaagtcacctggaagcccaaaaggccaaatacagtccagatacacttgaggaaaagaaaatgaggtgaaggtcatattctacaggatattgacaaagactctcctagatcaaactcaggtcgggctccccggagccttctcttccactagaccctgaccttgggcttccttttctgtcttatagaatccagtttaagcaagaatcctactagttttagtgaaaattctccacccttggtatctgtcctcacccctaactcttgatatcttatcaccctggcctgccttcagcaagaattctgttgagttggtctagcaagaatacccctgtctctgatgtttcctcttccatccactgaccccaccctgctgcttgactataaatcccctcttgtccttgtagaagttggactccagcccaatctctctcctcaccacagcaagacctcgttgcagcagtccctctacctatcacaatgttcccctccttgaataaagtcttctctgccatttttaacaaatgttacaaatatttttccttaacaataccaagacttatagagctataagtaagacagtgtggcattggcacaagtgtaggaaacagaccagtggaaaagaatagacagactcataaacagacccacacatatacagacacctaagttttgaaaaacctaacactacagcgcattagaaaaaaagatgtcttcccccagtaaatgtggctgagttgattggatatccatgtgggaaaaaaaggaaacacgcccctcccaaattcacagcattcatataactcaattccaggtgcattatgtagatataaatataaaagacaaatgatacaacttttagaagttaacataagagaaaatcttcatgactttgggataggcaacattgtcaaacaagacacaacaagtgccaaccatgaaggaaaagagtgataaatgaggttacatcaaaattaagaaattcttttcatcaaaagattctgttttgagactaaaaagacaagtcacaaaatggaagaatatatttgcaacacacaaaattaatgaaggatgcatagccagaagctgcaaagaactcctacaaattcataagaaatagaaaacagttgaaaaatggacaagagacttgcataggcacgttctaaaagaaaataagcatatgaaaagattattagtaataagtaatcagggaaatgcaaattaaacccacaatgtgatactcctgtgaacatgccagaatggctaaaattaaagagactgacagttctaagtttggagagtatacaaaacaacaggaactctcatacatggcattacatctacaacaatttcactatttggtgtgttcccaatagaaatatatgcacaaggcaccaaagaacaggtacaataatgttcacagcagcattatatatcataacaaaaacaacaggatgaataaatacagtgggtgaactttcacaataaaatacaacaaggaaaatgaacaaactttagcttcatgaaatctcacaaacgtaactatgagcaaatgaagcccaaaacacaaactacatacactacaatttcatctacatgaagttaaataacaagcacaactaatttatatcatttagggtgacatacttaggtggtaaatgtgtaaggaaagtaaggaattggctaccataaaacttaacataatttctacctttggtggaagatacagggctatgattgtcaggggacatggccttatgggggctggcaatgccctgtttcttttacctgcatgatggctacaaagtgtttactttaaaatagcccaatgggatatacatttatattttatttacattttggtatatttattatacttctaaataaaagattttttaaatgaaggaaaatcataaatcaaaaagatagaagagtatccatgccaaactgcatgagatcataggctttggagtgagacatacctgtgatccaatcctacccctgccactgactaattgtatgaccttgaatgagttatttaaactttcaaagcctcagtttccgtatctattaaatgaaggtgataatatctatttctcagggttgtaaaatgaattaagatcctatatataaagcacctagtagaacatctggcatactgtaagcctcaagaaatggtagcattgcaaattgtatatctgataacggattaacgtccagaatatgtaaagaacgcctacaactcaataacaacaaaacaacctgattttaaaaaatcaacaaagaacttgaacagacatttctctaaaaacaagataaatgaatggccaatccgcacataagaaagatgctcaacatcattaatcactaggaagatccaaatcaaaaccacaataagttaaccacttcacactcatgaagagggccatcttgaaaaaccagaaaataagaaatatcggtcaggaattagagcagctggaacccttgtacactgctggtagaaatgtaaaatggtgcagcttctatggaaaacagtatgatggttcctcaaaaaattaaaaatagaattacaataggatccagaaatgccacttctggaagtggaatttcaaaagaattgaaagcaggcactcaaacagatatgtgtacataccgttcatagcagcattattcacattagtccaaaaggggaagcagctcaagtatccatcaataaatgaacggagaaacaatatgtagtagatccattcaatggaatatcattcagccttcaaaatgaaggaagctgtgacacaggccaaaacatggatgaaccttgaagacatcatgcttagtgtaacaagccagtcacaagtgtgagtccacttatgcgaggtacctagagtagtcaagttcatagaggcaggcagtagtatggtggttgccaaggctgcaggcgtgggggaacaggcattactgttgaacagatcctgagtttctgtctgagaagaaaaaaataatctggtgataaatggtggtgatggatgcatgacattgtgaagaaacttcatgccactaagctgtacactgaaaaacggttaacatgataaattttatgttacatacattttaccacaatttaaaaaaattattaaaaaatactaacaataggccaagcgtgatggctcacacctgtaatcccagcactttgggaggctgagacaggtggatcaattgagctcaggagtttgagaccagcctgggtaacacagtgagacccctgtctctacaaaaaaatacaaaaattagttgggcatggtggcacgtgcctgtagtctcagctacttgcagggctgaggcaggaggagttcttgagcccagaaggttaaggctgcagtgagccatgttcatgccactgcacttcactctgagtgacaaattgagaccttgtctcagaaagaaagaaagaaagaaagaaagaaagaaagaaagaaagaaagaaagaaagaaagaaagaaagaaagaaaaagagagaggaaagaaagagaaaaagaaaagaaatagtagcaactgttattgtaagacatctccacacaccagagaagttaattttaattttaacatgttaagaacagagagaagccaacatgtccaccttaggctgacggtttgtttatttgtgttgttgctggtagtcgggtttgttatttttaaagtagcttatccaatacttcattaacaatttcagtaagttatttcatctttcaacataaatacgcacaaggatttcttctggtcaagaccaaactaatattagtccatagtaggagctaatactatcacatttactaagtattctatttgcaatttgactgtagcccatagccttttgtcggctaaagtgagcttaatgctgatcaggtaaattaaaaattatagttaattaaaagggcataaatgttacctgactcaataagtcatttcaattaggtctgttatcacaagttcttgacacatgtaattaagaaagctaagctacaggtcactctttgatgatgtttaagctgcagttctgattatcttcaaactgcgattccaatccagagttgtaactagcagttatttctctcatggaccaaaagatcagaattttccctggaagtttatcagaaatgctttcaagtttcaaaatacttgcctgaagtatcctatagtggccttgaaaacgatctgtccaaatacccagtttaacccatggtttaagaaataaagaaagttgacttcatttatttgtcttttttccctcctaaatggcagtttgatttgtaaagcacggcaatggaatgaaaatcttattttcaaggtcagctttaacaagcattcaatatctcaaatgccattacacattttacttactcaaaacaccaaaaagtcatcaacacgaccctcccaaaatctactaatgacttctgtgaaaggcactgaatctttgtaattagacaaagtaagatcatgtatgtcaaaatataggccctggttcacagaaaatgcttaataaatagcagtaaatatatatagatatatatatcataatagcacaagttgaatgtgcagggtccatgtaagctaaatttattatcccattttagctgaacagattttagaacattcagtgattccattccattttgtaaattactgatctgtaccaattcaaaaattcttctgaaactcaattcccaggcatttggcttttgttcctgggatttccactgctttagagaatccagctttaatgggcttctttctgagaaattctccattggttctgagaagtacttctattgaatgctccatttaatttcattttgcaattaatgaaactttcaagacctatttcccctcttttgaaaaatttctagttatttttttcttgccttttgggtaattaggagcagcaaactacttccactaagaactaaaggcagtaagtatggcaacaaaaataccaaatgtcaaaacaaatgtcattttccgagttctgaaacgcccatctctcagaattaaaaacattccatgtcacctctacgggtctttggttgctagctctcaaatggattcacgttctgatttcagtaaaattcaaccaaaagcttttagggtttttaatcttccttgacaaaaatacttaaccttctccagcctgggaggtaccgtcttttcctgcctgtgaaactctaccagtttggtaataaaacaaaccactaatttagttgtttattattcttagcctaaagatgtttgcgtggctagctgagtacaaatgtactgtatctgcgcttcttctttttaaagttttaaacaaataatcactgaacaaaatcagccaggaatgatcttctgctcatgggaaccgtatcccaacccagaaccacacgcagaagagtgcagggcctcgaggtctgttatctcaccaaataactttccctatgtggtgaaaaactggttaaatcacttttccagcgatcccggaattttcagttcaattctatccctcctaagtcaccagggcctctttggtaatggatgaaaccatgaagtttggttcagaggaagcaaagacacattcaaatgtgagactcaactgctccccgaggattcttcctgcttcctagttttaggtagatcaagagcacttttaaaataaacttggcgtttgtttcctattccaatggaaaatctgactggagactccacagcgacagcaaagaacccttacttttctggacaatcaaaatccggcttttgtcactctaactgcagcaggtcagcacacagggtaccagtgtgtccctgagcgcgctgacgaatggatatggtgctggcagccttggcctgggggcacttctgaggagctttaaaaaatactaattcctgggttcccctctccagcccagatatttttattaaattggtctgagatgtggcctgggtggcaggatttataacacttcctggatgatgttaatggaagccctttgaggtagaagaaggtagacaggactgactgggagcgcatcatcaaccacctctgcctccccactaagaagtctaagaataccccaaaataggggtgcagtggttgaggagaaaagagaggaagtcacgtatacttttgcaggctttcatgcaaggacccaagtgtgtgtgctaagcacagtccccaaacaggggaccccagaagtcctattcctaagatctgaattgcaccaaaggtagagagactcttcctggggttatttgaaacaaggcagactttgcctggcatgtatgcgccagacccagcctctgcagtgcttatgtggcaatgcttaagcagctcccagcactcgacagggtactttaaacaacttcattagtttgaaattttaaatccaaaaaaagctaccttcaaatgtatgactcaagagcataaaatttcagagcagagaacaccgccaggctagtaggtgaagcatcttatttttaaatggcaagggggaaccttgagtaaatatttggttgcaatgtattccaggggtggggggtttggacggagaggaaccactggtttttattcaaaatcctcctcccgctgggcccaggtcaggcctacacagctctggctacagactgtgagaatcctggaaggctccaggggctggctcccaccatgctccactccagcaagggcagacgccaggaaaaaaatggaaagggggagtcaggcatggaaggtttcagacttgctgcaggcaaaaggctgcagagcatccccagggagcagagacctcacaaccaggctccctacctcgctgtccttcagggccgcccacagctggctcacctgcagctgcaccacccaagagacagagacaggctcacacgcagcagctggagagaaggggctggaataaggattctttctaaacggaaaaataaagatcactgggggaacttctcgcccatccagcagtttgtgtgtactcagctcccctggcagggaatgagggcccgttgttccctgctgaagaccattgccctggagatgggatgggtgggaagaaaaatgtcagtaggggctctgtccttgctaccttctctctctggctgacctctggaattctctttctggctgacctctgaaactgagttctgggaacggaaggggaccttgtgatgctcccaacatctccccaagaatgcacgcccttagttggagctgtagctaggtaaggagtcagctgcaaactgcaccctccccacaatcttgtgacaggggaacatatgcaaatatgagatgggtcactgccggggaggtactggatgggggatgtgttcaggaggcttctgccagccatggactgaacatatgtcagccatgtggtacggttcttacacaaaaacagaatcctgagtttggtttcacaaacaggctcatctctcatctctgagtgtgtagcgggagagggtgcaccgtttccatgcagggcaaatctgtctgcatggggctgggggttctgcatctcagcatgggtttggaaagtactagaagtgcatctcactcaacttgatttagcaagcatgtctttgtggtccatggcttgtgttggcaacttaaatttgacagcacacaaactatgtgatggtgatggaggggcaggtatagcaacgtccagtttcccacctccaggtagtggcattctccctgtcctttctgcaacagcagcctgggaggttttcaatgcccttacttctcctgggtatatctgaactatgtcctgctcttatacacataaaagggtcacttgaggagctttggccatatggcagctgtttggaaacaggctgcctgatgcattgacaaccacaagaaatctggaagagtaaaacctgccccatagctggcatgctacttgtacattaaaatgagagcataatgtaaaagaaatgccttaacacttccttcactaggttcaaacttgctgtgattatttaggaattcatttcatttaaccaaatatgaattgagcaccttttacacagttgggggcaggggtgtccaaacagacatgaataattatgatacaaaacctattgtatatatacacagaaaatggatgtagacacaaaatgaataaacatgaaatgaatgtagacaaaggataggttaattttcattgaaggggaggcaggagggttcaacaaaggagttgaacgtagctgggacgtaagattagggcaggagtaggggcgaggattgggagcagaaagtaaggaggacagagaactttaatgggaggtagactggaaagtgggctggtgccagccctgaaggtcagctgtacaccaaactctgtagcttggtatacaatgacctctgagccaaccttcagggctggcattctgaaggtcattgaaggggaggtaggaggatttggtttgcggcagtttccaggtgagaggcaagaagtaaggagagaaggcagagatggcacaggatggtgggaagggagtccttggtgcccaatctctgccaggcagggtcctatcttgctaccccatgatccccacatgatgattgcatggagcagatgtcattatccccattgcagatctgggtctcctgggtccctcctcaaaataagacccattcaaaagacacctcctacaacacgggtctgaactacaggtctcccgaggccactatggaaggatactggcactcattcaacagcaaaactgtcccaaaacatcttctgtagacatctgtccctctccagcgttttgcttcttgtggcagttgttctcttttctccgtctctcacttctctctctactacccccttcttggatcccttttctcacaagagctctaggccaccatttcttactcagagtgacttcctgcttctctgatctgcccatcagttgccccagttagcaagatgaagggtcctcctcaggaaccaacctccttagaaagtattagaattctgtatgctccttattttatactctggctgggtcacattctaacaaggaaactgaagcttggagaaactaagtgtttctcaaggtgctcaacagagatgttttaggaagataaatggcattgacgaagaggatggatgggctgggaacaggtgctgaaagagaaggataccaatctatgacattttggaaaatacaaaactctagggatatagaagagaagagaagttgccagggctaagggttagggggtggcgggcagtttgagtacaaactctcatcatgaaatatgtttggggggtgactgacctgttctgtatactgattagagtagtggttacctctctgttcatttatcaaaacccacaaagctacacaaaaatgatgaattttactgtaggtaaacttaagaataatttttgaaatgacaggaagactggctaggaggttacagcatatgcaagaaggaatgagaggttgaattagagcagcagcagcagcaggataaaaaaataataaaataattttaaaaacctaaaaaccagagatctagggaagagagacttttagaagcaggattcagatatgtggggagtatgagtgaagaactcagatatgcagactttcagggctggaaagaatcttaagagatgatccaggaaagctctatctcacagatgagaaaaccaagttgaaaatgatttaagagtttggggctctgtctgggtggacagtgatatcattaagcagacagaacagacatagatgagcaggcgagaggaggaagttgatgagttcattttggacattttgattttggaacatttatgtcaccaagatttctttttttagtttttaggaatttgaaaacaaaattgttgggttttggcattgagtgcaatatctttccacaaatactgtttcattacagctacaatgaaaaagaactttgaatacagatccctacatgaagatgacacattagcttcttctgagttgtttttgttttgtgactttccttcagcatcacaaagagggaatgacactgacccagcaaagattttaggcacattatccattaacatacttgccacgaacactaccatattttcatgtgtttatataacaaagcttttccttccttattaaaaacaatacaaatcaagctttgaaaagcagttgttttccattcttactgatgctaggctataattcactgctgttttgttttcgttttagaatatttagcaagcaaccaagggaagatgggcattgacttgctattagtcagtaggcacagcctagtgaaagtttccatgctgcacatagggctgaaatcaaggagtcttttgtccatatttcagagcaacttggaaaatgatttggttcagcagtcaaggggagaaaagaagtagagttttcaacaccatcacagccattgggatatgcaaccaattttaagaatcagaaactcaagttgcaaactaccaagaaagcataatgttcttggcagcaaagtttaatcacagaagaacaacataaatataaagctaatagtatttacaataactgtctactgtttctttaagagctgagtaaagtgaatgcaaagatggtgagtctaaggaagaatctagaatgctggcacatttaggcagggatcttgttttgcttgctgataaacctacatgcgtagcacagtgcctggcacataataggctctcaatatgtaattgttgaatgaatgaatgaatgaagctaggagagaagtgaacaagtaaagtaagagatagcaaagccaccatacttcattcatccattcagcaaatgttactgagctcttactaatgtgaggcctttttttaaggcatggtggtggatatacacaagcctaaaataacaacttagaaaacagccccgggcctcaacatgtttataacctggaagaggaagaaggaaaagtatagcaaacatttgtatatcaaagtaatatcaaagagcatgtgacaaggcctggaaaaatggcacaaaaaaaaagaaaaaggctgaaaaggtggtaaagatttagaaatcagcggggtcactcccaacagggatactgtcatcctgaaggtgagatcagatctgggccttaagggatggagaattctgatgggaacagaatactctgggatgtaaaaacagcaggaaaaagatccccagaacagagaaggcagggcgggttcagagcatagcaatcttgctaaggagtagcagggaatgatgaagaaaatgtcacataggttgcagtgaaagatggagagaggaatttgaacagctggataaaggaaaatgaagacttacctaggaaaagaggagccttaaaataaaaaaaagggtggctcatgcctataaccccagccctcgaggaggccaaggcaggtggatcacttgaggtcaggagttcaagaccagcctggccaacatggtgaaaccccgcctctactaaaaatacaaaaattagccaggcatggtggtgcatgcctgtaatcctagctacttgaaaggctgaggcaggagaatcacttgagcctgggaggcggaggttgcagtgagccaagatggtcccactgtactccagctgggtgacagagcgagactccacctcaagaagaaaaacaatcagggaagaattttaattaaatcatcacaaagtataagataaactggagtgcggagaaactggagcaggtgaatgaattcccctagggaagagttaagaaggtggtggcagcaagaccagtgagggaggaatggagggcagtgaaggatgctgggctcaaaaacctgagcagaagctggaagaatgcaccctaggttttgagcctgggtgatcggaatagtgatgagagcaggaagagaaactgttgagtccaaggaaggttttggagggatgacgatgagtttagtcttggattaaatattttgattatgtgtttaatttgaactgccaacaggaagtccagatagaaagggtcatcaggaaatagtatataagcagaactggaatttgcagaaatacccatttgagaatcagctgcatacagacgatacggaagctgtggggatgaaaaaggtcccgcacaagagaatcaggaaaaaaaaagtgagacaatgagtcaagacagacagtattaaaggaacttcccaaccatttgctcaatgtaaaaatggaaatgaggcgaggtttgttcccttagaacatgtttttcacagcaaaagagaattcattcctaaaactggtttttatctcgagctaaagaaaacaccttaacactccattcatagtaaggaccatcacagtaatcctgtgtgacaaagctcaggataaatgccatggcaggaatttcacttgaatgagatagcaggatggaaggaaggaaacaggagcccttgctttggagagatcacctttcatgggctcagttcaggcttcactcagcaggaaaaaaatctgcaaggcttaaataagtacttctatttggtagaaggcaatggaaaagaataacctaattcatttaatctgcagttgccacagatacaaaaacaagagaagatatgaacactgtgtgggccgaatgtttctttcctactcccaccctcatcccactcggccctctttcccaggtcattatcaacatatttcaaaagcctccgagatggtgataaagcggctcaccatctgtgaactcctcctccacagaagagtgataggtctcaagaacaaaccttcctaccttagcatggaacaaaagcctgacttcaacacccggcacccacagctgttttccacgaatagaaagaacacagccaacccaactggctctttgaaggtacgccatccttttcctgtggcctaatttatgctgcagattgaaaagtgcaaaaaagcaaaaaatggataaggttttcacaagagttacttagtagatgctgattttcttccaatatcaaatgcttgaggcgcatatgattggcttccatttctctgtatttgtcgaaagaatctctaaattgttccccaaatgaattattattttgactggggacactgaagttcacggttatttttaaaaactacattttgcaaaaagttatcactcttcttaccaaagattcacaatacagtgttgatgggaacgtgacctagttggacagctaccttcagatatgcctgatgcccttcaacaggtcatcatttgcactagaaaccaatactcatcaagtgtcaacaggtccacagccccgtcctgaatcattcagaggaagttaaatacaagagtttgcaatttaaaccaaagtgtaccatcccaatctgtaaaagactcgggaacacatgaaagagtacaaagataaagcaaatagccttgagttacttagtttagttggaactatttttgtcacactatcaaccgaggccctggagtactcatgagtatttctttttttttttttctcaataaagcgggaaaaaatgctgaaagaattttttagatgtattcctttcttgtgttggaaagataatcttactgaaacaggaatggaatctagcttatgtctctctttcctattcttagaatcctaaacaaagaaatgaatgtctacaaggtggtttggggaaacagttagaagattcccatgggaagcaagttaaattgagagtccaagaagactagaaaccactttatatcagtgctgggctcacaggagagctaggtgataggagaaagggccagtgatgtggacagatcatgatagtgacagtgaagagagtccaggtaagacctaacgaatgacttaatagatcaactggagtggttttagtggataggtttgcatgtttctaacgacacagaaacctacaaaatagttcactggttttcagaaaaatactggaaggattcatcacaaactcctagccccagccaaccccagtgcaaaaaaaaaaaaaaaaaaaaatcatgcccaatccttcaaaagattcatatgtgcagggttattactctagacatcagcttgcctgggaccatcctggcctaccctattgtcccagaataatgattaataacaagtgtctcagcttggatgagacatgttatgatcatcttagatatgaaagaatggcaatctaataggttaatgaatatcaagacaaaatacctttagaaaggctttcctttctaattgtggttccagactttatacagcgcactcacacgtaccatgctagctgggatctgcactctggtaatagaaagggggggcttgcgcacagaaggaaatgggttcatgttggcaccacccaggtgctcagcaaatggacagcaaataaaccgtcgttgaagaaaggcaatgaaagaaccctcttcaccaatgtcttgaatgaatggttcttcagccatgacacatcgtactgaggaatggcttaacagttctccttgattctgggagtgaaataagtatgggggtaaagagcatcaggaagactcccactgcaggaaaccctgtgaagaaagtgctgaagaaagcgctctcccaccacgcattagggaaggagctcaggagctctctgccaactgcagtaggcacgggcccagagacagaagatttctgtggtctgggcacccttcctgctgctgcaggtgatgagtaataatagcgacggctctcatgtcacaacctggtggccgctggaccctcactttggttggagggtgtgtccccacaggggaagttcacaagagccaagctgggctctgagcttcatgcaacgtgcaagatgtgcaccaagacgacctcacccctggctggactcagccccgggacaacactcccaccccgcagagcccagccaggttctcagtggccccaagatagcacacaagcagctgggatgggaaaacaaggtttagtaatatgaaaccaaaatactcctccagcctgactgcactgcccaggatgaaattctctctaattccactgaacatcttaaaccaaaacatattcaaaccctgaacatcagcagcactcgtacttctcttttttggggctgtgaagggagggtggagtgctgcaacagaataacaattttcagcataggaaaatccccaatatgcaggttgtcacctgcttgatctattttcctcccaaccaagttaagcaatcaccaacagttctctatgagatatcttccactgagattaaaggaacgaccagcaagaaacagtgtatgtgttgtggtagtgtgagtgtgggttttcaaatgggtacattcctagaagacgggacagcaggctctgaggaggcagctttgtggaagagactggggtgtccagaggaccttggatatctggaatactcacatatggtgcttgttctggggctggggggagacaagtacatatagaaatatcataaccagttttctccagtaaatacaccaaaacaaaggaaaatgggatcaaagtatagccagcaacgtgaaaagtcccatttcaaaatctaaagtaagattccaaaatagaacatgttttaacagagtatgtaaatttatggaaacacttcctcacccggctcctgatcttttataggtacctctcatgcaacagttcagctttaaatcttttttaggaagcagctggctaccagagatcttcactcctgtgctttttttctctttttttttttgcaaatctagcatctcctttccatgtgatgcactatgcttggagctggcagagcaaaagcctgtcattcttaaaacatgaagagaataattcagcgccttattttgtgatcacagagaatgcaattaatactttggctgccttggtatgtagaccaaaccttctgccacagtgttttgcagtgctgttgtccagggcagctctgccaatcttttcattccaacagaaacgatgccagacttctcggtgctaagcaaagtataatgaggcggaagaggtggctggaaccctcagtgagggaatgtgctcctgggatgattctctacaaaatacaaagctatctcaagatccaatagcttttgtatccctgcatttacgaaacccaattaaaataaattctttaaaaagaaaaagtaggctgggcagggtggctcacacctgtaatccctgcactttgggaggccgaggccggtagatcatttgcggtcaggaattcaagactagcctgaccaacatggtgaaaccctgtctctactaaaaatacaaaaaattagctgggtgtggtggcacacacctgtagttccagctactcaggaggctgaggcaggagaatcacttgaacccgggaggctgaggttgcagtgagccaagatcacaccactgcactccagcctgggcgacagagtgagaatccgcctcaaaagaaaagaaaaaaaaaagtagttaaattcttatgtcattcatccatggtccaaaagctttttaattcatagaaggtataagacagggaaaatccttctaaaccgagaacatgcagtgatttactaaatcatatgagcaatgttggagaattactatctgtgtaacactagactctgaagataggagataagaaataattataatttggctgagttcggtggcttacacctgtaatcccagaactttgggaggccaaggtgggtggatcacgaggtcaagaccagcctggccaagacggtgaaacccccatctctactgaaaataccaaaaaaaaaaaaaaaaattagccaggcatggtggcgagtgcctatagtcccagctactcaggaggctggggcagagaactgcttgaacctgggaggcagaggttgcagtgagccgagattgtgccactgcattccagcctgggagacagagcgagactccatctcaaaaaaagataataatagtaataattattattattattataattcatagaaagtgtagggacaaggagaacagagagaaccaagaaagacaagtaggtataaatgtttttagatattatactacaatatgtatgtattggctatagttgcaaagaaatcctagacccaacttgtgtctgtcaagggccaagtgaatggtccaggccaatgatctcatttgccatagacctcagtgcccccagcacatcagacagcagaaagagcagcagtgagaagcaaaacctttataccatcattgatagcttattaatacaattcttgctgattctctggccttcgaaactcatagaatcacaaaatgttagtgagggaccctgtaactcaacttccccatttgcagatgaagaaatgaaagctcagaagagtatatgacatgcccaaacagcaagtgcctggcgggtcagaagaatacaacccaaggcccgttgccctaaatgtcctcaacaactacacagctctcacccatatccacctcctcttcttgatcaattctctcttcttccttagaactgcacctccccaacctttttcctaagccatccccaatgctgggtgactacctgggttggatcccttgcctctttggtccagggtacctgccttgtccttccatccctcaaggactaaacccagtctcaggattttctgacaggtgggatccaccaaccttgctccacgctgccaggaattttccctaacagtagttgactcccaacagaagaaaacgccccctggttgtgaccacatgcttgtctcaccctgaccctgcccttccccaatgggcctcaaaattcagcaagtcttacctttacactgaatatccactataggctttgattactgtgttttattagccagctgcagagcatgtttgtgtgtatttacatacacatgcacacagaaatacttctaagtgggctgtgttctatcatctttggtacagaaataaaagtaaatatttccatgcataaattttagtgtatttttaatagacactagaatagaagtcgaaagttctatttccaaccttcccaacccagctgtaatggtccagcctggcaagagttagaaactactgaagtccttttttttgagacaaggtctcactctgtcatccaggctggagtggagtggcacaatcatggctcactgcagcctcaacctcccatctcagcctcaagggatcctcccatctcagcctcccaagcagctgaaactacaggcacacgccaccatgattggcttaattgttttgtgttttgtagaggcagggttttgctaagttgctcaagctagtcttgaacacctgggctcaagtgatcctccagcctcggtctcccacagtgcggggattacaggcatgagccaccacgtccacccagaaactactgaagttttattcttggcttaactcttagggcaggctggcaacagtgacctcttacacttcagtatgctcacctgtaaaagtatggtgaggccttccctgcccagctcagcagactgacaatgggagccacaagaacatgaatatgaatgaactttaaaaagggctacacaactgtagctcattgaagaaaaaaggaaaggtctttctatcctcctatatagtaatatccaactatgggaataaaaaggtgaccacattgtgcaataaatggttagcagtctagaccagtgctgtccaatagaaatataatgggaaccggccccgcacggtggctcacgcctgtaatcccagcactttgggaggccgaggcgggcggaccacgagttcaggagattgagaccatcttggttaacacggtgaaaccctgtctctactaaaaatacaaaaaatttagctggggatggtggcgggcgcctgtagtcccagctgcttgggaggctgaggcaggagaatggcatgaaccctggaggcggaggttgcagtgagccaagatcacgccactgcactccagcctgggcgacacagcgaaactctgtctcaaaaaaaaaagaaagaaagaaatataatgggaaccacatatgtaattttaaatttttagtggtcacgtttagtatattttattaaactaatacatccaaaatactatcacttcaacacaaaattcttataaaaattattgataaaatattttgcattcatttattcatactacatctttgaaatccagtaaacctggtgtgtattttacactccaatcgcatctcaattcagattggccacattacgtgagcctggtagccacagccacggcactggagagggcaggagtagattttagacacaatgttatggtgtcacaccttggtggcacagagcagccttttctcagtgcctagcacagtgccttttagtgactaaatgcccaatcaagatgtgtaggatgagtaaatgtttggatatatactgtgatcgcagaaaatctgtagaataagaggaagaataaaggactttttgaaaaagcattagtctgtgttgaccttttcctgttcccaaaacacagaagtcttggctcgcagactgccaaagggaaagccgctgctcataatgaaattccaggcgtggcatcggctgatggggtgagccattccttcgcaagccacctttaacctgcctctctgtggacttgcctggcctctcaagtggctgcttctaaaagcccaggaacactgctgaaaacagatgagcacgtgtccctgggatccgtattcctgtgaaatcatttgcattctattaggcaaatttgcataaaattggagccaagagagcttggctgggtttccaggccggcactctctctctgtgctgctatggccaccagtatttatcaccatttaccagggtggtcgagcaagacagacccccaattagaatcggcagacaaatggaatctcttccctatgctgacatgaaaatcagtgtcctctggggtaaatgagtgaaggaactccgagctgcaatctggctgccgcatcctttgttatgacaagagtttattttacacgactctgacctatggcttgaaaacacagctcagtcgtggttgtaatgatccagaacggcacacacacctgaatgccaaggagctcagattctggcccatgggccatctgggaaaccaaactcaccacccttcattccagaaagccaagggcttcgactcctaaagcaaggtttaccctcaagggcctctcctccttttagctagctatgttgatggcaagctccaggcaaggtgcaaatagctacctctaaatgcacacactcatccctttctttgggacaaaggacaaaagtcaaatcacagtgatgcccaacctacccatggccaagggaacaaggtaaattacacaacagagaaggacaaaggtggaaggaaaaatacacagaaaacaatgcaatgctattttatattttgttatttttatctcaactacctatctctttctaggactattccccagagaaattccattttcattacaaaactagtttcttatgccagggaaaaggctgcggagctgttatcattgccattgttatttctactaaggtcatctcagatggcatgtctacgtgagataaatggtttcctaaacaggcttctctgcatcctgccaccacttaggtttgccccgagtcatcacttctggggccttgaaagcagcagcttcctggaaggctcaaaagctgggcggcagcagagcaacagaattaagggctccaagtactccaaaaccgcctgggttcaaattccagcccagccacccaaacagctgtaatgggtccccctctgcaagcctcagtgttctcatctgcaagacaaggataaaaacaccaccacctcccagtactgttgtaagaaagaaatacacgaatagtgatagaacgtttagaaagagttgggcaaagtacaggccatgtgaacctctgctttatcactgttgtgagtatagctggggtgtcactttaacacttgcttgtactgcttgtcatgtgtacccagctgcctgtgcattcattcatttagtcaatattactgagcatctattatgtgcttgccttgcgctaagcactgagtgttcagcgatgatcaactgtgcacaatcttgttgattctaccttagaacaccttttcaggtagtcccatcctgggagttcctactgcccatgccttggggcagctgcccagcaccttcacttgggcacctgaccccaccttcccatctggcctccttgctgccctcagtgccaccaacacactgctaccagcagtattttcatcaacaaaaaaatccagccatgtcacttagtatcctgctagaaaccttttactggcattccactgcaggaaaggtctaatcaaactccttagtggggcacatagagccttggagagcgagcctccactatcttcccgcttcatccccttccattccatccccaactgcctctcttctggtcactctggcctttttgccattcccaagcttggcaggcccttcaattactctgcttatttgcatatggtaccctttcacattctccagagagcaagatctcttgctttttttttttctttttctttttttttttgaacaaactcttatgtatccttcaagcccaggccaaacggcaccttctctgtgaaaccatccttaactttcccaggaaaaaactcactggactgtaatagatctgtttgtgtgtctgtttccccaggagactgtcccccccaaggccagagatcatgtccagaaacccagtaggcacaaagaatgtggaacaaacaaatgaccacgttttattgtacagtggtttcaaaatgaagtcaggaggcagagttgaggctgcaaagcagctcctcacaaaaaccactctatgcatcctgcagtgggggaggtggctcttctaaatatgtgtacaacttaatttatgcacagacagaataatttagatgcagtaagacagcaaaaactccccctagaaattacatccccgtccacttgagtcaagttcctactaattctctactctagaaagggaggtaggagatgaaaaagaatgaaagaagtcagcaaacgcccctgaaggtctctctgcctatttaacacacacacattcacagagaaggtgccatttggcctgggcttgaaggatatgtaagagtttgttcaaaaaaaaagagaaaaaaacaaaaaagaaagagatcttgtgctccttctctctctctctctgtgtgtgtgtgtgtgtgtgtgtgtgtattttactttgatattgctgggattcctctctttcactacagtctggactgaatcatttcacacaagtaaatttttcagatgactgaagcctaaacttttaaaaaattttaaccatttggaatggagatatttctgtaacttactactcactttccctgaactctttgactcttcctacagaaaataactctgtcttgatgactcagtggcatcattaggaatcactaagattgtcctgtgctacgatccagcgagaactccaggagccgtagagatctttgtgactgcctgccccacgcagaagagcctcagagactcctgagctggttttaagagcatttttgtcttcttccttgctgtcagactctaaaataattctttgaataatttacaggcctccattacctcctctgtcaggtcaattctaatttaatatatttgctgtttctattggctgggtggggagtggaaatgacaaccaattttttgagaaaatggacttttaaaaaagcaaatggtatggaatattattcagccttaaaaaggaatgaaattctgatgcatgccatgacatgggtgaactctgaaaatatgttagataaaacaagctagacacaaaaggacaaatattgtctgattccacttatgggaagaatcaaattcttcctcgaagagtcaaatttatagagacagaaaatagaatagtggctacctaggactggggagaaaaagaaacagggagttatagtttaatgggtagagtttccatttggaatgatgaacaagttctggaaacagatgtcagtaatggcttacataataatggtttatgtaacaaagtaaatgtgctgaaagccactgaactatacatttaaaattggtggaaaacgtaaattttatgtatatcttaactcacacacacaccacatacatacatacgtatgcatatttatacagatatatttttacatgaactggttgagaaggttggctgagctcttatgagcaatgggtatgaactttagcatatgtacttcatgacatccctctgcacagaaggggctgaaatgacttcctagttcctagttgtgattcacaccgtcatcaagaaacaatgatctccgaaggcgctaatgtattttgcaatcataaagatcttttactcacaaattacagtactggcgacaaacaggcactccgagcttcttggagaacattatgaataatcccaaagagaactgagctccagaaggggcggggctttgtccttttcacacgggaaaccagtgcgcctgtccacggcacagaatccaaatctactcttcccttctcctgagatcaaactctagaactaagaggtcacatgtaaagctgttaaaagaacaaaaatactgattatctgaattcattaggatcttaaggatatgtaaaaactacataatgcagtcttttaaatattacaatgttgggttatgtcttataaatgaaatattttaggtaatattggacgaatatttttaaagtagtctggtctataaaagagaggaggccaggtgtggtggctcacgcctgtaatcccagcactttgggagggaggccgaggcaggtggatcatctgaggtcaggagttcgagaccagcctggccaacatgatgaaaaccagtctctactaaaaaaaatacaaaaaaatgagctaggcgtgctggcaggcgcctgtaatcccagctactcgggaggctgaggttgcagtgagccgggactgcaccactgcactccagcctgggcaacaagagcaaaactccttctcaaaaaaaaaaaaaagagagagaaagagagaaagagagagaggaaatagttggtggcttgttcagttcaactaacacagagcctggggtttggggagcctgatggtgaactctgtcttgcttaatgaaaggtcactattgtccctctgcccgaataataatttcccttcctttttggcttccttatgaaataccacgaagctctactctaaaaagtcataacatgttgtgcccagggaagatgttgaattgaaattttttaatatgtgctttattaaacaaaccacttaaaacattatttttgtccttctgaagagtgacttattctgcacatgaattcagagtgagttaaatattcaacctatatatgtttcataacacaagagatatataaataaatgagaaagtaggggggaaaaagaggtttagtaaggatgcagtaagagtttcctatcttgtcagaatttcgcgtttaagtttcttttaagaaagtagtttcctggcccatgctgaaactcccttagccctgcaaataacacaagggcatcctgttcaaatgttattatggaaacactgtgctgttctgggccaaatgtatccaaattaaactgagggggatggaaataactctcccttgatacgccctggttgctgaaggtgggtttgtttttaagtagaataaaatgtacagctgaatataaaaacagatacatcctcatcttgtaaacctgagtgacatgtcattccacctctggactctagaagaaaaaaaacactaaggtcatgcctaaaataaaaagagtgaagggaaaaggatcataccagaggtaaaaccgcagactttccccacctttttattaaggtattaggcaggttacaatttgacagtgagatcatttctctggaaccaggaaggcactgtgggtttgtttttccaacgcacactctgacccctgtaagagcttctgaatcaggtgtctggtcttggtaggaaccagtgattagtacttatttttcaaaggctatttaaacagactctaggagtcaaaagggagacagaaaaaaaaagttgtttcatttattttttaactatgagagaacttaaaattacatgttgtaggaaagatttcaccttctagttattaaaataaagatgactaactggcttcctaaagaacccaaaaggtcacatgcataaagttgttcttttgtaatatgtttctgtttaaatttttgttttaaaaatttaagttccagaggacatgaacatcacttggattgcctaaataaaggatgctggttttgcctcttaccaggcaaagtcaattgactttgcagaacctctgtttccgcatctataaatccacttcctgccctcagggagaggttattgaggttaaataatctcctatccctaaaagtgttaaatccagggtctggcacatattggggttcaataaatattcatttccttccttcctcctgactttcggtgactgaggccaatgaccaatgttgtcataaatggaaatggggaaatgagaaggatgagtaggtaaggaaaagattgcgctaaacattttagccaaaaatagtaaaagtctctttaagttcatattgttcatggtaactcattttaaactgatgtaagggctatattatactaatacatttattatttttaaggtacaacactgttttcaactattaatgaagaaaaacccattaaatctcctctgtgtaaacttgtagtactgcttgaaaaatctcaaagaccaaggaagaagttaatattgtcccatcagcacccttgcactgcattgccctgttttcattactttgtggcccttatgttatattgttaatttttaagttgtttacttttctgacttcctcacaatgtgggattcacaagagatgggagagttcttaacctgtcatgttttctgttatagctccagcccctagaacaatgattggcccagagtaggctctttacagtaaacaaatatttataaatatttgttgattgaatgaacttgcagtaacatgccctttactactgcggaaaccctactgatgaaggctccaccattttcaacattcaaaaaacatgtaccaaatatttttggtcacctaaaaagaggagcccagtgttatttttttaattttatttagttactaaaggagatagtgtctcagtcaatgctctatgagcaaatttaaagactctgaaggacttcttcatatttattagtgtttgttcttttaatttttttgtttcacatcctttttaaattttttaaacttttaagttcaggggcacatgtacaggtttgtcacataggtaaacttgttggatgttgttatacagattatttcatccacccacgtatcaagcctagtacccattagttatttttcctgatggtccaatgcggcattttcttgggaaaagaaaaaagaaagatggaagagcaacatttacaggactacacttacgggcacttccgattaaagctaattacaacctttgaaaataataaataaggactctgaggaattcaaagaaataaaggcagcaaacagcatgctaacataacaccgttgctagtcaggtgtcaacaagcaaaaacagtcacacatgttcatctaattccaattggcccctgttgaaaggggctgttttacagggccttcaagtgttagagacctcgcacgtcaatcctactactgtcccttcagctcatgtccaagcccgcctggctcataagcgcatcctcacagggtcttgagctgatggtaggcaccaaatggaagcagctagatccccctctgctgcaagcatgagaaacgctgcaaaggctgaatcgaagaagggaaagtaaccagaaacaaaagactgcattccaatttccctgaacatttttgacacagaaagcagtagagtatactagttttcaaaatgcaatatatttcagtctctactaagcaatcttgtgtctttatgaacacatatccagagaagcagcacaggataaagaaatatctacgggattcccaacccagggaatgaatatcagctcttcctgtgcttattggctcgtacacacctttgttgggcgaactttcttctttacatgggcataaacaaataactaacagtgtgtgtggggaggaaagtagggagaagttggaatacaatatctgccttgcttagggttgttgtgaagatcaaatgggccaacagatatggaatttttttttagaaactttaaaatcctacgtaaaggcaagaaaccactgtcatttttttcacccggaaaaaaattctatgaaaactgcctttcataattgaattctttcctcaaatatacttttattaactgatagttaataaagatttatcacacggtgaattctaacaaaaatagtttttaaccagacaattttttaaaagtgaaataagaaaaaatatatatttgtataaggtcaggtgaggtgacccatgcctgtaatcccagtactttgggaggcggaggcaggaggattgcttgaagccaggagtttgtgaccagcctgggcaacaaagtgagatcctgtcgcaaaaaaagataagacagacattatctaggtgtggtggcatgcacctgtagtcccagctactcaggagactgaggtgggaggatcacttgagccccggagttcgaggcagcagtgaaccgatatggtgccactgcactccagcctgggcaacagagcaagaccttatctccaaaaacaaacaaataaacaaacaaacaaaaaacacaaaaaagcatttatatataaccagaacaatgaccacattctttccaagttgtacagaaagaccagcaaagctgaggaagaactgagccatgttctaaagcattcagtcaatcattacctcttccaaaaaatctctccactctagtcctaatcattgtgcaaagctagcaatttcttgccgttcccactaccattcctctaggtcaggcacttgatctcttgcccgtttgctgaaagagccttctatctggtcactgatttctcccccgtctcattaacggtctggagtggagtcagggtgacgtatctgaaacaaactcttccagggtgggccacctctagcatcatctttctgacccacccacttgcactctccactccagccaggctgaactcctcagctcctgcagtccaccatgtggccgcttgcctctggcctttgttcctgaagttctgcctggggccacacttggttcctcccacccacttcactacattgattcctgctcatccttcaggcttcagtccccttcctgggaagacttccttgactccaataaatgccaccactattgctgcatctcttctcatagctttaaacatgctctcctgcagctgatgttgaatggtcttcactcccccagaccaagcttgtccaatccatggcaggctttgaatacagcccaacacacatttgtaaactttcttaaaatattatgaggtttttttgtgctttttttttttttttagctcatcagctatcattcgtgttagcgtattttacgtgtggcccaagacaattcttcttcttccaatgtggcccagggaagccaaaagattggatagcactgccctagactatcagccacgccgctctggctctcacttcccacttccccagggcctggctcaatatttttttaaaagtatggtataaatgaataactgatctcttgttctgtctgctttaatcatgtgactgagtgcaaaaaaacaattacccacttaaaaacacagagatgcaagtgaatcctttgccataacaatgagcccactctttatcaataccctgttgtgccaaacaggtagagaggttttaaaaaagagtcaagtatcccaactcatattaaatttccccatattctccatattttaaaagcactggtttagtcatgggtgatgccctttaagtattccgtacaaaaggtattttcaaattccaatgacatgtactttcatcggttaatttttaattgagccaaatattaaatgttcacattaaccagacaaagcatttttagctactgatttgcagtgacagcttgtgttattctcacacacaggccaagcatgaaatagaaaactaataaccccttaactgtattctcaaagtatcatttatgggaaagaaaactacattcaaaggaaacttgtgcaatggctgtcatttttttccctgagccacaagctgttacaaagcaggagagctcattttctcacagatacggacaagctcaagaatcccactgtcactggatgtattcattaagaaggaatctggcagcagcacaggggacagatactttggagaacaggccaattatctgggtgtcctttataatttgaagtttctgaattcactcatagataagctgcttgaagagggcctggcaatgggaacataatgcacagatggccactgaagaaacaagagggaggaagggaggctggaagagagaagagaatttgcttgtggtttcattcatggggacaaatctacaagctgacacattcatctttttaaaaagcccctggagaagtatggtcaagcttcactacaagtaaacaaatcaaaatctttctcaaacagatgacaactgatgagcaacaatgctttgagtttgcttcatgctaacggatgagggttctcaaaatacaaattccatcagttgttaaaaccacagataggctgtgatgctggcttgaaccagaatagagaactcagccaaaagctgccaggccaatggttttatgtaagacatcccaggtggtcttcttgttgagcagtgtctttagaaatggaatcttaggttctgtcgcctctgggaatgccgcactgtactgacttccaccttcaattggctgcttatttttatgggagaagaacgaggggatcatttatccttgtgacttttgtgctgcagttctttttatatttgagctacaacactgatcagagttaaaatccaccttgctcccactgtgagaaccttgggccagccctgctttctataatgatggggtgatgaataatctcagccttcaaaaccttttcagtctgggttaggcttgagatgtgaaacaaaaggaatgagagcaactaggcatatgtacatacactgtgtgtctacaaccttcgtataaacagatagaatgtgacaaccagcaggctggtatctatattagcattaaggaccaataaatgtcaaatgtttaatatagagcaaaatctagatttctcttcaggaataaatgatatactttttcaattcaatgaaaaggatgaaatcaaaacacttaataggtatttttcttctttcatttctattaaatattaatgaacctgtaggatgggacatttcagacacacacacacacacacacaaacacacactataataaaagaagtaggagaaaattagctgcttaggatgaattgctcagaatgccctaacataatcattttattcattcattcaataaacagtcattgtgtgtgcctattacctactatgcttggtgccaggttgaatttaatagaagaaatattttattaataaggaagtctcaatgagaaaggacaccttgattttgtaagacctagagtcacacatagaggatactattaggatatttggaacaatactaatttgactcaagttgaagtactcattaagttggcaaactggtagtgggaagccaagctttgaacagcaaagctgcaggttaaccaccttaacccaatccatgcaagtctacagattacctttgggaaaaggtggggtgcaaacaacagtcgcaaactaagacagcatcagcagtagcatttaggaccacttagggcaatgaaagaaggcaaaagagaaacctacatgattcgaggggaaagacatattatggttcaacctcaatttttctcttgagatccagatccttatgtctaaggcttactgggcatttccacttggatatcctactggaatgtccaaaatgaaattcatcacatgtacgccacaaagcagtaactgttgttatctttcctttccctctggaagacagtatcattttttgaggcagccaggatggcacttgagtcctgattctttccctccctcattcctcacattcgacctgctgtcagtcctttgattctacacgtgcagtgtgcccacatctgtcctgtcctttctgttccaggtgcttcagacctcatacctggtctcccccgtccaggctcagtcactgtcaatcttcctcccacgcacacatcctgccttgtctgagaacctttgcaacatcctttcaacatccctggtacagttaaacgcagccatccttcagtaacctcaggggattggctctaggaacccccagtggataccaaaatctgaagatgctcaagtccctgatattaaatgagtagtacttgcatatgcacatcctcctatatactttattttatttatttgtttgtttatttatttattttttgagacagagtctcgctctgtcccctaggctggagtgcagtgacacgatctcggctcactgcaacctccgcctcctgggttcaagcaattctcctgcctcagcctcccgagtagctgggattacaggcgcccaccaccacacctggctaatttttctatttttagtagagaaagggtttcaccatgttggccaggctggacttgaactcctgacttcaagtgatccacccaccttgagctcccacagtgctgggattacaggcctaagccactgtgcctgccctaccccatatatttttgatccaaagttggttgaatccatggatgtggaacccaaagatagggagggctgtctatacaagtttcacaacttagtatgcagtggtaagttctcaaaactatggatttatctcaggagagttctccatgccccagtcaaatcagactctccacaattccccaaacacacctcccgcattcatgcctgctttgacgcctccagtttccactacctgaaagaccctctccccgtatcgcctgcctgttctctaaaacttgtctcaacattatctccggcatgaaactcttcagataccactgtagctgggttgggcctctctgtctactacacattgtccaggattacagtgatttgtatccttgtcttggtctcctactgattggtaagttccttgaaggcaaaagttatcttagacattttttcgcttaactaaaacacctagcatagagctttgcatggtgtagggcctcaataaatgtttttttcaatgaaacaagttagtgtgcatgttttcctaaataaccagattctaaaacccctctccatgaccatcactaccccggttcctgggaacccagggttaagttttgtggacaattgctcatttccctcaattaggacttcttcaaatcattttcttcttatactatcactttaatgtttagtaagtggctttgtctccctgttcttataattttgttataaaatacctcaaaacctctctgtgtgtcttcagtgtgtgtgtttttaaagatgctggcaggaatccataaaggatatggctaggagatagccctgaaattttacatccagaaatgccaatgctgccatcctttatggactcgctttttttttttcaagaagataaatcaatatttaaagctgatgatataatttgtacttaattttattcctattttaattgtaaatcagatatcaatatatctgagatatagcattgaactaagaagactaagtttatgtgtctcatgttcttttagaaaattctaatgcagctgagaggaatatttggctgcaattcaatttcagagttaatatagagatatagcattcatcatgttgtaaagcagaaaaaatatcatcctggttatctgctaaggagagctggaaaaagtcaagaagagacagcctgcaacactgatcctttgtttggtgcttcaagtattaaaattggtaaactcaccatactctgttgcagcttaactgtcttttcgacagttaaaaataaggaaatatggtaactggatctgtcacaagaaaagatgtattggtctcaatggagaaaacctcccctgaaaaattaaagcttcacttgacacagtgggttctcgggttgtttttgggagacatgataatgagcagagtggagtcagtcatcagtttctgactcattacatggaagccccagagagctgattattaactaaaaatggaatacgcttctatccctgaagttgtgaaggcaaaacaagaagcagaatggaaacacaaatttccccattgacgcatgtggcccaaacgcgatgctcaagggcaggtgtcttccacagttaacctgctcatggaatgtggttgatcgccccagaaaatcacccaagtcactctcagtatattgctacaaatggccataccagtatgtcagggagattccctttctcacatgtttaaaagggcgtttggggaagtagtccttaccctaagctattttagtttagttagtcaaacatttattgaagtctcaggtataaccccactataatcttgcactagaggaatcaaagtaagtacaaattttgccagcagatactatcttttctctgcacaggttaaagtttataatcactagaggaaaaggatagtgtctggtcacagaattttgacctgcccagctgcctgcagcaagtttggggtgagggttatcctctcactttgattagactccccacttctgctcccttttgctagtatctaagcgcattacggttttcttcaggtaaatcctacccatcactaattggaagttaacaaggagctacacctgagaggtccctcaccggtggaatgataaggcaggtaggggatggtcacaggggtggtggcacctatgagaaagtcccatggcttggaagagagaggaataatcattcaatccttattcacactgaaggacagatgggtgtatcttttgtctggcaaatggagggcagagaaatagtgctatagcatatacagaattgggcatatataagaacaacaagtgacaatctataaaaatatgtttttaagtgaaaacagctttgttggcattttgaaagttttacagtctccatttaaacgaacagaccacaagcccaaaaaagtccgaaggcaaatgccagtgttacaatggactgtgaatttctgtaactagcatcgtagaagtgtcttgataaatagaacagtaatataacctcaaaccaaaacaaaacagaagcttttttttcccctgctcaaaggaagagcccccgctctggttcaaaacctacttgtattttttggcatacaagagttatttaagaaagatagttcttcaaattaccctgttccagtcagtctaatcggagccttgattgtcttttacttaaaaagaattaatgaaatgctttagaaattgtagactggtgtttattaagtcttcttagtatgcataaatagtgcttagtgggttaatatttaacaagggaactccccctgcctttcagttctcttaagcatatgtctacgttacacagtattttttaaagtatctacattttggccctgtttaaattaggcctaatgcacacatgaacagccatatggtcagaaataacgttcttagaccaaggctgaagtacatgcaaaataacttatagttatttgcttttttcctctaagtctctgagtctaggatcatgcttatcaggctgtatgataactacgagtttattaagatgcctgcaacactagcctgtgagtttatccagggcagaagcaaagctctccttgccgtgcctccaacctaacccaaggcaggactcatgtaagactggcaatcacatctgtggaataactgtcagtccttggatgattttcatcattaatcctgcttagacatcaaacattaaggttgattaagccaaaccaagagggatgaaagagaaaattcacagtggagtaaattcactgagtggtctcctacatgtggttgacagaaaggatgaccagattgacaagttactgttatacctgaataaggtgatattagattaccttaaaaaggttgaacagaacctttgaatctcaaatacaatatatctctgggggaaaaagaaaacgttctacttgtacactacaaagacagtgttgttttctagcacaaatgcacttctgctgagatactgctttgctaaactactgctaagacacaatgagtgaccttagaaaagggtgcggaggtatgttgggtgggaagaaccactgttaacatgcagcacccacacactcgctcatgagtgggcgtatcatccctccaaatagcgcaataggactgggaacagagataagaaaaaacaacaagaattttgcttgccttttttttatttttaatttatggctttctgttacctggtatgctgtgtggcctgatgacatttaagtaatctgaaatgtaccagttcaatcaaagattgctaaaaagggcaatccattcttattagaaagtacagctgaaagtaacagaatgcgcaaaagaaagccatgttttcaatggacgttaaatagcaacaaaacagaaaagagaattcagttaactataaaattttatgaatgtccagaaacaatcacaccacagcacatgactgaaaactctatgagaaatagtgtgtttttctctactacataaattattgaaaggggtcatgtgattcttgtaggcagaaagatgcactttcccaaggaaagttcatcatgaaatatattatttaagactagatcatcttcaagctatttttaatcctatcgtcttgctgccaaaattggccataagcagccaatcctcagacactagaaaaatgatgctctttcatgtaatttgtacactggcatgagaatggtattgctttccagttaatcaaatgttttgctggatgtggactgccttgagaaaggaaaaactgcttgctgactaatgaaaaggcagctgaactctaccgggtgtggagaagttcctgtcttcctaaaccaccaacaccaaaaaaccaaaaaataagtcggattaccatcttgtcaacagaataaagccaatctcctacaatctcttgtctgaatcatctcattcttctagtggctcctatctcactctctcctaagacatgaagctgaatgtcgtcacagttcccagtttagagggtcactctccatcacctgcccaaaactcaatcccttgcctgcaagagtccctttgtcttaaagaagctgcaaggtcactaaagtcatttacagaatttaaactgtgttatgaggggataaaataataactaacagagctattaaaagagctaattctcttgcctttaattgaagaaaagctatcttactttttaatgggaccagtgatgccaatataaactatataactactacgaaaaatattcatgagaagactgggcttatagttgatctacctgcttgctatctctccttcatccaatttatgtcttcctaaagtcagatcacaatagtggacacctgggaaatactcggtattccaagtaacactatagatctttaaggccactggaaggggacaatgcagaatccatcccaggtagcaactcttcctaaaagatgccaccaggaaccaaggatggtagccagcatcgctaactttaacgtgcacacaaaccacatattctgactcagtagctctggggtgggagctgagctttagcatctctacaaagctccgggggatgcatgtgctactgtctataagccacactgagcagcaaggtatccacattttctagaattgcttctctctcactgcttcctctgtcctgcctctctctggatgccacacaatgccttattcagacctaggaataaatccacactccactctacagccaattacttctttagtctttatttaatttgtagtcttctgggacaatctatcagaggctgatcattccaaggacctgatttatccatgttatggaacacaaaagtcaaacagatttcctcagcctcacaaggttccaattttctacgagcagcagcaaagaaaaagaaatgacttgcagtctaaagcctggagtattcagtgtagtattcaggagatgggctaatccacggagccctggggacagtgcagattattgtcacatgccaagaaaatatgctagctctcttctgaagctttaccattaagactaccttacactataaaatacaacatattattagagatgtaaccccaattggtgtaaatgtgaagaaaatctgtctgtatgccaaatgcctaaaatgacttttagattaataatgcacatttgaaatgataggcaaatcattcatcattctcaaacactaccacttttattccaaagtgtcctatgagtgcatttcctggtatatatatatattttttctctaaattcctttgttttcctatatagtcaccatctatgcattgttctgaaagctattacatattttaccatcaaccatctgtgcttctacatgatttatttttactagaagcagttttgtcaaaaaatttttatcatgttctatggtatgtcattgtggtttggcatcataaaatgtagcctctacatttatcaacctcagatacctgttgaccacaaagataggtctactatgaaaactctgtttcacaaaaagaaaaaagtgagcctttacttaaaaagaaacttcagttacatgagagggtaacacactgaaattcagcaacaaatatcaaggttgtatcttaatttctgtcataaacatgtgtctctgtttcccacatttttattaacttatttgatagacagataccagttaccaccttggatttatttcaagtagaaagaaaatttgtaagtgtgaatttttcacaaaaatgtgaaatagtaaaactattaaatcagttttactttggtttaaaaggatcctttgggaatctggaagtcccaacccctttagttatagtgattaaaaatcaaaccacctacttaaccaaatatttaacaaaaatattcttttcaccctttagcaaattcttccagaattactaaagatctgataatgtgagatctcaacaaacaaacaattcaagaagaggatttaaattttagaaatttaaattggggcattttagttaatcttacttttaaacaccaaacagtggcatcaatattttgtcaactttggtcaaataagatcagatgttcacatcaatcatctacttttcttggccttttctctatttggcctcctagtatgagcacactttgtaaaatgtaataaaaacatgtggtgtgcttcttgacatctaatccacttgcagtaatttctaggctttttgctcctgttaggtcctataaaataatgacattagtcattctcccaagaggctataaaaggaagcactgaattgcatcctgtttttcaaagataactcttcagattaaaacaaaaagtgtaaaaaaaaaaaaaacttcacacaagaattactttttcataaattcatcattttagatatgagatatagatctccattacaatccttgactcttaggaactaaaccccctccaacaaagaatctcagaaaagtacaattgtatggtataatgatgaaagctctatctagcacagtacgagaaaaagatcatctcacaaatgttcttcaaagccacaggtatcaatcacttcaactaaagtaagggtaagataatccacagctaagaatcaattcttctacactttacatagatacctagatgcaaatttttttcagccgaccacaaaattaggtccactctgagtggtgaaaaacaaaagattctaacattctagcaaactggtaaaccatacacaaattatagaatacaaagaatgcagccgatgcaaattctgtcactgacaaggtagcaaagccatagcctgatactcctcaggacacctcatcacgcccactgggaacatggcacacactggagattccagtccaaggactttggaatgtcaacttagctctttacaaacacaactaagtttttcagggaaaaagacttacattggttttcctcttttggaaaattttaccgattgatgatgcccttggtcttctgtggagtctattcttctaatcgggttgttctccaattttagtgtacaacgggcttgtttcaggggagcttgtttgggatgcagactgtcaagacccaacctggtatctggttcataagcagtccctgaaacctccctccggttccaacaagctgctcaagccaggaaacggtggtcctggggactcctggaccttcagcttgagaaacactgaaggggtaccatttaccaccacatcctactggattacaaacgctagatctttggatctccacgactagcaagcaagttaaagacttttagatggcaggcgttatcggtcaggttgggagtgaacgctttgtccagaggaggaggtagggacgccgggaagcaacaactctgattttatttcgccggctccacagcctcccattgccccaggagcccacccgcactccaacccccgcatctcggacctgtggcctcagcccagactcacatcaccaagtgcacctacccagcctccgttatcctggatccaggtgtgcaggtgccggttcaggtactcagtcatccacagggcgatgttgtccaccaggggcgacatctcccggttgacgctctccacacacatgaccccaccgaactcaaagaaggccacaatcctcccccagttcaccccgtccctgaagagctcctccaccaccgtggcaaagcgtccccgcgcggtgaagggcgtcaggtgcagctggctggacatctcggcgaagtcgcggcggtagcggcgggagaagtcgtcgccggcctggcggagggtcaggtggaccacaggtggcaccgggctgagcgcaggccccgcggcggcgccgggggcagccggggtctgcagcggcgaggtcctggcgaccgggtcccgggatgcggctggatggggcgtgtgcccgggctgggaggagaagatgcccggtgcgggggcggcccccgggggcgcggcgcccacatctcccgcatcccactcgtagcccctctgcgacagcttataatggatgtacttcatcactatctcccggttatcgtaccctgttctcccagcgtgcgccatccttcccagaggaaaagcaacgggggccaacggcacctctcgccccagctcccaccccacggcccccagagaaagaagaggagttataatccagctattttattggatgtgctttgcattcttggacgagggggtgtcttcaatcacgcggaacacttgattctggtgtttcccccttggcatgagatgcaggaaatttttattccaattcctttcggatctttatttcatgaggcacgttattattagtaagtattgttaatatcagtctacttcctctgtgatgctgaaaggttaaagaaaaaacaaactaataagtaaaaaatcaggtgcgtttccctgtacacactgagtgaaagcagggcatacacactacaagtaacacggctaaaaagaatgtattaagctgcctggaaattaaatttactcgaatgcactttaagtaaaaaatctcaaaggtttccattgaaagttacattaaaccaatttcctgtgcagagaacttacttgtattttttaagtacagcatgatcctctgtcaagtttcctttttgtaaaaccaaaacaaatgcataaggcaacgatcccatcaatcttcagcactctccagttatagctgatttgaaacttcccaatgaatcaggagtcgcggggagagggagtaaaaattaggaggatttccagatcgattcccagacttctgcttcacagaaatgtcaatccgcaggaatcccaaccggagatctcaagagctcgagaaaaaaaaaaggcagcggcggcggcagatgaattacaattttcagtccggtattcgcagaagtcctgtgatgttttccccttctcggcaatttacacgcgcgcacacacgcgcgggcacaggcatgaatctctatccacgggaccgcttcacgcctccccaggagagagacaggggagaggggacgatgaaggagccggggacggaggcaggaatcctcttctgattaaactccgaacagcaaatgcattttccgaaaagctgctggataaatgaaggcaggacgcgcctggcccgccggtgccgagcgctagaagcccgcgctgtgtgtggtgcggcgaggggtggggagaaggaggtggtgggggagggttttattttttccctcttttcctaaaaaggatgactgctacgaagttctcccccctggaccccctcttccgctgcaccccaccggcgcaccccgcctccgggctgcgcaccctttctcctcctcctggtcctgcgcggcggcgctggctacggccgcctcccggagctcccgccgcgcagcccgctccgagcgctgacggccgccggcagggagggcccggagccccggcaccttcgctggcagcggcggcggcggcagcgcggcggggccacggagagcggcgggcgggagcgcggcgggcgggcgggcaggcggcgcggaggggcgggcgcgggaggaagggggcgggagcggggctgtggtgcctgtcctcttacttcattctctgcacagcccgaccggtttcctgtgcgtaacgtcacacggttcattcaaaaaaagaagaaagaaagagccctcctctgagccacccgaccgccccctccgccccgctccctggcccgggttaaaggcgccgcggcaggcccgggagtggcgcgtcccgccgggggcacatggcgcgcggggccgcggccggggagggcgcgtccgggccggccacccgcccgctccgctgcgcccgcggggcccggccagtgggtggcgcgggcggcacaggcctcccgcgcggccgcggcgcggtgggtgtgcgcggggccttctgctcaggcctgcggcaggccgcgtgcggacttggtggtcgctggggtccgcgacggggtgggggctcccggggaaccgcacgcggccgggccgggcggacgacggagtgcggaggggggcggctggcgggagggtgcgccatgaaaacaagggctggaaaagcgccgggaaccgcctggaccctttctggccgtgtgagtgtgtgtggagtgtgtgtgtgtgtgtgtgtgtgtgtgtgtgtctcgcctggaccttttctagccgtgtatgtgggagtgtgtgtgtcgcctggaccctttctagccgtgtatgagagtgtgtacacgcgcctacacacacacacgttgtgttaccggcgctcggccgccgggggaagacccaggccaatgccgccccccaccgcccccagcagtgggacctcagcgctgccctgctgtgaagacaggtgactctgcacgttttaagcaatgtctagggacgccccgagcgtggtgtttactttcaagtagcttcctaggtgtccgcgcactacacacgcacgcgcatccccgcccgtgtccacctgaacacctagtccgtggcccaggccatgcagaactcagcgctccagggaaggggtttatcaagggctttacgacagtttaagtcaatgttttccctctgtccctaacaccttttacactggtttagtgctacacgatgaggacttccatatagtaactttcaggcccaccgtcctaacgctggggtgggtgggctcctaaaggtctccacctttgcctcgtagccaatcctagttggccgcactttctcaaatgaggtacatagatacacacatacacattcacactcgcagacgtgtgtacgcgcaagcagacagtt

SEQ ID NO: 129 - DNA, 68851 bp, Homo sapiens
gtactttgaaaatatatttaaaaacattaaaaattctatatttaaaacatatattatatgttaattagtacacttaaatagaacttgtatttacaataggcttctgatgcggttaagttttaatgccaatttttttcaataacataattatataaatatactaaaatacaataaatattgttttttgttttacatggtgaataatatctttaccatagagagaacaaggccacagacatttacttacattttcaatgggaatcgccataaaaaagcaacaggcctgctgccatgcatgaaacacttctgccacaaagagaccacagcaagactttaaaaaacaaaacaaaacagaacaagaacgaacacaacagagagagattttaacaaaataaatcttaggtcaacataaaccatcaagcatgtgactgtgatgtatcttattgggtaaaagagccactgaccacacaattgctggatgtgtctcctatgaaaccacttaacagatctggcccttgcaatcctttaagtttgtgatggggggttgtttgttttaaatttgtccctcaaaaggaagctgcataaagttgacatacagcagatattccaagcattccttacatattaaaaataattacaaagataatattttcaaacaacacaaaacaaatctacactacgtaaagtcttccttctttcaaagaggtattcagatggtactgtgaaagactagctctaaatgaaagactgaacaaattgaaattctttgctgatggtatcttcattcctgggttatggtgaacatcctcttttgcttatccctcaccctactaagatgcagcaattgcttggggctttctgatacttaaggatgctggtccaagtggtgatcactaacattttcaggtgtgaaatgggctgaatgggcttagagctctagttttcactggggatccatttttccaagaaccactatttcaggctcccaacttgacttctcctaacccaaaatggcagaggtgaggcagggaccctctccatgaacagacaggatgggcagaaggttgctgtggccttcactggggagcaaaattttgtcagctctgtcctggcctcttccattgagcaaggcaccttcaagtcttggtgttctgaatgtccagacaccttcccgaagtcttgtctctggacaagatttcctatgggtccccttgatcattcggcctgagtttggggtttcttttcctgttcccttttcccttaccaaaagttctcaaaagataaaccctggtttcctcaagtctagtttcaaagcaataagtgttcaggtagcaaacatcttctatctcattgcatcaatctcatgatcacaaatgccacatttggctcccaacctgctccaggctaatccaattttatgcaaaattatccagaggtgggatggtgggcataagtcggcttgagtgtggtcctccagtcgagaacctcttgagcacagttagataatgtaggcacttaaagcacgaggtccaagcagcttgacacatgtcattccagagccacctctgaagggtccttcagaggccttcgttttggaatgtctcaaataccatgccccacctccacctagaccttgggatggccactcagaaattcctcccgcactgccggtaaatgcaatgccaactccacatagcctccatttggctgttcagtctcatgtcactggcaatgtggattcctgttctgatctaggtgtttctgggttgatacagggctctaccttttgcttacaagacattgttaagcctcaccatgagttttttttaagcttagccatgatttacccaaatgttcactcctcataaaaaataatcttcattttggggttattttttgttgttttctgttctaaaaaaaaatcactgttctccatgcttatacgagtgtcatgatgtgacacaatgtgttcacttgttcacagcagtggtaaaatatttcagaacgcgcaactgatttttcttccttaaaacaaaacaaagaggagaccagagggggagggggggaaagaatgtgttctgagcaaacataggtccttccgtcaaaagcagcttactctgaccaacgcccaaagaatgagcggggcctgggaggtgcatcacgggatgtggagtgtgagcatttttttgttcagttgccttaatttttattcactttctagtcatctgatcgatattgcaaacatcttcacaacatacaaatgtatcttttatcagccagaatatatattgtaggaattctttccccatctctactccctgtgggaactaaaaaacaaaacaaacaaacgaaaaaaaaacacaaaacaaacaaaaatataccccccatcccccatcccctaagccagtaaagcaatgacaacagcaccttgacattgttttaattccaacgctatcagaagttaaaagcagtaaaacagatatagtactaacaagaacgaagatacttactgtctaaaatgtaaacggaatgttttggttcaaatttttgttgtgtgtgtgtgtgttttttttctgttttctgaaagaggacagtttattatcaattcacaattaaagcagcatgcaatttattattttttttaactttttatgttttcagttcttggcaacggcaacaaaccacaacattatcaaggaatgtaatgcagactttttaagttgtgcgcaaatgactgtttcccttctggtcatggacatgtccaataaatagattgtagaaccactgtactgtataaacttcatttatacatgcagttcataaaattatttttttcttaactgaataatttaccctgttatgtatatatacaaatagataatttttgtctcaatataatctaatctatacaacataaatccactatcttccccttttaatggtcaatgtacatacacaagaagtgtctatccttatgaatcgccagccaattctctttttgctatccatggtaagggcccgcacgtacgactgggtagttcggcactgggagttccaatgccttttgtctatgcccctgcagccttcttttgtgtaacccatgggattgcacttggtctcgtagaagtattgcttcagttggccttttgatacagggaccttttcaaggactgtgaccgtcccgcccgacatgtccactgcagtctttttgtctgctgccgttacccactcactaatactgtcacacacgctcagctcccctcggcgggcagggtcagagtggcgccggaccctcatggacatgtttgcagcatctaggtaatttttgtattcctccagcagaaagagaagaggaggctccaaaggcacttgactactgagcatcaccctggacgtgtacaagtctgcgtccttattgttttcttcattgggccgaactttctggtcctcatccaacagctcttctatcacgtgttcgaaagtgtcagccaatgatgtcaagcctcttgaacctgccttgggcccattcacgctctccagagtcccatgggtccgcacacctgggtaggccaagccaccttgtcctcggatgtttgcttctttcatgggggcagccttcatgcaaccaaagtatgaaataaccatagtaaggaaaaggatggtcatcactcttctcacctggtggaactgtagggagaaagcagaaacaagacagaaaactggttagggctttctttcaccgggatgccatgtggcccatctgattgtaattccaggccattctgcagggtcaaggtttttttatgtcttggtgataaactccagctgcaccagacacaaatcagtgtcagtagtgtgctgtatgtggtttaatataaaccagagacatgcagtgtttcccccaagatctagcatataaacctgagattagatggcttctaagcaagtgcaaaaattgtggcttcaagttctccttcttcccactttagcagctttgtaagtttaatttttaatgatctctgctcatgctgtcacgagaaacacaaaatcataaatgttactaagcaacaactgcaagtgtaattaatagtaatttttttcaagttagcaacatggtcctttgcaggaatgtgtgacaggaacagcagtggcctgaggggtctgatgggcctttctagctatgtgatgtctaggcatgaatagcacaataaaacagcagttggggaactataaggagcctttaaattgactttttttttcctcttcccacagagatactctattatagcaaagaagaaagataatttcattgagccatcctgttttacaggtaaggaaaccaaaggccatagaagacttgccttatgtcatgaagaaagtttatgttagaactcagggctcccaattccactgttctttattctacacctgggtggtcacaactgaaaatgttttgcttatttctaaacagaaatcattttttgacatgttcattttaatgatgtgtctatgcctggggctaatgtcatgaaaacaatgtgtctggtaaggagaaaactgaaaaagtcagcattaaaaagacatttaagtccatttcaaatgcctcccatatgcagactccactttatctcctccagttctctaaaacccttcactccttggctttttctggctaatacacacatctagctaagaaagctcaacttttctttttactagagatgttctctctgtgtgtgtgtgtgtgtgtgcgcgcgcgcgtgtgcgcgcgctctgagtttatcctacttttaaaaagctgagtggtgttttacacattttggaataggcagctagtgcttctttttctgcttttgaagtttcctgggaagtcccttaaaagcataccacaaaattaatctcttcctgtttgccagagggttgctctactctaaatttggctctacatctacaagcatgctctaggaagccaattaaaatggatgaacaagcaaaatgaaaacatacctatggaccaacccaaggttaccgtcaggtggtgaaggacttcagaatcacttacctgaagcattgtgtttctcagcagcaaagagtagcatccccagccctgaccctaattttattcctacttctcagttctgaggcatggacttacaaaaagacacatacatgcaatggccatcatgatatccaaataagtaggaaaaggaactgtgtttctgcccatgaagttttactgaattcaaaggcaacctacctccagtcaataggtcagaatgcagaaatggctgaaaactctggtattgaaaagcaaatgttctccacttttgtaagaaataacattttcaaccactaagagactttattaccatccctaaacacacaaaaaaatttcttttagatttactctcactttgcacgaatagcaaacatgcttagaactgcttagattgcacaatgttctcagattaggaagggaaaattggtttgaataaaatacagatgtctattccgctaacaactaaatctttgtgaatgttctgagtcctgtaccatcaaagaaatagatcgtccatgggggtttctatttctggtagattgtacttacacactgaatgaaaaagctttctcctaatattcccagtccaaataaaaacaacccaaggggcacctcttatttaggtcaataaaagtttgcaaatgtggaatactttagccatctacatcacactggtagagactttctgtgatcagctattttttaataccatatttaatcaaatctaagataccatcattgtgaaactcgacattttatatatcactaagaaagcaaaaatgcagcctgggtgaccagagtgaaactccatctcaaaaaaaaaaaaaaaagaattaatgaactatagtttaatacatatttactaagtgcccacactaactacttaaaaatggtccaaaatactgaggcatcttaagctgttggaaaattgttttgttttcaccactacagtaatgagtctttgaatgataccattttctatacttggcttctagtttactctgcctttcactgatcttatctttttattaataactttatgagaaaaataattaatgctttatatattgttctctcagttccatgagcaaatatttcagagggaaaattggcatctgagtaaatattacttggctttcattctgaagcccaaacatgggtattcctcaagctgagcatctgcatagaattaggaattaacacaatggtgacaaagtccaaccccacattgcaagccctgctctctgagtggcacttctgcaattctaactaactgtctactcacttgtaaggccttgaagttaagtgggtgcaacaccaaactcaatactttttgttggaacagtggtatctcctaccttttctaacaatggttccctgatattttgggcaacccaggcataggatagaaatcctggaatcaagtttgacaatatatttcctgcatagccttccaatccagtcagtaaagatgtcctgttaatttttcctttaaaatatttgtcctggccatccctttttatccatcccactgccaccatcttggctcagccctcaccacctcattttgtgaccacaacgtcccgatgctgtatcagacactctttctgctccattcaactctgatgaccacttcctgggtaaccaccctaatactattctcttacacaaaaactggcaatggcatttttgttctatctgctcaaatctaatgtcttctctctgatactcaactctctccaacatctgccctcacccttcttagctaactttctcaaactactcaatgcttcatcacttctgctccgatcaggacagagtccttggagtgccgtacacattactgcctcctgacttgttccattcctctgacaaactcctctctccctctcacttgctgccaaaatcttgcttatccttcatgatccagttcaagcatcaaatcatgcatgcccctttctctaattactccagcatacactgccttccttccctaaaattccacattacatcttacgtagtacttgattcccttctcacttgttttgttttgtttttttcccaagacagagtcttgctctgtcgcccaggctggagtgcaatggtgcaatctcggctcactgcaatctccacctcctgggttcaagcaattctcctgcctcagcaggaggtagctgggattacaggcgcccaccaccatgcccggctaatttttgtatttttagtagagacagggtttcaccatgttggccgagctggcctactcacttgttaattgttaaccgtatttgctcattctagtcagtcttcagctgaaaggtaagttctttgagggaatggatcatgtctgagcccccataatgcttaacagagaaaaatgtaatagcagtactcagtaaaaacttactgataggtttattaaactaagagaaaagacagtttggatataattttcgtaagaagccttttcatttggaaagatcagtgaacccattgaaattctcaggtaaatataggctgtgctaaccccaaattataaactctaaggcagtggtcccaacctttttggcagcaggaaccagttttgtggaagacaatttttccacggtctgggagtagcagggtggatggttttgggatgaaatggttccaccttagatcatcagttaaattatcataaggaattggattctcataaggagcacacaacctagatcccttgcatgtgcagttcacaacagggctcatgcttctatgagaatctaatgctgctgctgatctgaaaggagacagagctcagatggcaatgtttgctcacccgccgctcacttcctactgtgcagcctggttcctaacaggccagggactggtaacaatccatggcctgggtgttgcggatccctgctctaaggaatttgacagatagcaattatcagccatgaccaacttcttgagttcctctaatggaataaaaccttacttgaataattaaaaagcagataacactaccacatactaactgtcctacaatttcctgtgtagctctatttctaacagatcaataagagacttgggaagtaataacaataataatagcaaaatttgtagttttcagccttttaacttcttgtttcttattctgctaagctttcaatgagtaattttatatactgtattaggaaataataaaagattaagtaagagcttccaggacaattcttcattttcaaccttcggatgactctttatcacacataagataaagaggctgtgtaatattgctaagcagattatatatttatttatacttaataaattcattgatgctgtctaattctgctttaaggcttacagccattaattcaaccacatctataaaatgctaggaaggctttcatagccccactgtcaggaaattcaatatagtacatagaactaaaaagaaaatcaatgaagtagatatcaagtttagctttaagtgtgactcacaagtcttagacatttcactgaaagaatgtccataacaacatgctcttttactcttgctgtagtcataacttacatttgtctaagagactatagaacattcacaggcgtcatctaatttgatttttacaaggagacaggatgggtattattatccccattatatagatgaggcaattatgcgtcagagaggttaggtaacctgtcaaatgccataaagctagtaggtcacctgtctcctgaaccaagcttttaccatcaggatgtgttgccagttttagaatatcagccacagagaagagagtggctgtgacaacgaaggagcttacaaaatgtggacactgcagctatgtgtgtcctggaacctaactttctaaaaggagtgccattaagatactactttgtaggtctagattaatcatgaccaagatccttcaactttaaggcttgattacttaaatggatgaaatttcagacaatgtggtctttttctaagagaaagaactgcaaaaattgtagcatgttagaactaagtttctatggccaaaggtgggaaaacaagcaacagtacagataattcaggcatacagaaaaaaaaaaaagtcttgtttgttcccagcccctttgggttttacctgtgagcgtgtaatcagagaaaacacagtttaaagatatggctgctcattttagacagtcctataaagataatggtaatgctgaagaagttattaatatttggttcctaacatatatgatacaaactattaagagttgaccttaatgaaatcttgcaaatcaatatttaaaaatttttaatttgcatccagttgactatatccatatgttagacttccttttgttcattcattcatcacacatgaagtctactttccagtcttacttacctccctccctaggagggaggtaggacatacgtaactagaatataaaggtagaaatgacccagaaaaggtacagatacaattttataaagagaaagaagttacttccagttagggaataaaggaatgcattgtcaagaaggttgcaaagggccaggtgcagtggctcacatttgtaatcccaacactttgggaggccgaggcgggaggatcactagagcccaggaattcgagatcaacctgggcaacacagtgagaccatgtctctacaaaaacttaaaaattaaaaaaattaggtgtggtggtgcacacctgtagtttcagctacttgggaggctgaggtgggaggattacttgagtctaagaagttgaggctacagtgagcgattgatcatgccactgaactccagcctgggtgacagagacactattgccctaggaaagcaactgttttgctgtaatcaatgaaggctcccgatagccagagccacccagaattcacagtcacatcgaaccttgccctcatcctctgcctccttgtcacagagcaacactgccccagtagcacacatctccagtctgtaacaaagaagtcttagcatcaagcatactcaagccacttggatagcaaatgaggtcatctgaaaatacttttaaagtttacttttttaaaaaacagttttttgtttacaggacccaaatggcagttgacattccctgtaaaagtttaacctcttcaattagaattctgttttctttagaatttcaggtgggatctgttacaattcactgaagtttagatttgacaatgttctatctactatgttattgaaaccatataatatttaccaaattcccatacatggtagacagtgacattaattaagaagataatttccaatttgttccatgaagtttcagtgacccactctgtaataaagaacttggaaagggaggttccaagatggccaaatatgaacagctccagtctacagcccccagcgtgagtgatgcagaagacgggtgatttctgcatttccaactgaggtaccgggttcatctcactggggcttgtcagacagtgggtacaacccacggagcatgagccaaagcagggtggggcatcacctcacccaggaagcacaaggggttggggaattccctttcctagccaagggaagccatgactgacggtacctggaaaatcaggacactccccaccctaatactgtgcttttccaatggtcttagcaaacggcacaccaggagattatgtcccaggcctggctcggagggtcccatgcccacggagcctggctcactgctagcacagcagtctgagatcgaactgcaaagcagcagcgaggctgggggaggggtgtccaccattgctgagacttgagtaggtaaacaaagcagccaggaagctcgaaatgggtggagcccaccgcagctcaaggaggcctgcctgcctctgtagactccacctctaggggcagggcacagctgaacaaaagacagcagaaacttctgcagacttaaatgtccctgtctgacagctttgaaaagagtaggggtcctcccagcatggaatatgatatctgagaatggacagtctgcctcttcaagtgggttcctgacccctgagtagcctaactgggaggcacctcccagtaggggccgactgacacctcatacggccaggtgcccctctgagacgaagcttccagaggaacaatcagggagcaacatttgccgttctgcaatatttgctgttctgcagcctctgctggtgatacccaagcaaacagggtctggagtggacctccagcaaactccaacagacctgcagctgagggtcctgactgttagaaggaaaactaacaaagagaaagaacatccacaccaaaaccccatctgtacgtcaccatcatcaaagaccaaaggtagataaaaccaataagatggggagaaaccagagcagagaagctgaaaattctaaaaatcagagcacgtcttctcctccaaaggaatgcagctcctcgccagcaatggaacaaagctggacagagaatgactttcacaagttgagagaagaaggcttcagatgatcagtaataacaaactcctccgagctaaaggaggatgtttgaaccttttagcaaagaagctaaaaaccttgaaaaaacattagacgaatggctaactagaaaaaacagcatagagaagaccttaaatgacctgatggagctgaaaaccatggcacgagaactatgtgacacatgcacaagcttcagtagctgattcaatcaagtggaagaaagggattgaagatcaaatgaatgaaatgaagcaagaagagaagtttagagaaaaaagagtaaaaagaaatgaacaaagcctccaagaaatatgggactatgtgaaaagaccaaatctacatctgattggtgtacctgaaagtgatggggagaatggaaccaagttggaaaacgctctgcaggatattatccaggagaacttccccaatctagtgaggcaggccagcattcaaattcaggaaatacagagaatgccgcaaagatactcctcaagaagagtaactcaaagacacataattgtcagattcaccaaagttgaaatgaaggaaaaaacattaagtgcagcgagagagaaagggcaggttacccacaaagggaagtccatcagactaacagcatctttcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaaggaacaaccagtaccagccactgcaaaaacatgccaaattgtaaagatcattgaggctaggaagaaactgcatcaactaacgagcaaaataaccagctaacatcataatgacaggatcaaattcacacataacaatattaaccttaaatgtaaatgggctaaatgctccagttaaaagacatggactggcaaattggataaagagtcaagacccatcagtgtgctgtattcagcagacccatctcatgtgcagagacgcacataggctcaaaataaagggatggaggaagatctaccaaggaaatggaaagcaaaaaaaagcaggagttgcaatcctagtctctgataaaacagactttaaaccaacaaagatcaaaagagacaaagaaggccattacataatgataaagggatcaattcaacaagaagagctaactatcctaaaaatatatgcacctaatacaggagcaccagattcacaaagcaagtccttagagacctacaaagagacttagactcccacacaataataatgggagactttatcaccccacggtcaatattagacagatcaacaagacagaaaattaacaaagatatccagaaattgaactcagctctgcaccaagcggacctaatagacatctacagaactctccactccaaatcaacagaatatacattcttctcggcaccacatcacacttattccaaaaattgactacatagttggaagtaaagcactcctcagcaaatgtaaaagaacagaaattataacaaactgcctctcagactacagtgctttcaaactagaactcaggattaagaaactcactcagaaccactcaactacatggaaactgagcaacctgctcctgagtgactactgggtacttaacgaagtgaaggcagaaataaagatgttctttgaaaccaatgagaacaaagacacaacataccagaatctctgggacacatttaaagcagtgtgtagagggaaatttatagcactaaatgcccacaagagaaagcaggaaagatctaaaattgacaccctaacatcacaatttagagaagcaagagcaaacacattcaaaagctagcagaagacaagaaataactaagatcagagtagaactgaaggagatagagacagaaaaactccttcaaaaaatcaatgaacccaggagctggttttttaaaaagatcaacaaaattgatagatcactagcaagactaataaagaagaaaagagaaaagaatcaaatagatgcaataaaaggtgataaaggggatatcaccaccaatcccacagaaatacaaactaccatcagagaacactataaacacttctatgcaaataaactagaaaacctaaaagaaatttataaattcctggacacacacaccctcccaggactaaaccaggaagaagttgaatctcttaatagaccaataacaggctctgaaattgaggcaataattaatagcctaccaaccaaaaaaatccatcaggaccagatggattcacagctgaattctaccagaggtataaggaggagctggtaccattctgaaactattctaatcaatagaaaaagagggaatcctccctaactcattttatgaggccagcatcatcctgataccacagcctgacagagacacaacaaaaaaagagaatttcaggccaatatccctgatgaagatcgatggaaaaatcctcagtaaaatactggcaaaccgaatccagcagaacatcaaaaagcttatccaccatgatcaagttggcttcatccctgggatgcaaggctggttcaacatatgcaaatcaataaatataatccatcatataaacagaatcaaagacaaaaaccatgattatctcaatagatgcagaaaaggcctttgacaaaattcaacagcctttgtgctaaaaactctaaataaactaggtattgatgggacatatctcaaaataataagagctattcacgacaaacccacagccaatgtcatactgaatgggcaaaagctggaagcattccctttgaaaactggcacaaaacaaggatgtcctctgtcaccactcctattcaacatagtattggacgttctagccagggcaatcaggcaatagaaagaaataaaggatattcaaataggaagagaggaagtcaaattgtctctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattgtttcaaagagaataaaatacttaggaatccaacttacaagggatgtggaagacctcttcaaggagaactacaaaccactgctcaaggaaataaaagaggacgcaaacaaatggaagaacattccattctcatgggtaggaagaatcaatatcatgaaaatggccatactacccaaggtaatttatagattcaatgccatccccatcaagctaccaatgactttctccacagaattggaaaaaaactactttaaagttcatatggaaccaaaaaagagcccgcatcgccaagacaatcctaaaccaaaagaacaaagctggaggcatcacgctacctgacttcaaactatattacaaggctacagtaaccaaaacagcatggtactggtaccaaaacagagatatagaccaatggaacagaacagagccctcagaaacaataccacacatctacaaccatctgatctttgacaaacctgacaaaaacaagaaatggggaaaggattctctatttaataaatggtgctgggaaaactggctagccatatgtagaaagctgaaactggatcccttctttacaccttatacaaaaattaattcaagatgaattaaagacttacacgttagacctaaaaccataaaaaccctagaagaaaacctaggcaataccattcaggacataggcatggacaaggacttcatgactaaaacaccaaaagcaatggcaacaaaagccaaaattgacaaatgggatctaattaaactaaagagcttctgcacagcaaaagaaactaccatcagagtgaataggaaacctacggaatgggagaaaatttttacaatctacccatctgacaaagggctaatatccagaatctaaaagaacttaaacaaatttacaagaaaaaatcaaatgaccccatcaaaaagtgggtgaaggatatgaacagacacttctcaaaagaagacatttatgtagccaaaagacacatgaaaaaatgctcatcatcactggccatcagagaaatgcaaatcaaaaccacaatgagataccatctcacaccagttagaatggcgatcattaaagtccggaaacaacaggtgctggaaaggatgtagagaaataggaacacttttacactgttgatgggactgtaaactagttcaaacattgtggaagacagtgtggcgattcctctaggatctagaactagaaataccatttgagccagccatcccattactgggtatatacccagaggattataaatcatgctactataaagacacatgcacacgtatgtttattgcggcactatttacaatagcaaatacttggagccaaccaaatgtccatcagtgagcaaggacatcattctgagcaaactatcgcaaggacagaaaaccaaacaccgcatgttctcactcataggtgggaactgaacaatgagaacacttggacacagggtggggaacatcacacactgggacctgtcatggagtaggggtaggggggagggatagcattaggagatatacctaatgtaaatgacgagttaatgggtgcagcacaccaacatggcacatgtatacatatgtaacaaacctgcaggttgtgcacatgtaccctagaacttaaagtataattaaaaaaaaaaagaacctggagaaattatcaagtaagcatcatatttaatgaatttatggtgaaatcatgtgggaaaaatttttctgtacagggatgatgactctggaaatggtggagagagagacagaaaaacaaatgtcactgtaacacaggtatttaaattgtatttaaatacacagacttttgaatttatagaaaattttcaagtatgaaattgatttcatgcaacctaaagtctcaaacttcaaataattttttgtgttaaatttataaattgtgtattaatgcaattcaaatttattcctaaaaatattttaactaaaggagaaattcctggggcctgagattagagttttaggaaatgtacatatgggataaacttacacaggctgaaattaagtgaaaccttacttctcaatgttgagatggattagccattttaacataaagtagaaacttctaagaaatgcagaatctcaacttccccaccctcattccacctaccccacccactcaatcagatcctgcatttcaataagatttatttagtgcaataacttttttacttatcaaagttgagaagcacaggactaaatgataaagagaaaagaggctgcttaggataaggaaataaaaggttgaagttaacttaagtattatgatactttcttagcgtgtcatacggttacctgtcatctttcctctttggttcaacttgttttatggggacatttatgtgggaaaatatctttgcttttgtaatttatgtgggaaaatatctttgcttttgtgtttttacttaagtaaaatctgggctccttttatgtcaactagcttttccactattgttattatgatagaaagtacaggctacttataaacatgattagttcaatgagaacttttagaatattgctgacctaaatctggacatctacacaatcattaattcttaccaaaatgctacaaggcaatataagcataattagcctccctgatccctgaacatagcctaatatcactcactcaatcagaatcatactggaaacgatatgaccaactatggcaggtagtagatgtccagtcacactagtattgctttcagccagatgtctctggtccttgtgagttcctttcgtccttaatggtgaaatagcaacagagggaaccaactcactcactcaaggcagatttcttatttctagacttgtcctgaaaccaacagatccagctctctcctaccaaataccatgaaatttaaacaaacgaaactcgcaaaataatacagcagcagcagcaacaacaacaatgaaatattaaaatagtaaatataagtatcaaacatcaaaaccccctctccaaccaaaatctctcttcttcgataaagttcccaggaggtaacccaatttctaggttggtgtccaatatttgggatcatttgattcaagactgaagtacttaaaatggcttttaaaaaaggaaaaaaggttagatttccagagaaaagtgtaacattttttaagttgaacattatgagggatttgatgggggcagctttgcaagtagaactggagactggtccactgttcaggctttttacgaaagactgcaaaggttgtttgtttccaaacaccaagaagtcaccaagttcaccagtccaaatgcaaatgactcacactaggaaccctaatagtgctgctgttaagtcatttgcaaatgggtggggctgagatgacacagaaccctattttcccaggtggcatcttaagtatggttgattctaccttcagccccacatttaaaagtacagtgtaaacacagctaagggaccgcctccttcaaattacacacaaggcacacctactaataggagatgttgtgaaagccaggtggggctttgtctttcaagtccctgcatccaagaataagcatgctgtgtacaaaaaaaaaaaaaaaagcaagggtgatgcaactgcattcattgtccctaaagggagaacatgcaataattctcagatccaaggataaagggaatccccctttaagaaaagatgttggcattatgtggggattgggaacatgccagaacaatcacacatttttacaagagagagaaagagaaaaaaagttaagacccatttgtcttatttcagtctctttcttcagaattgacgactttaatcaacaggtcactttcagagtattgctggacaccttgactttctgccatgaaatgctatgggaattctggcagttgagagccaacaccccactagacaccagtgctgcataaccacacttttaatagaccccagagctgtggtgacagcatgcccttcccagtttttccacagacggtgctcctgaaattttccatagacagtgtattcttgtggttaattagttatctgagcaatttccattatagaaagagtatctgtacataattaaacccatcttaggaccaaactgccgggcttcaatgtcattaattcagaagggctaaaatgaaaatgagatgaataattctcacctgatgaagggaccgcactagattagatcctatcctctgaaatacatacagcattaaatttaaaaaaacaagagagatgaaaacaggtgatggaagaaactggaaaggtaagttgcctctagagaccaaagaataacactccttttcaaactattatcaagaaatcttgggggaaagataaaattagcaagagaaggctattagctctctgttactcacctttatgaaaccattttcagggatcagtttgttaaattccactgaaacgtggaggtacacagcacagcccttcttctgggatgcacagtcatgccatacagaagcgtgtgggtagacgccaaaacatgtgtggacctgcaaccctttctgtagaaactcagcattctgagtagtaacaaggattaaccttgtgcactcatggagaaaactggtggctccacacatccagttgtccttcgggttatttttgcatcccactctataatttcttttaattacttaactgtaaagcacaggaaagtgctcattacttgtagcttaatgcaggaggaaatataattgaatatgttctcctagccactgctctaccccagctcccagctcttctgaagtgtcacggttcatttcaacagcacgagtaaggcagtttccaggccctgtgcataatgagccatgtggaccctattcaagaaactggctgtactccagaactactataaaatataaggaaaatattaacatcttagatgacaaaagatccatatggctggccagaaaatatctgcatcatttaagccattagaatgcacctatatggaaacattcaatttggcggtactgtgaacaacaggactgtgaaaacatctgtttatctccacccgttttcactaaacactgattcctatagaagacatgcaaactcaaataccaacatatttcatctaagcataggacagggactccatttttacatagttgctataataaatacaatacagtatttgttggtgataggattttggaagatgctctggatagctggaaaaataagtaaaatgtttctctttgtattaaacttgataaaaaataatagctaacatttattaatggtgaggtaaataatttgattatccaccatttatagctgaggaaactgaggcccagagagtttcggtggattccctaagatcacatacccattatgtggtggagagggaatatgaaccagtgctggcttgctatgcctctttccatatggggtcagacatagatgtggtgtcttataatgtgagggaggtctacttggcagaaatatcctgcagaccctatatgccagtttcttatttatttaaacaaagccccatatgagcatttctgataagcagtttgtttacacactaattccacagaggttaaatataaccctaatgtttctttgttgctactctgtttccagtattgaattattaccacaaggtaccaaccatatatgcatacttaatagggtattttgtcaaaactatgcatgaaggtcatttgtttgagatgtcagaacattttcccgtgagaagatctcattgggcattgaaacagaaccacatgctcttcagaccagcaaccgcgactaccaaatactcctctgtcaactctacttgagtaagaacgctttcaattaaggcctaagtgtcaacatgcctttaaaaaaaatcgtggtgacacaaaatctttctttttagcacccaacagaatcccttcaaagcctcgtggtctgacaccctatgctacgtgacttgtgacccatccatttgtcatgttcttcgggaatgtggctaaggggctaagatgtgacttgaaaagaaaggtagaacaagatcatctcaaatttattatcaaggaatagttcagaaaacgacttcagaccacagagacagcagaacagatggtccggcatggatagagcatcagacactcacagactgtgccaacaagagccatcgagtcaaaacagccaaaggaaggagggtcatggaatgggttctctcacaccaaactgatgcccagaggccctcagcatgaataacaaaggcaaccagacccacaagccatactgagtggatacaaaacctatacctaggctgacatcccaaatgtgtgtggcaagttagatgatgatggcacaaaagacagaacaccttgcttctggccattgtcagctcttggaagagagcacacttttagaggagcagctgcaaggagcctgagaacaaaactggaaatgtctgttatgaaagccttcacaggtattattaacaaaagaaaatgtctatttgtcaatggtgtttcagctagattttggcagtccattcttatgcccaggaatgacctcttgtgtagactggatacagtcatcaatgcaactgtccaggtgcaactcttctataaaggggaagaggagtgactttcccctatacagtggccctgtcaaaattctataaaaaatattgtccatttaaattaaataaccactgtgcccggctccatttaccacacttttctatgcagtggaactgaaggggatttttttttttgctgtcctcagagaaaaataagactaagaatcaacctttctaatgagaatggtaaggagttatgtggggatgacctggaatatatgctgctcaaatggtggagatgttatctaggccgtaaatcatggcatttttatatgatcccctatttgcctaatgcaggaaaccacttggcaactttaaggaaaaagtctagcaataatgcatcatagttcaatgtttatattgtacttggacagtttaaatttatcttataaagtactaattatttaattacaaatgttgagtaagtgtaaaatcattcctcaaaaaagcatcccttgagtatgaaagttccaagcttagcaagacatccctgtgatttgggatacatctcttgaactcagtcctgaaaataatgttaatagctgagaaaagagcattgaaagccttatacacagtgtgttgtagtgaaacaattttctttttggttctaaaaaacactgttgtgctctttagatccagcatggctagttagatgaataatgaatgcatgttcaactttctgctacaggaaattctgcaagtggcaacgtgggtccattccgtgtgtgtcactagagctggcgcaagcccatggccatggtgaggcagcgtttccactggaactaatctgatacctgcaccagctcttgcaactgtgcagtgttcccactgcaaactacggatggggtaaaagactgctcacctcctatttctcatctaatctcacacactctgtttgatgaggctatggagaaacaggtcttctcatacactaaaggtgggagtacaaacaattcaagccctgtgcaggacaattaggcaatacctatcaaaattatacatgatttttcctgctgacccagcaattccacttctgggaataattgacagatataggtgcatatgtacaaaatgatggaaagctctctggtatatattagtaagtgataaaacaaggtgtaaaatagtgtatatatggctactaccttttgttttaaaaatgggggaaaatggtggagcttgcggtgagccgagatcgtgccactgcactccagcctgggcgacagagcgagactccgtctcaaaaaaaaaacagggtggggtgggggggaaataatagtacatactcatatttacctgtatctatataaaacacactatcaaggattcacaagaaactaatacaaatgatcaccttatagatggtatgtattgggggatactgaggtgagcagggtataagtggggcaagacttttcagtgtaaacttcttttaaattttattttgatttttgaataatgtaaattaactgtcaaataattaaattaaaaataaccaatttattaacaaaacatttaatctagtggctttacttttgacacaagacaatctccaaatctccaccaatcaccaaaaacagagatttacaccagttcctttgcttgtttttcctggtaatgactacaattaagaagtcctgtgggtgccatctcagttttggagatatttccctagaagaaactgattcaaggtgggacaattgggtatagagaatagtccctgggaccgggggctgaagtcctgaattctggtcctgcctaactcccactttctattaagctgaccctgtgaaacggctgatacatgaccattttttaccaacaaattagacaaattcatgggtgatcaaattcaaaaaccctgttgccttaccactgtaatatgatgaggacacgtatacacaccctgcctaactcacagcatcacaccagggattgtcaacatatgggaaagagctttgtacattgtaaaggtcaaccctacaaacagcagctgtgaaacacaacacaaccctgagggggtggccatggccaaacataggaggggaaaaggacccagtctcaaaagcatctgagatactgagatagtgcagaggaatgaaatcttccaaaagatggaatctaaacataaacagacatcaagagcgggctgacttgcagtggaagatgtggttaaatgactccacatgtggtcatctgccattgcatacactgcaaattctgtgaagcctactaagggaaattagggagatgtaactgggagcgcactgtaaagatactgatacgaacacgaatgtgagatcaatgttgaatgatggacccaaaaggatggctcttagtccttgtgaacatatagttgttggagacatgtgtctgtcatacacagataggcctccaactcacctctgaaatcagatgcaaacttcaaatacttttgaaaagtctccctagaggaccttttacccccaaatgtagagactaaatgaaaaaccattctttaaaaggggttaaaaaaaacactcaaaaaacttctcctttccacatgtatagtcatctggaaaacagatctcccattaaacggatggtcaaagctgtatcacaacattaaactaagcacaaaaattcaagacttcccttcctcaccctcctaaaacgaaacattccaataggctagaaataacctcatgaggaagttcattgaaggtactcccacttggcactactatccagacactgggttaggaaactagttacttggaactcagaaaaaataagaactattttgattaggcaaggcccctgtgcaaggtgcctagttccagctgggtctcagtagtctgatgggtgtcatgcactcctggacctcctcttaatgaaacaagggaccttgactttgggccccatgttgagaagctctgaagccaaatataatggtcaaatataatgtcctctcacttctagcttcatagcagaccatgtttccatatagaaatttctctaggaggcttactatcctatgttatctcaagccgaggcctcctcttacacaagaggcttaaactgcccgtaagtaagaattaaagatatgttacattttttatgaattagtcatttattcattcagcaaaggttattaagaaggtactgagtttggatgtactttgctttaggaaaatcattttcaaggttgcttcatgcaaagtgggaataattaacttggtaactcaatagacttgctaagtgattgccccaagtttaaactgtcactgatttgcaagtatgacatgaaaaccagagacccaaggaggtgggcacattcccacctgtcaatagccctcaagagaagtgcttcagtattaccccaaatggccaactttgcatggttaatcatttagttagaggctcacaagatcaaaaacaattcttaaaaaactatttatgtgaacaaagggacaatgagctgacaccttcaaggtgcacgtcaggggcacaatacaagttcctgtttcaccagcagagctctggtcgctcagttgaagctgaaagtcagaaccagctgtgtttctgtcattccctcatatgaaaagaactcagctgtagacctttactccatgagaaaacattttttaaaaacccacaaataatttttaggtttcatttttgcctctgctttctccagagctacaaaggtcacccaaatttctgtggcgaggttatttaggagagcctttcttttggatgtcaacttgtcaaacttgcagtttagatgagtgtgatgtagtctcctaaaatttacttttgcactattttttcaaataatagatattctctgagcacaggcactgaggacatcaaaatgaatgagactgaatttctgcccttggggactgcagtgttaagggtgggttagacccaaaaaccaacaatacagtgcaatgtggtacatgctgtaactaacatgcacaaagggcattcccaaaaaagagaatgaaaagagggaggaaggtggcaaaggagaaaggcctttggcccaagtttttgttcaataaagatcatattttgtagatcaaaagattatatgatctgctaaccccttagcatgtatagctcatgaagcaagacaaagtacccatgaagagttcaacattagcgagcctctggggcaagtaagttggaaatcataacccatttatggatacctgcctagaactgatttcctattcagagtgccttcctagctgataagaacaatactgaaatctttcttttccatgagggaaaaacatgttgaatcatttagcaagtacctacagagccacctactatgtatgtgcccagcagtctactgtgtgctatcaggagtaagaaaatgtagaaatattcttgcttttaaagggtttacaatctaattgtagaaataatactaaaatacatgagaggaaagaaaagcaaacttagcttctctgggataaggactatatctcatgcaacttttaaaaagttaccatttattcaacttcctaccaccattacatacttctggtaatcaattatcttccttctccccttgggattttgaattgggaacagaatagaaataagttgccaaataagaatcaaaatacagggtcagcctcaatttcagtgcaagtggtccattgctttggttcacaggctctacagtccagaagatgaaagattaaggatttcatccatcagattaacctctcctcttttcacagaaagaacaagtaatggggataagagaagggcctagaatattcccctgaaagtgttacttattaggaagcaagttcccttgtggaaacacaaggatgggggaaagggatttccctcaacattgttctatctacacacagagaattcaagtaacttgcccaaaatcacagagctagtaagtggtgaggcttaaatcaaacttgatcatcaggtccaggaacacaggtacaggctggggctgcctcatgaagtgtctgtttaggaaatgtgtctttaaagtcaacagactgtcctgagtaggacattctagaacatttttctagacaaaaacatcatatctacaacttccagcctagaatctgatacagcaaagacacacaataatgttttgttatataagtgcatatacaattaattaccaaattatgaggtacagaccacctaggaactcagatagggcaggtttattattatgggcaagagtctttctagaaacaggattccagctaggtcttgaagaatgagtagaattcagatgaataaacagcagaaaaaatcattaataaacacatgagactcagagaattacaacaaaacagttttagtcttgtaaactttgctataaagtgaagcatatttaggtatgaagcatgctgattaaactttttattgtcttaatacaagtctaaaaaaagtatctttttgggggagctggaaagtactaaaaataaaaacagtggctgaaattcattaagcatttactatgccaagcactgctctaagcacttcacagacactaacacatttaatccctaccaataccctgttgagaggttgagatacagagaatttaaattactgacccaaggtcatagacctagtaagtgttaggcctggagtcaaactcgatcctcctctggctcaggaatattgttccaggcctttgctctcacctggaagtttctaattagaaaatttatttcaagtcagaataaaatcttcagcagttctctcatctcaaaatgtctgaatttctgattatttacaaggctgcaaatcccttctagccacgctctaatgcaagtacttggatagtgaaataaacgataagtctctctaaatcacaggatattcagtttatttgattttagttcagcgattcttaaactgtcccatacatccaaaccatctgtagaagtttctaaacccaacataggcccagggacccaataccaaacttacaaatcttggagactaagatctcatatgtatatatattttaaagattcaagggtaattctgatgctgaatgtgtttgagaatcactgctgtatgctgcattctattttattgtatttcttttattattattattataataataataataatacttttaagttctggggtacatgtgcagaacgtgcaggtttgttacctaggtatacagatgccatggtggtttgctgcactcatcaacttgtcatctacattaggtatttctcctaatgctatccctcccctagcctcctacaccctgacaggccccagtgtgtgatgttctcctcccagtgtccatgtgttctcactgttcaactcccacttatgagtgagaacatgtggtgtttggttttctgttcctgtgttaccttgccaagaatgatggtttccagcttcatccatgtccctgcaaaggacatgaactcatccttttttatggctgcatagtattccatggtgtatgtgtgtcacattttctttatccagtctatcattgatgggcattcggattggttccaagtctttgctattgtgaatagtgccacaataaacatacatgtgcatgtgtctttatagtagcatgatttataatcctttgagtatatacccagtaatgggatggctgggtcaaaagatatttctggttctagatccttgaggaatcaccacactgtcttccacaatggttgaactaatttacactcccaccaacagtgtaaaagtgttcctatttctctacatcctctcctgcatctgttgtttcctgactttttaatgatcgccattctaactggcataagatggtatctcactgtggttttgatttgcatttctctaatgaccagtgatgatgagcttttcttcgtatgtttgttggcagcataaatttcttcttttgagaagcatctgttcatacccttcgcccactttttgatggggttgttttttttcttgtaaacttgtttaggttccttgtagattctggatattagccttttgtcagatggatacgttgcaaaaaatttcacccattctgtcggttgcctgttcactctgatgttagtttcttttgctgtgcagaagctctttagtttaattagatcccatttgtcaattttggcttttgttgccattgcttttggtattttagtcatgaagtctttgccatgcctatgtcctgaatggtattgcctaggttttcttctagggtttttatggttttatgttttatgtttaagtctttaatccatcttgagttaatttttgtataacgtgtaaggaaggggtccagtttcagttttctgcaaatggctagccagttttcccgacaccatttattaaatagggaatcctttctgcattgcttgtttttgtcatgtttgtcaaagatcagatggttgtagatgtgtggcgttatttctgaggcctctgttctgttccattggtctatctatctgtttatgtaccagtaccatgatgttttggttactgtagccttgtagtatagtttgaagtcaggtagcatgatgcctccagcttgttcattttgcttaggattgtcttggctatacgggctgttttttggttccatatgaaatttaaagtagttttttctaattctatgaagaaagtcaatggtagcttgatggggatagcattggatctataaattactttgggcagtatggccattttcacgatattgattcttcctatccatgagaatggaatgttcttccatttgtttgtgtcctctcttatttcattgagcagtggtttgtagttctctttaaagaggtccttcacatcccttgtaagttgtattcctaggcattttattctctttgtagcaattgtgaatgggagttcactcatgacttggctgtttgtcattattggtgtataggaatgctcgtgatttttgcacattgattttgtatcctgagactttgctgaagttgcttatcagcttaaggagattttgggctgagatgatggggttttctaaatatacaatcatgtcatctgcaaacagagacaatttgacttcctctcttcctatttgaatatgctttatttctttctattgcctgattgccctggctagaacgtccaatactatgttgaataggagtggtgacagagggcatccttgttttgtgccggttttcaaatgaatgcttccagcttttgcccattcagtatgatattggctgtgggtttctcataaatagctcttattattttgagatatgttccatcaatacctagtttattgagagtttttagcatgaagggctgttgaattttatgaaaggccttttctgcatctattgaaataatcatgtggtttttgtcattggttctctttatgtgatggattatctttattgatttgcatatgttgaaccagccttgcatcccagggatgaagccaaattatcatggtagataagctttttgatgtgctgctggattcagtttaccagttttttattgaagatttttgcatcaatgttcatcagggatattggcctacaattttatttttttgctgtgtctctgccaggtttttgtatcaggatgatgccggactcataaaatgagttagggaggattccctccttttctattgattggaatagtttcagaaggaatggtaccagctcttctttgtacttctggtagaattcagctgtgaatccgtctggtcctgggctttttttggttggtaggctgttaattactgcctcgatttcagaacttattattggtctattcaggaatttgacttcttcctttagtcttaggagggtgtatgtgtccaggaatttattcatttcttctagattttctagtttatttgcatagaggtgtttatagtgttctctgatggtagattgtatttttgtgggatcagtggtgatatcctctttatcatcttttattgcgtctatttgattcttctctcttttcttctttatcaatctggctagcattctatctattttgttaatcttttcaaaaaaccagcttctggattcactgatttttttgaagggttttttgtgtctctaatctccttcagttctgctctgatcttagttatttcttgtcttctgctagcttttgaatgtgtttgctcttgcttctctagttcctttaattgtgatgttagagtgttgattttagctctttcctgctttctcctgtgggcatttattgctatgaatttcccctaaacactgttttagctgtgtcccagagattctggtatgttgtatctttattctcattggtctcaaataatgtatttatttctgccttctttttgttatttactcagtagtcattcaggagcaggttgttcagtttccactgtagttgtatggttttgagttagtttcttaatcctgagttctaatttaattgcactttggtctgagagactgtttgttatgatttccattcttttgcatttgctgaggagtgttttacttccaattatgtggtcaattttagaataagtgtgatgtggtgctgagaagaatgtatattctgttgatatggggtggagagttctgtagatgtctattagttccactgggtccagagctgagttcaaatcctgaatatgcttgttaattttctgtctcgttgacctaatattgacattggggtgttaaagtctcacactattattgtgtgggagtcttggtctctttgtgggtctctaagaacttgctttatgaatctgggtgctcctgtattgggtgcatatatgtttaggatagttagctcttcttgttgaattgatccctttatcattatgtaatggccttctttgtctcttttgatctttgttggtttaaagtctgttttatcagagactaggattgcaacccctgctttttttttgctttccatttgcttggtagatcttcctccatccctttattttcagcctatgtgtgtctttgcatgtgagatgggtctccagaacacagcacactgatgggtcttgactctttatccaatttgccagtctgtggtcttttaattggggcatttagcccatttatatttaaggttaatattgttatgtgtgaatttgatcctgtcattatgatgttagctggttattttgcccattagttgatgcagtttcttcatagtttcaatggtctttacaatttggtatgtttctgcagtggctggtaccggtttttcctttccttatttagtacttccttcaggagctcttgtaaggcatgcctggtggtgacaaaatctctcagcatttgctcgtctgtaaaggattttatttctacttcacttctgaagcttagttggctggatatgaaattctgggttgaaaattcttttctttaagaatgttgaatattggcccccactctcttctggcttgtaggcttgtagggtttctgctgagagatccactgttagtctgatgggcttccctttttgggtaacccgacctttctctctcgctgcccttaactttttttcctgcatttcaaccttggtgaatctgacaattacatgtcttgggtttgctcttcttgaggggtatctttgtggtgttctctgtatttcctgaatttgaatgttggcttgtcttgctagtttggggaagttctcctggataatatcctaaggagtgttttccaacttggttccattgtccccgccactttcaggtacaccaatgaaatgtaggtttggtcttttcacatagtcccacatttcttggaggctttgttccttccttttcattctttttttctctaatcttgtcttcatgctttatttcattaaattgatcttcaatctctgatatcctttcctctgctttatcgattcagttattgaagcttgtgtatgcttcacagagttctcgtgctgtgtttttcagctccattaggtcatttatgttcttctctaaactagttattctagttagcaattcctccaaccttttttcaaggttcttagcttctttgcattgggttagagcatgctcctttagcttggaggagtctgtttttacccactttctgaagcatacttctgtcaattcatcaaactcattctccatccagttttgttcccttgctggcaaagagttgtgctcccttggaggagaagaggcattctggtttttggaattttcagcctttttgtgctggattttcctcatccttgtggatttatctatgtttgatctttgatgttggcgacctttgtacggggttttcgtgtggacatcctttttgttgatgttgatgctattcctgtttgttagttttccttctaacagtcaggcccctctgctgcaggtctgctggaatttggtggaggtccactccagaccctgtttgcctgggtatcaccagcagaagctgcagaacagcaaagactgctgcctgttccttcctctggaaggtttgtcccagaggggcacccaccagatgccagccagagctctcctgtatgaagtgtctgtcgacccctgctgggaggtgtctcccactcaggaatcacgagggtcagggacctgcttaagaaggcagtctgtcccttagcagagctcaagtgctgtgctgggagatccactgctctcttcacagccaacaggcaaagaacatttaagtctgctgaagctgggcccacagccaccccctctcccaggtgctctgtcccatgagatgggagttttatctataagcccctgactggggctgctgcctttctttcccagatgccctgcccagagagggagaatctagagaggcaatctggctacaggggctttgctgagctgtggtaggctccacccagttcaaacttcccagtggctttgtttacattgtgagaggaaaacagcctactcaagcctcagtaatggcggatgcccctcccccgaccaagctggagcatcccaggttgacttcaggcagctgtgctggcagtgagaatttcaaaccagcagatcttaccttgccgtgctccatgggggtgggatctgctgagctagatcacttggctgcctggccttcagcccctttccgggggagtgaatggttctgtctcactggaatttcaggtgccactggggtatgagaaaaaactcctgcagctaactgggtgtctgcccaaatggccacccagttttgtacttgaaacccagggccctggtggtgtaggcacccaagggaatctcctggtctgccggctgcaaagactgtaggaaatgtgtagtatctgggccagatagcactgtccctcatggcacagtccctcagggcttcccttggctaggggagggagttcccctgaccccttgcgcttcctgagtgaggcaatgctccaccctgctttggctcaccctccatgggctgcacccactgtctaaccagtcccaatgagatgagcccggtacctcagttggaaatgcagaaatcacccaccttctgcattgatctctctgggagctgcagactgcagctgttcctatttgccatctggccagccacctaatatttctaatcattcacttagcaagagtctcaggtttaagtaaaattataactaagttactaaggaacaatacatcaaaagtcatatattcatttttccctctaagagttttttcttttttaaaaaaattaaattaaaaaactccttggaaaaaacatttttaatcttcccattaccactttattccttggcacacagaagggtaccagtctctgctggagacaaaggtggacagtaggccagggtgacaatatcagcctgttcctgctccaggtctcacattaatgcatcaagggcaagatatggtttcttacttgaatactgcaggttttggttatagacagctggagtggtggtaaggggactaggttaggtgaagtcactgggctatcatccttgctctggttctacagctgtgcattttggattgctatttagcttctctaagctccagtttcctcctctgttatatagaaataatgtctgccaatcttttttatagagttatttgtaggatcaaatggaatgagatatgtgaatgcattttaaaaatgtatggaataccacacatttggacaagattattattgaagtgtgcaatcttgtctacatgacaagtgaaatcacgtaggaatcgtagtaacaacaaaccagctgaattttggtctcagtaccaatgcctactggggcactgcagtagagcaagttttcctaacacctcatggaacagtgacagtgaaggttctcctaggtttttatgtgagactgcctgaagagcaattacaggctctggaacaatagatgctactaagtttattttattttattattattttttattttactttaagttccgggatacatgtgcagaatgtgcaggtttgttacataggtaaatatgtgtcatggtggtttgctgcacctatcaacccatcacctaggtattaaggctcgcatgcattagctatttgtctgtttgtcctgacgcactctctcccttcccctgccccctgctccaggccccagtgtgtgtggttcccctccctgagtccatgtgttctctctgttcagctcccacttatgagtgagaacatgcagtgttaggttttctgttcctggctaccaagtttaagaaagtcattgtcagggatgtgaaaatcagaaaaataatctggtattttaggaaaagcacttaaaataaattgtattaatgacaccacattttaatgattaataaaatacttgataaggcaatcctgtattaatattcaaccatttatacatgattatttctaaacattatacaatgcaaaaaaattcacatgtttaaagaagtatctactttatcaggtaccatttgtgaatactctcaacaagcaggtgaatacaactctcaatgcaagtgaatatacacagaaatgggcagcaggatggtcatttgcctgtctgtcttgcttgggagtaaaagagaaggctaggaacatggctgtaggtttggtactagaagaaaagtgggacctattccgacttcctgatcctgtgatttttttctttttttgagattcacacacacacacacacacaaactatgcacaagtttgcttccatgttgtatagcaagagtttaaatatttctgagttaatgatgccaaactgtgctccgattatatcagcatatttacatgatccttgaacaccacatatagattcctatactacacatttaagcaaaatcacctcctgacttcacaatgaaagagacctattggattaaaaagtggtttctagtaaaccccaaagagatactgttactaaattactaaatttaaaggcaaaatagtattcactaaactgatttttctgtcttattttccttatttggcataatcattaaccaacttctagtaaatggaagcattctcacaatttaagtttttttagggggaaacacacaatttataaatactgtcaagtgaagaacagattcctgaatactaaaagacccatgcatatccttgtatgtaaaaaaaaaaaaaatccatcataaaatcatagactcaaacaccatctttgattcagtagttctccctctactgtggcttctgctatagagtcattgttaaaaagagttcttcatgaaagattctcacatagcaaaatgctttaagaaaatgtctaacaaacatttttattgtctcaatttgtacacaaactgacacctgaaaatcagagaggataaagaacttcaatctttaaaaaagagaggtaagttattccaaaatgctaccagtcaataattaaaaatacagtttgggggcaagaagttctgaaataactcagagaacttgctcaagattttacttttggaccagtcctctttgggagggagtatgtgaataggtaatgaaagccttatatgagagagtcaatggagagccatatcaaggagcacctgaagatatatggatcaatacagggaaaagaaatccaagtagcccagtgcctgacactcactgggcactcaattaatgcacggtgaattaacaaatgaattaatgaaagaaccatttgctacatataacattcttactttaagaaaaaagaatttgaaacagaagaaaacatacacgcaagaacacatacaaactataaactatatgatatcctaaaggagatgtaaatattaaactgtttgctttgctgactgacactattaatacctaaaagcagtatgagagatcacaaagaataagtactcattcatacttggagtgggctgctcatcttatggtctaacttgcattttatgtcatggccatgttgcttaatctccagctgttctacagaagagcaaaataagttataaataaattattaaagaaaaaaagtaactctatccatgctgaggcctgagggagttgggggaggagtcaattccttttagtttatatttaaaaagagaaactctttggaaaactgtaatatctgaagattttgtggtttccaaaagtgaaggtgaacggtgagaagttttcttagtttagctactgaaccctaaaaaaatataacctcaaaagttaatttcttaagcaatttgggcacctgaatttgataagaacttttttttccagacattctgttctgtctaacccaaaggaaaaatagccaattttgagaatctgtatacaaataaggaaaagtaaaatacagcgctttgcaaagaaatgggagggatttctgatactcaattcatgatgctaaacacttcaagtagatgattcaaaggcagaaatatataactgttctcattaggattgtttatggactataaataaggagcagacttatggccaatgcattagaaaaaaacaagtacaaaggcacttcagaaaataccttactccaacctcccattttagtgtcatttctaaaagggtttcatttcagccttcctacctttcttccttccttcccttccttccctccaacggggtctcactctgtcacccaggctgaagagcagtgggacaatcacggctcactgcagccccaacctcctgggctcaaacgatcctactgcctcagcctcccaagtagctgggactacaagtgcctgtcaccaggcttggataattttttttgtcttttgtaaagatggggtcttgctatgttgtccagactcgtaatgatctcctgggctcaagtgatcctcccacctcagcctcccagagtgctgggattacaggcatgagccaccacaccagacctcttttttctttattatatattcctctaataaagtgctctgtatgcagtgagcattcaatatttgctaaattaaattaatggaaagttttctaactaccatgtagagtatctaaatttacatcattggttctagaactgctgtctgaagcaacacaaattacacttatgacagttcgtcaaatctttgaagcccatcctcaaaataaggatgtcaaaaatacatcacacatgttgacactctaatctcccagccacagtaggcattagcaatctgaatgttatttttactaatccttcacagttttagaattcttctcaacccaacattcaaaaaccacttgccattccagcctaagttttcttgtccctaagtcatgcattccaagtcccctcaaccattgctcacatgcaatgctttcaaattccctatgcatcctggtcacagtgatttgaatgtacactaatttatcgatgatgtacctaaaacaacttatttcatttccttgaactgatgataatattctagatacagtctatttaaaaagtgaagaattattagcttctccatttcagtattatatttctagcagtgcagcccaaaatttcagtagctatgataacagcctcttgtcacaccactggcttatactgaacttgcagttaatttaaaacattcaagcttcctttctacaatctgctgataagtcatcccctaaaaccgtgcccgcaactctctattctctcctaaattgatttttttgtacttaatcatagtattttacatttaagtaaatgtaaatgatccagattctatcattcaacagaatgtctgcaatatctgctggctttatgtttcatatgataagcatatcgtctgtgccttcagacacattatcagccaacatgtcggtgctggatgtattttcccaatgttgcataagaggaataccttcgagagtttggcctaggaatgtggcctgggactccgccaagcatctctctccagcaaaatgactgcaaatttctcgaccttcagattctacatgatgtaaaagaagtttgtctgtgtttaaaaacacattcaagaaataagtgaacatgtgaaaagacagaaaaacttgttttaatttgggcatagtttcagttttcaaaggcacatgaaggcagaaagaaagaatcacaaaatggaactactgatgatagcaactccaaaaccaagactgattagactaaatcccatgtggcaaaaattttatttagtaagtttccttctccctctctccctttagatatatgtgcatacacacacacgcacctttattttagtaattttttttttctgaaaaagaaagttttctgcacctgattgcttccatgaataacacaaagcacaaacaatatgactttctttggttatcatgcaattttttctctgcttaccagaaattggcacaaatttaagatatactatattctactccctgaagcacagtcgctggcatctccactggcatttaaaaatttgaagacatttaaaagaaaatccacaagcttatagttgctgtctaaatcaactttaacatttcatatattcacaatttcataagtgaatcaaattacacataagaaattatagaactaagccaactaaatgacttttataataggtactggggaaaaatattattaaaccttttcctccaatttctgcctttcttccagcaagacaaaccattttcatgaagtttctgtctacatcactagtgataatctgaagcagccattaatcaatctattagtgcattcagcaacatttatcaaagtgcctccccagaactgttttggatgctgttgtgggcgcatgcaaaaatgaactaaatatagatttttgtcatccaagaattttaagtcaatttgtaattattggttcctggttccataactttttttttttttttttttggtgctggctcagatgtataccttcatctattctaaggttaaggcaatccttataattttcttcctttttcttgtttgtttgttttttgtgtgtgtgtttaaaatcttgcttatatttgactttattttattctcacatcttctgagtacattaaagttaaaggtagatcataaatcgaaaacattcttaaaggtctctctactcaaattatttggtgttattgtatctcagaaagtataatgaattgcctgtagcaaataaataaaatcagaacctttatactcaatggttcggtttggtacatatccatgaaaataataaatgttaaaaaggatgctagccgttgattcctggcatgctattctacatttggctacattacaacgttaaaaggatttagtgcatatatcaaattgtggatctgcttgttttaaaatttcatctgtaattccacatgcaacccccacccccatacacactcacaagatctgaatatggtaacaaggaaatcctagtaactgtagcgttggaaaaatggttcatatggaaataagccatttggctagtaaagctggtgattttgttctctaggtggcactattacttcaatttttggtgagttgcttaaattacttggaactgcccgtttattttctttgaattcccattttataaattttaattttatacaagctagttgtaattaaacgacaggttgccttctaggttttatttcagtaagtcaatttgaagttcagtgattttttatcatataattttatgtttccttactatactgtcttagttttaagaaatcctcccttgcctgacctcctctctccaaaaatgcagaggcatgtcaaaaacacagagggtcgtcataaagtttccgtcagaccaaaggaaccaagatgaaagcatgtttaagagctactaggttctgggagatttcaaaatcaggacattactaccatgacaaccaatgaaaagttctttcaagtgaacctttggggaaaactatataacgttccttactctctaggctctctggaaataaacttttactttattatggctgtcactaaagcttgtaaatttactttgcttccttccaatcgttctcctgtcccacactcagccccctaactcacttaatgcaacccatcctcaaacatcaatctataaatgagacatcagggcaatgagccacttcttagcatctagtatatttgataagatttgtctcatcaagaggataagtgccctagagcttctacttgaacttaaatacttaatttaaatgaaagcttccacacttatctgaccagatactcaaatttttctacagaaaagagaataccttcctgttccacttaaagaacacacacatttaccactccccctcctctcccctgcaaaaggttttcaatgtcagtacattagtgagctccattttgcatctgccatcaataatgattccatatagtcaataattgggttcatgacctttctaaatctttacagtgtaaatattctggaaatccagtgaggcacttaagtataaaattatttaggattaaataattctatgccttaagtagaagtttaagaggacgtttaggacacacatgactaagcctacaaataccaaagccactctatgtttcctaggtttaaataccacatgcaaataacatacggatttcatttgccagcatcatttattgcctaacattactccatactaaacagagtaaatggatgcagagtgtaaccagtaagtttgctcattcacttttgaagctcatctgtgcatgttattcatcctaataaagaaaatttatcacaacacaacttgatgcgattcttgttcaaatgatttcctcttccattgaacaacagccagcacttaaaacctagaattccacagaattctctcctcgattcctctttaaaatgcaattcacagtttgagatcacagagcctgccagtggctgaatggctgcactagatggctgagagtccttcaattaagcaacaattttgcaattagtggaaactgagtgctctataacaattgtttgaaaacaagttgagacaagttagcaattaccctataaaagggacatattcacttttgttggataggcgagacccctcacacaaattgaactcttccacacagggagatgcaagttgaaaattaatgttttaatcactaaaatcaaatccatattatgggcacctgaaatgggagtgcctttcttctcaaaagatattcagagtttagctatcatccactctctatgctgtctgtttttattcaggaagtctgaaattgttcttctgtactccgggattaatttcctacatctcaaaatgttaataaactacttgaacatgacctttccattctgtaaatttccttaagagtaagtctacgattgagacccaaagctgctggctgtgttatatttcacagttcacagttctctctctctctctctccccctctacacacacgcgcacgtgcacgcacacacacacacacacacacagagagagagagagagagagagagagagagagcaccccaggttttagaagatgaatgtaaaaagaatgtaaacaagttctctgctatactatcaggtgggcgtgcccagctcactgtgcgtgctgaactacaaaccagtgctattcatataagaaatgatatcaatcatctacattttgactattgaaaagctgggactcttaaagattccaggaaaaagggaatagcttacattttcatggcgccccttttaaacaggaaacccacggactttgagccaggattttagaaatttgcatttctttttttacaggattttccctcctggtgagtcaaaatgaacaagaaataccccaggacctcccttccctccttggccattaatgagatgaaggcaattaactcacatagtataaatgaatcatttgaggtgatgactgcattttaggcaaatgatgactttcttggttccattggtttgcaagtaaaagttacacacattgaaaagacactgaaacagatttcctaaatgcttcattttctggatgcaccaatgttgacctactatacatgttaaatggttttaaaatatcaccttaaaataaaggaaacttccagctactaactcagctctgaatgggctatgaaaggctccaaaggtatgtgaaaaattactgttattttgctttaaaaaatgtgatgtctaagagtgtctgcaatgttctaatgcttcaaaacatgtacgtaagccttgtttatctggaaatcatttctttctgcttatatcatttataaatagaaaatgttctgtaataacttaaaatagttccacatacataatgcttttagtgtcataatacttactactggtctatatttaccaacatttatcacattttacaaaatgaagtagaagaaaaaaaagacaacgactttatggccctggaattccagtaatggtgaccaacatgttttaaattccagtaaaggttatggttacatttcaacaagtgtctctttccttttttttacctctcctgctaacccagaggtaaatttcccaaaaaaaaaaaaaaaaaaaaaaaaaaaaaagtcttaagcaaggcatttgcaaaatcagaaaacaggaacaggagtttagtgattgtttttaaaaggtgctgttcccagggtcaaaactttgtggtgtaatttcaacatgctatgttacctattatgtgtaatgccttgaaacgctacatgccataacatcagaaatctccaacctaaaaattatgttgcatgagataagcattgaaggcacacacgttcatacaaattaaatctgtaattatgcctcaataagttaaaatgtaaagacatatcaaattgtaagaccaaaatggcttttgaccttacaacaaactcatataaaaatagatttttccataataataaaggggagagagagattttgcaggatattgagtcagtagggaggggtctcatttaatatcatgtcgccttttatatgcagttagaaaatcaacgttcccaattacatattactttgctttaaaagattactaggaggattaataaacactcagaaatatgcctttctttgcttctggccaagaacattcctgcgtgcttgtcggaaaatgttctttggttgctactgacattaaggagtaagtgcaggataactagaggaccctaaaataagatccaagaagccctaacacaccgccaatcgaggcttatcaaagctcccccagcgcgaggaaaacttgcatagaagccaaacaagaacgaggagtcaaaatccaccgacgacgagtcgcacgccccaccgagctggagtcagcagcaccattcaacaagtccctcctaccagctctctaagggatcccgcaaaaccttcctttaccacttccccacccccagcctcccgcccccagtagctgctcttggcagcatggccggcagagggcaccctctaccttccctagcttcgttctctgggtcccctcctcctcctcgcctcccctccaccccggtccctcatccccgctctacccccaacacacaaacactgcatcctccagttcaccctcgcagccccgaggcttcttccttagggatgcccctagtctgtaatctccccttcttcttgcccgtcaggcacagagcccccaatcctcagctatttctttccaggagtaactcactcacccattcctcttcccggctctgcatccccagagactaacccgagtcaagaatcccccacgtacatcccaaccactccccgaaagtcaaaactcttaacttccctggagggcgcttcagaagaggggcgcaggatgggtagagatgtgggttcggcctgcccgagagtgtcgcagaccctttcagttcccagcggtaggaattccgcctcccaagttttccaagctacattggcttcggacttgtaagtccacttcagtctcaattcctggggagcaggtagccgtgtgcagctccggggaagggatgcgggctgaaggcgcaagcttccctcccactccccccgcaagtcggcgcggggaccacccaccccctggaaggattcctagcctagccccagcaccctcccctcagtcaggaccctcgacagctctggccccctaagtctctctcgactactcctgggctgggggagggctgcgagggatccccgggtcgccgtctttgctcccatcacgcagctctgggtctcctccaggccttccctcctctacttcgtgacttccccgggtccctttttccctggtggtgccggctgaccttctgggttgtgggatgggggagaaaactccccaagagtaactccaaatcgtcccttctaccggaggggaggaaagaaggagactggcctcgtcccacaactttggggtgggggatcccccagtcaactctctcccgcggacgggcagctcctgcaccaagccccattcccagcgcttgcctacctcggggtccacacaaacctcacgggtccccggcggcggagtcacatcgtggttccgattctggctccagcgcccagccccggtccccgtcgcggtgctgctccccgccggccccacagcagcggtgggtgtctcattaaagccccccgagcaggaggtggaggggcgcaccgggctggctcctctgtccggcccgggagcccgaggcgctacggggtgcgcgggacagcgagcgggcgggtgcgcccgggcgcggcggcggcagcgtcggggacccggagctccaggctgcgccttgcgcccgggtcagacattatttagctcttcggttgagcttcgattggtcaaacggcgccgcccccccccccccgccccccgccccccgctccccgctcgcccgcgctaccgatacccgttcgaggcggccgcttaaagggaacgccgcgtcttttcctcgcgcggggaaccgaggggcgcccggaactccccgctcccccggggcctgtcctcacctcctcccctagggccccgcgacatcgccctgcgagtcctgcgccctcctggggcgccttggacaggacgcccgcggcttcgaggggtgttccagccccagcctcagccccggggaaccccgcgtcccgcgccctctgcagaaaccccggctgtgggcgctggggcgggagggagcgagtgagaatcgcacgccccgaggtctcgctcccctagctttcaactctccccttcctccccatcccagcacccaagttctctgggagagggcgtgcgtttcccgggccacagacacaccttcccgcaccttcctgcactacggagcttgcgaacgcgagcacacaatgaaatcgcacagagcatgggggctattggtttactctgctgccttaaacacgccggcttaaacagagttcgcgcactgacctctctagagtttgcctaataggaattcaatcaagataataacagcattttttattgatgaacgcccccagataacgttacaccaagttacttgttccagccaggaagcccaggcaatgacagacctcgctaaagccacacgctttctagccgaccaaacagaaaaacggaaagagaaagaaagaaaacaaacccaccttttcagtcactacttgtcaaagtaaccatcaaggcagctgctccgggaaagacttcggccccaaaactcccacactctattattttttcacgttcccttcgcttaattaaaggggggagggggcgcgagtctttggtgcccggtatgtactccttctgttctgcagcaaagaagttaaattattgatagtggaaattgcatggcggaggtaatactcgcaccccatcagcgagaagctccatttgatctcggcagaggcagggagatttcatgctagttcgccggggggagcggcagcgagagcagccctctccgcggtgaatgggaaagtgggtgggagtccacgagagggctccacggtgccttgacgtgcgctgtcatatgatacctccgctgcctcgaaatagacactctagtgcacgaattaccagaatcaaaattcagcgcatttaaaatgatacatcttttattagaagagttccgttccagggcattgcatgcttttgcagatgttttcacttccagccccagcaaacacacgtataagctaacccttttaataacgaaccagggcagccaagataaataaaaagtcttctgctttaaccagagtgggggtaggtgattcgagggtgggggcagaactggctcagttaatcctcccccgccctccacccccaccactgcccgcagcaaaagagcaaatagcctttcgggttctcatttgcctgtagccaagacccttgaagagaacttatatggctagggtccagaggacattttcaattatccatttgatgaactctgtcaaccgtctacctgtgtttctgctttaaagctgaattttcttctcattagttcaaccaatttgtgcagaccttaaaatttagaataaagaataagacagcagtaccgtacttaacttggagtccctggacctcctcggagcataaaaatcacctgggtgagtgttaaaatgaaggtccctcctcctgaaattgtgatttagtaggggtggggcagggcccaggagttataattttaataaataccacaagcaattcgaatgcagacaatctgaagtcacactttgagaaacactctcttgggggtacaacactgggtatcagaggaatctcccaccaagcccacacccaaattctgcaggcagctttctgtgtgtgtgcgtttttctgtaatctcaaaggggtttgacctaataattgcgaagactattgctgtaagaatttccctaaagactccaacattaattttgctaaagggaaagatttataaacagtttcctttcctggaccctcttgtggttaccaagaatgtgctgttgaactgaatatataatattattacatactcagttcaatttacctaagggtttacagttagcaaaatgaattcactaacattagctattttagaacttctaaagactagtgacagaaattatttacccgttttataaaagaagaatccgatcctctgccaggaaataatttacccacgttcacacagtgaagtaccagggacaagacttcagtgaactcaagaattcctgctagaaataaccctgcttccatctcccccaccccctaagtgaagctatctgttccttggaagtgttatcagaatgtgtgatcattcagagcgcctttgcaaattgttggactaaatagtcaaattattcaaatatatgcatattcttcgagtgtcacacatttagctttgcacctctgtcaacttgacagagcacatgaccaatacaaactaccctacagcacagatggcagagtttattgtggaatatttaatgtatgtgaaatacgcaggctaaccagaaagcaataaaggacagagggcatgaagctggataccgctaccccacagaccctctgcgttggttcccaggttgtaagatgaatgcaggcacaatttcttttagtagcacaatacaatttaaaaggctagtgttatacatttaaaaaaaatacttgtactacattataaaggactggaggaaccctactccaaactttaactttgttaacttcaaactgatgcttcacatttgcttgaaaatgagttctaccctcaggtttttaagctcaattgtaatttatttccttcctgaaaaaatacctggcaagttaatgccaggaatctaagctagcattctgaaggctgctcacttagaagttatggcaaatcttttttctgctaaattcacattggcacgtcagcatttctgctgaaggaaaaagtgttctcatttcccagactctgattgggtgggtctatggccaatcttcttattcctactctcccttgacattatataaataaatgtgtgtatcttcgctttccagtgtgtggtgcagttttactgaggaaaagacagaggagtcagaaatgtcagggatatttagaaagaaaagaagatcagatgccaattcagataaccatgatgaatcacacctcttaacacttgtaagcatttccaaactttctgatttgtgattatagcattgccaatactgtatgcgaccagcttaaaacatgtacttatttgccttaaaagtacatcttacattcaaaaacaatgaagccaagataaacaaaattgtaccagtgccttgcatggaattctaaatattattttttatttgcttaattcaggtagcatatagagataattttggaggtctaaaatcaaacattttacaaaattatttccctattgtgggcaaggatgatgctgagaatatagagcatgcatttctcttcttcttaaaaattggcctctggcataattgatatgttaggagcaaagtttccaagtttataatctgaacattttctctattactaaaatgagggaaagtttcacagcttgaaaaaataatgctacctatttcacttttgtggggcttaaaaattaattgtgaattcgtctgaatctttatttctttttggttatgttctaatatgatcctaacccaatgttccagggggaacaaaggtcaggaagaaatttgaattcccatctattcttgtcgggaaatataaactaatcctcattactcaagtgagaacagaggtagtaggcttgacattgacatgttttttctattaataattttaattggctgaggtcaattctatcactataagcattttatatttatgtttatttaagcttcctagttactcctaccttcagtattccttgcaagaaaaaaaaaataagttgtctagtctagcatcaaataagttggcctaaaaaaactgttgaaactttccgtaattagcatagggaaaatacttagtaaacagaaaactctgctgttgagcagagtggcacaggtgttttcaaactcatcctggataatttgaaaggcctggtccaatgttaaactatgtcactcgcaatccttgaaattcttgtatgaggcctgtcctgagaaaaaccttaagggagaagtaatttccctattcatgagatgttacgttctcactaagctttttatgaaccataagaatagctcaataccataccaaaatgtgttcaaattggtcaacacctgttacaggagttatgtaaccaggcatagccattagtggcagacaaaagaaaggaaccacagcaagaaacttttagaagggccaagactaggagagtagaacaagagggtcaaaagctgatcccatctgggaataatatttagttggatcaagaaaaacggcatagaaaccattaagaaactgttgagactaaacccccaaacatatgagaaatatcaacttgtagccctccaagttaccagatttgtgctgagaacatttaaaaattaataatgaagaataaatttggtttacttgttgtaatagttctataagcgtggtcaaaagggatgtgagattgtgggcataagttagagctgacagtaataaatagctgtggtattagttggttttgctaggagaaaagccatgagaagaattaacaaatttaaaccaaagggtttcaggacattgaatcagatgaaagatgaacattagcttatttttgagactcacctatttaggctgtgtgatgtttggagtgagagattttctacagccaaattttaaattcttcatgaaaaaaatgaaaaagaagaatatgcaaaaataatttagaaaaaaataagtgaacttcctaaagtcttattttaaaaacacacactaagaatttggcctactttcatgtgattctgatacatgaatctacaaagcactctttagtggtctttttgaccaaggacttgagcaggatgtgcaactggccctctttctacctccagatagcacaggcatggtgagaatgaaatccttaatagtgcatggttgtgaagaatgggttaggctttagattagtctggcatacagaatcatttggaaacatccgaaactcctgactttctcaactttagttgcctttcacttcatagttacagtcattcagttgatgaaagattgctgagtatctactatctgtcaggaggctattctatgggctgatacaggcagatgcataaaatacattttagccctttacatgctcatattctaggacataagagttgtattttaatccatggtgacacttgcaaatttgttaagtctaggaagttttgttttgttttattttcccttgccgtaggtttggtgtgtagaaagatgatggtaaacatgcccctagtggccagggggtggtagtgatggacaagaaacttgctcccaaagctggagtggcacttagaggcgggggagggcccaccacggttaatcagtccccagttatttcggttagcagtgttttacaaaaggtagacaaaagagaaggagtggatagggtgagagggaggaaatcagataatttttgtttgaggcaaataatttttctaaatatgatagatagacctataaaagataggtccagaagggatcttaagagattatctcatctttctcactatttataggcctgtcattgcagaccagggaagtagactacacatccttcttttggggagctatctagaatccagcaatgctggtgcttggaagtcctcacttgtaatgcatttttgttcctgttgcaatttatatcttatttcatttcattcaaccttagtgaagatggagaacagctgcttactaacctccttatgttattaagtcaccactcagacttttctcgtagcaaaagatcagatctcacaacctttcttcataaactccaactttcaacccattaatcatttcccttggtctaccctggacctcctccaagatttctatatttttctgaaaatgtggagccccaaaccagacatgtgtgtgaaattatccagggctcaggaaacacaggagtcatgaattatctggacacagctgttgggaaaaactaaagggaagattcaatcagattgacaaatcttccctttgcaacttggagacaaagtagtggttgtttaataaaaagatgagccttcataacaaagctacgtcttctgtccttagcttttaaatgaagcattattttcaaaagaaacaactcttgaatagaacatttagctttcactgttttccccctcaacaaaattgtttaagaaacagtggcttttctgtactccatttaaaatcccaagttgtagacctttcacatttaaattggatttgtgctttcatattctcaggtgcttattatatactgatataatttctctcaaaggtaaggtctatgaaatactacactacttttgaagctttacctttcacctaaattgaaccatttcttttcatttggtctgcacacaaaatccagttagaataaagtgaataaaactaagttgaattcagtaaaagagaattatgctaacctacatgatacctagaatcaagtcttcataaattcatcaagtatgtctccattatggcctaacaacccaatgagaccaaatcatgggatcagcagaaatattgttcccattactcaggagatattctatggtgtctgtaaaatcagtccaattggcctaagaagacattaaaccagatatagaataaagttagcactctaaaaagaaatggggtagcagaggagaatgtttacttcctcttcataatatcgccttgagaaattgtccagggactttgtaaccaaaaagagactgctgcaagtgtttgctgtaagtaggtacttctgaaaccttagtcagccagtgagaggcaccaagaagttataagtctagttggatataggaaaggctgatgctgatacagaagaataggacaaatataatgtttcataaaagttgaagacagagagatggggtggaatggggaatgaattggtgagagtacagccattaatttaaattccagcccctataattgttttttgtttggttggttgtcactgccatgtatgtactctgggaaattacttctttttttgctgcttggacagtagtcatgacctgggaatggggggtggtgtgtgtgggaggtgaggtactatacggctagatatccaattttggaagtcagatgtcgacgccatgattcagactaaatatatttctgagacacaaactaagaccatagtcagttttcctcaagatagtttccatgctgaattagaaaaatgaagaccaacacttcctttattaccagatttcatgtgtcccccaaatgcagtaaaatgtttaatattgaggatcttttatttcataggcatgttttcctgaaggccttgagaagaatgagccaaacatatgaccatccactggcctttttaatttaaataagttccaagtgtaaacaacttaagttagctttgcattgtttgtccctttatgttcatactaaatactgatttgaactactattcccacataatattcttatagcattataaccagattgtggatgtagatcatgttagaactactttgcaagccaaatttccattaccttccatcttgtccgcacacaaaaactaattagagcaaagtgagtaaaaataagttgaattccataaagaagaatcatgctaatctacatgatgccaatttatctcaaaagtatgtacaagtttgacatattcttgactatttcctagattaatttttttctaatttttttttattattgtacttttggaaattcatattgttatttatatgattttgctctctgtttctagaaagaatttataaaacatcagatttactcttaattaactgatgtttataagagcacaattttagaagagtagtaataaaagttaatcacaaaagcagaattatatgtatggatattatatgaggaacaaagaaattgctccaaagagtatttagttggaatataaggtggttttaaaaataaaaattttaaatgagcaaacattttctaacgttttaagagtagggatattaatagatataattaattttagaattcctctttttttttttttttttttttgatacagagtctcactctgtcacccagactggagtgcaatggcgcaatcttggctcactgcaacctctgcctcctgggttcaagcaattctcctgcctcagcctcccaagtagctgggattacaggcatgcgccaccacacttggctcattttttaagttttagtagagacggagtttcaccatgttggccaggctggtctcgaactcctgacctcaggtgatccacccgcctcagcctcccaaagagctgggattacaggcatgagccaccgcgcctggctagaattcctcttttatttcttgatcactttagggaaaatatattagtagctgttgttttcttggggtggaggatcaggagtgaaaagaattttgtcgctgaaaatcaaataaagctgttgtccaatctcagataaaagaaccaaatgaagtaactctgaaataagtaataatataggaatcaatgaaaacttgaagtttcaagttttagctagtgtctcaatagtcataaagtaactataggatatttaagaagtataaagtataattagttttgtcctaccattttgaaattaataatatctgattagaatgctattaaagtgttgttatgcttatgttttagtaataatctgtttttaattttattttgaacattaaagtaactaaaatcttgcacaaactgtccattgtttccttttgatgtgactattaggaaacagaagaaatatctttgtcatatgatattattttaaggcccagatagtagtcaaaagaactttggtcctaatttaaaactgtcagtttctggccatgtaacctgggcaagcaacttcactagcccaagattgttcagatagatatcgtaagggccatataattgtttattgaataaattgagagatctaccactgtgcacctcagttgcccaatcaatcaaatgaggtcagtgggctacaaactgagtttgctaaagctggcaacacattcagaccttatctcagaaagaagagatgatttaggtgatttcaatgcatgaagggaatcagtgaactagatcatttgtaaggtactttttctatctaaatttgaacgacaagtttagtttaccaaatgatatacagttcctgagccaaggtaaggacttacagtctaccagccatcatattacttagttatctctgacaaagctttaggtggactttttcatacatcaaaatgtccttcaagattatccttttttgctaggctgctttcagagctctgggacgtatcaaatccattatgtgttcatggggtccttccctgaataaatcagagtggaggtgggatgaagtctcttcatagacttccgcatctttgattacttatatgcctttggcagctctgcaaagaccactgacttgtgtgctaagacataccagtatgcatccaatccctcatttaaaaccacatctttctaggaggtgctctctaggaggaagatggatgaaataaatgtatcaggaagatgcccaagtagatatgctactcccttacccagaatatatcccagcttagtttctagagctagtatccagagttctgagttggtgcaaagacacaaaggacccagacaccaattcctggcatgctcccaaatgagatgctattttcaggaaagttccaagtttggagtggatcctttggaggaagagcattgaattgcacaaggaaagccaataaacattctagtccccaacagggactataagccttgtaattacgttttagactgtgcttgtccatcctcttcttctccatatctgtaaacaacatgttagctttggaggtttgtcatccactgtgtgtctttggagagggtgttcctcatcacagcatctgcagtattatagccagtaacagttcgcaaaggcaaacttatgaaatagcttctaaacatactaaatcctaatccaaacaatttataacatttcttactcaataactctcagaagtcaactaacttggaactgccctaaacaagttaagaaaggagtcagacatcatccattgggttaataaactaaagtggaaggaagaacatgcaggtgaaaagtttcagattctaatctcttcagtgactatatacttatgtctggatcattctgtatcttgatagtgttttaagtgtgatgataattataataataaaagctaagattgaatagtgatttgcagattagtgattaaaaaaagggctttgacattagacagacctaggtttgaacccagctttgccacttattggctctgctaatttaagatagttaattaattactgatgcctcagtttccttatctttaaaagaaaaataatcgtcttagcctagaaagattgttgtgaggattcaatgaactaaggaaatgcagaatgctcaccatagtgagctcaacaaagttagattttattattaatgtatatgatcctaacaaaacattgtaatactgtttccattttatgattatgaaaactgggcttcaaaaagggtaggtgacaattagctatttgaaaatctctcatcggttagcaaagatcaaaatgattctaaagtagcactcctggaaatgaattgtgagactcatggccatctcaaagagttgtggtcaagatcttgtaagaaaatgtgtatgtaaaccatctgataatgggagacccagattaaatctgggtggtagctataagatggggaggcacaacttcataatggactttggaaccagaaaactttgggtttgaagtttagcttctccacttcagattttctgtgttagtttgggcaagttacttaaattctctgagctctagttttcttaatctatctctgagagttactttaagagttaagtaatatatgccaaatacaaaacaaataacagcactggatgaatgcagagtaaatgtcatcccacatcattataatttcccatggtgtagtaatgacaaacaggaagagtttcagtaatctcttgggttagtgaggtcagaacaggtatcttaagcaatgctgagttaatgaccagaatctgaactttttatctttttcaatggagtgatggattgctagggtaatggggttgtgctggtgatgctaaagataaacgttagagtaatagcaagctcagtcaatagaaacatgcttaccataccctggccttctcagtatttggtcctttccccacttgacagcttgtctaatggcaaatgtgaattttaaaagttttctcccaatgctgatttccttttgccaggaaggaaacaacaatggctaatgttgacatttactaaattaatatttctgaatctatgctgtgttaataagtgcttctcaagtgttctgttgttaaatatgtgtgggaaatgttacacagtagtacttgcatgctttctcaccagtatacatcacagacaccttcatatcacgtcagttttatagatatttcaaaatacattgatacttatcattatttcaaaattataatatttaccttgctgttagatcttatttaatgtattaaaaagcatatatattactatatcacacaatatattattttaaatgtttttataactgtacatcaatgccactggcttcctttgtaatcttatacatttatttcattcacttagaatttttttttttttttgagacaaagtctcactgtgtcatccaggctggagtgcagtggctaatctcggctcactgcaacctccacctcccagattcaagtgattctcgtgcctcagccttccaagtagctgggattaaaggtacatgccaccacgcccagctaattttttttttttggtaaagacagggttttgccatgttggccaggctggtctggaactcctgacctcaagtgatccacccgccttggcctcccaaagtgctgagattacaggtgtgagccgtcgcgcctggccccatttagacatttttatgagaagggtttacataagctttaccagactgccaagagagttgagtccatggcatgaaagtcattacagtgagcaattctttctttctttctttcttttttttttttttttttttgccaggctggagtgcaatggcatgatctcggcttactacagcctctgtctccatggttcaagttagtctcctacctcagcctcccaagtagctgagattacaggcatgaaccactaattttttgtatttttagtagagacagggttttgccatgttggccaggctggtctggaactcctgacctcaagtgatccactcacctcggcctcccaaagtgttgggattacaggcgttagccaccacactgggcatcagagcaattcttaaacattgattatggaagttattggcaagtaagaagtccttagcggaggaggaaggtgaaagcagaagaaatcattgtttcctactaaagtagccagaacaacaatgagcatggaaggtagagaacagtcaattcaagagcccctgtataattagaactccactgtgacttccctttttatttctcaattttttcccacattctctttcttttctctattcactcacactgcaatgccctatcccaaaggctttggatgtttgtgacacctttctgcaatcacctaatttgtgtattttttccccacagtaaccttgttacttagagacaggaggtggttgatatatttccttgaagcgggaggaatcaattctaactccttttggtactgatgagcatggtgctacaaggaaatttctagatagcataacattataacattcactctgggaacaaagatctcagagcattttctgccgctatttaggaaaattgttggatcacctttcccaggttgcgaagattttggagtggatttaacattcactcaaaggttaaaaactttgacaaagtacattttacttcctgtagtggtctgggaaatgcccagagtggatcaaaatgtcctatacaagctacagctttctcccagcttcaggctgaattcttaaatccagaggttgcatgttactaaactgctggtttttagacactagactttaaagattttttatttttaaattaatactttgtaatacattttgccatttgtctaaaatagaattcaagaatgatgtctgttatgcctagtgcatcagaagttattttaaatatgacatctttataaaagtcaatagctgcctcatcaaagggcaatcatgtctagtgtgggtggctgtgccaattgtttttgaactactgcagcaatctagccaatcccagggaatggcttgcagtctttctacacccacattttttttcttaattatctccaccaggctgagttagttaaggacagatctatagcatttcctggatgtcaaaatgcccacacaccttctgcaatccttgggctacctgcttcctttcatgtttcttttggcttgtccatctaattatctattatcatgtgtatataatgcattattcatgagacccaggcaatttcaggatgtaatatttttgattttaaaaggaaatgacctgaaaaattataacttctgcttgcacaaagaaaataagcagtaaatttgatagcaggtcttccatcgcaccacctgcttttaaaaataatccgcagaaatttgagatcattctctaaattaaaactttcctagccatcattccataaatgaacaggttcaacacctagattccttctattctgggttcaaatatgttactttgatttttttcatgatatacttcttaacaagttaaaaatttgcggtacccacccagaattgtaaatcaccaaaggttagggtaacttaggccttaatttcccctacactgcaagaaatagttatagactatatcttttatatcactcaaacttggaacggaagtggaatttagagtttattctgagaacatctcttttgttttatgtgtgaggaagcagagatcaagagtgactgattgacttttttgggtactgacaagcggttggaagtaaagcctaaactcaggcttttaatcttattcactgtgttctcttgaaaaaaggaatcttatgagtccagaggtctgtccccttctaaggattggagcaaataaagagaccagtctttgtctctaggccacaagatccaccaagatagggaccatttggtcttgcttgttcttgaatctccagattgtaatacagttcctggcacataatggcaaattatgtgttgccaattaatacttacaaaataaaattatgaatgctagagtctctatagaaagtataccttttgggcaaaatgggaaatgatcagccaagctcatgatccacataagtatcagaacatctaccaagataaacaagtacccagtgtccaagactgggatgaaattccagaggattgaaacaaaacaagccagcatgaattcatgtatcagatatgagctgggctaagtgacctctgagaaccttcccagaacccagattctatgattcacaagtaaaggtaatgtacatcttggctttggttcttcttattctttgtatttgttttttggggaattagcaactatgacttagatggtatgtcaactagaggaagagtcctgctttctttgagtgtctaactgtgggagagggaaatactgtcttaggaagactagttaaaactttccattaggcctgaaattttgaaaactatttgtaaaaaatgtttttaatttaattaaataaatcaaaataggagaaaataatgcctacagctccctctgatgccctagtggagtttaaggcagcatggtctagagaggaacaaacacaaatttccttaaaatttgaagaaagactctgagttagtctttacatcttactggcagtgtagtgttagataattctgcaccttactttcctcatctgtaaaaggtgattggtgattcctaccttacatgactgataaggaaatcaaatgaaacctatagagagctgtcaaagtactatatgaatctaaagtgttattactaggaaatacaaataaagtctgcactatagcagaaaaatctcttataggattgttttataatgttggaaagaaagcagaaaaaaaatccacctgaatttttaaaaagtcagaatgaatactccaaaaattgccaaatgagattagaggcagggttaaagaattcatccttccctctctgcaccatagtgttttaagggtattaatctttatgaaacacgtgtatctttctcaaaagacacttgttaaagcagcagctctacattccaaagtaaaagaggaaagatgtcatatttttgaaattataatcacctttaagccaaaaaggggaaaaatttttttgttgaaaaatttaatctttctttaagacctctatttccatagcactcaatgatggtaagctttcactagatgctaatgtttatttttattgctaagtagtacgcaatgttcttgacatagattatggcatgtaaatttaagagactcactgcttgttaaattcccactagaaaacacacacagagacacacacgcccatacacacacacacacagacacacacacacacacacacacacacacagcagtagcagatcagcagagaaagacaccagccaaagaaagataatttgagatacttctgaggtagcagttgtaaaattaaaataagcaactcattaaattatccatagagtgaaaagaaagctgcaaaaatagatatttttctggcaagtcagtgcttttcagaataaatttagttttcagcagagcttttaaatctgatgatatcagttcatattcattagagttatttaagtggttagactagtttgtctaattaaaaccaaagagtagctttactggcctttgagagaagtatatttaataaaaaatatgctcagttagacatcattttaactgacagattgtaagcaatatgatcgagtgaatgttacttgagcaagtttgagcctggtcccaaaattacagaattacaaaataaaaaccctttgtaagtcatgctttaatgctggttttccctcatttctgtttcttggctgattatctattttgtggtcatccagtcccttgccttctctctcgctcactgcctgattttggaatgttgtttcttactaaagcttcccctagaggacaggccaggaaaaggaaagaaactaaattcaccagcttctcttcttattaagaatttagatcagaaatctgatagggaaagagtctggcaaatgaaaggggaagcttatttatgttgattttagatctttaaaagccttctttccaatgtacattaatagacaattgaaaaataatattttataagccaactaatcacttgcttttaaaatccccacttactaccttgagcatatacattagattatgttttaaaataactagtactctggttcagtgaaatgaaaatgatatgtgcaaagagaatgtcataatgatacctcccatttatggagtgcctgcttcccagtttgcaaagcccttatatatattctcttctatcctccaaaaattgctgtgttgtaggtcttactatcaatgacactgaaaaagctactggcaggatgctcatattctcatctgaatcaatactggtatactccattgggggagctagaccaagctaaaatctcacatacagaaatattaatatgcaagaccaaggggtataaaagtaggctaggttactgttaatttaatagcatctaggttaaaattctctctctttcctctttcttcccttcttctctccatcaccttctagtcttctgactgattccaaacaggacaattgaaatgtcttgccttcatgctgaagagctctttgtaaatacacataaacagtgaatatcaggtgcaccatttttaaagtgctattcatttccacaacagtttaggtgaaaccatgtcatcttacaagttgagtgtgtgtgtgtgtgtgtgtgtgtgtgtgtgtagaggatgacgtgacacttttgaggtttatttaagttgttaaagacctcaaggttacaagacttagactgttaagcatttttcctcccagagacacgaaatctacaattttctcgattcaactgtcaactaaattggcaagtcaactaaaaggataatattcccttaacgatgcattcatttgaagccctagcaactgtattaggcagcagcgagtattcgctagcaagggatggcgcggggagagggaactctgcaatttagagtgacagatgatttctttcccatccatcaagctgcctcaaaatgtcacaatatttacacctctttcttggtgaattagaatccagagacaagcagacagaaagaaaaaaataataattccggccggttgccgcctgattggaaaaagcaagcgttgcacctttaaattctgctcctccattccccgttccgcacaccacccccccccgcccctcccgggattttgcaataaatctcccagttctgcgttcagccctgcagatccgtatttaaaacagcaccatctgggaagggtgggtggcgatggtgatgcgggcgccttggagttcctttgcagcacgcttggaattgcatcagactgatcagaaatccccccgcccccaagctcagcccctcccgccacgctcccctgcccgcccctcccctcccctcccttcgcgtagatctgactgagaaaacgactggatctcggaacaatctgtgccccattcgctgcaggcttgctccgtaaaccctgccctacgctccctttgtgtgccgagcagcctatcaccgtcatctgatcctagcgcctgttttttatcttttccttctgaatttccacaatatcctcgcttcgcctatgaatccacctgcgcagagttgggattctttctttcgttcgttaaaacagtggtcttgagtttcggaaacagatttttcctacgttcccctcacccctaccccaagctcttgccttttaattaagaagagctgatcgggggaggagtccagaacgaccaaaccctggggcgaaaactgccaccgggcttggctctgtggccggaacaaaaggcctgagaagggggtgggggtgagggttataggagtgtggagagcctggtggcccccgcccaggggcgcctaagtccctgagctccctgaagagtggcaagaggataacgcagccgcgcgttccggcagttcgctgtcccccgggggtgcaggcgggggcgggagaggtagaacacaggtctgggcggctccgcgccgcttctatctcacccgccaagcccctcacctccacccaccgccagtcccctgcccacccgggtggcggcggcggctcagcgactagccggccgccctccaccggcgcctccggacgcaacctcgccctggcagggcggtctgcgcgtccagctgattggtggctctgtccagccgccgcacggagctaaaagtgttcttctccaccgcctccagccgcccaggccccctcgcccggcccgctctctggctcttcggtccggaaaggaccttctactcccaggcggaggctcccctttccctgagttaccccgactgactcggacctgggctcagtgaggcatccggcccggctggggagcggagcgcggtctcggcagctccccttcccttgagaaagcgggaaccctctaagccagcgcccgaaactcgcggggagggaggacagaagggaaaaaaaaaagaaaacccagaaagaagcatccagcgaggagcgagggcgacggagaggaagagatagaatgagggagggatggaggctggaggagggggcggggtggaagaaggggggcgggaaggagggagggagggggaaagagagggagggagggatacagagagaatgaatccttctcactagaagagctgaaattaccttgattcatttttttgtgttggaggtttagctttacctccttccctcttcccaacctccacctcctctccccaccgcacaccacctccaccgcctgattctaaatgctacaaagtcaaattttaggaattcgaatgttttgcaaaagcttcataattagtaatgaatctactgtacacacacacacacacaccagcaaagagaacggaaaagagggaggtgaagaggagaaaaagagagataaatcttacatttgaatcagacatttgcaggtccaagttaactaaactcattatatccgcaggaagactgagtttcttttttttctttctccctttgccccagggttctcacctagggcaattcaaactgggcaaataccaagaaacaaccccctctcatgctctccctctacctcctcccctccaccacgcgtcctctccggaagacagtatcaaaatagctcaagaattggggatgcaaggggtccccgccctggtgcttaccttctttgcggcttacaccaccccggtggctagatcctggagataaacacttgcatttcccaaagttaacccagtataccaacccggagcttgccaagagtctattccagcctacaccgctaggaagccaacttcagcgagctcaatgaggggaccaaactggggctcgctttccaaacgctccgctccaaaatctgactctctctccagccccgatctcagtgtgagccgaacctcagaaaagacgctttttaagggcgacacagggttggctttacagcggggccaagaagactacctgggggtaccgccacctcggacaaatccgttggctctgtccaaggtgctgaatggactcctatcgcccggattacacacccggcacagcaggaggaaaaggcttaaaaatctctaattaagtgatacttgatattgctctagacggtttcttccacttccttacggtttgtcacgtgcggatggctttgccaaagccatcctgttaatagttgatcacatgttgatgagaaccttttcttctacgagaggattacccattaccggtgatatgcacttctgacttatttctctccccccaaccccaccccccatctacacctaaactcccagtctttaccccacccttacccccactccaccccctaaccccaacctctaacagcattattgtttttagatggaaattaacccccttgcaaatgtcaattacatgcccacatataaatcatagaatatgatcatacaccatacacattaaggaaaagaatagaatgcaagactgctgagagacaagcatcagccttgaacaaccaatataacacacacccccccacccagctccaagtttgttccacgcagttccacatagctgtgtcaaatctcaaatgattccaattaaagttgcactgtgtaaaaacccgattcccctggcctgagtagctgctgttctttggcgtgtgaagtgctaggaagagccgtgatatgcccgttgttaagcaacatgtcaagatttttcaattataatgcaggttttattgctactcaccattgtgcctttgctgtcctggagactcaagtgtcttaaaatctcgtctccccaacagatgctggaaggtaatgtgtcttgtttgaagtcatcatgtgagaagttcggctttgctcagtggatcgcccaccacttggtgtgacttatgaatctaataaccctttgcaatatccgcaagcttaaactctcaaccaccttggcgactacagaagacaaagcaactggcatcgatgtcgaaaaacctatagatttacgcaaacgccctcactccgagagacacgtttccttttgagttcttacgtgattctaatgaatgagcgaggttaccaatgattgcccaactgccctgctatgtagcaggtgtttcctagggctgccttctaaccgcccgttactgggtcctggcactgaaagttcccagagaaagtgaggagtttcagggtacccctgtaaaaaaaaaaactcagcctgcacaccgctcccttgcccactacgcaggtcacacctggggctccggcgaagctgaattcggctcgggagatttccctgtcgccaggtaagaaaaccttcgccttgtcaggctagggcgggaagaccgctggggaacttgttgcttatcagcgccggcagactaccgctttaataataataccagaaaagcgcagcagggagggggtggggggcggcaacggcgacgactaacctcgctgtttacgtgaccgactcactgtgactctctgggtaaaaaaaggaaacttcttagaaaagttcgtgcccctccccctcccccatcatgactaagggtctccagccgatgaggtcgtgagtgatgatcaaatggggactggggggaggggggcgagtaagtgacttgtccttgggaacatctgcatgcgtcgaagcgcgaaccagcccaacaactttcccttttcctcttaggtactgatgactaggcgagaggcaccaaggcgagccactagttgcccacaggaacctgtgtaagccgagctctcgagcggctgagttgaatgaagttatgactgcgtttgctctaatgggttatggcttcccaaatgtgagttaacagccccggtgcgcagctaggtcggaaggcgagccgcggagagcggagccgcgggccaaggcagggacgggaggggaggcggcaggttgggcgctccgctgctgctcggtgctgcttccccggagccgcttcctcatcctgcgggggctgccccgccgccggggtgccggggtgagcgcggcgggagccagggctggggtggcgaacctcggagggggctctcccaggaagccctgcggttagcgcccgcgcttccccaccagtggctgcgcaagctgggaagcgaagaggtcacgtgttggcggaaagtaacttggaggcgaaaggatgaactttgagaagaggaaaaaaagcacaatgaaacaaactacccccttggagtgtctaatagagggggaggcgggagggggggcggaggggcgccgctctccgcgggagatgtggggacgactccggaaatctcgggaaataggcaataactcgagctttggcaacgtcccccagcctagggaggcgctaacgcaaggtatctttccactgaagctgccctttgcctaccctcagccatcgctagcacagcagagcagaagaaccagggatgaatgtagaccagttgttatggagatgtccgtcgctctgaggagcgctagtgccctgggaagtccccagacgcatttcaggtttcgtcgttttggcactgacaccatgattttactcgctctgagttcccaccaaggggagcccaccaacggcgtcacaggccctggccgtggcgctattgactgcagggatgaggcacagcgatgctgcagaagatggtggatagctcttaagtttcagaccacccagccctttccaatttccagtttctttattccagtcaaaagtgctttgtttgaatatcattcttgcttgcttatgtagaaaaatcttacttacacgataggatgattagaagcaacagaacataagcattcagtggctgcttcaaggtcctccctctcccatcccagaaatgccttccttatggaaaataagttttacttcccaattatgtgcatggacctctgttcattgcagcccccattggtactgggttattattattagcagtaagtctagtgttgagttcatgcttctctagaaatgtttccaaagtcaaacaggcttatcttaggctccagataaaatatctgtatacaaaagcttcctggttctcattaggagtagttctagatttgccaggctcctgga

SEQ ID NO: 130 - DNA, 67922 bp, Homo sapiens
gagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactctttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacgaagcccctgcgtggagtccacgcccttcaaaaggtccctaggggcaaagggatgaagcccaggagcgtcaatgtgaggtcaggtccagcgggttagggttacgaggtcagggtcgaagtctcagaattgactcgggagtatgaccaataagcccaagagatttgtggaggccacgcccagaccatgcctaccctagcctttctcgagctccgcccgtttctccaagactgggcccctccagcctgaagccccacccccaggacatccagctccgctccttccctcccccagtcccgcagccaagctcaactccagggtgggagattaaccaggtggagacctgggatttcgctctgggaccccctggtgacaaccctcacccccgtgccgcctgtctcctttcttccccaggcccgcccagagctgagctccgtcctccggctgctgcccaaatcaggggtcgtggacaaaggatgcctggggcctgcggccctacgccaggaccccgcgccgaatactctgattcttcgggctccctccaagggagtcccaaagaccccaatggccaataggaaagtgggttcggtctgggcagcagtctgattggctccagccttcgggagcggacccaggggcaaggggaggggagaggggcggtcctgggttttggggtgggaatcggattccagctgtggttctctccctgcgctcccgcccgcactgccacggcggacggccaatgggcgcgcggctcggggccggcggcgtccggcgattggctgcggggctgtctgggggcggggccgaggcttgaagttgaagtgagggatccagctgtggtgtgcgcggggctcctcgccgccgctttcgctcgctcgctccgcgtctcggccggaggaggaggctgtggcgccggcgacagctacggcagcggcagccaccgcggcggctgcggcggcggcatctccgcctccactcccgcccgggactgccccccactgtctccccgcccctcccggacagtgagcccgcggcggggcgggggaaggagccgcccccaccccctccaagcccacccctaaagagatccctcctcccctcccccgccgcctggcgcggagccgggacgatgctgaccccttagatccggctccagctgcgccgcgggaagagggggcgcccctccccggacccccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccatatccttcggggcacgacggccaggcgcggggtcagaagggggacgggccgcaccgccgggggtcgggggggaagaagacccaccgccaggtgagtcgaagtgagcccggagggtaggcggatggggggggggctgccagggaggggagggggcaccagagtgggagcggagacgcgagcaggtctcgtcggtaacccgggcttaccccacctgcgtacacacacctcagtcttcctgggttgggggggtggggatccaggccaggagaagagagctgtgccccgctggctcgcagctggacgccctccagatgtggtcaggggagggtcgtcatcctccagatgtgggaagcttcgggagcctgggagctgtactctgcccgcgccggttagcgagctgggtttggtttccgagtttggtggggggtgggtgggggcggtggggaggaagctgcggggacggaggaggggggaccgcaatctcctgggtttccctccttcccccgccccaaagtttgcggcggattctagggtctgatcccccaacctggtccttgaggctgaggtttttactgacctagaaggagatgttggggggcggggaccaggtcctggcccacctcaccccccacctcgcgggttggaggcacaacaaggagattccggcggcggctgatgtcaggggcgcagaatgagaacaagatgtggtggaggggagctgtctgcccccggagctgggagtggagcccctttccgctagagcccagtgccgcgggtgcctcctacccgatctccattcgatgcagggtgcttaagattgggttggggagttttatgctggatttttcttgtggagggaaagactgtgtcaagagcttttttagcaagtgggggatggggttaagctggtccaggttactcctcccctttcacaaataaagagtgctcctgcagaccaggtatgggggactgcaggcccgcgaaagtcttgaggggacagtaatactgtcagtgtgttcactaaggaggactcgggtccaccaccccagcgtagactccgcagataggtttggggaatgcaagccccacattccagggagatggatttagcactgctccctgtctgcccaggctggagtggtaggggagaccccagcccagtcagaccctagctcaaagcgccacttgacagacgcctggccccaagctccctggcgggtcctgccaccgggggaaggaaaggtggaggggaggtgttgctgccatctcaggtctggacagcttctctgggctccttccttccagctcagaggttcttatagacccagggtgggagaccccaggtctcccttgtagcccctgtgagcctagcagggactctgctttggggaaggggggtggaaggttggtgccgccctcactctctgcagctctgctgcctctagtgcgcaaagcagggatgagcttgtggcccccccacccccatcctctacaccttgtgggtctttaggaagctcccctcatcacatcctcttctcatccactgccccttcttcctttctctctgagctgcagaaagagaggtgcaggcctcagaggtctgtgttcttgctgaataggcacaatcttgaggtttgagcccccagccccaggcccctttctcccaggcagggatggagatggagaactgatatggctggaaaggatgggttccgagcaactctcctctctgcccctaatcatttaccccttccacgaatgggaaaaagcatcaacctctatgtcctccttctcaagggtcccaggggaggtagagagagctcttctctcccctctccctgaaaacagacctctaggctagcatctcttctcgcctgccctatctccaggtgctagtggagggtctggaggcagactccttcactgagtggtctggacgggggcaagtgttgaggcctggcatgggggaggagaggtgggaggacagcactcaccttgggagttggggagcagcttcccccaggggagtggtagttgggtgtgtggcatcagcattactaggtctggagaagcctgggttggctgaggatgggttgagaacaattttttggcaggggactgcctaagctgtgcccctcaccactgccatcctacccaagtaccaagagacacctgtatttttgctgccagaggggctctgaactgcctccagggcctccctctttctctttgtggtatctgtgactccccacaggcttcaggagggtccctgtacgcctctgagccggagggacataaggacactcccctccacccccaactaactgaagctagttaggcttttcttggtacattctgcttcttggcctctcctttttaagggaccaggtttcctagagaggagatctagacccaggtaggaagtgtgtgtgtgtgtgtgtgtgtgtgtgtgtgtgtgtgttgcaagggaggacagcaaaaggctcagaagtgcaagctttggtgtggagagcaggggtactggcagacagtcacccctgcctcagatcagaggggagcatgctggcctttccagtatgtgttcctgcaagtgtgagggagcgcgctcccctctcggggaggagttcctccgcattccctctctggctgttgtgtcacatctggaagtttgtgtaggagtttctccaagctcagagcccagcacagctttttctcatttggaaatcacaggctggcatttgggatgccgagagagggggagtgggaggggggccagagggggagaggggagcctgccaggagtcgggggaggagaggggggggaggcctgaacggcaggagccctaatggcttccagaagtgagtgtgagtgagtgactgtgcgtcactctgtgtgtctgagtgtgtccctctagaggggtgggggcacaggagtttctggagccttccttgccacactgtcccaatgccccaagtctgcctatttctcttacctagggagaattctccatttctgtcctcagaggaaatggtggggggagtgttcttcctgtctcttcatcaattccctcctccaatttaatttccaaaccctaagctcaccagaggagattctggggagaagggctggggctggagaattgaatgggattgagggggggccagatcaccccttggcatgctttctgccccaggcccactttccttctgggtcacacacacattccttcccacccgctctgctccaccgctctgctgggggactccccatcacccgtagtgccagttggagccattcctgggattacccccaccacacagccccccccaccctcgcctgctcccgcccagcactcaccccgccctgcctgcctcagccaggatggcgacagacacaactgctcacacgcagacatgcgcacgcgcgcgcacacacacacgcgcacacacacacacagagtcacagacgtttgaatcagatttctggcctatttccccttccaaagattccagcgggccgtctctcttgtgtctctgtgtctcatgtctctgtctctgggtggagccggctgcctttctgtgagcttcagttttcaattcagctggaagcctctctccccctacacccacgcactgaagcgtggtgaggggggaaccacagggaaataggcttgtggggtggggcggggggttctgctgggggaatccccctttgagctttggagcagggcggagcccctacatcccatgttaccctaggggttgccgaatccgatagacaccaggagcctctctgtgggatgggtgaggcaaggacctatccccctacctcctcatttactagaaggccaggactcctgggtccaggcccattttctcctcaacgttccttagtctcacatttccaggctcctaggtgggaatggggccgctggagggcctgcttgccttctcagcccatgcccagagcccctgtgcccctagaggtgtcccagccacccccctcctctccctactttcctcacccttgcggctgccaggctaagcaagggctctatctagataaagccccacacagaggactcatttgtggagataacatgctctagttctctctcccaggagggaggaaaggaggagggatggaagtggggttcctctctctgccgtttcctttttctctgcttttgatggtgggttgtggggagaagaaagatcctcccctctcctaccccctctttgggatccactccagcccggacagtcaccatagcaacagtagacatgtgactgcacaggtctctcatagtcactatggcaaccagtgtcccccgttcccttggttaccatggggatctgtcacatggttttcccccaacctgataacctgtgggtctccctgattctcctcccctgcataaggacaagacaacagcctcagtcaggggagatcatgtgagaggggtctttttaattaccatgacaacaaatccacaccacctggtgacacatcctcctgtcgttatggcaacagaagaacatcacacagtgacatactgccatgttcccaaggaaacaagccctactctgagaagggtgaaagaccccccccccatcaattattcctctattcagagtgtcccaaattgtcgtgtgccttggtctcttccctgtccgtttatgcttacgtgtcgtggaaggagagctgtacagggtgggcaggatgttacttggaagtaggctgaattgccaagggacccttaagaaggggctgacatgatcaagagctgtgcatgaggttattcgggggcaggctttgcctgtaagaggcctccagtctgagcctgggtaaggtggggacagaaagaggggcaactcctctgtgaggtcacttctgtaccttcccccagttataagcagttcacctctgtcaagggaaacaaggcaggaagacctgaatggggacacacatctggcttctaggcagggagacttattgattggttgattcgttcattcattcattcagtcttcccaggtattgatcatctgctccgtgccaggcactacagcaagctccgtaggggatctaaagacgtatcagaatgcccctgcctgtcaggagccccagctcagcaggggaggtcgacaagtgcacagattactaacacggtggaactctgccattagaggggtccaagcagatgtcctgggagcccctcttcctcagagatctactgcctccacacagagacattcactcactggggctccttccagacccccctttccctgcagaggagaggaggggacctgcatggggaaagcagaccagttcttgagggtaactgtgtctttccctttccaaatgatggctcccttcctgtccccctttttccagggtgacccctggctgacccccattctggggagagatccactgcactccggctctactcagaaaaacaattccgtggaaacagagcactttttatttcctccctgtcatctgcctacccccaaaaacctagaacttttttcttaaaccctcttattcttgtgagggggtgggggttagggaaactgcagtgcattaggactctcggggtaccacggacaggtggcgagcaggcatgtgagtctaggggagaagggcctgggtggtggagaagagacaggggagggctgtcaggggtttgagggattcatgggctatgggggagggcatgtggcttgggagtcagaacagagatgggctatggctgggaccagctgggaggaaggtccataggttcctgaacattcctgctggcctcttcatgcctggccaaagccttctcattccagaagcaagattccacctgctctgggccctacagagtctggcttggtgggtcatgccaggagctgccacaatacctcccccatccccattccccagggggtctctggtctcctttccccaatctcctgctctctgatcttttctagcctctttactcttccccacccttctcatattttccttaaagaaaataggatacttggtcatttaaccgtgagtccagtgcctggaaccttctaaggtccggaggccgttttgtacattctcctgctgatgggctggaaatgagtcaccccatagaatccactgtatggaaagacccagggtttagaaagaacccctctctcctgcttgctgttttggctggtctgggctggaagccacaagcaggtgtgatggcggcaatggcctcttgggggagggggtagacattgtccactctgcacggcttgggagctatgcccagcatggtgcctgacacataatgggtcctcaatatttaaatgtgtgaatatgcctagtggtcatttgagggtgttgagaggttgggaggctggtggtggaagagggagccccgggctctggtgctgtagcagcggggactgcagctgtggacgtctgccttacacctagtgccagggcggtcatgacaggcagttctgcctgcctgagcagctatggtgtgcagaggaaactatcatagatcaggagcttggaaaccaccgtctcatcctgccttctcgggtgaccttcagcacatgacttcggcatttctgggcctcaacttcctcgagttctggggaagaaaatgatctaccccagatatttcacagggctgttgtgagcatcaactgtggcattgtgtgaaagtgcttggtaaactgtaaggcaggcataatccgactttaggtttgtataacacattcacatacagtatctcatttgcttctcacatctaccctgtgaggtagggagaataggattcagattctgcagcaaactcatggtgtctggcatttccacaggcatgatcgatttattccccaaatggcttgtgcaaatagtcagggtatttgtggcttgtcttcctttacagatgaggaagctgggtccagagaggtgagatgaccaaggtgggactccccttctctgatgaggagtctggggctgggggctggtctgcgtgtatgtcagggccctggcaccacacctgcttagcctcagatggagccaggaggtaaacgaggaggaggtgttagggcggggtcggggggccggcctcagctccagccttggccagctgtttccttgactgccagtacctggtttgagcgcatcagcatgttggtcatccttctcaactgcgtgaccctgggcatgttccggccatgcgaggacatcgcctgtgactcccagcgctgccggatcctgcaggtgagtgtgtgtgtgtgtgtgtgtgtgtgtgtgttgtgtgtgttgggggttggcccctcttaatcttaataccctctactcctctgcaagaggccctgacccaactggtggggactagggtgggactagagggtattccctcacccacgtctcagtttcagccacctcttgtccccacatcaggcctttgatgacttcatctttgccttctttgccgtggagatggtggtgaagatggtggccttgggcatctttgggaaaaagtgttacctgggagacacttggaaccggcttgactttttcatcgtcatcgcagggtgaggacctgggctggggtgggagagcaatggatcagatcggtcccttccccggggccagggttctgggcctgtgacctctcagctccagcccagttacagcaccactttctccctggctatctcctgagggtctgaggctgccctgcctctagcactgtagcctatattctaaattccaaggccctattcctaattctgcccccttctctgatgggcaatctgtccttgtctcggggtagccttgccccccagacagagagccggatcttcagggtcccttggtgaagaagaagaaggagtcagaggtcatcctgctgcccctaaagcaggattcctcattgacctcttttgaccccactgtggcctcagactcaaagggcctccctttgggcccctccctgcaggatgctggagtactcgctggacctgcagaacgtcagcttctcagctgtcaggacagtccgtgtgctgcgaccgctcagggccattaaccgggtgcccagtgagtgacccctcagccctcagcccctgaagagagccccaggaggaaatgtggaactctcagaccccacctctactactgtgtcctcacctgacccctcacaggccccgtcagagaagggctcagtggggagctgggattgctggaacaaaatggaactcctgaatgtggcactatgggagttacctgggaaaaccccacctcattttagcctggctttaggtcagagtctcagaaacatctcagatgaccctcttccttcagctagatgaccactccccccaggaggataggggtgtggggactggagaggctgacaggcaaggagtggacgcaaagtgctaatggccttttctagccagaacagcctctcatgcaatctggttcttgctggtgagacacgctggccacgctgaacgtgacttctctcaagacaaggccactccatgtctcaccctccgcctctgtccccttcctccttcccgcccccttccaacccattgcagtaactgccgggcccattatctaaattaaactgcattggtttctggagccagcgaggctttggcagctctagttctccctacatactgccccctccctttgctcaggccccctttgcaactccccaacctacacaagctgcagatggtccctgctgtggtcctaggagtggggtggttggcgaggaatgcatgtttctggggctcagtgcctgtttgtgtacctgatgtagcagcagccccctgcgctctgtgtgtgtgtgtgtgtgtgtgtgtgtgtgtgatgttgctgctgcccctgggagggcagagctgttgaatgtgtcctctggggctcggggtgtgttggtgttaacaggagctccagaagaggggcatgcctcgcctcctctcccgccccaggtgatggctggcagatttataggcctctgtctaaccaccggtgtaattcccttaatgcaaaccctgaggaattgatctcagttggagcacagagaagctgaagggggatggggtaggaggagggggagggagactgagtgagaaaactgggctggcaggggcgaggctgggcgctgcagtcaccaagagggttaattagctgctgcttagcagcttttgccctggaggggccagggggccatagatggcactttgggggtgaagccagccattagagatctgtctgcttgacgagggcttggcggactgggggctggttcagaccatttgggccggttgggttctagacctggagtacggagagagggaagtaaccctaacagggcttttgaggagggggtttcagtggctttccctatggagggggttgtaaattgatggacttctgagaagacagtattgtatctcttcaggtcctgatttggggatctggaccaagcagggaatagtttcagggaagcagggctcagagccatagtgaagcacagggcatcttggcccctgcctaggagctggctctcaaaatgagattcctgcctgctgtcattcctcctggagttcgctgcctcagtttccctaatgactctggtggtgataacttagaaaggtcaagtgactgtgcctgttgagagaaggaagtaggtagggagtgtgcgtgtgaatgtgtgcgggtgtgggtgtgtgttggagagggattcggaagccaaagcctgggttcgagttccggcacctacacttagcagctgtgtgatactgggtgagtcaagtcatttctccaagcctcagacttctcatctgtgaattgggagtgatattatccacatgtgatgatgttgggagagttaggaggggccacagtttccccagctcactgttggtggtactgtgcagattaccgtgggcaagccacaaggggaagtgggtcggggcaaggggctgcagaggctatctggggagtcagaggtgtctgttggtctcccctccagcttgagccgggccgtctcagcctcagagtccctggtggggcccctccgggagtgctgccgggccgtggcagtcagcctagcccggccagcctggtgtccccagcgtggcttctgcccccacaggcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctgtgagtggtggacagggtccagggaggacctgggagtggttatggggctgggcacccccccaagttcctcacttccggttgctactgacatatctgttctaacatctgagacatatctggttctcaaacttggctacccattggaaccacctggggagttttaaaaagtactgatgcctgggtgccacctccagagattctgatttcattgctctggggctcagcttggatgtaaggattttttcaacccctccagtgatcctaacttgcagtgaaatttgaaaatcactattccaggatgtgaccttccaacatcctgagtctggagtttccccactcaggcctcatgctcctggtgcccacaaatccctgccctgcccagtcccttccccattcttggttctgccctgctcaccctatatgcctcgagcactcgtgccatctctcccttcctgggccctctccctggagagcccactccccagtctcacccctgttccccttcccatcctgcagccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtggggcagcctgggccccgggagcttccccagaacaccagccccaggacacagcccaggatcggagtggtcgctctcagggttggggtgggggtcaaggcctctggaggagactgaaggaggatttggtgggcccatagtcagcctgcccctctgcaccccctaggtcatcacgctggagggctgggtcgacatcatgtactttgtgatggatgctcattccttctacaatttcatctacttcatcctcctcatcatcgtgagtgactcctcagatccccgtggggatgggcgatcctggggacacctgtgggggcagtccagagaggggatagtttgctctgtctgaagtttttagctctcaggacaagtcctgtagagagggcatccatcatatagtaggagggacaccagatgcagagtcaggaggaaatccaaggtcaaggcgggacttaactgctattgggaccttgggcaagtcattctccatgaggcctccagcactgctctgggcctctgtttcttcatgggtaaaatgaatggttctcaacctgagatgataccacctctcccagagggcatttggaaatgggaaagggtgattctggttttgattttttttaatagctttattgagacataactcacatatcattcaattcatccctttgaatgaatccagtggttttttaagcatgtttacagagttctgtttttttgtaaggacaaggggagtgcaattggcaatttgttactgggggaggggagagaagctaaacatcctgaaatgcttgcaaataaagaattattctacccaaaattctgatcagtgatcaattggtgttaaatgctgcctgatctcttattcctgccagttcagaaattgccagactttaagaaggcagaagacggaggcaaaagcagcaatatttaatagttttaatcactaccattcatagttaataacttcatcgccaccactttgagctaatatttattgagcacttactatgcgccagcccctgatctaagcactttcaatgtgctggtgcatttaatcctcaccgtgatcctctccattttacagatgaggaaactgacatttcctcatttatctgaccctaccagacgctttgcctatgctgtgtattaatctccaagagtggggcatcactgctgacgtatgctgtaacatctgctgcctgtttaatcctcgtcgtcccctgtgaggtgccagggcagggattgtggtccccatctcttaaatgagaattcagcgccccagagggtgggtcactgggccaagatcacacagaaagtaagcggctggggctgagaattcagtcccaggctaacgactccacattcagcctttcttccatgtcaccaagaggccaacgacagagccagacagagggacagacattgagagaaagagattaagaaagattaagatctactcaggacctaggactagctccagagagagatgaagacaaaataaggcagctccttgtgagagacagagggtaggccctgagaaagagcaagtccccaaggccacctcattctgcctgcgtaacttcccctggtgcagaagagtgggcaggcttggggcgaagcctgactggaggcctgttcccatccctggccaccacctcaaggggtgaggccagtgcttcagggaagtggggtcttctcaccatgtgccccccccacccccactccctttccctcctgggcttgggagagggggaaggaagcagacagggagataaggggcctagtttccaccctcccacacaccccctgaaaaatctttcctaacagctctctggaatcacactagtgaagctaattatcataattactaggacacgatctagaaaaaaaaaatctgctttgtcaccataaatattcatttccttcatttgggattgttgtccaagcaatggctgttccagagttctggggaaactgaggcgtggagatggggactggggtagtgtgagcaagtcaggtggcagcctgactagtctgtagggtcaagggttcagcccctcccacatctgagggaggggggcacagggaaaatggggacagacaaggccaatggtccctgttttcagatgaggatatgaggtcccatggctaagggtctctcgcccaaagtcacacagctagaattggggctagaagcaggagtcttgtaaatgatgtttttgtcaagatctcaaggctcaatataatttgaaaaccccatgtccctaatattgcgttcatttccacagcattcgctactcctaatggaaattgcggaaggggtgctgcgtctctgcaggtgtgcgtgtttagggacagggaatttgagagattgcaggataacaccatgttcaatagcaatatcttggaatttcatagagcttggttccagtcttagccttgctctgaattagctgagtgatcttgggcaaatgtttgacctctgtggacctgagtttccttacctgtctgatggagattacaatagcatcacctcctgaggctgtcttaaaaataaaatgagataatgcttggaaaataactgagcgtggcgcttggctcataggaatgcctccgtatgtggtggctggcattgtgattcacttttcttcaggacatttcctcttcctgtccccacccctacaggtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgagaactctgggtggaggcatgtgggtgccctcgtctggggactgggtggcgtcccagaggggactagggggtctggagtcagagggaccagggcttatattctcatgctgcctctcatggcttaggcaccttcaaccagtcacatccctgctatgagctcgaattttctcatctgctaaagtggaactcataattcctacattgtaatagcagtaactatcatgtaataagcacctgcttcgtgctgtttgcaatgatgtctagcaactgttgcacacagcaatggctgtgtgcctgtcacatgctttgcgggcaaaattccattggatcctctctacccattaagtgataggctttcttagcatccccattgtgtggatgagaaccaggaggcttgaggggattgcatgacttgcccaaggctttgctattggtgaggggcggactcggggcccgcactcgggactccttgttgtgaggctcagagaggaaatggtgtgtgactgtgcccagcttcatgccccactggctaaacctgagtctcattgcctccgcacagggagacccagttcagggagctgcttgtctgatgggtgacactcccagtgtcgtgggggcagtgagacacatagggacgtcgggctctccccagcagacaggttcactgtagctgcagcccacggcctgtgtttcaggaaggatgtggcacgtggggagcagcgggatattcgtggggatgttacgtgggaatgtgggctgggaccagaaggtgctatcacagaacccagagcgaaaggtttctatgccagctcctccactaccctgccacgggacgtgggccagtcacatgcacccacgtttttatttcctcctgtgtaaaaggcaaggctgggcccataattactctcagtgggtgcttactgactccctcctgtgtgcagatgcagtcaagggagaaatgtcgctgagagcccacctggggccaggccctgagcggggggcttccacatccatgctttacctggtactctctgaggttctcatattctgtgatcaaagctggatttaaagggacattgatgtcttgggctaggtccctgagtgtgtgcgcacgagtgcatctagtatgcgtgtatgcgtctatgtccatgaaggggtccagtgtgtgtgtgtgcgtgtgtgcatgcacgtgtctggtgttcatatgcatatgtgtgcacatgtgcttgatgtgtgtaggtgcatgtgcgatgtgaagctctttccttggtgtgtgtgcatgtgtgcatatgtctggcatatgtgccgtgtgtgaatgtgtttgtgcacacatgtgttggtatgtgcatgtatgtgtgcccatatggtggtgtccaaatagtatacatgtgtacacgagtgtgcgcatctggagcacgtgtgcaggtgcacgtgtctggtgtgggtgtgtgtgcaagtgcacgtgtgtgggcgtgtcttaaggatcccatggaaagtgctgctcagaacagtgttgatgtagtcctggcttctgggaaggggaaggggagcgaggctccttgctgaaggcacctaggatataggagctgtccaggacctcagaggacatccaggccacctctctgagccccaggacactcagcagtgactgtcaatgaagtgctattgacattagggcatcttgtgggtcaagactgcccaccttgcctgacattcagcacccctggcccactaagtgcctagcaccccatcactgtaacaaccccagactccctgactcattttacacatactcacagggcagggtagccccaggtacgagactctggagcctctcacctctactctcctgttccaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcaggtaggagagtgggcagaggcagggctcctgccagctgcttttcgcctggggctggggccttctacctccctccgcacccctcctcctgagctcagcttcctctccatgctgctagcccacctggcaggtaggaggggaggtgggtgatggagcaatgcatggggattctctagagggagtgcttaaagtctctgagtatggaggtcgcctcaggtaggccacagggtatgttctacccaggaaggctgctcagaggaggctggctttgaaggatgtgaacaagtggtgagcatcagcatgtggggagaggcgcgtcactgggagatgtttgggtctttggagaaggtgtagtgcggagggcgggtgttggaggtcctgtggcatccatctgacccactaagtccgggtgtgactgattggaggcaggaggggccatgtaaacaggggtgcagaggggagggttggtgcctgcgcctgggtggaatgaaggcctgttggggtcagggagggaggcaatctttcctggcctcccgtctgggagccgtgctgtgaaccagggcagctcagggtggatgagagtgcccagcatggcaaggggacttgaagccatcgcgtttgaggaatgattctaagaaccgggatgtttagttaggaggagcaagggctcagcagggacaggcaagctgtcttcaaatatttgaagggctgtcatgtggaagaggaagcaggcttgttttgtggggctgatggctacaagcaataggatctgggctgagggggaggaggcttttctaaccctcagagctatgcagagatagaaagggtagcctgggggaccccactgatcccccatcatgagctgaagatgcccgcttgttgggggtccaagcaggcaccatgggtcctcacaactgggtttggctccctcttccacagggttctttccagaagtcgctccccctccccccagtctggcctttcaggtcacccctgtggctgattcttggaaaaggagagaggctagcaagcaggtgctgcagttcacggtcctcccaggctctgttctcctgggtgttctggcctccctggggtagcacggaggcactgggccatcagaacccaaccttccctggtttggaacgaaggccatgcacctccccacctccgcaccctcccaatcaggagcagaggcggagggggccagtggtgtggagtggctcttacaccagcacagcaccctgtgaaaggggcatctcaaaaaggtggtacaggcagggtggtacaggcatgctgggaggtctgggttgaggctgaggggcacaggtcaagccgggtctggagcagacagtgaggtgttcacttttccgggggattcgaagcccgcccccacaccactgacctctgcacctgcaatatttcgagcacccagcttttacccaagactgctcgacctggccaggtgcacccctccccatcaccatcacacattggcgtcccttcctctaacctccacagggccccctccaagcagccatgaggtggagagagagtgggaccctggctgcagtgccagcgggtgggcgcacttgacaccacggtgggcatgttgtgtctgggctacgtgggtgtgggtgtgtgtgcacatgccaactctgccagcctcccagggagaggtgctccactctgccagattggtggcagtggggggtgggcagcattttctgcttccgggacccaggtggtgacagcccctaacctcccattactcaggctccctgaacctcagcctcctttccctcacccctgttccggccatggtcaggtgcccctcccccagggggcacctccccagtgccccctccctaccccggggggagcacccagcagtccctgcccagccgatgctgctggtggaggttttgattgcactgggaagaagctgagtcacacagacccagggcagatgaagccttggtaagagggctttcagttagatgtcaagaaggacgcccctttggagagaaggcagcagccgtcagtcaggggtgcctgcaccttcttcttgctcaggctcctgaggaagggcggagacagcccagggctcccactaagtcctcagcagcagggaggcctcactcagtgacagcagtgtctgctccagggagggttttgtccgcatacctggtgctgagggccccatgggggtgagcgggagtccccagcaggctgggcagatgactgacagctgtccagcgggctcaggggtgcggagagtaagaagtcccagaagctgccatggccctgtgcttgcaggcactgcggcgtgaacgtcccgccatctgggccctggagcctgagcaggctgggagtggggggttgccagggaaggcagcaaggagatgtggggggctgagacagagacacagagtgggcacagagagggagacagagacacatgggggaatggggacacagagggagacagagaggagactgatgggggcgagacagaggcacggagggcaagatggagacgggggaggagggcaggaagagagacgcgcaggcaggggagaaaggatatggagggagagatgagccacagcggagacagacagagacaaatggagccacagagacacacagggagacagagacacagagagggagctgaagacagagaccgagtcccagatgcaaatgagggcagagacggggtgggatggggagacagagactcccctggagctggctgcatgaggaggctcacggcttccctgcggtgcccttaatgaggcaattgtgtccattgatcccggaatcgattggatgggggggcgggcactggaaagggtgttgctggtgctttgccagaggaggagtccctgccctccctcctggccgtcaccgctgccctccccaggccctgtcctctcccaccatcccctggctgactcatcattcgcttgtcccgtccccccaacctgcgctaccccaccatcctcctgactgaggaagcacctatatgtgataccccaccccgcccggggctggccccatgctgtcctctgtctcctgcttcctccaccccttaaccaccagctggaggagaactggcaggattgggtttgcccagagggctggtgagaaggacaagaacccaggagactgaggagagagcaagaaaatgacctgatgtcgaagtgtgatctgatatggggccagcctacatgtgtgccccatccgctcagggcggtacatggagtccagaacctttttccaattcatccttttgcactggagttgggcctaagcagtgatttgctggtaaatgattaacaactagcccttctaaaataataaagtcctgatctgtagcatttgccaatttccatggtgtaaatgctcccaccatagctggttttaagctaccaacacgattccaccgaatgtggggttgggaagagacgtggacaattggttctcccaagccagtgagaaacagctccagcacgccactgggcccaaggcactgtccttctttttaaagaggtcacaacaagtaaacggtcatatttacttgatgtggcacatgctcagagagggatacgtggaggaggagcccttaacccagaccagagaaggaattcagggagggctccgtgtaggaggtgacctctgggctgagtctgaaggaagagtaggacatagccagtgaaggtgaagggcagggcacagtatgagggctccggcagtggtccaggcagttcatactacatcttcatccctggaaatggagagcagagggctggggagagctggctggtagctggatctgcaggacccaatcagttggaaacatgggttgagaggaggcagcaaggatgactcccaggtttctacctggggtgggagcaatgtggcttgagcagatgtgggctgggagacatgttgcatacaaggtgcctgcgggccatcctgaccatatccagcaggctgtcggagctcagaaaagaagttgccttctcttctgtgtcctgcctggctctgcactggggccagacctctccaggaagaggggagtgcaggagtggggccttggagacacaggagcttcctaacatctccttcctggctctgggtcatggtggggtgggggacaggtgctagtctaatgttctagaagagggacaacagcatatggggagaggggagctacatgtagcccagtggtctcctgggctgtagacggggagaggaaggggagggaccagggtagatggccttgcaggctgagagaggacagggcaggtgatgactctgctcattgctcacactctggggccatcctgtcactccagatacatgtccagagagggtttctatttataagtgagtgagtttggctgttcaaggcgagagaagctgggggtggggcaggaggaggtggtccagatatggtaagtctgaactttgaaggaggtcatagactccttttcagttctgctgaaggctggggaccctctccccagaaaatccccatatgcctggacaccctaaatgtggcctttgagggcaaaggttgatggacacctcccaccccagccagtcccttggtctccagatagaggagccctggctgaagagctagggctgaggaccaagcagagctttgggggatgatcctttgcagctgactggccccagacattcaaaggctatctggtgtgggagggagaggggcattgttttggagatgtctgctaaggtgttctcttgttcttttaggcatcccctggctccaggctctcccagttctgcaaacaaggggagcatatcctgtgcacagcacactagaatagaatattagaatatcagggggttgggggctgagccagaaacacccaagaaatgtaggttctggtggaaaagtcattctgtttcatggatgattatgccaaatgccgcaagagaggcttcaggggacaaaggagagctgctcatccccagctctccttcggaagggcttcacgaaggtggtggcttttgaacggagcctcgaaagatgaatggaattgacagtggcttgggtggtgggggtggggggaggtgggagatggaggggtgggtaggagcagagagatctaggtggagggattaaggcacatgcacagggtggcactcgatgctctgaaggacagtcaggttttcctccctgccctggccccgaggtgtctgagcagtgattgatgttagcccagcgaggaagccggtgcttcccattggtgcaggctgggtggaggagggcctagaggctatttctgttgttcagatcagaggcaaagagggccccaagtaaggccatagctatgggaacgaggggttgtgggtaggacgcaatttcactggcaggttctctgggccggggcaccttagtgtccagagggaggaagggtgggcaagaatcctagataacccgaagtttctaaggcagaatcccgagcatgatggcgccacccgggaaggagcaggtttgggagaggaggcgagagggtttgttttggatgcactgagtttgagatggctgtgggccatcccaggagggagatcaggcaggctctggatctctggatgagaagccaggggcttggagagattgtttagtgtcgtctacaccccagtgacagccagagaggtaggagtgggggtactggtggagggagcgggcttagactgaactctgaggaatgctggcctgagggaagagaggcggtgaaatgagcactgggaaggggaagaggtggttgctcagggtcggggaagccaagggaggctcagctgctgctgaggcatccactaagaggagggctgggaagagggtccctggacagagctggagctgtggggcccagagttcagaactgaatgagtctggagtcccacagaagctttctgcttttaggcacgggggaaggagattggagaagtaatggatgcaggcataactgataggccagggcccaggggagccgggggcgggggtagggggtgacaggggggcggcgggggagcacatcaaagaatcaaagtgcaggtggaggaacggctggctcccttccaggagaggaagagagacagtgggatgcacaacacagagctctttggaggagggacgtggagccccccatgtaagcctgcaacgaggggccaggtggggagtagggctgggggctgcagagtccagaaggattgaggcagctcctgggggagagaggagacctaagaagggaggaaccagggactgtgaataaaggcatgaaacagccatggggccaccacccacagggaatcacttgtccagtcagcacatgttcgtgcctctctctagcgatactcagcacttccagagccgcagaggagaggaggagggcaagggcacttacctgggctggggctgggcagggcaggagctcttgaaagtcttcgtcagaagggcagcctttatgtggcctactgtggcccaccatgggctagacgctgtgcaggtggacaaggcacaggggctgcagctccagcattttattatttatttattttaagagatggaatcctgatctgccccctgggctggaatacagtggcttgatcatggctcactacagcctggaacttctgggctcaagcgatcctcccaccccagcctccccagtagctgggactacgggcacctgccaccatgcctggctatagctccagaattttaagtagcaggggccttgggtcagctgtcttgaagctgagtgggcaccgtgagtgtgctgtgcctagttagcttgtgtgtttacttttgagggcttcggggagctgggaaatatcatgtcacctacaccccaatgacagtggagaggtgggagtgggggtgctggtggggggaataagcgtagaatgaactctgaggaatgttgccctgagggcagagaggcagtgactgtggctaaagcctctccttggcactgcctctgattaggaggccctgggggcaccatgacacctagcagtgtgcccagtgggcaggagggcacaggaggggggatccaaactggagagcttccgggggctggggaagaccaggaccatgatctacatgatgaggcctgtgagatttccaggaaacctcctgccaccgaggtgttccctgacttcccacacctccttgaagacttgcctcccactgacccagtgaccctcactgcctcactgcagcctgtctgtgcccctgtcctgggtgggtgggagcagcaggcaggcccatcagaagcagaggtgaggtgagctgaggagtctgaacagaagagcagagatttcagggtcagtggagcaggtggaagctggggcgatggcagctggctggggtcgggcttgggcagagcacgagtgactggtccaagcctctgctcagctctgacgaggcctgtccagcccctcatgccctctctgcaagaggcacatcactgtctgccagagctggctctcaggcctcctgcctggactgctgcagtatcctaattggtttctgtctctaccctccaagccgtccacacgctgccaccactgcagccagattaatcttcttcatacactgctttgtacatctccttcctcccttcccacccgcccccagggcctcagtggcagcgtggtaggcagagacttgtccagagggagcagaggaaggctgttccacctggccctgccgaccttgtagccttctctcccaccagcccctctcaccctctgatctgggcagacaacttgattcttggttctgcactgtgccctgcacaccccttcccttgctgtccccagctggggacaccctccatggacatcctcccaggctgtcctccccactggcccactgacctcagccgggattgagctcccgtggctcctgggttttgcccccagtgtggtgtttagttgcagccttgcagatatcggtcctgccttctgtgagcttggccctggggctggggtttctcacagcctttcactcctttgttctgtagagcagcctcccaggaggtagtgttaccctgtttaacagaagaggccactggggatctgagaggcaaagggaattgcccaaggtcacataggaagaaagtctcagagttggtggcacctttctaacaccagtgtttggcacacagaaggcacttttagggctagttgatggagcagctatgaggcttggggagccccggtgctgggaagtactgagcagcttaacgctgctgcaaggtgacagccggaggggaggggagtggaggtgttaggaaatgggagatggagatttacagtcaacatcagcacagacaagagacctgggacctctgggtgggataagctcaggctgcctggcctcatttcaccgaaacctccactgggccttgacatctgtgaacagcaggaaggatgcaggctagacctgggaagggacttccacagctgggggtggccagtgaggggtggctggctccagcctgatgagtttgtgtgctctctgtgtgagctctgtctgggtatatggtgggggcgatgttgtggaaaaggtcttgagggcagagatgtagagggaggcacaacggacctggctctgcacctctccaggagggtgatgtgacctccatcaaggcaccacacccctcggagcctcagtttcccagactatctaggaggctcacagccctccctcgtttgttgtgagcagggaggaaatgaaatcccacgaggaggtcttcagcctagttggcctgtggtgggcactgccagatgttggctccacccctgccccttttcagccgtaattacagctctggtccctggggcaactttgttgctaagattgtgtctctatgtcctcgtcctgcattcgcagatcgttcccagcctccaatttagtaacttggacagacctggctatctgggggaggagggctctttttccatggctcactggagggaataccggggccctggagaagaagtggcatttaccctaagtgttgcagggagactagagagagcaaggcagggccgagggagtgcgccaggcccctttccacctgcatcaggctgccctgcttttccaggcctggagtcacttggctgggcaaaacaggggttccagcctttgctggcacagcccttgacaaagttcaatgaggcaagccttatgggacggcaggcttctcaggagcctggcatcatccttctccataagcctctcggtggtgtgcaggagagtgaggtgtgcacgtgtccacaagccatcagtacagactcctgagagccccgtggataacatcggggagtgaagagaacagtctccttctccacgcacagtagtagtcggacttttagaattcactgattgagtaaatacatgacatcaaaagctactgtgttttcagcaacttttaaaagaacgtttcattaatttttatttttagcagctttttgggggtatagtttatatgccatgaaatttgcccattataagcgtacctcagctgtgtcttcacatcgagttggtctttattcctagaactctgttgatttgaatataattttagaagacacgttgtgtatccagtccaccgtgtatctggattcacaagcccctcaccatcaccgtggcttggttctgaatcctgactgtctaatattcttggagtcagagggatgtgggattgggccccaccccagctcttcctgccctgtgactttgaacatcatacctgtgcggtccatgttcattttaatctaatccaaggcccgaaaacacggcgagtggcagagtgacagggaggagggtttgccgactcccgctccctggcagaccggacttggaagtacagagtggggggatccacttagccaggtggggtctgagcccagggctttatatgcattgatcctggccccgccccacctcctgtactgtgctcacgccggagacactaatggccctgtgtgaccgggctaaccaggtcaggtggcagtgcccccactcacaatccacggagctacgacttacttgagatctgctggagcaacgggctccatgccatactggcccccacgacagccactccccctctgcatagctggctgtctgcctgcctgctggccctgactctgcccccaggcctgcctttgaacagtctgaaagtttatctctctctgagtaactgttgtccccgaggctcccaaatgccgctcacctgctagtcagaagccccttgttccgagtcttttcacctcccatccaagctggctgcacaaactagggccattaggatacatttgggtgtcctcaggcctggctgcaggcttggttgggcagctggccagcgagacagtgagaagcaaggagaggtgtctgatggaatgagtgcctcatttgaatgtttcattaacccatactttttgagcagctactatggacttggcctctgccctccaggccagacacctagtttgtccagacatccatcaggtggacagtggggtccattgagccaaccatatctcttcttgcttccccagccctctgcctggccacacccctcccttcttcaaccagaaccaggctgaggttgctcatgatccccccaccccgtgccacaccacctagacccttggctggggagactccacaaacccttaggcattcaagtgctgcctctctcccaactaagcctttctctgtgtgttcacccctcaccttttctcccctgaactcccggacttgctgcctggataatttattttggcactgaagcatttaaggcctcttgtggttattcagccgttttgtgtgtgtacaacgtgtttctagcagacactgagctcctgggaggcggggcgtgtggctggcatgtttttgcagctcctttaatgcctggtgcattgctaggcacttcatattgaaagcgaggtcactagtgagctggaatggcagatgagacagggttcgtcattcgtccttctgaggactctagggtgcatcctcagtcccagtcccagactcgggtagggagcatgaaaggaattacctctggtgtttcacatttggccagagaggttgagaatcttgctgaaggtcacagagtgagtgacaggataggctgaggattaacccgggtgtcccgggctcaggctgaggctccaggtgtctcctcaactgtgacaacccttcctgggtgtctgcgtgtcttccttctgcctatcaccatgtgtgtgactgggaatgcgtgcatttttctctctctctctctctctgtgtgtgtgtgtgtgtgtgtgtgtgtgtgtgtgtgtctggaaggaagcaagagtagccaactgttgtccaagagaaagctgccaagtccacagagtaattgtggaatacatgtgacgttgtgtggggcttgacgaccgggtgtgcctgtgaggccttggcgatcgccctctgacatccgccagcattgtcatgctgctggcctgggcccgctaggcttgcattgtagcctaggtcaagatgggccatgcagctcccagcaggagatagggcggaacccacaccacaggcctcccattgagtttgtggcccctgaatctgagacccagagctggggctatgggtttcacgtggccctttcctggggcccctgcccctgggtgcatttcctcctggagcctttggggcagggtcctccccatgggcctgagcatccagcaacccctccgcacaagcttgctattcctgctcctcctctccctggtgtcccatgtttggaggactggatcgaggggctcagtgataagccagctgcctcacatcccaccctgccctgcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcaggtatgactaccccccggcactgactctcagttgaggaatggtagcaggggtggcttggggccaggggccatgccacctattcccctggggtggaggggtctggagtcaggccccactgaccccacaggacctgccactcctcctaggtggggggctctctgtgtccccatgccccctccatctctctcttggccccaccttgctcctgttgaccttgggctcacctcttcattgcccaggcccctctttagtctcctctctccacttctacctcttgtccttgaccccacccaggcctgggatgggcgagggtgagattggctttagaggagttggaagaggtatgaggcccagccagctgcccggctcgaaaagtgcttggaaatcatctcagacaccagcaacttgctttagggtttccaagaccttgggaaagtgctccgtccccgcaaggcctggggccaggagaaccactttattgcttttggaattggctttagatttcattagaagagaacaaagcaaatattccataacttgatgcagttgcattggccagatttagggagggagttgtctactgccaggatgtgatctctggcagggaggagagggcggagggggccggggctgtcacccaaatcctcactatcttggaggctcctgcttagaggtctgggggcccacctgtgccccattttctctcgacgtgcccacccagccaggcccttgggtgctactgagtcctctccgagggagtagggggagagggtgaaggtgcagggggctcaggctgcctgccccctttgcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcaggtgagggcggcatggcaccttgccggctgagagaccggccaggctgggggcaggagggcctgaggggtgaggagcactgggctctgatccctagcttgtggcccccttgtgcccacagcatcctgggcatgcatctcttcggctgcaagtttgcctctgagcgggatggggacaccctgccagaccggaagaattttgactccttgctctgggccatcgtcactgtctttcaggtgcgagggtaacagggcagggcgtggacaggggccgtcaggtgcccctagtataggccctgattcctgtcttctgcccgcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggtaacccactgctctgcccacctcaccctgcccacagcagtcccacttccaattggctgcctgtcttgagcctcctccctctgttgccaactttgggggcctgggaagtcccacaggaagagcctcttagactaagccggggtggaccagggcgggaggctccagatctcgtgcagcccctcatcacatgggacacagggtggttgtttggggtccctccaccaaagcttagctaccgagtagacatccccttcagagttggctagaccccttccccagagaggcagaccagataagtgtctgcctgtggtgcagctggactcctgagcacagtgctctatggaacacccggagaggacccctctgagccgaggggtgcaggaggcttgtgtgcaagttatctgagctctgactgagcagatgaagatgccactaagaccagagcagggctgagctgcccagggtgagaaatgagcccaattagctacgggcatggcagagatgagcgtcctatttccagcccaggctccatcaccttcgtcacaggcagcgtcatcaattaatattgatttacattgatcctgcccttgccatgtcagcgagcagcctctgcccagagggctgcaccccctcctctccctcagctctgcctctcttcccacccgagcccccagacccaccccagcttgctggggcttcaaacagggcagtttgacccaacctagaaacgctccaggttgggtctggagaagctcttggtccagttctctctgggtgacccggatggaaactcccgctgcggcctggtctataaatacctggcacacggtggaaaaacaaaaatctattttccgactctttcccagtctttcaagggagggcttttccctgtgggccggctgggttggtggggtgcagcgtatctgtcccacactggtctttctccccgctacccttttcagtctgtagttatccgttatcgcatttcctccctcctgtggggcagccagggcagctggtgggggaggctttggtgatggctgtgcctcttgcagggaaggagggagggacgccggtatgctccctggaatgggacactaatttgggggttccctgaggcctgaagaattaaggggcaccacagtactcccacaagagccagtagactcactctgctgctgctcagggtctataagaggaggagctgagtgaggaccgggccccctggccccttctgaaggcagctcctgccagccacggttccctcagaaaaattcccgtgcaactctgtggagggaaatggaaaacaccgcgggcctattcccctcccctcctctgccactcagccgccaaggcagtctggaggtgcccagcacagatggccccctccccagcactcagccctttcagcaaacaccttgttaacttgagtgcagctgagcggcctggttgctaggcaacagcaaagccagagtgtgggaatgagcgcagcctggccctggggcggcctggtcactctggccctgctgggggcctgggactgccccagtgtgagggctcaacaaggcccacgcagccacaccctccccaaccttcgcagtatcaggacctttgcagggagggtctcactcaggatgcggtgtcttgggctgggatgcttcaggcctggggtgggatggagaaaggactttaagaacatcccctctccatgggagtgggcagtgactgtggccccggagtgcccatgggaggggctgggccagttgctcccctgtcctgcatgtggtgggcagggctggggagtgtccttcgatgcccatggcctggacaactccaaggcacctgccctctcctgggtaaggtttcagggggccccacggtctggcaggggagtctggttttgctgttgtggtggcctgggatttttgtttttattttgacaaataagacaacccaccttggcagaggaagtggctgcccccattttggtgggcttccccagcaggaggcttcaagggtagcccccctgctggccttgctaccttgccaagagctaggagggggtggtccagggacacagcctgcttggctggtgatttcctgacttgcagggggcagcgccctgaatccctgtgtatttatcattcacacacttaattaaatgaacaggcagcaggccctgtgtgaggccattaattgatactaaataacatcagagccatcatctcagcattacttgtcacatcccatctcaaacggagcagctggatctgttctgatctgaagggacttaagctgagagcatgagacgttatgaggcctgacttggctccgtgttgactctgactttcgtccattcctttccttgcttcctacccattccccaagcccactgcctccgaaccggtgagaggagagtggtgttctgagccacagactcgggttccaggcccagatccacctcttactctgtatgatttggggcagtttccgcaacttctccaaatctcgggtttctcttgtgtaagatggcgatcctggaacccacttcctaccttgcaaggaagccagctggtgttaaggaggcagtttcccatgccaggcacacccttaatgaatggtggctgttattattaggattatggggggacctgcccttgtccccatctttttggcctctgcactcacccttcagattcattctggcctgagggcctgtagttgaattctggaaggctgttctgtcccctctctgcccccccattccccgtgtctctcagttcccctgctgtggggtttgcgcccctccttttcttcatcctctctcgacactgccgatatctgaaggccccgagcgcctgtgaccagcagccctcccctgcctccccctttccctgtaggaaatcagcaaacgggaagatgcgagtggacagttaagctgtattcagctgcctgtcgactcccagggggtaggtacgcgatcatgagccggcatgcctcccgtgccccatgcccgtgcccctccactccgcctccgtgtctctgtgctcgtgttcacgctccgctgctgtgcaacctgtcatagccgtgatggtcattggtgttgtgaggtttgcttcgattttaagtcccttcccccttgaggacacggaagggaggcacctccttgcctctgcccccatcaacccaccaagggcaccatctccatccctgccagactggtggatgggccggagaaggaagggacttagaatcctctgtgtgcacgtgtgtggggcaccccgtgtgtgcgtgcctgtgctgaggtcccggaggagtcccagacgtccggcttcagtggagtcaagatctggccgtagaccatactcccccatctcccaccccttcaccccttgccccaggcccctgttggagaccccgcaagctgtctcagctcaggacaagtccttggaggatgtggggatgggatgtggctcttgccaaaatgtaccaatattttaaatcacctctgagcctttggccccttcatcacccacttgggtccggctggcgctgtcagggctggctcccggtctggccccacgatgagcctgtgctctgctgttccctgccccagcaccagaattcggggcgaagccagcattcctgtgggaccccatggtgctgcatatcccgagcagccccctggagatcccacttgataattaaaggcctcgttagggctgtaaactgagttaatgaaaatgatcccctgagatgccaattacccaatatttatgtccttatcaaaagtagcaatcaagtattttttaataacttcttaaggagaagtatgtaattactggggaacctactgacctgctaagaagaaagaaaaaactgtcccagagacagggagagaggtaaaaatggggccagggagggggccgggacttggggaagatgaagggaagacaccgagggactgaagtggcgtcctcgggctgagctgttctgtctggggtctttcaatttccttccagggtcctcgagtctgaggctcaggggaggggagccgtggagagaaagcaaagggcctccagtgaacttttgcaagagaggctctagtgaccacttcactcaggtccccaggtccccagccccctctggcctgtgccacctgccacctagctaccccttctctccccagccagccttggtgaccgttcagccaggctggttgtgctgtgggctcacataagctgtggccttttctgaggtgtggctggagaggcagaggtggtggggccctgggaagcctcgggccccaagcctggggggtctggcctgcgccgtgcatgtctcgtgccgtggttgctggttcctgtggcctatatgtggtgtgcgtgtgtgaagagagggaggcccggtccatcccaaccacccaagcctggccggatccctaatggtccgctgctcccctgccctagggagatgccaacaagtccgaatcagagcccgatttcttctcacccagcctggatggtgatggggacaggaagaagtgcttggcctgtgagtacctatcctggggtgcgacttttggccctgggccagccctgtgtggactcgggatctctccctctctccccgtgcagtggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccggtagggggtgcatgtgggtaccctgatggtgggagatattccaaggaggacaggaggaagagaggatggaggcaggcgggtccaagggcacagcccctgccccatgggctggatggggcctgggtgtgcctggacaagcccctggggaatctgcgccggtgatgcaaaccagggtaggagccctagcctgggggctgaaaacagggcctaagctgacctcttctgtaccctagctgagtgacctcgggcaagacgccaccgctctgatctgcttctgtaaaatggaggtggggtgtccatacctcctcaagactgaataataataatagcagaccctcatctaggtactgactctgtgccagacactgttctaaacactactccgaagcattctaaatgcatttaatcctcacaccaaccctgggaggtaggtaccacaatgatccccattttacagagggggcctgagcctcagattgcagaagggaatggcagagccagcattttaatccaggaggctagtgttggtgcccatgctctcatgattttatttatttttaatttttttaaatttcgcttttaattgacaaatactaattgtgtatatttatggggcacaatgtgatgttttgatatatgcatacattatgggatgattacatcaagctaattagcatatgcatcacttcacatacttattttttttgtggcatgaacatttaaaaatctactcttagcaattttgaaataaatatgcattacgttattattgactatagccatcatgctgtgcaataaatctcgaaaattgattcctcctgtccaactgaaacttcgtatcctttggctaagccttccccattggtcccatccttacctctcccaaccccagcctctgctaatcaccattccactctctacttctatgagttcaatttttttggatttcacatataagtgagatcatatggtatttatttgtctttctgtgccttgtgtatttcacttagtataatatcctccagttcatccatgttatcacaaatgacagtcttcttttttaaggctgaatattattccacagtgcatgtatgccatattttctttctttctttctttcttttcctttccgctctgtcgcccaggctggagtgcagtggcacgatctcaactcactgcatgcaacctctgcctcccaggttcgagtgattctcctgcctcagccacctgattagctgagattataggcatgtgccaccatgtccggctaattttttgtatttttagtagagatgaggtttcaccatgttggccaggctggtctcaaatacctggcctcaagtgatccacctgccttggcctcccaaagtgctgggattacaggcatgagccactgcacctggcccatattttctttatccagtcatccattgatggatactaggttgattccatatattggctattgtgaataatgctgaaatgaagatgggaatgcccgtatctcgtccacatactgatttcaaatcctttggataaatacccagtgctggaattgctgggtcatatggcaactctatttttaggtttttgaggaacctgcataccgttttccataatggctgtattaatttacatttccaccaacaggacacaagggttcccttttcttcagatcctcaccagcgcttgttatctttcatcactttcataatagccaatccaacaggtgtgagataactcattgtggttttaatttgcatttccctggtgattagtgacgttgagcatttcttcatgtacctgttggccatctgtgtctccttttttttgagatggagtttcactctgtcacccaggctggagcgcaacagttcactgcaacttccaccttccaggttcaagtgattgtcctgcctcagcctcctgagtagctgggattacaggcgtgagccaccatgcccaactaattttttttatttttagtagagatggggtttcaccacattggccaggctggtttcgagctcctggcctcaggtgatctgcccgcctcggcctcccaatgtgctgggattacaggtgtgagccaccgtgcccagccctgtgtctccttttgaggaatgtctattcaggccctttgcccattttttagattgggttgattttttgctgttgagttgtgtttcttcaccccattatatatactgccactcagctgatgataacacttctctcaccaaataaatgaggaatgagctctattgccatatctagtttacagatgaggaaacagatgcacagagaggcttaataacttgccccaggtcacacagctggttggggtgagccaggatctgaacccaggcatcagagtccagagctcctgctcacatccctacacttgatgtgatgccagtgaggctcccaggagaccgggtgcacatgagaggacagggctgctgggccctgcctgagaccactcctcccctgctcacccacagcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctggtgaggcccctgtgggcacagtgacccctcacccctgaccttgaaagaggggaggtgtgcctggcctggcagggtataagggagttaccattccaagcccacggaatatcaaggggcacctagaaaccgagctccaaacaatcccttttctccctctgcccgccttgccaagccccagatccttgtcatgcctatgcctggggctgcggctctgccacccttggtggatatgaatgattttggacagatgtgtatgaatctttcatggccctccccctgtgactcagaaagacccatcactcatctctccaaactgatgccccgcatccccctttctcgtctcaacctcatcacaagccatgacttcccactctatccatacccatgtgcccctgccccagcccctcatcaccaccattccccctggggatggggtgcagtgacctcagggttagcatgtgaagagcagggccagtgtctcctcagctgaggtgtgtctctgaacagacagctgtgtggggccagtgtttgataactgatgctgcttcccagctcagcagggaggacaggcagggggctgggctggaggcaggggtggggagaggggagagcggggttggggatgcaggggaggagagggaggaggtggagaggcaaggggtcctcagggatggggagggggcctggcaaggttgacagggagatgaggaggtggctttaggaataaaggaagagaggcagggcagagcttgggccccaggtgggagagggtagacaaggagtgaggctcgtgactctgctgaggagccaggagccggggaacctggaggcctggtcctgctcatactccagtgtttgttctgcagagcaaaggggaacgggtccgcgcgtggatccgagcccgactccctgcctgctgcctcgagcgagactcctggtcagcctacatcttccctcctcagtccaggtaagtgacagggcaggggtctgacctgtgtcccgacctcttcttctcacgggaaattaccgctggtgatgctgtcagggatttgagaagtggcaccctgcctggggtgtgagcagggtggcctcagctgggagggcactggaggggcaggggctgcgggcggtgcctctcgttgccacctgccctgcctccccctctcagccgttgcctccatgcctgggcaggttccgcctcctgtgtcaccggatcatcacccacaagatgttcgaccacgtggtccttgtcatcatcttccttaactgcatcaccatcgccatggagcgccccaaaattgacccccacagcgctgtgagtcaccagccccgctcagggcaaggcctctcctggggtttgcactcaggaccagtgagggaggcaaggaggccacagttgctgacctgcaagtcacacagcagggaacgagggggccaggactctcctttaggtctctcaccagatcctggtccccgggatgccccctgtgtcctctcctgcctcagtttcccttctatgatacatcagcccagctgggtgctttgtctcattccaggctatttctcatgagccagagccttgtggggcacacgcgtgagtcggggagtgctggggcggtgcaggggctgtgtgcagatggggaggcatcttgcccagtctgcctcagggcctcgggggcatgcagagtggccatggaagccgttctttgctcctggtcatccttccaggtcaaaaccaagtagattttcaggggccatagtggggacatgggtcacttctgcttggctgcgaacctgtcagtccttctcagaaggagagccagaggccctggacataccgccccagggtcgaaccccttcagggtgggcccagctcaccctgggagctgtctcttcctagcctggcattatagcccttcgctgtcggcagcaattctggttccagaaggatgggtggggggtggttgtgtttccgctcacggcatcctgcaccacttgcttagaggtggccagggtttgcctctcatccctctttgccatctcccacaccattgtttagatttcagcgctgctggggcttctgttttctattagggtcggggtggagggagcctgaggaatggcgggagcagcccaagactaggcgggtgagagagcacccgcactggggacctcacacccggagtcacagggtaaggcaggggcgctggctgcactccagccttggctgcctcccgcctgaggccctgctgtagagctctctgtcaccatgtcactgtctccacgtctctctcaccatcttcccactcagcttctccatctccagctctgtcactgtacctgctcctctccttccctcctctctgtgctcacaccctgcccgccacctctctagagatctgcgcctgcctcctggccacccagggagggactcagtccacagatgccagggaactagatggccttcctccctgccctgccccagcctgtgcctgggggtgcagagtctgtgtcaggaccccagcttccactgctgctccatttctggggtgcacagcaggaaagcaagtgaagagggtgggatggcaggcaagggtcagagatcaagtgagatcctgccccagtttttaaaaggaaccagggaatagggcttaggacgtgggacgcagatcacagcactgcagtgcagatcctctcccccttgggctaagtggctgtgggggcggggagctctggtcacagacaggggtgtgactgtccacagagctgcaggggagtcagggggcctggcactggctctgtgcgtgtatgagaggggcgtgatctacattgttgtggagggtgggggtcgttttctgagtcaaatgttagaagcaggttttgacttgtgtatgcagagcagacctggcccaagggtgggggcttcctggcgggcaacccctgcctcccctctcttgcaggaacgcatcttcctgaccctctccaattacatcttcaccgcagtctttctggctgaaatgacagtgaaggtgatgggggctggtgttggcttgggacctctggttcctggtgggggtggagacagcttgggctgagggtgggagggttggctgcagcgcagggagggcggccgatgacgtggcggtggtccccaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcaggtgactccctccccagcactggaacacctccaagaggtggccccctccgcagggacatctcccaccgccagcactccctgccacgaaacaaaagcctgcacaggccagcatcctgtctgtgacccccacaggcgatcctgtccccgccccagacaacactcagattacggccgcagtaatttccctccaggtgcacacctgctttcctcctcttcaacatgacatattcctcagggccgctgcaccatgtgatgtaaggtgactgcagccctgtgcagcacacagcacaaggggccacgagcaggactctcacagtcttcagctgcggctctcccttgtgtggcctctaggggtgacactcagcccctccccgtgaggtgacaggctcctcttgctggctttccccatcttcaggcgcctgccagtgaccaccccccggtgacatttctcctgaccagggatccaccctctcaggaatccctttccaatcagccagtcaccacccccaactcagattttttttttttaatagggatgatgtggactaatggcgatgcttccctgactgtgatagtccatctccctctgccccttcccctctctgcctgctcccctacaagtttatctcctggtgcccccaacccacaatacactgcatctctagggaacgcctcacttgagttgaatcctccccactcccaacccaaacaggtcgtacatttgacatcctgggatggaggtggagatgtggggcatggggatctctgccacttgttttgagagattacaataggggtcctgatggcaggggtcccatgaaaagaggacttgtgttctgccaccagaggccaggaagggaccagtggtcaaggttgggggtggggagcagggtcaagggacaagggagggtctgggctgggggaagccttatcacctccctccctcccctccccagggtgatcagccgggcgcaggggctgaagctggtggtggagacgctgatgtcctcactgaaacccatcggcaacattgtagtcatctgctgtgccttcttcatcattttcggcatcttgggggtgcaggtgtgtggggttctgggggccagctgtgggtgaaagcctgaagagggcccttccccttggcccctgggtcctatggctcaagctgctgttgctgccttcattccagaaaggaataagcagggacgcttccctccaggctctaggcccttttacctcctgggcatttcaaagaaaagtgggagcctagaggaaggccccaaggaggaccggggctgccgagaggcttcaggccatgggagccgcaggctgctgttcctgccctctgcacgcactccctgagcacagacgctggcccgcggtctactccgggatcccctcccttccttcccggctcgagcacagtgggctgcaggccaggtctggggatccagggcccagacagctgggccaggttagcagcgtgctggcaggcaggcgggtgcagaccccagacgaggcaggaagtgggggctgctggggaaacttggccttgggcccagggaggagacttggctttggaagagaaagagccagagctgcctgcaggattcagcagacgcctcagggggccggggagcccctccatcatagtcttccagggcccttggctccagctgtttcagctgcagggtagacagctggctgttcaggcagcgtgggagcccctgggtggctacaccctcccctccccgcccctcgttcccttggcttcctgggatgtccactctgccctgggttgggggctgttccctgacttcctagaaattctctagccctagggaacaggctggggtgcatttaccaaagctgtgtggtgcctctctgtacaccctccccactcccacccagtgcccttccccttcctcacttcccagcctccttgggtcagtagagtgaagcattgttgagcccagtccttccggtggatttaggtctgttttgagcagtttgctcaggccccctggtcctgccttccgtttttcactagtggtcatagcctggtttataatggaatgagggtgagctttccaatcagacagacctgggttcgagctccctttctgctacctgctggctatgggaccttagtgagtggattaacttctctgagcctccgttgttcttatctgtaaagtggggttgatgatacccactcccccacccagagctgctgtgagaattaaatgcccagctcagtggttctcaaacttgagtttgcgtcagaatcaccagaacggcttgttaaaagatcgctgctcccccacctcagagtgtatgattcagcagatctgggctggacctgagaagatgtgtttctagcatgttcccagatgatgctggggactcccacttggcacacgcctggcctaaccgttggtggaagatgaatgactgttacccgcctccaccctttcccactgcccgccccgattacctttcctccccactcttggaaaggaagggggtgtcggcaggggagactcttgtcagtgtttccctgacttgactggccccagagcagagcaccccacactcactcaaaatgtgcccaggctggcgtgggggtggggctcaggagtcctgggcttcctgtggtcacagctcacttttctctgtctctgggaatgtgtgtccagctcttcaaagggaagtttttcgtgtgccagggcgaggataccaggaacatcaccaataaatcggactgtgccgaggccagttaccggtgggtccggcacaagtacaactttgacaaccttggccaggtgagccccaggctcagaggtggggctgtggtgaaggaggctggagggggcacagggccatgcttagtgatacctgctgactccggtggaggtgggctccacgaagagatcagcccttcacaccctctgctgtctaaccaccagcatgtcgcaaagcccagtccatcccacagtgccccaaaaagtgggcccatggggtctctagccgtccttaaagatgaagaaacagaggctcagagagggtaaggggcttgcccagggccacagagctacatggtggagcaggaagcacacgtggcagtgggggcaggcagccctggatgtgaatcctgtgcaaatcctgaccccaccattgtcagctcaatgacctggagcagctgacttaccagggcctcagtttcattaactggtgaatggagtcataatagaatctcctcggaggtcacaataaggatgcaatgagatgatgtgtatatttctttaacatggtggaagggacggatatattgtcaagataattcctttcctcactccatatttgcagaaacagaaatgcagaaaatgaaattgctcgctcagttttgattcccagacccactctggttttggtttctggatttccagggtttttgtgtcccttctcctacctggcggagggcagagggtgtgaccatctctcagggcccctccagctgcagctcagttatggaaccctgagagggagggctctcctggagcctggagtgtgactccagcttgacccctcaagggctggggtacttggagctgatgcaggaggcactttgggggcaggtgataggtgattcagccacacatcctagacttcaaatgtctccttctcctcctccccatcaggccctgatgtccctgttcgttttggcctccaaggatggttgggtggacatcatgtacgatgggctggatgctgtgggcgtggaccagcaggtagggctgaggtgggcaggatccatctgtgggctcaggtcactcagcatgggctgattccaggacagaaagagcaaggcagggtggcaaaatgccatgaaagaagcatcatattttacagcagaggctgttgctggtagcctgtgggccaaatctgggcatgttttattggtctacaacatgtttaacatgttttgaattagtgatgaatatttttaaactggtgaatttgggctgtgtgcagtggctcacacctgtaatgccagtgcattgggaggcctaggcaagaggatcacttgaggccaggagttggagaccagcctgggcatcatagcaagacccccagctctacaaaaaataaaaacaattagccgggtgtggtggtatcatctggagtcccagctgaggtgggaggatctcttgagcccaggagtttgaggctgcaataagctgtgatcgcaccactgcactccagcctaagcaatagaacaagaccctgtctctaaaaaaagaaaaaataatggtgagttttacacagaaattcagatttgtgtctactcaggaaaagtctgaagatctgggaagactgggcttgcattccctcaaggcaggagtcagccagaacaaagaggcagttttggatggagaatctactctcccctttaccacagtccccgcccctccctactgcttcacatcaaacccacaccattcatttccatcgcctgtcaggcggctgtagctatttgggttcgcaggaacccaggctgtgggcagctcctaagacagcttgccctcgggctgatgcctccgcctgtccttcctgctccccgccagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctggtcggtagtctttccacctctctctgggtcgtgcttgaccttggccttgcgactgcagggggctgggcgctggggccgggggcagggagaagaggctcccacccccctcctcacctccttctccccaagagcatgtctgcctttagagcgagcatgaagcagaccacttcagccccatgggtagggggagctgtccccaccctggggcctcccaggacctcagcatcatcctccccagatgatgccaaatggaggttgacacccagcctccccgagcttgactctcagaggagcctcactggctgctccactgccccatgccagcatccagaggcccagggtgggcagcaagcatctcaaccctgcacccacctagtgtctgcagctgccgagcaaagcctcagcagatctcagtaatggacaacagcgtaaaagagaacccagacacccctccctccctatctctaacaaaactttctaccatgatatatatatatatatatatatatttctgctaaacttaaaaaaagaaaaagcaaaaacaaaaacaaaaaaagaaaactccccttggcttggggaagttctggaataacctggggccctggagcccctcacctcctcacctgtgctccccagcatctcttggcattgggtgggtgaagcccccatccgtccgtcctcatgcccttatgccatgggtgggccgagactaagtgagaagacagaggccaggaaggatgtgagagacacagcaggcgcccaggcccctttgtttctggggcatccccagatgcgtctgcacctgtctccctctctcccgggctccagggctcccatctgcctggtacagcgtaatctccgcgcctctctctctctctcagtcacggcccacgtctctctaagtgtctttgtgtgtgggtttatctaagcctttgtgtgtctgtctgtgtgtctctctctgtttggggtgagggtttcccatgctctcttcaccttttcacaaatcgtcttccttccgccgataagatgggtgcggtggcctgagttttcctttggtgtgttcacatgtgagtaccaccaaatgagtgaggggttgccgtgcccctgcctcccctctgccctcagctctatctccctcggcctgggagtggcactctgaggcggggggagagtgtgggagttgcagacgagggtggaggtgggagggggcctgtgttccctgtgaagagcgggagctgctccaggatgtgggggagacactggcctctgggcagcaatgggaggtgccgttctccacgtccccaaccctcactatcagcacccccaaggccttctgctcggctcagggtaggggtccgggttcggcttccctgtggatatctgcagctgagcaggtgcagtgtcccctgtggccaccgtcccactcctgctccatcctccccacccccacctcacagtcaggcagatggaattcttttggcaggcggcacttgtggcccctgcctgcccagctggctccccttctggggtctgtagctgtctcaggtgcagctgaggccacaacgcaggagaagcggacatctgttctgatgaccggctgcctgcccctcccggtgcctccctgccccgtgaccctgaccagctagccacattgcttgtcttcctcaagtgccctgtgcccccagcttcgggctggacattcagagccagccacccaatgggctcagcgcaccccacccataggcagagtgaggtgggagctgaggggaagccgcccctgaggggccctgcccagcgcacctggtccggccagtgaccaatgtcgtgtttcgttcttttagatctaatgctggacgatgtaattgcttccggcagctcagccagcgctgcgtcaggtactgcgtctggggtgtgggctcatgcgtgtggggacatgctcttcactccctccccgtggctcattgattctatcctcttggggtgaaagggtgagggtccctggggcccccaagagggcaggggctgaagcgctgggctctgcagcatcccgcaggcctgcgccaaactggacgggaggcgagggcctgaggcctctctgccgacgccctttggagagcccaccttcccagcaagggcttccttggccggccaagctccccacctcctgccacctcttccctcctgtgcctcctccttgtagctcaccggtcgattattagagctgcaaatctctcctgtctccttttgtctgaggggagactttgatccaagggagcaggatgagaggagcagagaggggaaggatttgttttaaaaatgtaacaatgaataattgaacagactcattaatagtcaagtgatcacggtggctgcgtcatcgctacaaacagcaggaattgggaatcaaaggcctgagttggccacgagcttcttccaaaaaaagccaaagatttgggagtgacttgggtccttattttcaagagccatgtctctgggaagactctcctggtccagcccaccctccatggtccctcggtcccctgctctcctctcccccactggcccccagatggaggtgtggaggctcatggagtccgtggcagggctgtggggcctcataacactatgtctccagctggtggttcccaagctgttcatccccaaggcccccagttatcatctcctccaacagacttcacactttagaaggctgtctatgaagttaagagcacttcaataatgactttctttcatcatttttactaatcagaggcgcatctaattgctaatcacagcttctgagctgcagaaggttacacactaaatgatggcaaagaaagaccatttcgtcattaaattagtctgtggggccttaacacaggcaaagtatagggtttctttcaagctttttgaagtattggaaagaacataagggccgggcacagtggctcacacctgtaatcccagcactttgggaggctgaggcgggcagatcatgaggtcaggggtttgagaccagcctggccaacatggtgaaaccccgtctctactaaaaatacaaaaattagccgggcgtggtggcatacgcctgtaatcccagctactcgggaggctgaggcaggagaatcgcttcaacccgggaggcggaggttgcagtgagccgagatcacgccactgcactccagcctgggtgacagagcgagactccatttaaaaaaaaaaaaaaaaaaagagagagagagagtgagaacataaggacccccatggctgctgcaggcttggaacttcagtctgggaaccaccggctccactttccccactcctctggaagctagaatcaggcagatgctgccctggggatgttgggtgtcatgatctgtggggcctcagggacccacccaagagagaacccctgagcccccattgagtaggtcatccctgaggccctcagcgctatggccccatgatgctaagcagtggtgtttggcattgagagactgcctctctggggctcaggagtctctggctggtttgtgtctggattgccagggtccccacatctctgcatcaggctgtcttgcaaattcctgacttgttaggggatgaggggagggagggaagaagtggccttcagcttttcccttacgggcccacctggtctgtagactgaagtgtgcacactttcacactcaccccaaaacatcctagcacagggctagcccacagagacttttccaccttgggtgttatcccagaaatcaacacatgcagactctcatggctcctaagacgtgactcacccactcagtgctaaacactctcgtgacccttgcactgcactcccattccgggtaccttctgctgtgctcctgaagtggatagaccccactgtatcctggggtggcacacgcaggcatgtacaccagttaccttccctggctgttggtgaggactcagagaccccgaacaagggctcaggtcatcccatatcccacttcctaggacctggagttctgcgtggcctatgccagagcttttcaaacttccatgtgcataagaatcacctggaaagcataaacacagattcctggggcttaccccagaggttctcctacagcagtgcagatgcactgatctacccaccagggtgatggggacagagtcaaacgcagtccagggctgctgagaatcaaacacgtgcaccgcacctccctgctagcactcctgtcctggtgctgctcccagcaggggcgggagagccagaccctagggaaaggcagaagagcggagcctgtgattatctggggaatgggcctgaccagaagcctgggtccaccccggcttcccagatggagggagggaccggggctgctgggtcatcaggctgccccacgggacggctaagcctccaacaccagctccactctccttggccacctgtggcgtcgaccttcactcactcaccctctttccttccaccaggccgggacccagtgatcaggcctggccacggcagctgaaggtgtggcctctgccgtggggggcctgtgtccttgggagtgacccctgtcttctgcctactcattgccactcccctttgcaaaccctccgccctggccatgccttgggctccctgtgactcctactaactcactgcctgttgccttgcggccctccttctgtacccttcctccctccctgccccgaagtggggacctgggctgccctagatatgcccttccccccactgtctgactctggtattttctccacctaaggcagctcatcctggtgggaggcagggaggtggtgccacagctaccaatgcatcagtgaccacaggtccaggctcctcctggactatggttggagctctcaaagcagcaggcttgcccaaggctcctcccaggggctttctatttcttctccacacctgggtgcttgcctgcagagccgaggtccagagagcagcaaaggagggtggcatcgccaggccccaactttggaggcctttgggcagaccatccaggggtgtcctctgggccaaggcctcaaagccttgtgtctgtacccacctggcaactggcgagggactcgggctggaagttcgggtccagctcggtcatgcctcgtagctagctgaatgagtcactttttgcctggcttcattctctccctctgaaaaacaaaggggttgcccgaggagatgctgatcagattggcctggtactctttggacctgtgctctaatgggggatttctggcagcctcagcacctgccgtctggggtaggggccagggtggaggggtgtttgtacagacctcaggggccgggacctgtctataagcagatgccctgcctcagtcctcctgccccgccttccttctgggcctcttggaggagggtcccggctgaattgaagcccacccaccccacagactcctagtgcaaggccagagttggtgggagcagctgctccgtttggcctggaactgcctacagagtcaggctggggtgacggggagaggagggcaactctcccagcctctcctctacattgtctcagctaataatggggctaataaggagccgctttttctaacctaattgtattcaaacattttagttaattctccattcatattttagcataatgggatcgggtgctctcggcatttatggagattaatgcagagaaaatgttccggctgctcaggcaatgcagggcgactagcgccctctggttcttgtggtactcaaggaaggaaggaagaggcccggcccacccggcccaccctccaccatcgcggtgtggatgacccgtagcctcctgtcctcccttgccccaggctctccagccccacactcttggggctctgttctcgaacaaacagagccacagttggctggccgatctctgaaaacaggaagatggcctcatgcatgcctaaggcgcagcagagtgccggggactgtctgctccgtggtcatccacacctcaaggccgatgctggagagtggccaggtgggccaggagcatggcagcccacgaggctggatgtgcaatacctgggtgctcttcttccttcagcctcgggtgggggcccaccccaggccgctccttgcctcagtttacctctctgttcaatggtcctgtgcatgggaaaggacagttacatctgagctggcctgggcccaaagcttcctgctgcccctaagccagctaccccctggctcaggcctcagaggcggcagccctcactggctggcttccccctagacctcctgagacggggaagggctgtctgggacctgaggctgccacacacctccccgtgaaaagcctcttccttctctgtggcttcgtgggagaccaatctgtcaacttcctcccaagaacatgtgccccaagttggcctggcccttcctcagcacctggaagagggcccccctgaaatctcctgcccccagatttattctgcctccttggcagcccaaccttctggctctgtgattttcataactaagtggttcactaattacgagagaaatattatgcctctgacagatctcagacagtgcttccagcccagcctgcagtctaaggctgcccaaacacccaggagcaggctgggcagtgcctcattagaaactgggtgagtccaacaggtggggccctcccagcttgagtctgggatggagcagagccccaaggcctcccctcttgctctcactgacatgagggtacaggaggcccaggccccgccttctggaggccctctgggtgggtcagtgcagccagccaagaagatgtccaatttccaatctccggttttatctccaaatcccagctctgtgtaatctcctctgctcccccgaggggctgagcttggtgaaggagcaaaagcctttgcctccccgttgatggcgcgtcctctgagcctgaggagaccagttgtttttcatcgtatcgatctggccttgctgcggaacactgagtcgagggtgttatgaggggctggtggattttggaggctgcctaggggagggggctcacctggcgtctaatgtaggtggggggctctgcatgtcctgatccatcctgccctcaactgcagccagtacaacagatgcttggagggggacacgcccagacggctgcccccaccaaggggcagcgtggggagggcgaggatggtgatgattatggaatgtttcagttctggcgttagaggctggtggctgtgagggactgggggtggaggggtgcggggggcaggggcctgacgcttgctctgctcttccccctgccccatcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccaggtaggagcgagtggaccagccatctggcccccccacctccagctgaggaacctctgggcaaggttaacacagcctgagccagggtacctctgtgccaagcaagtgctaggcacactacatgggttcctcttgtgccccttggaggtgggtatcatctttgttttatagatgaggacactgaggctcagagatgttagttgatgtggccaaggtcacacagaaagggagtggaggacctggtttcttcatccagcaaatgttgagcgtctactatgagctgcgctctggatctttgagggtaaaaaggcagatggatgcctgcccttctggagttgagattctagcgaacgtccagctccagagctcacctgtgaccttgccacttctccagtcagcctcccttggctgccttccagccgtcggtttccctgtccatccaatgagggggttgaatttgtaatgcacaaggccccttccagtcctggcatgccgtgtcatctagtacattctcatgtgatctcctcaccatctcccaaggagaaagatcctttagcataaggttgattcattcatgtgaataagtgccctactcccttctggggtttggtggctaatggccagccatcatgatgggaacagagaagacagggctccttggagttcccctgcctctcagacctgggcggtatgatggaggggcggggggacaagccccagccctgggccttaagggaccctgcatcttgcccccatccctgccagattctggatgaggctctgaagatctgcaactacatcttcactgtcatctttgtcttggagtcagttttcaaacttgtggcctttggtttccgtcggttcttccaggacaggtaacggagaaaaggggggtcttggggacttgcgtagagatagaaaggaatgagtctcttggggaaatacccaggaagacctagtgtctaagacttttcttaattcctgaggttcagcccccaccctgtggctgacgtaggggactaggggatgggaaggcatggtctccaggaccaggagatgggaaggcatggagagaatttgacaagacagggcctgggggatgctggcagctagaaatcagtgtgacctagcctggggcttaagagcacagagcctggagccagactgcctgaactggatttgaatcctggtctcaccacttagtagctggtggccttgggtaagttacttaacctctctgtgcctcagtttcctcatttgtaaaatgagagaaaataatagtatccacatcacagagttgtgagattatgaattcctatttggttttgagggtgtttttcgttttgttttgttttgttttgttttctgatgcccaggctggagtgcagcagctcagtcatggctcacagcagccttgacctcctgagttcaagctgtcctttcacctcagtctcccaggtagctgggactacgggcacccactgccacacgcagctaattattttttatttttatttttagtagatacagggtctcactatgttgcccaggctgttctcgaactcctgagctcaagtgatcctcccacctcagactcccaaagtgttgggactgcaggtgtgagttcctatttgtaaagctcttaaaagtgcctggtgcatagtgaacaccatataagtgctaaattaaaaataaaagcaaatgaatacaaatgaaaagcagaggcttttgagctaaagtcctagtcctactcgtgccaccagttggctgtgtggccttagataagccacgcctcttctctgtgggatgggaggctggacccgctgatgtctgccctcctttcaagccctgtctttctgtgccacgactgccccctccttcaggaaccccctcccccaactcagggagctgtattctgggctttccaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgaggttggtgcccagcccacgcacctgccctcctagggtgaccagcccagggagagagagcaagggtcggctttgtggctggtcaaggcctgggcggctgtgggttcccatgggtctttctcccagcttctgccaagggaggctggagacagggctgaggatggggatgcaacctggctggcccggagatggccatcccagcagccccagcccagccctggtcctgactctgccagctgtctggccggggacccaaagaggccagctcatgacgttgtcctgttctgcagtgctgaagctgctgaagatggctgtgggcatgcgggcgctgctggacacggtgatgcaggccctgccccaggtagccgggaggtggggggcctctggggagggggaggtgctttccagagggaaggggctcagagaagctgactgggagacccagcggcatcgtttctatttcttctccttttttccaggtggggaacctgggacttctcttcatgttgttgtttttcatctttgcagctctgggcgtggagctctttggagacctgggtgagttggggtaggggagggtggaggagccagggctggagaccagggggctcctggactaacatgggcctctccccctttccctcctcccccagagtgtgacgagacacacccctgtgagggcctgggccgtcatgccacctttcggaactttggcatggccttcctaaccctcttccgagtctccacaggtgacaattggaatggcattatgaaggtaagggcccagggttggcctaggctccagggaggcagccccacttcctgagctaggattccttgggaagatgaattggccacaaataaaagcatgtgaccttctctcccccgtgctagaacactctggaactccctctcccaggaacatgctctgactcacacttgtagtgctcctctgcccccaaacactccctcctcctccccttccttcccatcctccaatgctctgtgacaccagtgacctgattttccacaacagctccaacaactgtcctccccagcctcacccctctattccaccctccccaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggtgagcagacacccaccccagccgtgagaggagctggggcaggagaagggtgtggagggtggtgggcgggagccaagcgggcagcacacaaaccctaggctcctcctggaggctcccgccctccgtcctggatgctgagcgagcagtcactgcccctccccagggatggctgcccacactcaccccacagggccaccccagcagacgggccagcttagccatgccctgctcctccagcctggtctggcctccccttcctgactcataggttcaaggctaagttttctgtttccttcctgtttctttcttacccttgcccaactgccaaatctctttcctacccaccctttaacctgcctgattctcttccatctctccatccttttatcttctctttaccgctctctctctctccccccgccgtgggctctgctcattttccatctcccatctctccttcctccttcgccttccctcttccccaccccctcctctttttctctttgttgctgtgtgtgtttttgtgtgtgtgcacatgtgcatgtgtgttgtctgggtgtcacctctttctcctctgtttctcttgtcaatccccttccacgacacttcccatcactgccctctgacccctgctcccctgcctctccggctccccttacgggctggctccccaggacaggcagctgtttgacaccatatccctgctgatccagggctccctggagtgggagctgaagctgatggacgagctggcaggcccagggggccagccctctgccttcccttctgcccccagcctgggaggctccgacccacaggttactgtgcccctgtgctgtgccctctcccctgaccgtgctgggctgtgccacgctgtgccatgcttctggggaagctgggagtgttcctgcccactgggtatctgtagaaagtgcagccttggagcctcagttgagtgcaagaggcagtcaggggttcttctagactgagatcacctccagaaaagagctggaaggcagggctgctgagattgcccctctgatgagaagggtgtgtggaggaggagcttggggaggggagaggggatttgtaagaatctggaagagaaaagaggggatggggcagaagataagttagcagggggaccttagggggtggagggaaggaggtatcagatccagggaggaaggcctccagagacagtgtaggtggccagggagcccgctgccaagctgcagtctctctatctgctcgtgtccagcacacacttgccagtcctcagtttggtggctttttaagccatggagcccactgggcatggtgagtgctgtcaggagccactgatttctgtcctgagagagatagaaggctccagctgggagtggattttgagaacttggtgtgaaataggacttggcttcctgcccaagcccagccccttcccacagcgccacatggccctctcccccagtcccatttaattccaggtcttctgctttctgggctgttcctgccctcctcccctccccttgatcccctcaccacgacccactaccacgtgagagagggccccaccctccctccacctaggtgagaggctgcagacccggagtggagacaggtgtcagctgcagatagaaaagccgagtcctccagaggcccttttgggtggtggggcaggcaggttcttaggaagcctttagcctgatcccagaaaaatggacagtgatcctcatgtgggaagggaccttgcctcttgttgggattcagtctcagatctggcaatgacctagaatgatcagtgggaaagtgagtccctttccgaggcctccccttcctgaaagaggctcacagggaaaggttgtgggagaagaggacacgatgggaaggtgatggggttctgggagggacggtccaactgtcccctagcatcctgtgggcactgaggcaaccccctgggtcccaggtgagccagccagatggtgtggcagcccacccgagtgcgcccacttcaggctaacgggagaacatctcccagagcccaagttggagagggcgggcgggctgcaggcaggcggaggagggcccacgaggggagaagccagaatctgggggcaggccaagtcctgccaggctgttggaagccgagagaataggcagaaaacagccgtcagattggtggcattgtcgccggcgccccccgtgccgctctgtctgtgccgggaggagagacagtgctttgctggcctttcttcattttttttttttttggtatcatctttttgagagtcgcaagccctcggtcctcccgctccctccctgggtggtggtagtgtgggaggggctggggaggctcctggggtatctttagaatgcgtttctgtgtctcctcgctttgtcagtgtttgctctggctcttcagtgcctgccgcagcctctctgatcagagcagggggttgaagtgggtgcggggaggcactgtcagcttgtttggggaaagggtggggagagagaagggatgcctttttcccgcccccctgtgcttcgtgaaaagggggaagtggggactgagagagagcgcgtgtgtgcgtgtgcacgcgcgtgtgcgctgtcctggtttctcatgcctgatcatctctctccctgtctagatccctctagctgagatggaggctctgtctctgacgtcagagattgtgtctgaaccgtcctgctctctagctctgacggatgactctttgcctgatgacatgcacacactcttacttagtgccctggagagcaatgtacatacacactgccctcactgctcccggccacccccggggctggactggctgcagggctccagatcggcccagggagggtcctggggccgcctcctctcagtttgctgccaggctccacccagaggcatcaactgtcaggacctcggtggcccacgctttgctggcacaaggtcttcaggttccccactggggacaaagagattagataagtttaaattggggccttgccctgaagggtataggagcagcggcagccattatgaaaaagtgaatccagacacccaggagtgacacggcccaaaacaggtgtcatcagagtcaatctatgaatttggagccctgtgcaagccagccctccctgtgcctgttcccctcctccccaccccaccccaccccccaacaacatgagaccttcacaccacgtggtgggtgagagccgcatctctgccaccgctgccatgcccttcttcacttggagcgctgttcctgtctcctccgtcactgtccccgtgtgtccctgcgtcttcaccaaactcagtggggtgaatggggcttctctgtgctctgatagcttccctaccctttcccttctccagctcccgtcccttctgactgtgagcagccccctcctctccactgttcccctcctgttgtcagaggagggcccagctgaggcagggactggaccaccggctggggtgtccctaggggtcttgggtggctggcagtagtggagcctggggctgagaggggaagcaaaataagattgtcctccaacttagccatcctcaggcctgctggggctatttaactggctgggcctgcatggcgacagggcccctacagcctccctgggaacaaggggtgaagggttcagggggaagggggtcacagagtgatggagaaacctcttgagaacaaactaggctccctcatgctggagtccaaggctgagtacctcccttctctgaaacagagcaacaaccccactcccaccccgagtctgtccactaagggagcagctgaatttggcctccaccctcacctgccagagttattggttaaagtggaggtcagggagccagctgtgacatgcctctggtggtcatctgccattcaactcacctgaacccaacccaggccctgtgctgggacctggggctgctgtaagaactggatgaacagcctgcaacctgcaagctctcctgagctgcctggtccctgctccttgggagggtcctctccccctcacctcccccactgacagcacagggtcgtaggggctgctgttggcttttttttttttttttttttttgagacagggtctcactctgttgcctaggctggagtgcagtgatatgatcccagctcactatagctttgacccccccggctcaagcaatcctcccacctcagcctctggagtagctgggattacaggtgccacgccaccatatccagctaatttttttttttttttttttttttttttttttagaaatggggttttgccatgttgcccaggctggtctcaaactcctgagctcaagcgatctgcccaccttggcctcccaaagtgctgggattacaggcatgagccaccagccactgtgcctggcctgctgttagcttttaatcctcccctgagctgctctgggtcagggccccagcccatccctgtggacaccgggactcccttcagagcctctaaatggggcctttagaatcagcttgtgagccacctgcagggctgggggctgggggctgctctcccttctctggatacctccccgcccctccaccaccacagtgggagcttaaaggtgatacaatgtgtgcagttttgcagggggtggggggcagggcctgcagactctcccggctgcccagaccccctcctacctgcttcctccccgcgtgtggagggctcatccatgtgtctgcccctctccccagccatgctcatgcccatctctaccttgtcctgggagggcacgggggtgagggctgggcggggggcgctgctgctttctgttgtcagcgctgcctcagttaccaaacccacgcacaccctcttcctccacctccctcccctgttccttttgcagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggtaccagggctagagcaggccaatttggctcacacagggagattccatcctggcctaagccagtcctgatctgaggggatggggaactgaggcagccaaagaggtatctctgacctcaggggagcctccagcctgggggaatggctttgagtccagggggtaagggtagaggccctgatgagggggagagagtggaagggagggctcaggtgagaacctgctcccctgaaccctccagctccattctctccccccacccctcccccgcttccctccctccacaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggtgagcagatgtggaaaggcaggcacaggcctgggggctggaccctctgctgctggtgatgacctgtgttgacactttcattcttccagcaaatatttattgtgtgccagtgatgtgccaggctcagttgcagataccagggacacagtactgggcaaagcagaagtggtctgtgccttcttgaaatttgcacccagttccttgttccactgaggaggcctggagaccagaaggggtagtgcttgcccagggtcatgcctatctggtcggaggtagaaccccagtctctggtctttccttcctcaccaaccagagctgcctcccaattcttctccccactttggactgagctatggggcacaaggcaggttttaagtgtcttcacttttggccaagcctagggcccaccttccagagcccagattcttttttttttttttttttttgagtttcgctcttgttgcccaggctggagtgcaatggcacaatcttggctccccgcaacctccgcctcctgggttcaagtgattctcctgcatcagcctcccgagtagctgggattacagacatgcgccaccatgcctggataattttgtatttttagtagagatggggtttctccatgttggtcaggctgagctcgagctcccaacctcagatgatctggccgcctcggccacccaaagtgccgggattacaggcgtgagccaccgcgcccggccccagagcccacctgtgataaggccacagcccatgccatgtgtgtgtcctgaggcatgagcgtggacacatgagaatctcaatcccacatgcttgggggagcaggcacagtccttattcattctgcaaatagtcactaagcagcctctgtgtgccaggcactggcgacacagcccctgccccctgaagctcacagtctaatagtggagacatgcctgccatcagatcattgcagcctcagctcacagctgccagacacctatgtgtggagggcagcagggacacagaaggggaaggggtcggttttacttggggacagagactgtcacacactgtgtcacagagaacctgagtccgtaaaatcgagggattcttgccaatcaggaagggtattcagagccaaaggggaagtctaggcagaggcggggaggcgtgaaggagccagctcagtgagcagagatggcctggcttctctcatatcccaggaggcaggggctgcagagagagcgattcttgcaggcttaggggagaccagagcatgggggagggaagacagggtttagtggggagagaggaggcatggtggacaacagaggtcaggctgcaatgacccctatctactagtaagagcggctaccaggacctctgcttaggatagtcctgctgtgcctggtggtggtgggcagggggcacagccagcttgacaggagggctagtccatgctggagaggagactgctgggctgagccctcccccaccccatataggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagatttta

SEQ ID NO: 131 - DNA, 7836 bp, Homo sapiens
attgttctctttgacatgcacaaggccctaattccaataggggatgcttcactagaaactgagggtacaagacactagggatccatcccaggcatgttgtctttgtgctaagtgagtcagattggttggtcaacagagtgcttacaggcccctgaaactctcctgggaaaaatagcataaatagcagcagagattccattgaagggtatagaaaatacatttttaattttgatagagttcacaaatgacagcattgacatttctttaaacaaatacttctgtcaaggcacagcattaccatgtgtccccagatgcccaagaggcagtgatttcatgtccccctgaggtttagcagagccaccaatgtcaatagggtggctgacggggcctagatttgctaccagataagccaatgagacatgctgtcagatttatggttacataatcaagtatttaaaaagatgcacaataggtaactgcaatgagcttgttctgcatttagcaatagttcctttcaaacaaagaagatagttttcagtatcaagaaggatgcctatatgtatgtcttccatggagcctttcctacaaattgctttcattacacattaaaaggagttcagctttattgtgacctaggaggaagaaaataacagctagaatttagttactggttaattgtcagacttaacatctattacctcacttgctctttatagtaatgcttggaggtaggtactattgtagccctcaatttacagatggagaaactgaggcttggagagagttaagtaacctgttcatggtcatatagctggtaaagggcaaatacagttcttgaactcaagtctgtacacttaattcagaggtacacaacatagtaatgtatactctaaaatgatagtgtcattatctttcaaactcaaaggctagaataatcaaaattataaatgtcaaacagcagtgttctaaataaacaggatctgtatttcttggtctgatgatctcagggttacaaggagagactgaaaaaacagagatgaatccaaattctagggtcttagctactggaactcagatactggtgtgggtaccttcccttatggattttttaaaaccacatggtctcagagaggctcagagtggttttacacccctgtaaaaaccagtcattcatcttcccatcccatcatacaagggcagtcaccttcttgagtcattcagctgctcaggcttgaaggtccctgcggcgcctgccaaaggctttggaacccacattggtgggcacaaagttgttcttcaccacaccccctgatctgctcagcaagcctgccagccgatgagtcacacaggtggcagtgtcacaggctctcttctgggcaatgattctgatttgcaggatggagaaagaagagaagatctgtgagtgagaggctgggagagaggtcagccccatgggaccttcatggtaaagttgctgtgctgaaaggcaccaattaactttaagtgtttctcctaaacacaattatcagagcagaaaatcacaaggccattagggaaaatgccatgatcactccccatagatattcccaggggtgtcagaaaacccaaggtgactctggatgactggctatggaatgtggagcagtaacagccaatctttcctgtataaattaactaaaaatcaaagcggaggtttatgacactggagtgaattatggtcccacacccagccccattcacaaaggactataaaatctacaccccagtcacgggcaccaaataccctttcttaggaaaataaaaaattcctcagtcttacctggaagaggagcggagtttgcagcatcaagtcctagaggtgcttacctgctccttaggacccctgttcttcctgcttgagcttggtcaaagggaccacccaccatatcctctgtccagctagcctagggttaaggctatttctaagcataggtcttagacactatgaagcctgggacatagatcagagcaatgaccaccacagctcagatctttggggaaaaataattttattcctcaaatgatcagcacattcagaagcaggacagaggagctctgatgacatctctgggggactcaaagcggccctcattttctggtattttcccaggtgattctcttccaacctgtgagtcctgctctctttcctcccatctgaagtttgagacatcctctgccacaaggaaagccaccaataccagcccaaagagccaccagagaggaaccaaaccacatgcatcaagttataggaaggatgcaagaagggaaattaggaaggaaagggaggagtttagttggcattctggggcatgctaacatgagggcgatggtctctctccaagtcgctggacatatcccttttctttccaggtgctccaaccccaattgcagtttgggggaacgtgtgaaacttgttgaagtcctgcgtgtatgtgcccagcatgcaagtactcagattaccgcaccgcttagatctggggctgtccaggctgcagggaaaacacataccagacagtaccatgcaccagaatctgtccccatgggcagtcacttagaaggttagaccaggcaggggaccctgggagcaggaggggcaggcaggagggcagctcacttatctatccttcattaggagagctcagaggtgcagtgggctagggcaatgcagggaagggctggatggggaaggatgatcttttctggcattccacatgctgttcagtccttcatgcttgacagaggggttctcagggcagatgcaggggcaacacatgcctctgcctgagcagtgctggggccaggccaggggctggtctctgctcaggctcaaggtacacagggatgtggatctggggaagggtgctctccctggcctcctgacaacatgcacatctccacagatgccacacatttaaaggctcaaacctacctcagacactgctctacccatccccatcccctgcaagggcctcaccttcaccttgcaaatgtgaaatgaaagctccttgcaggtgtgaaagaatgtcgtatgcagattaacaaggtggatccaaatttctaaaacttcctgagatgtactatgtgtatccctgacttcacccttactagtcttaactcatccagtgctgggaggtctcccagtactgcaagaacaattcccacagtgagcgattccacacctccccatttcatttcctaagaactttcagaaacggagccttttgttatgtctaaccacggtacctccagctgcagtgggacctctgtctcccttggaggctgagaacagctgggccccaggtcccggtgaacaacacagcctgttggattcctggccagtgtgttctctcctacctctcgggatccaccttcctgtgtatgctgcggggagaggaggccctgtgctgagcgcttggggagcctcacctggagccctctctctcttgctcctgctccagctcactggccttcatctgcacatagttctgcaccagtgcagccagcaggaggcgcgcttcgtcctcactgagcgtggccgggtctgctgggctgctctccagggcagacctgtggaggggaagcaaactcagtgcaggctgtgagcccctgcctgcccctccccaggataagcagccaggcttcctggtctttgcttcttcccctgaggatgtggccagcgggagtcctaggggacagggcacaaggccagtgtcctcctcaggacccaggcactggtgtggcctctaaacagtggtgtgctggagccagtttgtataggcttgtgaaagctaatggttaaattttcaagaattttgcaagctgagtgcagccattattaaaaattaaatgcaaaaacttacagttagtgctgaacctgaaaatagtttcagtttaatagatttatatgtgggtgagaaatagatcaacaggtaaaataccagatttaacaataacaaatttagtggcaaactatttaacagaataggatgcaattcatttttcaaatcatggctgaataggataaataggatggctacacatacaaaagtttggctaaaagcaacaaaagcattttgtgagactcagtgggctatataaaatttataataggccgggcgcggtggctcacggctgtaatctcagcactttgggaggctgaggcaggtggatcacctgaggtcaggagtttgagaccagcctggccaacatggtgaaaccctatctctactaaaaatacaaaaattagccgggcatggtggtgggcgcctgtaatcccggctacttgggaggctgaggcaggagaattgcttgaacccaggagatggaagttgcagtgagccgacacggtgccattgcactccagcatggatgacagagtgagactctgtctcaaaaaaattataatgaagaatattgtctaaatatttatcactacttataaattgtgtaccacacatttttatatcaaaaaattatatatgtgcatgagtacataccttaccccggccccctgtcggtttttaagcattcagtacaccacacttaagaggcatggaattgtctgataccagtgtggttctggcttcaggctgtcttacctgaatggtgctgcatggaggctgcctgcctgcaacaggaccaagatgctgagagccaggaagggggagaacttttggaagcccatgacacctctctgcaagggaagaatgagataaaccacctgcgccagttcgaagttctaggagcccacagaccttggctcctatcctggttttctgtcttgcttctaacgctctggctttgtggcttcagactggtcattatatttctcttcttttttgtttcctcatcagcacagtggacttctgggaggttcagtgggcctgtagcatgcacagtctgatagagctggaggagcgatcctagagggagagctgagtgggggaggtctcagtcctacccttctccccaaagccacacagatacatataaacctgttagccaggtctctgtggaggacatgctcccaggcccctgtcacagaagctgatcccataaggaaacccagagctgtcctcctcttctggggcttttgcatacaccttggtgggaggggtgggatctatccacagagattatctctgcaattggaatctgagaaataaaagaatcaattttagtgctcagcctaagctccgcctgctggcacctcagtcccctgcaggaaccaagttttactcttaaattgggacccaagactttctctctttgctcccagagcctgtgactggggcttgcagtttagggctgcttgtccctcagtcgtcgtgcctatttgccacccatccgctctgttccaggttctgaaccaatttccctgggactgctgggctccagacgccgtccctgatcgcaccgtctgcggaaagtttctcttgcctcaggctctgtgcgcggtccctggggagcctgagtgtcccgagactggcctaagcctgtgtgcagtgcgagagagtaagactggagtccgcagccgagcaggaagagcgagccgggggattgagactgtccgatccaacctagggcacgagcctggtataaatcgcggactaacagagactatctgatgaagagactaacggagagagagggagaggaggaaagggagtgagaaaatgacgaatggagggagagggagggagagacatatacctgagccaggatctcggggctcacctggcgggaggtggcttggatcagaggcggtggcagcggcggcggcggcgtccagccagagccctgtggaagcggcggcgacacttgggctgggcagtgtctctgatgcctcccagcgccagcgactgctcttattcccgccgctgtgggtcgggaaagttccgccagtgcacagcaaccaatgggcggaggggtcctttgcccctgggttgcgtcaccctcatgcttccagaacctggaggatccagcaggaccgtcccacttgtatttgcattgaggtcattgatggaaatggtgggggatggtgggggcaccaacaagtaacgcccttaaagtgagcgggaatttgagggcagtttgacgtcatggtgaatttcacctctcagtccggcctggttttgaaccctcgccccactccacccctggtttcacgatttggcggaaagggtccaggattgtagggactcttccaactctgatcccagacccctgcccaagtgagattttaaaggttaatgcccctaagggtgggttctgggcccaagaaatctgactccagtagctggtattacccacagagggccagggctcgtgggaaacaagagacggagctgggagcaagaactttgttagacaggagttcaattacagttggcccaattcctggttgtgtgatcatgggcaagtaacttcacagaggctcagtgtactcatctttgaaatggggaccacaatctcatcttgaaggaatattgtgagaaacagcccagcgcctgggcctcagataggcagggatctacaagagtttcctggtccgcacaggggattctgtaagatctccatggatactttccgaatctccatctccccggactgtcccggggtactcttcagatccattacatgtgtgaggagggggccgatgacctgctgggcctgaggggtgagttgcaaggtacagatgcggaagcctccatccagacctctggacctcccccttcctaccctgccatccatcacctgcctgagccgtttgcacagctgcccctttgcttccggctgctgtttgccaagatgtcccagagacattctattccggccccgtacccccacccccgcacttcagtcctctactaaagagcaggcaggtgtgacagtgctgtgtggtccctgcctagatcaagctcacactcgcttccggtcacactcatttacacacacccaaacccattactgtctcccaacatgtgcccactctgaatcacagacactaaaaaacagatactggccagaagagtatcctgaggtgttcactcaaacgtgtcccaagcctgcctccgagtctctcgggcggtcgcatccacacactcgcacgacgatgacctgcttgcatcaaacctgcacacatcacgaacaggcgccctccatcacacccaattacgcgtgacctcaacagctctcacatcccgcagaaccgggtttcagttccactgtgcctgagcgttcagctcagcagaggtagggactaaggcgcttgccgcccacagcgtccagagtggcaagaaagaagcttttcagcgtctccaccatctcccggtggaacgcgcagcgcgcgatctgctgcagccggtccgggcgctgcctgtgcggtgagcgcagcagcggcatcccggggctgtgggcggaggcaaggactctagcttgaggttctttgaggcagagcagaaattagcccctaggtgtgccgtccgtggcgcgagtcacggaactccaggtaccccggggtcgtgtccgcacctttgtcctcagtccccagaagcgtcgaaatttcttagcacgacacccctgcctcgcgctacatctcttccccctagggggttggtggcctccgtgctcaaaggaggcagcgggaacgcctaacttctaagatgcccttaattgatctcctccttcttaactacagcgagggaataacaactcggggctggggactgggtatctaagactcgctctccgcagggtccgccggcagggcggccacaggacccgggactggaactg

SEQ ID NO: 132 - DNA, 10077 bp, Homo sapiens
ccacatccaggacctgctacttaatttgcagatcccagtgcaaaataaaaattcaggactccttgttcaaaaagtattatggggccaggcacggtggctcatgcctgtaatcccagcactttgggaggccgaggagggcggatcacgaggtcaggagatcgagactatcctggctaacacagtgaaaccctgtctctactaaaaatacaaaaaattagctgggcatagtagcacacacctgtagtcccagctacttgggaggctgagccaggagaatcatttaaacccaggaggcagaggttgcagtgagccaagattgcgccactgcactccagctcgggcaacagagcgagactctgtctcaaaacaaacaaacaaacaaaaagtattctgacgttcaagctggcaatagcagagcattcctgcttttccattttccaatctaactatcaggcccttctaagtgcatggccctgtgtgactgcacagacggcacgtccagaatgccggccctgcccatgcccctttccagctggtgatggccccactcccctctcctgtcctcagctgctttcttagacagatcctcggagcctcctggcagcaacccagccccagccacctccagaagtttccagggccctgttcagtaggcactcagcacagattccccaaggtcctgggggaatcttcaccccaggccaccactcacatcctcctcaaatcaatgcacagttatcgagccccacctggctaagccttaggaagggaggacaagtggataaacgatcactgccctccaggagttcagtttatagcagagcgaagacttgaacaagagcaggaccggacaagaatcctgtcaattcagagaaaaataatcacagtttattaggaaactgaatttcacaaaagagagagcataaagatgggctttcgtgaatgggcaagatttgattaacccgatgaggaaaggggcattcaaggaagaagccatggcatgggcaaaaacttagagataataaaatgcatggcacgttctagaatcctgaattgtacagtttggctgaggtgtgcagatggtaaaatagtgggaaaaagctggaaggaaaatgtacagagaagagctacaagggtaatagtgaagtgtttgtactcccttagtggaaacaccgaggggactttaggtcgtgatgtttaggttatttgggagcaaagggagaagacttcctccccttggccctcacagcctgcccgaagagtgcaaagcctcacgcttttgcaaaacaggccgcacctagcccagattctggagctgattcagtccatgcctctcgacccacagtttgtcctgagccctgacaaaggtctggccccctcctgcactcggaacgcggaggacccgcagctcgtggattcgcgcctcagtgcccaagctggtgttgatgggggttgcggtttcctgccactcactccccatgggtcctgtggggggcgtggggatgcggggagagggtttcagaataggatcccggactgggagggaagggacaccatctgggcacacccagtaggtacgaccggaggtgaaaaaagagtgggtcccatcccctgatggccccgctcgctatccactttaagtttatgttatggatattttcaaacatattcaaaagtagagagaaaagtagaatcataacccaagtccacaccgcccagcttcaacagttatcccctccaagcccatcttgtttcagctaaccctctcccaccacccattttaaagcgggatgtgggtgtcctgagggaggtggaggctccccagttggagagcgggtgcccgcacctctggaggctgaggcacaactgggctgggagttgagcgcataccgagtaggggctgcgggggagcgggggcagggccggcggggcggggccagaagcccggcggggttgggggcgctctcctagtgactcaaggcgcgcagcgctgggcgcaaagcgccagtctccgccttgcgagctcagagtgtgcccgctgcgccgccgctgtccgtacctgccgccgccgccaccgccaccatgcccaacttcgccggcacctggaagatgcgcagcagcgagaatttcgacgagctgctcaaggcactgggtaagctggtgcagagggcgcgccccgacggggagatgcggcccggaggtgccctggtcccggaagtgccccggtcctggagggggtggaagttggggagcccaggcaggagggagtccccggggcaatagatcgccttgtctcccaggcgcaccgggtctcggagaagctggtagagatcccggaacccacgcgttcagcgaacgtttgctgaatgtttggcgccctcctcgatggtgcggactttatctcgtgctagatcatagcgaggagagattactggagagcaaggaggatcagggacttaaatttggagactcaaatttgggaccaggctctgccacgaattcactgtgcaactcgaggaaagtcacttaccctctctgtgcctcagtctctcatctcgaaaacaagggcgagggcagggaaacgagtggatcaattttaaggcccctttctaaagttagggtatgaccagtgcccgaccggtcccgagactggcggcgaggccccgtgacccaagcctgtggtgcaccctgcgcaggtgtgaacgccatgctgaggaaagtggccgtagcggctgcgtccaagccgcacgtggagatccgccaggacggggatcagttctacatcaagacatccaccacggtgcgcaccactgagatcaacttcaaggtcggagaaggctttgaggaggagaccgtggacggacgcaagtgcagggtgaggccccagagccactacagcgtccccgtgtccccgctcggtgcccatggcccactgctgctggaggaacctgtgtctccctttgcagcctgtggcgcgccttccttgcagggtgtgtacactggctgtttgcagagggggtttgtgcatcctagttgcccctggctcaagacaaagtattaccttcattccatctcaaccccatccctacgctgcctcccggggtgctaacagccgcgcttaaagagcgggctctgggttgcgccgcgttcccagcagtggcttttgcagcggtttgcagcgccaagcgcaggcggcgcaggaggaggaggaggttgcaggagccgccaggttctctgtcgcaggtgaagccgcagctcttgcattcctttcccgccgtatcccccgcgcccgcccgggtccctgggccgcctgggtacgctctggatacagttttagcagtcccgatggccccgtcacctctcccttcccgccttcggcctggttccttaaaggaacggcggagtctttccaaaagcaaggcaggttctggctgggaaaatggactagttgccctctcttagtcctcaagggcaagagtttttttttatttctccatgcatcggcccagggatgaaccggtggattgaagcaaggggttgtacattcgttttttgcatgggcaaaaattgcatttggttaaccagatggaaaaataatcaccggtgctaccacttatttaaaaagtgacagaatgtctccctccccttctccaattttttttttttaaagaaaaaagtcgtaacattccagagagtgggaaattgtttctttcacctttcctgagcagtgcctggtctgatctcggaatgggactctctgagcaccgggcttggaaggacaaagaaacaaagccccccagaagcaggctgatctaggaggcaatctttggctccagaattgtcatagcctggaaatgatctccacgcttggagggggtgggatctgaagcctaaactgcactgcagaaacaaagagcaggacagcatagagtgaagggctgggagtctaagagaggaggcttggcaataggcagggctcagtctggggacatccaatgttggctactgccaggaagggtaattctgatttaaaaaaaaaaaattaaaggttcacacaacagccgggagagtggggctttatgcaccccccatccccccacaccttgcctaatgaatgtgtcccatgtgttagttaaaaactgattatgtgcacattcagctctggcccaccccccagcccagctgtaccacacttagctttgtgcagacactggggaaaaacttcaggaaatccctccttttgcctcccacctccaaaagcatgaagagccttcagattgatttgctttttaaattttttctaaagggatgtaaccgggaaagtggcagcattttaaccctcagagccaaagacaccgaggtttatcagtgcaggggtgcactaaatctgatgaggagtgaacagaaaggacgttcctatcccaaaatccatgcagggaatcgtgctcctgataggctgatgacagatgtggttacaaacttggtgtcttaactgttgtcaaatcttgtggttctgatgtgaaggttcttgcttttaaaatccaaattatgttcacctgaggtcaggagttcgagaccagcctggtgaaaccccatctgtactaaatataccaaaaaaattagctgggcgtggtggcaggcacctgtcatcccagctactcaggaggctgagacaggagaattgcttgaacctgggaggtggaggttgtaaggagccaagattgtgccactgcactccagcctgggcaacagagcgagactccatctcaaaaaaaaaatgaataaaaataaataaaatccaaattgtttgaagggttagctaatttttatataaatgaatcatttcatgctctaaattttattcctagagatgtaaagcatgcctaaggcctcgctgcttcagtaagagattgtttgtgtgtgcttgtgagtgtgtgtgtgtgttatacaaggtgtatttataccccataaaatctgtgaccagcactctgaatttggactttataaggctcagcggagaagaatctgtggcctgctgacagggaccatgtgttgattctctgcagagcaattatttttcaatgctcattgttgtccctgctcccgctgctgagactctaattaatgtcactaatggttttcccgcctgcagagtttagccacttgggagaatgagaacaagatccactgcacgcaaactcttcttgaaggggacggccccaaaacctactggacccgtgagctggccaacgatgaacttatcctggtagggaacccttgaccctgaaataatcctgaagttcccccagagggggccccagatgggccccacaaatatgtcctcctcactcggccgttcagagaaagacaccatttgccctggattaaaattagagcagaaaacccgagatgacagttcaggtcagaggaaatcattgttaaatggttggcaggaaagaggagtggctcagaggatggaataggggctggagacaggctggagtgcctgccactatccacactaatacatcccagtggcggtgacatgctttaagccaagctcccctctcatcaggcttggaatgcttaggctctatgaggtccccacgctcacatggcagaagggattttttttcattctcattcccccttttgctggctggaaaaggtttcagtaatttttatcacatcagcactcagaaccttagagaacatttttagctgtgatttgcaaactccaatggcctttgggagccaggcaatgaatgctaatttgggaagtgtctgagtataacacagtgtggagagatgagcccctgtagaactaaaaaagataggcttttccttaaaagtattcagatcccagcattctggggggccaaagcgggtggatcacctgaggttgcaagtttgagaccagcctgatcaatatggagaaaccccgtctctactaaaaatacaaaattagccgggcgtggtggcatatgcctgtaatcccagctactcgggaagctgaggcaggagattcacttgaacccaggaggcggaggttgcagtgagctgagatggcaccactgcactccagcctgggcgacagagactctgtctctaaaaaaaaaaaagtattcagacgaaaacattttaaacacctgctcctagccaaacaaaacttacctagtgaggccaaattagaaacctctataatttaagcacacacttcctcccctttttttaggtagagaacaaaggaaggctgagggcagaacaatccccctcgctctccctttgtgttacaaaactgggctgggattggtggctcacacctgtaatcccagcactttgggaggctgagcccaggagtttgagaacagcctgggcaacatagtgagacccctatctctacaaaaaaaaaaaaaaaaaattagctgagtgtggtggcacatgcttgtagtctcagctactcggaggctgaagtgggaggatcacttgagcccaggagtttgaggctgcagtgaactgtgatcatgccactgcactctagcctgggcaacagagctgagaccctgtctcaaaattaaaaacaaaaaaaaaaacaaaaaaactaattaagggttttgcaaccacccttttcttccagaccagaaaagggaaagctgttttgggtaaccaggaaattatatcctttgttctccattaggtattttgttaatctctgctccatcttagtgaatgtcaccttgaaatgttgtgaataggagactgcctgctgaagggtgctaggaaaggacttgcagtgtgacctgagcataggccttcccttcccaagctcttccccttgctatacaatgaggggttaagctgaagtctgatccctgaggtccctctcagccttgaaattacatgtttattctgcaagaagaccctaaattgagctattacttgaaatgagactgcttgatctttctctctctcctcttgtccttccctggtatgatttaacatgctttctcctttcacagagaaaggactggcttaatttgcaacctggttaatattgtttccagggaaaggatacttgctgggcttgggggagcaatttgaggctgagacatggaaatttaggagaaaaggcgtatatggtttactggtaccagagacagcagagggagatgattttagagttttagaatgtagctgagggttcagtaggatcggtttgctctgagaaagagtgattttattaacctctgtagtatacgagcagctggagtcacaggccaaattctgctagatggaccccatcactttcaaatcctccctcctcccaacttcagttctatccctgcattcttccctggcacagcaaacatatatacaagactcaaagggaaagggagtattaactcttggcattttggatctgaaatgtgggcttttgtttcaagggttattatcattaataaatctaaaacgcagagagatgcagtctctatataacaagaggcaattattctagttaagttgaaataagctctcccagcgccaacagtaaattgcccccaggctataagttgccttcctttgaaaactgagtatactcccacaaaccactctggaatattctacagagagtttctgtcgggaacctctaagcatagtttgcaggctgagaagggcgcttcaaatgtggttggaaatgcggcgatttcttctcatgtcatgaagctatttgttagctggggagagctgtcagctagtgagaatagtttctccagggtacagcgttcaatacccaaatgctggcagccatttgacaatccatggctgtagaactcaaagaattatggaaaattaacatggttctgaggcgtccagacatctgcgaggtagacttacggtgggaaagtcaagccccacaccccctagcatgcagaatcacctgcatttcttcccaatagagaagaggctaggacaaaggtgtccaggagtgggtataactgccagtctggtcaggagatccctagcatgaaaagctagtggctgggtgcagtggctcacgcttgtaatcccaacactttgggaggctgaggcaggtggatcacttgaagtcaggagttcgagaccagcctggccaacaaggtaaaaccccatctctactaaaaatacccaaaaattagctgggcatggtggtgtatgcctgtaatcccagctacttgggaggctgaggcaggagaatcacttgaacctgggaggcagaggttgcagtgagctgacatcacaccattgcactccagcctgggtgacagagtaaggccgtctcaaaaagaaaagaagctagtgatgggcatctgcttcctcagtcactaaggacttgaactatttccctgaagcacacgtgtcaggataatgttttagcatatgttctctgagagcatctcgtgaccaactaagatggcagggtaagaatataaagatcctaggatagctaaatgcctcgtttagtggttttaacatctctgtaatttcaggccactttaagaatctgaaagataaggaccttctggcacataaatgtacatttgcaaacaaacatactcacatcaggtttacagactggggaatttctgtttcttggtttttgtttttgttttttttttttttaacatacatattgctttccctgttctaactgcctgtgagaggtccaggagagcaggcctgtgagtaattgctagttttgggggaaagttgagacagtttacttgtgggcaatatcatttcaggggccagcagaaaaatgtcctcctccatctgtgcaatgattcgtgtcctccctacagcaaacaaactaagagccatagaattttagctggaagagcctttgcgatgatcatcttgtcaactccacccctctcctcaacaccagcccctgcctgcccctttcccaaacaggccacgagaggaaaacatttgcccccaagcttagccagctgtgagctgcaggggctaggtttggatgccaatgctgtgcttttgcagctgagaccaattttctagcttgcaggtgacttgagtattacatatacagcatctcagcctgtctcccaggttagatgactgcttcctggaaagcagttctattccttctccaaagcaaggaacagaactggctggtgagtgctgggcctcatgaccccagctgcctgagcttctttctatcttgaagtcatttgaaaagagacagagccacttcagaaatgtccattgtgacattctttccctttcagtttaattttaaaaccaaaactcctggcatttcttatgtcagcattttacaggttccataagcaaaggaaaatggtatataacataattctatactctggttacctctttaccaatagcgcttaagggggaaaaaatatcccttaatgcttagcctgagcacacacacaggaaattgaatgtctgttacaaagagtttttaacagggcaataagtggccttattagtgatatgctttaaacatttttgcacaggcatctgcactgattggttttccttttcttcttctctgcagacgtttggcgccgatgacgtggtctgcaccagaatttatgtccgagagtgaaggcagctggcttgctcctactttcaggaagggatgcaggctcccctgaggaatatgtcatagttctgagctgccagtggaccgcccttttcccctaccaatattaggtgatcccgttttccccatgacaatgttgtagtgtcccccacccccaccccccaggccttggtgcctcttgtatccctagtgctccatagtttggcatttgcacggtttcgaagtcattaaactggttagacgtgtctcaaccttttcccttttttggtttgcctcttcagtttcaacgtgggagttattgtgtacctactgtccttagcactgtgttggtctgtgcggtactctcagctttggcctgctggcctcggtgtggggctttgagcatacgtcagcagttgcaagctgggctcccgcagactggctggatccagactgcagatccaggtgtg

SEQ ID NO: 133 - DNA, 85734 bp, Homo sapiens
caagagtccattgtcctgtccttccctataacagggaagggggccagagagcctccacaagcggaactgctcctaaatgacaagaccacccaactggggctccatttgccacattagagcaatggaggcccccagactgttgcacccctcttcctacccacagctccttcctgcaccactgggggccttgcatgcttgtggaaaattggagaaatgcctgtttgccaaagctccctccacttccctcctcctccccccaccatagctacccttttaagtcagccctgggaggataaacttaaagaagaggcctgcataggccctggaatgaactcaggacatgtgggcacatacttttggggtcccatgtgcctggaggcgaggcacggggcacatcatcttggccctgtgatctcttactctgtgggaaagagtgcgggggacagccagagatgggcctctcaagcacacagtccagggcaggcggccctggcttctcagctctcaggacagaaaaggtcctggaaaggacaaaagagagagccaggcccaaccaagagaagtagaagtggaagtagcccaggtgtgtgggcaagcatgctagcactcatctctggaagtgggtttcaggatgtaaggcaagcaaactcagtgtggagtagaaagtggttggttgtatcacctgtgagcaaaagccatggtgtgcaaatgacaacagtcaatgtgatgttatgctgctgccctggacaaatgcagtcctcttttccatctcagtgatgctgtcatcacccccctgattgcacacacaggatacctgggagtcattcttggtgcctgtttcttacctcccattatccaccagcaagtcttatcaattctactttttggatctatctccaatccagttccctctctctcatccaatctcccttcatctctttcctaacttctgtgctagtttcctaactgaacttcctgatgcctcttgcctctcctgtctattctcatagcaatcagaatgatcttagtaaaacagagctgaccatgacatgccccagcttaagacccttgatgaacctcctactgccctcaaaataaagtccaaattccctattgtggcctaccaacccacttatgatctggccctaacctatcagtgtcattcctccaccctcacactctttaagttccactcctcctgaatttcattccgtccttcccacatttttaaatattttgtaaagatggggtctccctatgttgcccaggctggtctcaaactcctggcttcaagtgatcctcgtgcctcagcctcccaaagtgttgggattacaggtgtgagccaccacacacacgctcttatttaggtacttttttgttttttgtcattctactaactgtagtactgcattgtggttttaatttccacttctttgatgactaatgatgttcagtctactccttctttgaaatctctgcttggttttcatttgttccaagaagtaatcgctccttctacagactaagttcctgtcctcctttgtagttccatgacaaccaatatttatctccaccttggccttaacccactaaagtacagttgttttacttttacctccacacccaccgccatcatcacaaacacacacatacacgactgtgcacttcctgaaggcagaagcagcatcatacttctttggtatcttcagcaatcagcacagacctgaaacacaatctttacacaataaatatgatgagtgaatgaacagttgcttaacaaattaaagaatggatgaaggtaggtagttaggtacaaggttttgcagataggcctggctgtgtcaattaaacctttcttcatgggtcctcacacttagtaagctcacttttaaaaggacaatgctgaagacacaaatgtttacaatgaccacagcgatgacgggatccgagagaaaggcaaggcggaaggggtgaggccggaagccgaagtgccgcagggagttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcaggtaacgtggcggtggcgtcgcgtctgcggacggtgccggggtctcagcgctcggcacgcgtcagcacctgccaggtgccaggcgctgttccaggatctggggctgcagttgagaaacagcccatcatgccgaagtgggcccgacattctagtggaaggacgctctatccatacacacacatgcgcaaataccacacataccacacaacgtgcggcatatatctgtagcacctgtctatatttctctagacacatacgttatatattgcatatatcaatgaacgactgcggcagaccgctgaatagttgttccatggagaggataaagccaaaagtcacccggctttggggtgcctttgtatcacaaaccacaatcttgactgggccattcatgcgcagattttaggaagcgtgtctagcctctagaacagcaactctgcttcctcatctgtacaaggagaaaaccagctgactcgcggcctctgtgctgagtcggcctctgctggccacactactgaagactcccttaaacttgtgggcactcctcccatacccgatcctttaccccggtgtgcttcctgcctctcagatcttcttcttctcctttctgttctgtcctctacctgccccttaagtgacatgcatcccacgtcgttagcttcagtcattccttcacttaacacatttgttgaatgtctgctgggtgtcatactctgttctaggcagtggggattcagcagtgaataaaaacgccagtgttcgggcacacccacactcacacacgcaacctgtcctctgtagctttcaacctaactgaggtagatagacattaacaaaatgaatacctatacagtatgtgagatacttacaggaccagtctcgccgcctccacgggttataggcttcttaaagtgcagccagagcccctggctgggatcctgtactctgtgattcgtgggtcaccacattcactctgctaagacttcagcctacccagccagaccttgcccttgaacttcagactcacatccctgtcattcacatgagccagaatatatggagcattataaacctataaaccccatgaccagtcacccagttcactggattctatcttctcagtatctgtcccataagtagccactataccagagtctgaattggcaaatagtgatccctttttttgaagaaaaaaagtaatacatattacaaatttttttttttgacagagtctggctctgttgcccaggctggagtgcagtgatgtgatcacagctcactgcagccttaacatcaggggctcaactgatcctccctcctcagcatctggagtagctaggaccacaggtgtgcaccagtatgcccagcttatttatttatttatttatttatttgagatggagtctcactctgtcacccaggctggagtgcatggcgcaatctcagctcactgcaagctccacctcccacattcatgccattctcctgcctcagccttctgagtagctggcgcctgccaccacacctggctaatttttttgtatttttagtagagacagggtttcactgtgttagccaggatggtctcgatctcctgacctcgtgatctgcccaccttggcctcccaaagtgttgggattacaggcatgagccaccacatctggcctaaatttttattttttaaaaattgtgagatggggtcccactatgttgcccaggctggtctcaaatttctggcctcaattgatccttccacctcagcctctccagatgccggtattacaggtgtgagccactgtgcctggcccacattataaaaatcttaatttagaagctgaaatttaatttaaacatttgaagttttaaaattgcagaaatttcagaatgcagaaaagtttaaagagtgatcccctatagaaatacaactatgcggccgggcgtggtggctcacgcctataatcccagcactttgggaggccgaggcgggcagatcacgaggtcagaagtttgagtccagtctgaccaacatagtgaaaccctgtctgtactaaaaataccaaaaattagccgggcgtggtggtgtgtgactgtaatcccaggtactcgggaggctgagacaggagaattgcatgaacccaggaggcggaggttgcaatgagccaagactgcaccactgcactccagcctgggcgacagaacgagactccgtttcaaaaaaaaaaaaaaaaaaagaaatacaactatgcaaagataagttgactttataaattatggtatattcacactatggaatactacaaagttgttaaaaagaatgaattatacctgcattgtagacaaacacagctgccatttatttatttatttatttttttgaggcagagtctcgctctgttgcccagtctggagtgcagtgccacgatcttggctcactacaacttccgtctcctgggttcaagcgattctcctgcctcagcctcctgagtagctgggattacagacatgcaccaccatgcctggctaatttttgtatttttagtagagatggggtttcaccatgttggccaggctggtctccaactcctgacctcaagtgatctgcccgcctcagcatcccaaagtgctaggattacaagagtgtgccactgcgcctggcccgccatttattaatttagcaaaaaagccatagaacaatgttaggataatttaattttttataatatatatgcatgggaaaaaagctgaaaactttcacaacaaaatgttaacaatattcttatgggacatttaactttttctttgcacatttctatattgtctgaattttgcaatgtacacgaattaattttgtaattacaaaaaaagaaactttgaaaagagcaggcatctgttattccacttctgtaatgttgctggctttttttttttttttttttttgagacagagtcttgcactgttgcctgggctagagtgcagtggcacgatctcagctcactgcaacccctgcctcccgggttcatgtgattctcctgcctcagcctcccaagtagctgggattacaggcacacaccaccacaccaggctaattttttgtatttttagtaaagacagggtttcactatgttggccagactggtcttgaactcctgacctcgtgatccacccgcctcggcctcccaaagtgctgggattacagacgtgagacactgcgcccagcaatgttgctgttcttatacctatattcctctccctctttcctttttcgtcatctgttctttgcttttcctcactcgtctctagatgtcactgccatgtgaccatctgtacaggactcagattcattctccctgggaggagcaataatcactattccgtatgagtgtctgcattgcctgagtttttccctcagataaccccgttggcagctgatcttccccaagcccacctatagaaatatctcatggtctaatgattgagagcaaatgctctggaaccatacaccctgggttcaagtcctggctcctacacataccatctataggaccttgggtgatatttacttctataagcctcagtttccttatctgtaaaatgcagataataataatattcaccccataggttggttgttttgaggattaaatgagtcaatacagtaaagcatttacaatattgagcatttacaacatggtaagccctcagtaagtgatagttggtcttgttatttggactagatgctaattcctacatccagaaattagggtcagagattgtcagcagacccaaatagtaagacacataacacagaacatagtactttatatttgaggaactgtcccaggccactgtctcctgaaaaacatttcctgactccaagaagatttagttacttcttcttagccttccatatatcctcattcatatgctattatagcgcttttaagagttgatttcacctatttgtatccttgccaggcccctcctgctaaactgtaaactctttaagagcagaaaccatatctgattcatttccccaaatgtaaatggtaattacacaataaatcttttttttttaagatggggttttgctcctgttgcccaggctgcagtgcaatggcacaatctcaactcactgtaatctctgcctcctgggttcaagtgattctcccgcctcagcctaccgaatagctgggattacaagtgcctgccaccacgcctgggtacacaataaatctttattaaaagaatgactaaataaatctttgcgatcccaccaactttaggaatacaataaggaacactgtcttcctacataaactgtttttttttttctttaaaagaaatggggttagctgggcatggtggcttgtgcctgtaatcccagcactttaggaggctgagatgagaggattacttgagtccaggagtttgagaccccatctctacaaaaaaatttaaaaattagctggatatggtggtgtatgcctgtaatcccagctacttggaggctgaggcaggaggatcccttgaccccaggaatagcaggcaggagtgagctgtgattgcgccactgtactccaggctaagccacaaagcaagactccagttctaaaaaataaataaataagaaaggaaaataagactgggcgcagtggctcataactgcaatcccagcgctttgggaggctgaggtgagtagatcatctgaggtcaggagttcaagaccagcctggccaacatggtgaaaccccatctctactaaaaaatatacaaaaaattagctgggcatcatggcgggcacctgtaatcccagctgcttcagaggctgaggcaggagaatcacttgaacccgggaggcagaggtttcagtgagccaaggccatgccattgcactccagcctgggcaacaagagcaaaactctgtctcaaaaaagaaaaaaaaagaaagaaaggaaaagaaagaaacagggtctcactgtgttgcccaggctgatcttgcactcctaggctcaagcgattctcttgcctgccaagtagctgggactacaggtgcacaccaccatgcctggctaatgcaaactatctttcatattacctgtaccagtgagctctctgcttcttgcctcgagaagtctgaaccagaaaatatggatcagaagtttggctggttgaatagtcaatcagtaattagtcttgaggagtatgttgggcatccaagtggactctctgggcgcaagtactgtgacagagtttgggctacaggtgtttgttagctatcaacacctgtgaggggaggggaatgaaagaaggagtgagccacggaagaagctgaactgtgatgggggcccaacaagccttgacaaatgcagcatgttgctctgaagagagtattgcctgtcaaagtttctctctttgggtcaaaatggccaggtctttatacccctgcctctctcagtcacaggatgtgggtgctgcagaaaggacatggtctcaggtgactccttttcagcagcttaggtagactgtgaaggggctgtctgctgacgacgttccctgtagctagggagcaagtccttccttgaacgtggatctgggtggcaccacaggaagtgtgctaacttgtatttggtatttcactgtttggatggcagctctctttattgtgaagccaggagacaggtaaccaagctcaagtctgttactggccttactatggaaacctttaaaccattcccctctatgggtctcagttttcagatctagtagttcagaccagatggttggaatagttctctgactattctatgcttcactggaagccctgatcctggggtagggctgagtaaagctaagtaatggtaagtaatctcaccatatttctgtgcatttgatcatccccctgccagattcgggagctctataagcagcggctggatgagtttgaaatgttggagagacatatcactcaggcccaagcacgggctattgcggaaaatgagcgggtcatgagccaggctggagtacaggacctcgagagccttgtcaggttgcctccaggtgtgtataaagaactcccacatgcctgcccaattcccgggctgttgatatttcactgtgtttgctccattgcccactctctaggctttttctggatatttggagagcaagtcgcagacatgataatatgaatattaccacaaaagaatatttcattaccacaaaacacttctgtatgtgtatcttcaaaacaaggacgctctcctacataaccagcatataacccccacaacctggaaatcagtttctgtgcaacactaacctctgacccacagatacttgtcaacctaaatagcagagagagactctctaaaagaaaatgatggacactgcaatgggaatacatgtgccattgtaaactgtgtgcatattcagggaggtaaaggaagacaaaggtttttaaaggaaaagtgaggaggattacacaatggttttgaagtaattatccttggctgaaaaatcattaacaagagtagtaccagtctgagattaaacaggcggttgctgggcagatttgtgtgtgtgtgtagggttgcaatgacctttgtgtgaggttgtgatttttgtggcgtgatatggtttgtctgcatccccacccaaatctcaccttgaattgtagctcccgtaatccccacgtgtcatgggagggacctggtggaaggtattgaatcatgggggcaggtttttcccttgctattctcatgatagtgagtaagtctgatgagatctgatggttttataaagggcaattctcctgcacacactctcttgccttcgctcatgtaagacatgcctttgctcctccttcaccttctaccatgattgtgaggcctccccagccatgtggaactgtgagtccattaaacctctttttctttataaattacacagtctcgggtatttattcatagcagtatgaaaatggactaatacaaggcatcttttgtgataattcttgttatcaggcacttatgcatggccttccccagcaccatttgtcagggttttttaacacaagtgactccattttgattcagacaacttttacatcccattcaaattttactgactgtcctactgtggctttttccccccctcaggcccaggatcctgtccaggaagtcatgtcacatgcaattgtcatgtctctttttgagatgccttcatttggaacaattccttgatcttttcttgtctttcatcttcctgacagttcttgaccagacttatattctgtaggatggggatggttctgtctgatgcttccccatgaccagacttaggcaaacattctgggcaacaggaccacataaagttattccttgttcatctcactgcagcacagcaggagggtcacgtgatgttaacctccatcccctgagtaggttggtgtctgccaggattttctgcattaaattctccaaatcaaattataattgattagcattttatagagaggtattctcagattacaccaatatcttgttcctcatcaaagctccatcgccataccaccagcattcactgaaaattcttttcttaatgcagaagtttaaagagtgatcctttagaaatacaactatgcaaagataagttgactttattaattatggtatatccacactatggaatactgcaaagttgtttaaaagaatgaattatacctgtgttgtagatatagatggctgtctgctatttattaatttagcaaaaaagtcacagaacaatgttaggataatcccatttttatagtatagatgcatgaaaaaaagctgaaaatttgtatatcagaatgttaataatgttcttagggggcaattaactacctataatcaaaattgggttgtttttcctatggacttgtccatagtctggattttactgatatcagcatcatggtgtcatttaacctgttcttccttgtatttcctataaatctgtaattagttctagagactttatgaggtttaggttcaatgatggtcaggtggtggggaaagagcacttcataggtgatgctgtgtgtttccctcaggaggtacatgatatgtggttgctatctctcctttcatgatgctggcagcctttttattttattattttattaggggttacaaattataatgaaatgctaatggtaataataattctatctttatttatttgtcagctgaactacttctataaagacaaacttttcagaaactactttgattaccccaaagtatgggcagcattaattctttccctttatttgccagtgtttaaaatagtgagttggttcccctaacatctgccaaaggtgactaatgaggtttgtttggttgttttagtatcattgtgcacgcttggatttcatgactgcaaattatttattatccttttggtgctcaaattgttccatctttggcagagagccttttccagttgactgctgattcatttgacaatcagctgtctttgataacttccttgctttctgagctggtgagatgttccaggccatcttgggtatttctggccccagatctggaatcagccatttcttcaagaaacgctgattccttttattccctccaccactccccacaaagaccttgacctgttctcctgaattcttgaaaatcttgaaaattcttgaaaattatcattttccagtgcagtagacagaaaagacagtatatttaggagacctgttatatctatggcctagagggaaagatctaagggaggaagaagtggaagatacagtgccttaaaaggcatttaaacttatgaggacctactagggcccagatgctaatatgctttgcataggttatcccactaaatcctcccgacaaccctgtaaggtaggttttctttctatcttacaggtgtaggaactaaacttagatgatcaaacgacttccctgaagccccacagcttggaagggggtgggacttagatttgaacttgggtgtgtctgctgtcaaaacccatggctttcttctatcgggaggaggaaggattgttgatgagccatggtgtctcaggagtgttgatgacttctcttagagtgtggctctgagcagcagaagccctatccttcatcaggcctgccagacctctgagactcaagtcccattaaacagtaacactcaggcacaggttctgtatctcttcctgtttccccctccaccacagcacagtgtagctgcaaggacccctccctcaatggtggcccagataatgtggattttgcagaaattattggtagcaaatgtccagagtctttactggttgcctgatgttccctgaatcctgggagtcagctactgtcccttttttgttgttgttggctagagattaggggagattaaataattaactatttgggtttttttttttaatgaaagtgaaataaaacattgagaaccaggagacaaatgtcagtttggagaatttttcaatgactttcattttatttttacccaagaatgatattaagttctaatcagccattatctgtcctggtttctcaggtctctgctggtgatgtgtctttcttttaagaagtgaagaagtagacacactaatccagttccatggatacccctctggtgtgtctgcttctcagagaagggtgaggtaacttttttttataactcagataactggcaatgaggacattcccctaaaagtttcttatttgaggcatagaggcaacctttctgtgtttgctaataaaaatgtgacaaagtggcaagcacatgtaaattctccaaagtgagggagaaagatcagaatgctgcagaacatcttgtgctttcattcttgtcccttgctggaaacttgtccacattatccaagacctcgcagagccatgcccaggagccacagtgttagtataggaagcccacccttcccaggggagaagagatggtcacaaggccagagcaggcttttccaaggctcggggtacatgcccaggcctgacagctcctgcagacacagcacctagccacccataacctggggcaggactgtggaaagaattgtatcagaagagagaggatacatctcttgtcacatggcctttatcctttgtatagaagtcttatcttttgatattttaaataggccatcaccaaagtccttgggaactgggctagtttgtgtcaacttggcattgctgttaccgcctgctaaagtctctgttgccaaggagagaccagggagtacatttcccagaaggcacctcccacttgtgcttccaggataggtcagctgatgagaagcccttggtgagttttggaaaggaaggccatttatttcaaaaagcagtagtaggcagatgattgagtggctgtgagtttgaaaacaacttccagataactttttttttttttcaagacagggtctcgcttcatcacccaggctggagtgcagtggtgcaatcttagctcactgcaacccctgactcctgggctcaagtaatcctcccacctcagcctccctagtagctgggaccacaggcacataccaccacacccggctagttttttgtatttttagtagagacagggtcttgccatgttgcccaggctgagtttccagataacgtcttaagaaagccctgcttcagtgctactggctgaagttgttaatgatgatgtcttagttcatttgtgttgctgtaaaggaatacctgaggctgggtaatttataaagaaaagagattgatttggctcatgattctgcaggctggaatactgggcatctggtgaaagcctcagtctgcttccactcatgggggaaggcaaaggggagccacgcagatatcacatggcgagaaagcaagtgagagtgggggttttgggggggccaggtgagctaatatagtgaggactcactccctgcctgcccccacctagggcattcatctacacatgaggggtccactcccatgacccaacacttcccattgggccccacctccaactttaggaaaaaatttcagtataagatttgagggaacaaactcctaaactatagcagatggcttccctgacattatttccctcagtcttcaatcctttgtattaaaacctttaatatttgatatacatagattagtttctgttttcctgatggaactctcaatgaacatatgtgatgggggaatgcatgtcttcactgataggttggttataggagacctccaaaaggaaagaccattcaaaggcaccatgtctctctctctcttttttttttttgctggagggcattggccccatactggctcactgcaacctccacctcccaagggatcctcccacctcagcctccagagtagctggaaccacagacgggcaccaccacacccactaatttttgtattttttgtagagatggggtttcactgtgttgcccaggctggtcttgaactcctgggctcaagcaatccgcccacctcagcctcccacagtgctgggattacaggcgtgagctacctcacctggctggcaacatgtcttaagataatgttggctaatggagcaaacaacaaagtttgaaaacttccaacaagtcttctgttcgggcgctggtgacagccgggactgatcgctcagcggcagtggcgcagaggcctcctccctggtccaccgcggtccccacccaaccccacctgtccctgctgcctgctgccgtagcaggagctggaggctgctgctgccagagggcaatgagttccagtggtgcttctcccaagtcaatggggccatcgaggaggacatggctgaagatctgccacaggggagaggccagaagaggctttgacgaccatcagtgagtgaccagggggctacacagcctcactctgcagcagatatcatttccactgttgagtttaattactctggagatcctgtggcaggagacaaggacggtggagtcgtttttcagcagagctagagaataaaagccgccctcattctaggggagaatataatgtttacagtacctttaaaggtcatgaaccagggtttggctattagaaaagtctagaaattgagcaaaaaataaaattaggtggttacaacagaacactgctcattttctactctctacaaatgataaaactataaaattatggaaaagaagcggatgagataaaagagcagaaagttataacttgaatgatgaagatggatgacttcaagattcatttagaattacagcactatcaatgacctgaggattaatttatgacacttagaaatcacacatagacattttgacgtggtagacatcaaacctgctaacctggagcagctgacagaagtcattgtggcagccaagttccactcataccagtgcaatgtgcttgtctacagtagtagcaaaggaaccattgactaagcagcatgggctcctcgaccctgtgcaacagacactccaagttttttgaagagcctcaagatcccagcagtaggtccttcttctcagaaataatttcatccatacccaatgtaaaatgtagccatagtgggcagtacctgatgaccagagactccctgttggtgaaggtgtgggacctcaacatagagagcaggctgggaccacaccgggaccacgagtacctgcacagcaagctctgctttctctatgagaatgactgcatctttgatagctttgaatgttgctggaatggttcggataggtgcatagttgaaccacaaataagcaagggaaatctcccaacagccagaaacgaagagggagctgaaaccagaaccgtagcctctaaagacgtttattgcgagagaagccccacacccctggctggccttgggtgcatcagccaatagcaggaaccgctgcctcctgtgaacagcaagttgtggcgcagagctgaagccttggaccatgaggtgtggagttggaactgcgccctcaaagatgatgaggtctccgtccactggagtccagagggaagtttatctgagatcttgcattggggtggccaaagctcccctgagatgtgtaagcatagcttcccattacaagggtttgaagtccctctctctccctccccctccgcctcctcctccccctctccctctcactggtctccctctgatgccaccaaagttgtgaaagccgaggctggactgtactgccgccatctcggctcactgcaacctccctgcctgattctcctgcctcagcctgccgagtgcctgagattgcaggggcgcgccgccacgcctgactggttttcgtatttttttggtggagacggggtttcgctgtgttggccgggctggtctccagctcctaaccgcgagtgatctgccagcctcggcctctcgaggtgccgggattgtagacggagtctcgttcactcagtgctcaatgttgcccaggctggagtgcagtggcgtgatctcggctcgctacaacctccacctcccagccgcctgccttggcctcccaaagtgccgagattgcagcctctgcccagcggccaccccatctgggaagtgaggagcgtctctgcctggccgcccatcgtctgggatgtgaggagcccctctgcccggccgcccagtctgggaagtgaggagcgcctcttcccggccgccatcccatctaggaagtgaggagcgtctctgcccggccgcccattgtctgagatgtggggagtgcctctgccccgccgctccgtctgggatgtgaggagcgcctctgcccggccgcgaccccgtctgggaggtgaggagcatctctgcccagccgccctgtctgagaagtgaggagcccctccgcccggcagccgccccgtctgggaagtgaggagcgtctccacccggcagctgccccgtccgggaggtggggggcagcccccgcccggccagccgccccatccgggaggtggggggcgcctctgcccggccgccccttctgggaagtgaggagcccctctgcccagcggccaccccgtctgggaggtgtacccaacagctcattgagaacgggccatgatgacgatggcggttttgttgaatggaaaagggggaaatgtggggaaaagatagagaaatcagattgttgctgtgtctgtgtagaaagaagtagacataggagactccattttgttctgtactaagaaaaattcttctgccttgggatggtgttaatctataaccttacccccaaccccgtgctctctgaaacatgtgctgtttccactcagggttaaatggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacccttgttcacttgtttatctgctgaccttccctccactattgtcctatgaccctgccaaatccccctctccgagaaacacccaagaatgatcaataaatactaaaaaaaaaaacaaaacaaaaaaacaaacaaacaaacaaaaacaaaaacaagggtttgaagtttgtgttggtggcagctgcgtgatctggaaaagctcacactgaggagctctcctgcctccatgagggcagcgtgcaggcgcctggaggcactgacgtttttctgggtctgacttctactctgtttacagactaatctgctagcctacagtgtttcacagatgttgactgaagacatgaggttcctgggtccttggagcacagcaagcagcatgagcctcttgctggcacaggtttcccagggggtgacacaaggggcccaggcagatgctatgcaagcagtggggctgatgtcatggccgatgcatgctgaggttggagaactcactgctttttcagtggacagtcaacaaacctgcactttgactagaagaaacatgacctcattcctctagaccacttgctgtaagcacagccctgagaagtggcccaggttaaaagaatggtgttctttgcaaacttagtgagaacatgcatggtgggtggctgctcccagcacacccaggtctctctggatttccccagattaaaaccagctaaacatgagctcacaggtaaaattaccaagcacatatgggaaaagccaccacgagtaagtcagcagaaccacagcggaactgaacctcagagaacccagcctttgacatcctaaattaaactaagaatgcttgagatatttacagactaaaggaaggaaacagcctgaaccaggagccacaagaccactaaaatgacctggcagactggagaggaatcaaagagaacgtctggaaatgacaagtacaatagatgaaactgtgggtttaacaacaggcccattttggctagagattttgaattagtagatggaaaggaaaatcagaagaaatgcagactagagagccaaagagatagaaaacatgaaacataagaagtgtggaggtcaggatgaggcacagcacacatttaaacagagaagtgtggggacatgaggcttaaagtgacagtggccaggaattttctgtaagttatgaaagcctgaatacacagaagcaggaagcacagaaatccacatccatatcatcatgaaactgcaggacaccaagtgcaaagagaagatcttaaatgcagccaaggaaaaagcacaaattacagagagcagatgctgagactgagagtagactttatagcagccacagtgggagccggaagccatgtgatacagtgagtgtgacttgggactcttcaccatcagcttagaatcaggcattgaaatagatggttgttcaagaatctgcttatggtaaaggcatttccagatgggaaacagaatttatcacaacaggaaactcaggagagtgagactcaaggaactcactgaagaacgtacttccagcagaaggagagtggtcctggagaaagggtgtgattctgagataggcagatgaacagagcagtcagtgaagacgtgagcaacggaaagcaacgtggactctaaagctctgttaactgggtgaccctggttatctgggttgcggggagaaaaattagagccctcaccaacaccacacagcaaataagctctgaatgttttaaagcctagaagacgctatgggagagcatcttcatggctctggagatgaaaggccttctttaacaaggtcctaaatgcccagtgaaggaaaacattaagaaattcaggctgatcgtgctggctcaagcctgtaatcccagcacttcgggagaccgagttgggtggatcacttgagcccaggagtttgagaccagcctgggcaaaatggtgaaatctgatctctacaaaaaatacacacacacacacacacacacacacacacacacacacacacacacacacacacaaatagctgagtgtggtggcatgcgcctcccagctacttgggaggctgagatgggaggatcacctgagctagggaggtggaggttgcaataagctgagatcgtgccatcacactccagcctgggtgatagaatgagaccctgtctcaaaaaaaaacaatactgtagttaaatttagtggtttttggttttttggttttgtttttgttttttgagacagagtcttgctgtgttgcccaggctggagtgtagtggctcaatctagatccactgcaacctctctctcctgggttcaagtgattctcctgcctcagcctcctgagtagctgggattacaggcatgtgccacgaggcctggctgatttttgtatttttaatagagatggggttttaccatgttggccaggctggtcttgaactcttgacctcaagtgatctgcccacctcggcctcccaaagtgctgggattacaggcgtgagccaccatgcccggccaactacattaaattttaaacttctttattttgaaataaaaagtaaaaacaggctgctctgcctatggagtagccattcttttattcctttactttgttaataaactagctttcatcttaaaaaaaaagtgaaaacaaaatccacaaaagcaaatataacgaacagattcagtatccaaaatatgtaaagaattaggagtcaacaagaaggtggcaaacagctcacttaggaaagagcaaaaaccatgactgggaatttgcagaaatggaaaaataaataaaaatgctcattcttagtgatcagcaaattagagccagagggatgtcctttcacacccatcagaatgatgatgatgatgtcagggaaaggaatgaaggccagtgggcgagaccactgcctttttgtgggcctccttggtggcagcaagtccagttgggagcttcttgtatgtacagacaagaaaatgtattcagaagcttgaaatagcaaacacctggagacagctcaggggtgcatcattaggggaatggataggtaggttgttgtctatcatatgctaaaaagcagtaagaatcaattatttgaactacatggatcacagctgggcacagtggctcacgcctgtaatcccagtactttgggaggccaaggcgggcagatcacctgaggtcaggagtttgagaccagcctggccaacatggtgaaaccccgtctctactaaaaatacaaaacattagctgggcgtggtggcacgagcctgtagtcccagctactcaggcagctgaggtaggagaagcgcttgaacccaggaagcagaagttgcagtgagctgagatcatgccactgcactccagcctggatgacagagcgagactgtgtctcaaaaaaaaaaagaactacatggatcacataggtggatctcacaaagataaagataatccgcaaagaaagaaaattcaggcggaacacatacagtgtgatgacatttgacatgttatatttaaggcatgcagaagttttatttgtttttaagaatctgtaactattcaaaaatataaacgtgcatggggatgatacatacgtactctagtgagtgatttccccagctggggacaggattggagatgatctttctagagtgggacatggtggaggttaactgtcttagcaatgacttatgggtacttggatactcactgtattattcctttttttttttttttttgagacagagtctcgctctgttgcccaggctggagtgcagtggcgcaatctcggctcactgcaaactccacctcctgggttcacgccattctcctgcctcagcctcctgagtagctgggactataggcgcccgccaccacacctggctaatttttgtattttcagtagagacggggtttcaccgtggtctcgatctcctgacctcgtgatccgcctgcctcagcctcccaaagtggtgggattacagcatgagccaccgtgcccggcccactgtattattctttgttcctcttgatatatctgaaatattgtgaagtatacttaaattacacatccctaagaatatccaaaagctctcctggtaatatttgcttactccattcactcttacaaacactcccatatcttcttgcctggaaacatctgttgagggatgggatgaaggggaatgagatttttcagtgctctctctgcccagtcctgatcccctgtgtgacaccactttctggtgctctaggttgccccgcaaaaccagacatagccgcttgctcttgagtgtgtctgcactgtccctacctcaggccagcaccgatgcaggcggctaggcggctgtcttgtttacagtgtggaaatgcccactcccaggccagcattgcctatcaataattgacaagtgataataaaactgtataaaagctgaaaaagtcttatattcttcctgttttttctttaatttttatcaaagtaataaatatatatggtttttaaaaatcaaatagtttagaagaacttctaatgaagaataaaaagcctccacctgtacattataaatttgtacaaatgcacagaatgtacaccaccaagagtgacctgtaatgtaaacatggactttgggtgataataatgtgtctatgtaggttcttcagtagtaacaaatgtatctctctagtgggggacgttgataatggtggaggctgtgcatgcaggggctgtatggggaatctttgtaccttcctctcaattttgctgcaaacctataactggtctaaaaataaagtctatttttaaaaaagccttttccacctcacctctcccaacctcagtccacttgccaaaggtagccattgctagttttaattctttggaatacctataaataatgttatttatatgttatataaataataatgtgtttgctactatttctgggctcatcacccatagacgttaattatcacctttcctctcttgagattttctctctcctgtatctgcaggtcagtggggaattggccgagctggctgggcttggctggctggactggctccaagctgtgggtccagctaggcatgtctccttcgtaggtcaggctcaggtctgctctggattccccctggggtctaagatgaagggacagggaagctcttgtcacaataatggcaaagccacaagagggaaggctcagctgcacaagtgcatttcaaacctttgctaacatctcattggccaaagcacgtcacatggccacagtcaggagtgaagaagtgcactgtctctagtagcaggcactgcaaagtcacatagtcaagggcctggatatagacagaagtgaagaactgggaccttttattcaatctaccatatttctcataattctgttttcttatagacttctctgtaacagtattttagctcaaataatacaacacagctttgcccaatggttggcctcttttaagtggctgatagatacttgatgagtttcttaaatctcaacattcccacaggtttctgagaaggaattttgttagatagtttaggcttggcggatgaagaaagtttgggtgtgggttcttcaaagtcagtctggctggaaacaccttgttctccccttcccttctatgaagtgaagagtgtctccagatggtgtatagacagcgagttgctacggaaacatcatttgatctccccagaagattactacaccgatacagtgccgtttcactctgcacctaaaggtaatgcttctgtgctctcaaggcctctgataccatttgggggaagttcagtagggccacgttggccacctctgctgccatttccttgctcagaggtttttttcaccttttctttaatttcgatggtgactgttgggaaagtcaaatctgagcatctgagcatgccaatttcttgctagtgctcccccgcctgtatgactgaagtccaggcttctccatgtggactatgatgcccacatctgctgcccaataccaagaattatgtaagtgcttggagttgcagttgaaccaagagaaggaaaaactgaagacatagaaaagcaagggagcgtgtacctgatgagttggagcagggacttatgggttttcccatgcaggaaaagagcagcttctcatcctttcagaatggagggaagcctgggtagagaggcagagagggtgtgtacatgtatgtgacattgggccagtttcctgtgatatgggaggcaagatattctgagaatgagtggggtgggaggctgtgatgtgggcttaagcagcgagttagacttatggaagagtccacacgtggacagggagaagtccctgtgtggattctgtggccagttatcgggattgcctagcatgctgggctcagaagacaagctctcccatagctccagttgagggactgtttgattctctggggcttgggagctgagaaggtgtttggggtgggaggattgggatctagaaaattgagggtgctcctggggagagttccactgatggtctgagctacgtagggaagtaaggcaagaaagaggtagcagaatcaagtgtcatggagtactaagccacttagtatttttttttttttgaggcagagtttcacttttgttgtccaggctagagtgcaatggcacgatcttggctcaccacaacctccatctcccaggttcaagcaattctccttcctcagcctcccaagtagctgggattacaggcgtgtgccaccacacctggctaattttgtatttttagtagagagggggtttctccatgttggtctcaaactcctgacctcaggtgatccacccacctcagcctcccaaagtgctgggattacaggcatgagccaccgcacccggccaccacttagtattttaaagttagttggaaactcagtatcttatgcaggtcaataagaatggggctaacatgtattgagagttaaccaggcattgtgctaagagatttgtgatggtatccatttgattgcattcttgctagcaatgaatgttctcatttaacctttggagggatggttttcttgtttgtttgtttgtttgtttgttttttcttgagacagagtctcgctttgtcacccaggccagagtacagtggtgtgatctactgcaacctctgcctcctgggttcaagcgtttctcctgcttcagcctcagcctcctgagtagctgggattaaaggcgcctgccatcatgcctggataatttttttgtatttttagtagagacagggtttcaccatgttggccaggctggtttccaactcctgacctcaagtgatccgccggcctcagcctcccaaattgccaggattacaggcatgagccactgcgcttggccagggggtgggggatgatcttaacagtgtaaaaagctcatacaaactttcattccttctgtgagctcttcagaaagcatgctcatgtatggggtatgtgtacaggcatgtgtgtgtgacagtggtctactcatgttctttgaccatgttggaaaatattttaacactctagtcctaaattttgttgttgtttgtttgtttgtttttgagaccgggtcttgctttgttgcccaggctggagtgcagaagcacaaccataactcactacaaccttgacctcctgtgctgaagtaattctccccactcagcctcctgagcatctgggaccacaggcatgcactaccacacccagcaaatttttaaatttattttttgtagagatagggtctcactctcactatgttgccaaggctggtgtcaactcctgggcttaagtgatgctcccaccttggcctcccaaagtgctgggatgataggtgtgagccaccacacatggccattttgaatacatagaataagttccaggagtaattcatatgttgaagagcaattatagctggtgtggtaaatatgaaagtttaggagaaagatcaagctaactgtggctttggtggttttatttggtcatcttaggaatgcccacctcctcaccttgttgcagtgattcagtttgtttccttgatgctgtaggcatctccctacctggatgttcaaaactgacatttagctgtgagaagcgttccgtccagaagaaagagctgaacaagaagcttgaagattcatgcaggaagaagcttgctgagttcgaagatgagttagaccacactgtggacagcctgacatggaatttaactcctaaggccaaagaaaggaccagagaacctctcaaggtcagtttggaaggctgtgcagagcagtgtttggggggacagagaggcagtgaaggggaaggcattcagatgacatgagaagctgtgatgaatccatcgcaaaatagagtagagcttgtgttggccatctatgggtcatgcagttggtcaagatgtcaacaagcacaatccctttgcctgtcattgactctatgcttttgtatgtttcaaagaaagcaagtcaaccaaggaataaaaactggatgaaccacttacgtgtgccacagagagagctagacagacttctgcttgccagaatggagagtcggaaccacttcctaaaaaatccccgtttttttcctcctaacactcgatatggaggcaagtctcttgtttttcctccaaagaagccagcaccgataggagaattccagagtacagagccagaacagaggtatgtctttctctggcttgaactctcagaaaacctggcccatgagagttaacctagatggtcctccgtttggtctggctgtagaggtccctagacttgtggggcagggtagcagtatcagaacagagcagggctgcagggtcacccactggtgtggcctttgaaccttccccagagtcctgggtttatgcttttctgacctgccaggggtcttgagaaataggggttggtgttggccctttatttacattggagcaatctgggtcaaatggaagcaatcccgttagagacataggtcttgagtaataacagcatttgaaatttgattgattataaataattagtgtaaactgtgatttttctttaagagtgcctttgcctatatatcagtaactgtccttatgaaagtaatgagttgcttcatgggttcataattttagtaagcctaaaactattaacatttctttattagacaactaatattttttattaagaaaaattagatacaaaaactagctgggtatggtggcatgcacctgtgatcccagccacttgggaggcggaagtggaaggatcacctgagcacaggggtgtcgaggctgcagtgagccaagattgtgccactgcactccagcctaggtgacagagtgagaccctgtcaaaaagaaaatagaagagaagagaagagaggaggagaaaagagaaagaaaagaaagaaagattagaaaagactaatatttgagatacctatattaaaaacccacttacttattggtgtttaaacatgtagagtttttcctatgcatattgaaaatgaaatatgtagctacttatgtcttcacaaagattggatcatactgtaaaattattttataacctgcattaacaataagatccaaaaaccccccaacaaatggtatattgtgaatatctttgatggtctttatgtatttatttttacattaatcagtcactgcctactatttcattgtatggatgaaactaacagcctttctccccctcttttttcatcccacagttgtgctgatactccagtgtttctagctaagccaccaattgggtttttcacagattatgaaattggtccagtttatgaggtagacatcttgtttctttacagctcccaccccatctgctttcttatttttaaaaagtctttattatggaaattttcttttttttttctttttttttttttttttagtatttattgatcattcttgggtgtttctcggagagggggatttggcagggtctaggacaatagtgaagggaaggtcagcagataaacatgtgaacaaaggtctctggttttcctaggcagagggccctgccgccttccgcagtgtttgtgtccctgggtacttgagattagggagtggtgatgactcttaacgagcatgctgccttcaagcatctgtttaacaaagcacatcttgcaccgcccttaattcatttaaccctgagtggacagagcacatgtttcagagagcacggggttgggggtaaggttatagattaacaccatcccaaggcagaagaatttttcttagtacagaacaaaatggagtctcctatgtctacttctttctatacagacacagtaaaaatctgatctctctttcttttccccacatttcccccttttctatttgacaaaaccgccatcggcatcatggcccgttctccatgagctattgggtacacctcccagacggggtggcggccgggcagaggggctcctcacttcccggacggggcggccgggcagaggctcccccaccacctcccgggaagggcggctagccgggcgggggctgccccccacctcccggacggggtggctgcggggcagagacactcctcagttcccagacggggtcgcggccgggcagaggcgctcctcacatctcagacggggcggcggggcagaggcgctccccacatcccagacgatgggcggccgggcagagacgctcctcacttcctagatgggatgacggccaggaagaggcgctcctcacttcccagactgggcggccgggcagaggggctcctcacatcccagacgatgggcggccaggcagagacgctcctcacttcctagatggggtggcggccgggcagaggctgcaaactcagcactttgggaggccaaggcaggcggctgggaggtggaggttgtagcgagccgagatcatgccactgcactccagcctgggcaacattgagcactgagtgagcgagactccgtctgcaatcccggcacctcgggaggctgaggctggcagatcactcgtggtcaggagctggagaccagcccggccagcacagcgaaaccccgtctccaccaaaaaacacgaaaaccagtcatgcgtggcggcgcacgcctgcaatcgcaggcactcggcaggctgaggcaggagaatcaggcagggaggttgtagtgagtcgagatggcggcagtacagtccagcctccgctcggcatcagagggagaccgtgcagagggagagggagagggaggagagggagactgtgcagagggagagggagagggagagggaggagaggaagaccgtgcagagggaaagggagagggagagggcggaaatttttaactgtacacaaaactagggaaaagactataactactcctcatgtgcccaatatgcagcttcaacagttatctacattttgccaatctggttttgtctattactcctacaacctcttcatgtacacatctatatgcacatgtatgtgctggagtcatagaaggaaaatatgatatcatgtcattcttcagttaatacatcaattagtatctctaacagataagggttttaaaaagtaaccatagtaccactgtcacacccagccatattaataatgattccttaatatcaactaatacccatctatgtctgatcttcatttgttttaaaaaaaagtccatttatatttggtttctttgcatcagaatctaaacattgcatttgattaaagtatctcttaattctcctttagttgataataattcctctcccacctcctgctttttaaaaatgccatttatttgttgaagaaactgcaatttcgtacaccctggatttggctaattgcgttattgtggtgacattaaacgtgttcttttatcttccatattttccacaaactggtcattagatatagagatttgatgagattcaagttccatttttcctcttttttgacaagaatacttccttggtggtactgtgtatttcttattgcaatccatcaggaggaagcatgggatctgggtttcccatgatcagttatgaatggcatcaggtgttgaaattctgattcattctctataaagttcttatcaaactttcacttaatagttaacagcctagatgactgccagatgactattgtccagatccattttttcttcaatcagggcttacaaaatggtaatttctaattctattattccatctacatttattagcttgattttccatttaaaaaacagaataaaactttccctctaactttgattcctgcctcctcctctttcttgtactctcctgatatctataggtaactatttctattagtttgcattcttccattgtttctttttgaaccataagcaaatatgtatatatagttgaaccccctttccttcttactgtcctctacatcttaacagtatatccagtaattcctgcaagagcagaggctttcctcattcctttttcccagcttctttcttttagaagcttcccaccttcttggggaatcaggtcaagaccaagcttagcagtcaccaactctgctcaccaggtacaaagacaactaggcctaatgatagcaatcccttcacatgcacatggattgcattttatagtttaaagagcacttgcctatccataattcttgaggaatgtctcaaccactcatggcaaaaagcagaccaatatggtagctctatatgctgaacattagaggaagcattttgcttactccctggacttaacagtaatgtgttgtcttttgtacttctgtgtctgggacttctgtgtctggccatcacgttttaaggacagttgtagaagctggcaaacacccagaggaaaggagctaaaatcatgtcagttagggaatagaatagggaaaagggagagctgctgatggacttatggaagatattcttcttcagggctttcagatgcctgctgtggaagcctgtgctcagagcctggagatcctgaggctgtagatgaggtagacatagactgctatggaacagtctttcctctgatctttgcctacttgtctaattctcatccctttgatgttcataacagttgtttacccggctaaactataaagtgtaaggataaaaacagttcaaattttcagtctttaaaaatttatgtcccatgtaccctttctctgaaacctcccagggaacatgcttctttaatagaaatgaggaaaccaatgaagaggaaggcatggaatgtggtaccaagagatccaacataggggagaggtgaaggaaatctccaggttaataactcttaagagattttgcagttaatattgctgcaaagcaaaatttcccaaagctcagcaacttaaaacaatcattttatcatgcttacaaattctttgggtgaaaaattcagagagagcacaatgggaatgacttgttccacaatgtctgaggccattgctggaaagagtcagtgcttaggggtgacataaaagttggggttgatgctgttgatgctgttgtagatagagagctgaggctgtctaccagaatgtctacaccacatagcttctctatgtgggctgtgcttccttacagtatggcaatctcaggttaatcagacttttacatgacaatgcaagtgagtatctgcacttttttttttttttttttgagatggaatcttgctctattacccaagctggagtgcagttgcaggatcttggctcactgcaacctctgcctcttgggttcaagcaattctcccacttcagcctcctgtgtaactgggattacaggtacgcaccaccacgcctggctaattttttatatttttggtagagagagggttttgccatgttggccatgctggtctcgaactcctgacctcagatgattcactcgccttggcctcccaaagtcctgggattacaggcgtgagccattgtacctggccaagtatctgcacttctaagtgagtatcctagcaagcaagaaggagattgcatcacattttatgacctaatcttgtaagttgcacagcactacatcctctgcatgccgtagattacaaacaagtcactaaggttcatccagattcaagggaagatatgtagacttcatttctttttttttaaaacctttttttttgaaataaggtctggctctgtcgcccaggctggagtgcagtggcatgatcttggctcactgcaacctctgcctcctgggctcaagcaactcctcccaactcagcttcccaagaagctggggctacaggtgcaggccaccacacctggctaatttttgtattttttgtatagacgggtttttgctatgttgcccaggctggtttcaaactcctgagctcaagcaacccacccgcctcggcttcctaaagtgctaggattacaggcgtgagccagtgtccagcctagacttcatctctaatgagaacagtgtcaaagaacttatggatgtgtcttaaaactgctctaggagttatcctatatgatagcagtaggtgtagtgggcaactagcccagattagaagaggccagaaagctctaggagaggttgatttatggagatgacattgagaagagtccctgatacacctggacatatgggggagagatttgtagggtggtggagaaggattgaattattgataagcacaaagcaaacaaaataattagttgattattcactccaggaaaaccaaaaattgtacaaggcagggaaaggaatcacctcatgctcagctgtgaatagcaattacttagtaacttgaatataacatgaattactaatctaaccagtagtatgatataactatattggaaacatgggggataggaagggcgtgtcatatggtgagtcagatatgggagagggaagagggaatatccatatcctccatctataattaatacctaaaactgaacaaaagtagtatactatttggagacatggaaataaataccaaaataatcagctaaaggatgaaaaagtgtttatctttggggagtgggaaatggcaggatggggccaggggaagagggcagtattctattttcaaaaccttgtcgaactctgactctttaaaccatgtggctgtccaacttagaagaaaacaatttaaaaaaacccaaaactttccacaaaaagaaacaccaggcccagatcattttgcaggcacagattatgaaacattcgagctattccctattttatgaaactatttcagagactagaaaaagagggaatgtaccatcattattaggtaataagcctaattaccttgacaccaaataaaaatatataccagtcttaagaacataggtgcagaaatactaggtaaaaaacagcaaaccaaaccaaacagtaaggaacaacacacacacacacacacgcagccaattctttgaaacccaggaacgcagggaatgtcttcacagcaggccttgagttggcagttggctctgctgagcctattatttttttcctccaaagcttccagtgctgttaaggaaagccagtccatgccacagtccttataatgatcactatcccaaaccttgcagccaccacagctaccatgtttcactccctggccttccacctgcacctcatttcagttgaccactagtgaaagccttggtaattgtgacaataccatcccatggtgctcacaccctagttcccaccagctgtttcacagatggattggtgtaatatgtagtgttggccaaaaattgatgtaaatgctgatttaggaatacaaatctataaataaaaataggaagacatacttcatatttatgtcaatttttatctggtggggggctggtagaggatttcaactttatctgtaatgttttatttcttaagctgggtgatggaaacatggcttctgtcatgttataatttatacattgttttctagtgtaacatttcacaaaatattaacaaaagatgtgtacctgtattgatgtgctacacactgtgctgggtgcagttggaggattaggtctagaccttgcccttgggggtctcccaatctggggtggcagaaaagaaagtggggcttaaagggggtgagtgggttgcgtaagaggcccaattacatcctgacatagaggtgccataacactctttgtgtccatgggaagaatggttcagagatacgtgttgaggaagacagtaagtaagaggtgaggtgagcaaaactttgaaaccagatatcctaggctcaaacctaactggtgcctctttgaactccagtttcttcagctgtgagatagaaacagttcccacctttcctggttgttgcgaggttgaggaggtacagagcagatgctcataaatagtaattgttattttaaacaataggtcagtttcatgcacgtccgtgtgaagagactgctaaacaagctttgtgtgagcaataaaagcttttaatcacctgggtgcaggcgagctgcgtccacaaagagagtcagtgaaaagagatggggtgggtccattttataagatttgggtgggtaaaggaaaattgcagtcaaagggggtttgttctctggcgggcaggagtgggagtcgcaaggtgctcagtgggggagctttttgagccaggaaaaggactttcacaaggtaatgtcatcacttaaggcaaggaccggccattttcacttcttttgtggtggaatgtcatcagttaaggcggggcagggcattttcacttcttttgtgattctttagttacttcaggccatctgggcatataggtgcaagtcacaggagatgcgatggcttgccttgggctcagaggcctgacattcctgccttcttatattaataagaaaaatgaaacaaaatagtgttgaagtgttggggtggcgaaaatttttgggggatggtatggagagagagaatgggcgatgtttcttagggctgcttcaagcgggattggggcagcgtgggaacctagagtgggagagagaaagctgaagggagatcttgtggtaagtggtgatatcgtggggttgttagaagaaacatttgttgtatagaatgattggtgatggcctggatatggttttggatgaattgagaaactaaacggaagatacaaggtctgaataaaagaaggagaaaaatgggtattaaaggactaagaattgggaggacctaggatatttaattagagagtgcctaagggggttcagcgcaattacttgcttggtttagaagtgatctccttgaggatagatttccatgatggaaaggaaatgagaggttctaagagacgggctagcggcttgtaacctacatggaagaggttatgaaatgacgacagaatagaatgggcctgtgaggctggaaggaggtattttccttggtctaagaactatttgccttgtgtgggaagagattgataggtggaaatttcagcggggaagtaggtgggagtgaccgatgtgaaggagaaaaactggccctgagggacagaagttggagagctagctgcttgtctagccaccttatcagcataagcgttgcttagagcaatgggatctgacgccttttgatgcctcttgcagtgaatgaccttagcctcctttggaagtaaaggggccttgagtagagtttttattaaagaggcattaatgatggaggacccttgtgtagtgagggagcctctttcagcctatatgaccacatggtggtgcagaatatgaaaggcatatttagaatcagtgtagatattgacgcatagtccttttccaagagtgagggcttgagttaaggcaactagtctggcttgctgagaggtagtggaggggggcagagtggtagcctcaatgatagatgtggaagatactatagcatagcctgcctttgctggtgagtggcaattaggcctggtggaactgccatcaataaaccaagtgtgattagggtgagaaacaaggaagaaggaaatgtggggaaatggggtgaacatcaggtggatcagagagatgcagtcatgagggtcaggtgtggtatctggaataatgtgggaggccagattgaagtccaggccaggaacaatggtaactgtgggagattcaacgaagagtgagtgtagctgaaggagccggggagcagaaagtatatgcgtcaggtgtgaggaagaaaatagattttggaaattatgagagctgtagagagtgagttgagcatagtttgtgattttgagggcctctaaaagtattagggcggcagcagccactgcacggagacatgatggccagcctaaaacagtaaggtcaagttgtttggacaaaaaggctacaggacgcgatcctggtccttgtgtaagaattctgactgcacagccctgcacttcggctgtgtgtaatgaaaagagttgggatgagtcagggagagctagagtgggggcagtctctaaagctgtcttcaaggaacagaaagaggagtggggaaaggatttaggatctatggggtcaactaggtttccttttgtgagtttatataatggttttgttaggatggcaaaaccaggtatctaaaggcgaaaatatctaaccatgcctaggaaggaaaggagttgttgttttgtagaaggggttggggtttgagagattagtcgggcacgattggcagggagagcacgtgtgtttttatgaagaattatgccgaggtaggtaatggatggagaagacatttgagttttggagggagatacctgatatcctttggagaataaatgttgaaggagcagaagtgtgtcttgttgagaagattcaaaggaggggctacaaagaagaaggtcatcaatatattgaataaggtgagaagcggaggggtggaaagaaagtaaatcacgagaaagagcttggctgaagtaatgagggctgtccctgaaaccttgcggcagcacagcccaggtaagctgctgggactgatgggtgacagggtcagtccaggtgaaagcaaagagaggctgggatgaggagtgcaggggaatagtgaaaaaagcatctttaagatcgagaacagaacactgagttgtggaggaaggtattgaggacaaaagagtgtatgggttgggcaccacaggatggatggcaaaacaatttggttgataaggtgcagatcctgaactaatctgtaagacttgtctggtttttggacaggtaaagtgggggaattgtaaggagagtttttaggttttagaagcccatgctgtagcaggcgagtgataacaggctttaatccttttaaagtgtgctgtgggatgggatattggcattgagtggggtaagggtgattaggttttaatgggatggtaataggcatgtgatcagttgccagggaaggagtagagatgtcttatacttgtgggttaaggtggggggatacgagaggaagacacaaaggaggctttgggttggggagaagagcggcaatgagatgcggctatagtagtcagggaagcagataatttggttaaaatatctcggcctaataagggaactgggcaggtggggataactgaaaaagagtgcataaaagagtgttgcccaagttggcaccagagtgggggagttttcaggggttttgaagcttggccgtcagtacctacaacagttattggggctagggaaacaggcctttgaaaagaaggcaacatggagtgggtagcccctgtgtcgattaaacaggggatggacttactctccactgtgagagttacctgaagctcagcatctgtgatggtctagggggattctgaggtgatcgggcagcatcaatcttcagtcgctaagctgagcagatctgggaaggagtcggtcagagagccttgggctagagctttaggggctctaggagtggctgctgggcgagctgggcagtctgccttccagtgggtccttacacagatgggacatggcttggaaggaatcctgggctgcaggcattccttggcctagtggccagatttctggcacttgaagcaggatcctgatggaggaagtcttgtaggaatgcttgactgctgcagcttaggcattttgaagttcttgtatgctggaggtgtggctgagttttgtctcacagcagaggcaagtaattgtaactcagaaatgcgttgccatctggctgcttcctctctattattgtacaccttgaaggtgaggttgattaattcctgtttgtggggtttgagggccagattctaatttttgaagttttttcctaatgtcaggagtggattgggtgataaaatgcatattgagaataaggcggccttctggcccctctgggtctagggcggtaaagcgtctaagggttgctgcttaagcgggccatgaactgggctgggttttcgtctttaccttgggtagtttctttaagcttgtcagaattaacagctttgtaagctgcctttttaagcctttcaactaggcaggaaatcatgtaatcttgcctagctatacctggggaatttgtctggtagttccattggggatcctcttggggaactgctctaatgccttcctggaggtcaggttcatgaagccggcggttatcagcatgagattgggctagagaaaaaactctttcctgttcatctggggagagggtagaagtcaggatgacatttaagtcactccaggttaaattgtaggacagagttagatatcagaattcctgtatatatttagtggggtctgatgagaaagagcctaaacgctgactgatttgagagaggtctgatagagaaaaaggtacatgtaccctgactatgcctttagctccagccacctctctaagaggaaattgttgggcgggtggggaaaagctagtcgcagaactaaactgtaagccggaccgggtgtgaggaggggaggtggtagaaggattataggatggaagagcggaggctgaggaagaattgggacttagctcaacctggccatgagcagcctgaggaggaggggaaaggtcagatgggcctgtagaaggaagactggaaagattcaacgacgcttggggttgggactgagggggcaggcgggaaggaaagaaggaggatttgggaggaatcgcattgggaacagagactagggagggaacaaagtgtgaaaagtgcctggacgtaaggcacctcagaccatttgcctattttttgacaaaaattatttaggtcttgtaggatggagaaattgaaagtgccattttctggccatttagagccattgtcaagtttgtattggggccaagcagtgttgcagaagaaaataaggcatttaggttttaggtcagatgtgagttgaagaggttttaagttcttgagaacacaggctaagggagaagaaggaggaatggagggtggaaggttgcccatagtgaaggaggcaagcccagagaaaagagagagtagagacacggagggaaggggttcgggggttcttaccctccagaaaagtgggaaaggggtcggggcgtggaaataaggggttggggcacagagataagaggtcagggcatggaaataagggatcggggtgcagagataagaggtcggggcacagaaataagggattggggcacagggataagaggttggggcatggaaataagggattgggggttcttgccccctagaaaagcgggacttgccactaagggtgaaggagaaggggttgaggggttcttgcctctcccctagaaaagcagagaaggggtagagactcagagagaaggggttggggtacttgcccctcccctagaaaagcgggacttgccactaagggtgaaagaccaaggcaggtgtccttgtgtggtctgacacctctgaaacgtgggtgaataatcagagaggcatccctgcaatgattaaacatcaagggaaggctgccttcctagtctgtgaccggcaccggagttttgggtccacggataaaacatgtctcctttgtctctaccagaaaatgaaaggaattgaaattaagagaagggagagattgaagggtggcgccaagattgaaaggagaaagaggttgagggatagtgagggaggttggagaagagagtaaaaagaggccgcttaccagatttgaaattggtgagatgtttcttgggctcatcggtctgaggacctgaggtcgtaggtggtttcatgtgcgtccgtgtgaagagaccaccaaacaggctttgtgtgagcaataaagctgtttatttcacctgggtacaagtgggctgagtctgaaaagagagtcagtgaagggagatggggtggggctgttttataagatttgggtgggtaaaggaaaattacagtcaaagggggtttgttctctggcaggcaggagtgggggtcgcaaagtactcagtgggggagctttttgagccaggatgagccaggaaaaggactttcacaaggtaatgtcatcactcaaggcaaggaccggccatttacacttcttttgtggtggaatgtcatcagttaaggtggggcagggcatattcacttcttttgtgattcttcagttacttcaggccatctgggcatatacatgcaagtcacaggggatgcaatgtcttggcttgggctcagaggcctgacattcctgccttcttatattaataagaaaaataaaacaaaatagtggtaaagtgttgggacagcaaaaattttgggggatggtatggagcgataatgggcgatgtttctcagggctgctttgatcaggattaggggcagcgtgggaacctagagtgggagagattaagctgaaggaagattctgtggtaaggggtgatattgtggggttgttagaagaaacatttgttgtgtagaattattggtgatggcctggatacagttttgtatgaattgaaaaactaaatggaataagagaaggagaaaaacagatataaaaggtctaagaactgggaggacctaggacatctgattagagagtgcctaaggagattcagcatagtcctgccagcaaagattatttatttacttcaagagttaagaatggcagtttggggatagcacgaggagatatcagctgtgatggcttggagaaacagtgtaaaccggcagtgtaaacaagagcagggcatgtatgagtagttgagaatggagaataggagtatgactagacagaaaatagtagggatgacaagtgtttttggggcacagtctaagttggtccagtgtctggaatgagactgggacctaataaaaaggagctcaaatgggctgtaccttgtagcattccgaggacaggtctgatttctgagaagggaaagtggtgaaagtattgtccagtcctttttaagttggtggctgagcttggtgaggtttgtttttaaaagacctttagtctgttctacttttcttgaagacagaggaccgtaagggatataaaggtttcctgaaaaactgcttggctgatttgacaaataaaggctggtctgttatcagattgtatagaggtgggaaggctaaactgaggaattatgtctgacagaagggaagaaattactgggatggccttctcagaccctgtaggaaaggcctctacttatctagtgaaagtgtctacttagactaagaggtattttagttatctgactcagggcatgttgagtaaagctaatttgccagtcctgggtgggggcaaatcttcaagcttgatgtgtagggaagggagggggcctgaataatccctgaggagtagtagaatagcagatggaacactgagaagttatttcctcgaggatagatttccacaatggaaaggaaatgagaggttctaagaggcgggctagtggcttgtactatagcatagcctgcctttgctggtgtgtggcgattaggcctggtggaactgccatcaataaatcaagcatgatcagggtgagggacaggaaagaaggaaatatggggaaatggggtgaatgtcaggtggatcagagagatacagtcatgggggtcaggtgtgttatcaggaataatgtgagaggccagattgaggtccgggccaggaacaatggtaactgtgggacttaacaaagagtgagtacagctgaaggagccggggagcagaaagtatatgcgtcaggtatgaggaagaaaatagattttggaagttatgagaaatgtagagagtgagttgagcataatttgtgatttttagggcttctaaaagtattaaagcagcagcagccgctgcacgcagacatgagggctaggctaaaacagtaaggtcaagttgtttggacagaaaggctacagggtgcggtcctggctcttgtgtaagaaatccgactgcactaaccatgcctaggaaggaaaggagttgttgttttgtaacagattgaggtttgggagattaattgggcacaatcagcagggagagcacgtgtgtttttatgagaattatgccgagataggtaacagatgaggacgaaatttgggcttgactgaagtaatggggtctatctgtgaagtcttgcggcagtacagcccaggtaatttgctgagcctaatgggtgtcagggtcagtctaagtgaaagcaaagagaggctgggatgaagggtgcaaaggaatagtaaagaaagcatgtttgagatccagaacagaataatgggtagtagagggaggtattgaggacaggagagtatatgggtttgacaccatggggtggataggcaaaacaatttggttgataaggcatagatcctgaactaacttgtaaggcttgtctggttttaggacaggtaaaatggaggaattgtaaggagagtttataggctttaaaaggccatgctgtagcaggcgagtgataacaggctttaatcctttcaaaacatgctgtgggatgggatattggcattgagcggggtaagggtgattaggttttaatgagatggtaaggggtgcatgatcggtcgccaaggagggagtagaggtatcttatacttgtgggttaaggtgggggaatacaagaggagggcccaaaggaggctttggattgggaagaagggcagcaatgagatgtagctgtaatccaggaatagtcagggaagcagataatttagttaaagtgtctcggcctaataagggaactgggcaggtggggataactaaaaggagtgcttaaaagagtattgtctaagttagcaccagagttggggagttttaagaggtttagaagcctggctgtcaatacccacaacagttatggaggcaagggaaacaggcccttgaaaataaggtaatgtggagtgggtagcctccgtattgattaagaaggggacagacttaccttccactgtgagagttacccaaagctcggtgtccgtgatggtctagggggctttggaggcgatcgggcagcatcagtcttcaggcactaagccaagaagacctgggaaggagtcagtcagagagccttgggccagagttccaggggctctgggagtggctgccaggtgagttggacagtccgatttccagtggggtcccacacagatgggacgtggcttaggagaaatcccgggttgcaggcattccttggcctggtggtcagatttctggcactcgtagcaagctcctgggggaggaggttctggaggaatgcctggctgctgcggttcaggcgtttggaagttctcgtgtgctggagatgtggctggggtttgtctcacagtggaggcaaggaattgcaacttttttctattattgtacaccttgaaggtgaggctaattaagtcctgttgtggggtttgagggctggaatttaatttttggagttgtatttaatgtcaggagcggattgggtaataaaatgtatattgagaataagatagccctttgaccttttagggtctagggctgtaaagcgtctcagggttgctgctgaaggagccatgaactgggctgggtttttatatttgatgaaaaagcctaaatgctgtctgatttgggataaagaaaaaggagcattaaccttgactatgcctttagctccagccacctttttaagagtaaattgctgggcaggtgggggagggctagtcacggaacgaaactgtaagccggaccaggtgtgaggaggggaggtgataaaaggattatagggtggaggagcagaggctgaagaagaattgggacctagcttggcctggtgaggaggggagaggtcagatgggtctgtagaaaaggaagattagaaagactcaatgatgcttggggttgggactgaggggacaggcgggagggaaagaaggaagatttgggacgagttgcattgggcacagagactaggaagggactgatgtgtaaaagaatgcctggacatcaggcacctcagaccgtttgcctattttatgacaattatttagatcttgtaggatggaaaaattgaaagtgccgttttccagctatttggaactactgtcgagtttgtattggggccaagcggtgttgcagaagaaaacaaggcatttaggttttaggtcaggtgtgagttgaagagcttttaagttcttgagaacacaggctaagggaggagaaggaggaatggagggtggaaggttgcccatagtgaaggaggcaaacacagagagaagagagcgtagagacacggagggaaggggttcgggtgttcttttttttttttttttttttaatttattttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcgtctgtttaacaaagcacatcttgcaccgcccttaatccatttaaccctgagtggacacagcacatgtttcagagagcacagggttgggggcaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagcagccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcggggggctgaccccccaacctccctcccggacggggcggctggccgggcagaggggctcctcacttcccagtaggggcggccgggcagaggcgcccctcacctcccggatggggcggctggccgggcagggggctgagcccctcacctcccggacggggcggctggccgggcggagggctgacccccccacctccctcccggacggggcggctggccgggtgggggggctgacccccccatctccctcccggacggggtggctggccgggctgaggggctcctcacttcccagtaggggcggccgggcagaggcgcccctcacctcccggacggggcggctggccgggcggggggctgacccccccacctccctcccggacggcacggctggccaggcggggggctgacccccccacctccctcccggatggggcggctggccgggcggggggctgacccccccccacctccctcccggacggggtggctgccgggcggagatgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagaccctcctcacctcccagacggggtctcggccaggcagaggcgctcctcacatcccagatggggcggcggggcagaggcgctccccacatctcagacgatgggcggccgggcagagacgctcctcacttcctagatgtgatggcggctgggaagaggctctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggccccgcggggcccgtcccggttcgggtgttcttaaccctccagaaaagtgggaaaggggtcagggcacggaaataagggattggggcacagagataagaggttggggtgtggaaataagggattgggggttcttgccccctagaaaagcgggacttgccgctaagggtgaaggagaaggggttgaggggtacttgcccctcccccagaaaagcagagaaggggtagagactcagaaggggttggggtacttgcccctcccccagaaaagcagagaaggggtagagacatggagagaaggggttggggtacttgcccctcccccagaaaagcgggacttgccgctaagggtgaaggaccaaggcaggcctccctgcgtggtctgacacctttgaaacgtgggtgaatgatcagagaggtgtccctgcaatgattaaacactacgggaaggctgccttcccagtccgtgaccggcgccggagttttgggtccacaaataaaacgtgtctcctttgtctctaccagaaaatgaaaggaattgaaattaagagaagggagagattgaagggtggcaccaagattgaaaggagaaagaggttgagggatagtgagggaggttggagaagagagtaaaaagaggccgcttaccggatttgaaattggtgagatgtttcttgggctcatcggtctgaggacctgaggtcgtaggtggtttcatgtgcgtccgtgtgaagagaccaccaaacaggctttgtgtgagcaataaagctgtttatttcacctgggtacaagtgggctgagtctgaaaagagagtcagcgaagggagatggggtggggctgttttataagatttgggtgggtaaaggaaaattacagtcaaagggggtttgttctctggcaggcaggagtgggggttgcaaagtactcagtgggggagctttttgagccaggattggccaggaaaaggactttcataaggtcacatcatcacttaaggcaaggatgggccattttcacttcttttgtggtggaatgtcatcagttaaggcaaggaccagccatttacacttcttttgtggtggaatgtcatcagttaaggcaaggaccagccatttacacttcttttgtggtggaatgtcatcagttaaggtggggcagggcattttcacttcttttgtgattcttcagttacttcaggccatctgggcatatacctgcaagtcacaggggatgcaatggcttagcttaggctcagagttctgacagatctattcctgccttcatttttaccttgtattttatttatttgtttttaaaattttaaactaatttttttgtttttttttttggtagagagagtctcttcatgttgtccaggcaggtctcaaacttctgacctcaagtgatccgcctgccccagcctcccaaagtgccgggattacaggcgtgagccaccacacctggcctgtattttattttttactatggaaacttcccaaaacaaacaaaagtacataggatggcataatgaatccccatgtacccctcagccagcttcgacagttaccaacatgtggccaagcctatttcatttctacctctacccccttctcatattagagtaaatcctggacatcgtatcatttcgtctataagtgttgctgtctaaaagagatcatcttacctttcaacagatggtaattgcgctgcagaacaccaccacgaccagccgctacctgcgagtcctcccgccttccacgccatacttcgctctgggactgggtaagttcagtatttgtaagttcattagtagtagtggtaatagtagtggtggtattagtagtaatagtagtagtggtggtagtaatggtagcaatgatagtagtagtggtggtggtagtagtagtagtgatggtggtagtagtggtagtagtagtagtggtggtggtagtagtagtggtagtagtagtagtggtggtggtggtggtggtagtagtaatagtagtggtggtggtggtagtagtggtggtagtagtagtggtagtagtagtagtggtagtagtagtagtggtggtggtagtagtagtggtagtagtagtggtagtagtagtagtgggggggtggtagtagtagtagtagcagtagcagtagcagtactgctactactttgaggattgcctcaaagtcacttgctgggcttgctgccagttgctgactcccgccctgagtctacagcctgggcctggactccccccatcagcagtccttgagggctcctcatgctccaccagcaatgtgtcctcagagccttgacagctcctttctcctgaccgcctccacccaggcactggtcctgctatctccccactcctcgtgctgccattctcctcaatcaggccctctctattcctcacttaagcctcagcagcagccccccagccagccttcctactttagtgtcacagtatttgtcttaagaacaactctgatcatgtcaccccgttcagaaatctcaaaagtttctctgctatccaccaaagaaattctaagccatagggccaggcatggccccacctgacctttctggatggatggtgtcatttccccccaggctctggcatgcttacctggagtcgccacccttgcagcctgctcccctcgcatgcccttttcctgccatcagcgtggctttggcccagaaggcacttacagagccagccctggcagggctggggtctgtaccagctgagctcaagccctggtggctggctgctcccaggatcctcacttgtcacttttgtcatgcacagggatgttcccaggaaaaggtggaatggtggctcctggaatgacctgccagtacattgtccagttttttcccgactgccttggggattttgatgattttattttagtggagacccagtcagcccacacacttctgatccccctgcaggcccggaggccgccccccgtgctgacatgtgagtgtgcaccgtagcttcccacagattcagttaaggttggagagtccccataaggactgcctgcctctcaggttccctttgtatcagcacacagcttggctctcttgggcaggggccgtgggtcctgcagaggaaactgctagcagcttctgtagccatccacagtgtcaagccatgattgttctgcttgcttttgggttttctcagtggaggttgactcacagcaggggatgaggccaacagtccagctaaccccaccataggttttgctggcttatgaacatccctgaggggacctgtgccacagtgggcaaggaagaagtgcctgtgcaccctgaggagtcctaacaggtcgtcgttgtcctcgtggctgtgggggtaggagtccttagcaaagctggcttcagctgggctccctcagcgacaagcttctacagctgggcataggctggaatttgggaccgtgatcccccttacttctgccatagcccccaaggaccatgctgggtggccctggctgagcatgaatccacaatgggcactgacttctgctgctctagccaggagtgaatagagtcccatggcactattgccatgtggccagcagcagcctgggcagagcccaagtgggtgtagggtcaggacatgtccccactcatcctctctgcatagggtgctgggctgggaccagctgtcctgatctctggctgtacctcaggagaagcatgacagtagggcctattaagagtgacctgttgtttctcttgcacatgttctcctgtggctacagtgtcaccggtgttggactgtggttactgcctcattgggggagtcaagatgaccagattcatctgcaaaaatgtgggtttcagtgttggcaggttctgcattatgcccaaaacaagctggccaccactaagtttcaaggtgagtgatcacaggttgctaactggaaaaattacaagtccatcaaaggaaataacccccagaggaacttactagagtatacctatgattggaaacacacagaacgcagagtgttgtaaactctctatgcaactgccacaacccgaatgagaatggatgtataagggtccagtgttgtagttctggttatgtcactaatacctgtaccatgctgggcaagcggtatcacctctcttatccttcaagccctggctcaaatgtgactgcattcactcattcagtccttctttattgtagcaaatgactgaatagttcagaggttacaaattggctgccctttggccaaattctgctggtatttgtttggcacagcacttaacattttctgagccaacatttaaaaataaggagatttggccaggcgcagtggctcacacatgtaatcccagcactttgggaggctgaggcaggcagattacctgaggtcaggggtttgagaccagcctggccaatatgatgaaacaccgtctctactaaaaataaaaaattagccgggtgtggtggcatgtgcctgtagtcccagctactcaggaggctgaggaaggagaatcacttgaacccgggaggtggaggttgcagtgagccgagatcgcaccactacactccagcctgggcgacagagtgagactccatctcaaaaaaaaaaaaaaaatggagattttatataaagttctacatttccagtcctttgaaaaactggaagatatgaaggccagggccaggattcactgtgagcctgttggccagggctgggggcaggccctgtgtaccttgtcctgagtgcccagctccaccagtcccaagagcatcccagcactgacaccatccatcagcatgctcacaccatccatcagcactgacaccatccatcagcactgacaccatccatcagcatgctcacaccatccatcagcactgacaccatccatcagcactgacaccatccatcagcatgctcacaccatccatcagcactgacaccatccattagcactgacaccatccatcagcatgctcacaccatccatcagcactgacaccatccatcagcatgctcacaccatccatcagcactgacaccatccatcagcactgacaccatccatcagcatgctcacaccatccatcagcactgacaccatccatcagcatgctcacaccatccatcagcactgacaccatccattagcatgctcacaccattatttttctcatagcaaagatatttatttgtacccagaaaacaagggatacatctagaggatgacatttcaagatgttccaagaaagacatttcactcatttctgttactgaccagggtcttgtaggcatgggtttgtgtccctggcatgctaagtgacttcttgtgtaggcactggggctgcagctctcgtgcctcaggagcttgtagccaggggtgggtcagggttggaggcagacacatatgctagcacctgtgacactgggtgttactgtaggaaaaggacaatgtgctttgggagcccaggggagggcccactcagctcacctcctgagtgagaccttctcacacgcttgtcactttgtgtcccaatcacttggtgatggtgttccttgtacctcctgtcagtagtcagctcttcacagatgttctaagacttactctccttaaccttcagaacctcacctggtacctggtgatggctgagtaaatgcctgctgaatgaataagcctcagttttttcattaccatgtgactggatgatccttaagttccttcacattgcaaaatggatgtttgaaggagagaagtttgcaatctgaatactggcttttacaatgtcttccacactgttgggtaatctgcttttctttaaggccattgcaaccgtcggctttgttgaacaacctccttttggaatcctgccttcggtgtttgagctggccccgggacatgctatattagtggaggtaggtaatcagacattggcatgtatttcctcaactgcttgcatgcttgcatttgtctctgttttcatgactcaagtgtccagtcccatcccatatcacagccttagtgacttctgggtagacgcatattcttgcattctgtagggtgatgtcagatgtcatttgactgtcttatgagcattttcacaaagcaaatgcagatagccctagcatcacatcacaaacctgagccttgctagtccacacctttagtctgggagctacctccaccaatgtccaagctgcctccaagatcttcgcttggttcttcagtctctcttgggtcttccctcccccaggcccctctatcatctggtacctgattattgcggttattgtggctttgttctcactttcctgcttcatcctcagtttgtatagtcagcaaggcccaactccgttacgcctcatcctgaacctctgcagaagctctcagtggtctgcccctggctgtgggcgtctcctttcctaactggccccttttgctgcccccttcagctgatcacacctgcttgctggtccccagaggtgcccatgagaaatggtgatacttcctgtccctgttgcagcacactgccactctccccgactcctggtctaggagtctgactccacttcatgtgactgggtgtgggctgctacagacatgcttggcctttcacactagcctgccgagggaggcccctgacattcaggagcaaaaaccgtctggcttctgggggtggatttggcctgtgccatatcaccaggtagtgagatccagcagcccttattcttaaactcagctgcacattgcaatcacctgagagacctggaaacaacaccaaggccctatccctgaggttctgagttcactagactgggctgtggcctgggtgccggacttctaaagtcccccagggaatgctggtgtgcagccaagttggagttcaactgccacagcgactctgccatgctgtcaggaagggcttcctcttatcagctgctttctagtttcaagtgcccagtaggttctgcagccctaggatgtggctctcttattcatgtccctgctcatctgatccctgatgagaaactagttcttgggattgagactgagccagttcaggggctttgtcaggcctcatctactgctgaggggcaggttgggtctacaaggcccatacacaggccaggttctctgttctcttggtgtagtccaggacttgtcacaggctcatcgaagctttaaggaattggagctgctctgccctggacatccccctcatcccatcctcctgggatctccaagtaaaggaagagggtagcagcaggactcttaggggagcagtgagggagctggggaaggctttccccttggcatttcttgcgtattttgtttactgattgtttgggggtttgtctgttccaaaatgtattcatagttccaaataagaaatacatttgcatgattaaaaattcaaaagagagactgggtgcagtggctcaggtctgtactcctagcactttgggaggctaaagcaagagaactgctgagtctgggagttaaagaccagcctgggcaacatagtgatatactgtctgtatagacaatttttaaagtaaaaaataaattcaaaagagccaggtgtagtggctcacacctataatctcaacactttgggaggtcaagataggaggatcacttgaggccaggagtttgagtttacagtgaactgtgattgagccactgtactccagcctgggcaacagagtgaaaccctgtcctaaaaataaataaataaaaataaaacattcaaaagatgtaaacaggtaaacagtgaaatgctccctttcaccccagttcctcagccatccagaggccatacctggccagttttctgaatgcccttccagagatagtctatgcccaaataagcaactgcacatgtttttacccccatttttttcttcacacacaaagttgcccactctatactctgttctttgccttgtgttttctacttaactctatatcttagagatcattctcatatgttttagtaactgcatagtatcctactgtgtgaatggaccataatttagttcagcagtctcctgctgattgacctgaagatttttttctgatctctggctacaaattatgtataaattatacatacatcactctgtccaaggatgagtctacccacaggatacagtccttgaagtagatttgctgatccagcgctttgtgccctcataattgtaaggcatgttgccaaaatccttaccatgcggattgtaccaatttatactttcaacagcagtatgtaagggtgtctgtttctttacacctttgccaatacagtatattataaaacttagaaactgttcatggacgttgtatataaaaacatatacaaaaatagagagaataatgatcatccatgtattcattactcatcttcaacaattatcaacccttggccaatcttattacatctatacccctccatttccctcagacattccccaccctgctcttctagattattttgaacaaaatcaagacaaaatatcattgcatttaacagaatgaaactagacctgtgtctctcaccatatacaaaaattaacttattaataaaatggattaaagatttaaatataagacttgaaaatgtaaaactactagaagaaaatggtggaaatctgtatgacattggtctgggcaatgattttttgcatatgatctcaaaagcactggcaacaaaagtgaaaataggggccaggtgcggtggctcagcactttgggaggctgaggtgggaggatttcttgagcccaggagtttgagaccagcctgggcaacataaggagaccccatctctataaaaaatttaaaaaactagccgggtgtggtggcatgcacctgtggtctcagctacttgggagctgaagtgggaggatcgcttgagctcaggtgttagaggctgcagtgagaaatgatcacaccactgcactccagcctgggtgacagagcaagatcctgtctcaaaaagcaaaacaaacaaatgaacaaacaaaaaaacaaacatgaatagacaaatgggattacctcaaacgaaaaagcttctacacagcaaaggaaacaagcaacagagtgaagagacaatctgtgaaatgggagaaaatactatcacatctgaggaggggttaactccaaaaatatataaggaacttaatgcaatagcaagaaaacaacctgctttttttaatgggccaaagaccaattagacattcctcaaaagaagacatataaatggtcaatgagtatatgaaaacattctcaacatcattaatcatcagggaaatgcaaattaaaaccacagtgagctcccacctgacacccgttagaatggctattatcagaaagatgaaaggtaagtgttggcgaggatgtagagaaaagggaatccttgcccgctgttgatgggaatgtaaattactacagccgttatggaaaataatatggagttccttcaaaaaattaaaaatggaactaccatatgattcagcagtcctactactaggtatatatacaaatgaaatctggctggagtgcagtgatgtgatcattgctcactgcatcctctaactcctgggctcaaaagataccatttaaaagatatccgcactcttatgttcattgtgtcattcacaataggcaagctatggaatcaccctaagtgtctattgatagaggataaagaaaatgaggtatatgtacacaatggaataacagccctgcaaaagaaggaaatcctgtcgtttgcgacaacatggataagtctggaggacattatgtgaagccaagcacagaaagacaaatactgcatgattgcacctatatgttggaccttaaataattgaactcataaaagcagagaatagaatggtgattaccagggttgggggttgggggaattggggaaaaaatagaaaacaaatcattgcatttatgacagctcaccttctgctctttgccagtatgagtggtaaaaagccgttcttctggatggttttcattgacatttctcttattatgaatgagggtatgtgttgtcattcatttaagggccatttgtattttggtctctgtgaactttatcttcatatccttttagcttgctccctgcttttctctggggtggagctagggtaaaacacttggccttaggagtaaggtgggaggtggcagggaggggaacagagagtgaagagcaaagaaaggggtgtgtgtccgagaggaggagggtgggaggcggggagggtggaagccctttaatgggaggtaacggaacaacccttctctcccccaggtcttgttttccccaaagagcctaggaaaggcagagcagaccttcatcatcatgtgcgacaactgccagataaaggagctggtgaccataggtgggcttgagtgtactcccaggggcaaggctggagaggctgccccagctccaggggccactgaccacagtagcattagcggcagcccacctgtttcctgtgtgtgtcaggagcgcacattaagaatgctgcagcctccaggtgccagagtctcgtttcaggcccattgctctggtctgactttggagaccaagccagtgtggcctccaagacagtccaaggagccttctagcaagagacagctggaaacctggggtgaaatctttcattgtttcattttgaaactcactttgatctcctttggggaattgccagtggctcacacataaacagccagagccacctctagatttctgcagggttagaagaggcatcctaggaatcgtgacaagatgcccctggccgcccctccctctcttcctccctccctccttccttccctcttttcctccttccctccctccttttctcccttcttctctcccttcctcattaattgagtgtctgctatatgctaggttctcaaaatcacctccttttggtcttcaaagatgtgagaacattaacctgtgggcggatatcccccttttccctccagtgtgagcttgcaggaatcatggtcaaggccagctgcatgtggatggcggcatgggtcctgcagcagccttggcctgatttcagccctagtgagccttcactgacttcacttactctactttggcaggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacgtgggtaacccctgtgtgtgccccaatacccaacccttcttcttgcttacctggccctcagtcccagtgagacaggaggtccttccaagggcctggggaagactgggcacagaatggatatccaaattcaattgagggatccagattgacccagtctatcatggaaaccagtagccactcttggctacttaaatttaaatcaattaacattaaattaagagctcacttcctcagtggcaccagccacatgtagctagtggctgtcatattggacagtgcagatctgtaagatctccatcccttcaggaagttatgttagatagtgctgccccaaatcatcctggaccatccctagccagccccagctttccagagaggacataccatgcctgtgtaggggaagccatccaagtcccaggggcagacagactatagtctgtgggtttcattctccttgccatttatttcctgacccgcctctgagcactaccatgaaaccaggacaaatctcagggagcctcccaaccagggctgccctggggaccccagacattacacaggactctgtcatctctcccccgggatagctgcaagtcctgcccctcctatgctatggagttgccactgttcctgttggcagccagtaggcacatatctttctggacacagctctcctgggagcccataacaggaaaggcagagggcaggaatggggttgatgtggcaaaccttggaaactcatgtggtgagagacactgcagaagatcttcccaatattagggggtgatgtatagcctcttccactttaatgattggaacatgagttcctgacttaccatgtcccctgagtcatggtaggtccaacctccagctgccatggctgggaagcgaggagctctcttacatagtctctgtcttagactccctcgcccacttgctgcccctcctccattggagggtcctccattggaagggtgtgaaggctgacctggtttcttcctgttcctaggtcctttcctgctccctcttggagcagggcagggaggcatggggtggagggacctggtcccagcagaactgggacatggccttggatgcgttgcccccacaggcacgtggagctggccttctactggcagatcatgaagcccaacctgcagcccctcatgcctggagaaaccttcagcatggacagcatcaagtgctaccccgacaaggagactgccttctccatcatgcccagaaagggggttctaagcccccacacagaccacgagttcatcctgagcttttctcctcatgaggttcagatggtgtcatctcagtagccacacatggttggatcatgtatttagaccccccacctgtgttcctcaatcacactgaagccacagctgggcccaccgaggtgctatcctgcccaggccagcacttggctgagttgggttggagtacacacctggtgtgcagggtgaagcagctcattttgtctggtcctgatcccagactcaccccatctgcagcaagacccttggctggcttcctccgctctgggtgtctcccacatgtctactatggcaaaaaacattaccatccccacccataccacagcatcccctagagagagtgaggtgcagggacccgagggccaggttagcacagcgctggccccagcatggagggaagccctgtgggccacggtaggctagaagggaattcgagctgggcatgaaaaggatgctccggggccattgttagtgggtttggggctgagatgagtgatcctgcctctggtcccagcatccagctgcctcgttgtctatcctgggagggtgtggtgcttcggacacgttgaggggctttgtcagcatcaggaaggcctttgcttcttgcacccaggcccagctgagacaggcccctgagtcctggctcatgttctggcagcaacttcacttttcctaaggaggggaggaggcagcagggaagcaaccctgggttttcagaaggtccttctgatggctaggctaaggggaggaagaattcctgccatgccccagccttctccaggacaacctgctggaacgcagtggtgttttcagggcactgtgtttgccttgcagctgagggattttcacagtgtgctccagatggtgctagaggaagtcccagagcctgtaaggtgagagaaactgggccctggatgagaagtgggcagctgggccttcccccaccttgggggttctcctggggaaggtatcaggtgagggggagtgggcagcctggtccccgcaggctttggggagtgagagcattttttttgccttgccctggcaacccagccctgcaatgggctgagcacactaagctcgctaaactcactatgaggccaccccaggaactttggagctgtgccccaggcccattgttgctcttggggagccaaactggggggccctcggtggtggtgagtgtggaggaaaagctttgcccccatggtgtaaaccttcaggctggggctccaggcagcccagtgcagagatcccaggctggagggctgcagatggtccctggaggcagcagggcaatgccccgtcccagtccttatgctaaaccactgtcacagccatcggtgcttatcacctttcaggcactggctaatgcctttgatttagggggctcaggagctgtgggttaggcagtgttttttttttcacaaggccaaacgtgggacagaggcagggacactctaggatgtgcttccaggtgtgccggctcctagctaacggtgggtttgtgtttagttcagaagcggagagcctggggcactcctcctactctgtggatgatgtgattgtcctggaaatcgaggtgaaaggctcagtagaacctttccaggttctcttagagccatatgccctcatcatcccaggggagaactacattgggataaatgtgaagaaggcttttaaggtaggtcattgtctctcccctgcctaggctggccgaggcagtgttgacatgagtgcaagtgtagggaggatatagcaggaggggcagatggtagcagccactgcatggaggctgaggccattcccagggctttgaacccaacttgacttgcacagatgcataggccaggcatggctgtcttcttttatcagcctcccagaatcctctgaaagttagggctatggaacctattcccgtccttggcagagtatgtcagccacaggcactgcagtgtggagggagggtgcttttgggttgggaggcccatggctttgggtggccaggaattagccgggaagtgtcatatggactctttacgagcccacaatcctacagtccttcagcaggtacagaattgacatgaaggggcagtaaatgggcagcctggtctcgggtgtctttcagatgtggaacaacagcaagtcacccatcagatacctgtgggggaagatcagcgactgccacatcattgaagtggagcccggcacaggggtcataggtaccttggggactgcaggaggggttgtgacctgcctggggctggctcaggaagaaatcttcagagttaaaggggcttatgcagggctcttggtgtcctgtgactgctctggctgaggcctgggatgtgagggagatgagaagtctgtgcaagccagatgtctgggcccaatcataggaggaaactgcctctgcttctcctctccacctctccctttccctctcttctcagagcccagtgaggtcggggattttgagttgaactttactgggggtgtccctggccccacaagccaggacctgctgtgtgaaatcgaagactcgccctcgccagtggtgttacacattgaggctgtctttaaggtgctgcaggtggagctgggcagtggggtgggcccagagaggtggcagggctgggacactgagccatccccaggtggcccagtgacaggccctctgggtgtctcaggggcctgccctcatcatcaacgtctcagcccttcagtttggtctgctccgcctggggcagaaagccacaaactccatccagatccggaacgtcagccagctcccagccacatggcgcatgaaggagagcccagtctccctccaggaaaggcctgaggatgtaagtcaggcactgctggttcctctggtgcccccacaatgagcccgtttagcttgccctggtgaaacttgccctggtgtgtttagatcagagcttcgaggctggtggaggaaaagcctgcctggtgacttcggcctggcggtgcctcctgttctccccatcgctgaggcagctcagctcctctctacagccaaatgtaatcccccatcagcatttcctgtgcctttcactaccatcggatttagaaatagggcgtgggtttctccctcagagccgtctgaggcaggaagagatgggcagctaggttgggcaggaagcctccaaggctgctgctgctccagccgcattcccacctcctccccactctctggaaggttcagatcctcccagggatctgctaccagatggcatctggtcacaggctggcagcccaaacccaaggctccaaaaagaaaattcaagatttatttcgactcaaatggcacttttcactataaaagtaggaaaaaaagcagctaagtattatcataatcatatttaaatgcagtgggcgatctggaacaagacaaagtcacacaaatcaccagctactcgcaaaatgcccgcagtgagtcgtacatcaccgccccttcaccacggcatggctgcagctccctggtggactgcacatgtgagaccctggccatgtctggtgaccacactctccttctggctgcttcccaccgaggtccccatcctgcttgcccacttgccctccgagtcagaacaccgcacacttttccttctgtattaaggagcccagggaagacaatccaagccatgcatataccttattttgctagtgtgcattccctttctgcaggaaagtgggctttcctttctattccagggaggcctcgctcctttacctgatggcctatagctgggcactctgaaacctagaagttatgacagtgtgcatcaaattgccaacgccattgccaagtacctgttacacaggcttggagttcaatactttccctcccagggctcatccatctcccaccatggatcctgaaaccacaaaagactaaggctggcgcttgggctgggatggggctgggggcagggtggcatcagtatctttagtgtccacattatgtttagccaagaaccctttcttcaaatgaaactttatgcaaaagcccagaacatagaataaactgtgactgctccagccacccagagacccccttgttaggcacctctgccccatcctgcttctccccacattccagtcccctgcacttctagggatttcctgggattttccagagcacagttagaagcttacagacctcagccagcctcctcatttgatagaggagagactggaaggggcagggcttccccaaggtcatacggctgatgggtagcggcatcacatctgatccctcttgtctagttttcagtctgtggtgttctcccactgtgaagaataactatgttttataatggaaataattgccaatgttatagtattgtaagataattccctctctacagttctctgcactctattcttttgagctctcaaaaataatgttgggatttggggtttgttagatggtctcagattaggggacgcagagctgctgaaacccaaccctagactacagccacccccagagctccaagggagatgcacatgagcaacaaagacaaaataaagcaaagtggctccttacagggacaagtgtcctctctcagtcagggcaggaagaatggaatgtaaagagccctccccagatggggacacttttcttcctgctctttcccttcccctctccctttgtgtgtgtgcctggcatgggaggaggagcagaccgggggcggggtgggggtgggggcgggtaaatgaggctgagcctgcagtaggggacagaaggaaggggtgggggaaagaccacgtgggtgcaaaggagaaatctggccacaatagactctcccctcccctaatctagtgacctggtggctttcctcagttgaagctgctcagagggctacccccctagtttggctcaccagctctcctctggctccccagctctccccattttccctggagcacctccctccgccttctatctctcagatctgggccagggcatggggccctctgacttatgtattcctttacttggagactcagtttctatgctcttaatcctgagactcttgtggctgtggtcccccacctgcttgcctgtttctggatcccagatggctcttggaagagctggggcagcttaggagtgactttggttaggcatggccagcccccagttcctctgcaattccaagtgtcctcagtgctcatcctcctgagtgttctccggggcaggtgtctcccttcgacattgagccttcgagtggccagcttcactctctgggggagtgcagggtggacatcaccttggaggccctgcactgccagcatctggagaccgtcctggagctggaggtggaaaatggtgcctggaggtaagggtgccgtgggaagagccactacaacaaactatgcatattcgtgatgtatttatctatattatatatttatctagagatgttctggatttaaaactattgaatccagaaaattagtattctataaaatttgtaaattacagaaaagaaactcaaaatgacgcataatccattccctagggatgatccactgataatattatgtatatatctttctagggtgtgtgtattaaagagatgtaaattagtataactactttcgaaactacgttagcatcagctagtgtttgcccttctgagtatactcccagggaaatccttatacatgcacagtgggagatgtgtgctcatgttggaatgctcagactggactgttcctacaggaaaaactagaaaaaaccactgtctgtcaacaggagaatggacatttaaaaagtgtgacatatttaaataagcacataccattgtattctgggaggaacatgctagaggtttcaaaggtattggtagtattcctttttttcttcttcattctccctccgctcccccacttccctccttttctttctttctagtggaaaacttctcatatatataaaaacagaaagaatagtataataaacctccacatactctttcctcccttcaataattgtcaactcactgcaagtactgtttcatccatatcccctatctccttctccccactccttcccaaattattttcaaataaaatattcattttcctgctgggcatggtggctcacgcctgtaatcccagcactttgggaggccgaggcaggcaaatcacgaggtcaggagttcgagatcagcctggcaacatggtgaaaccccgtctttactaaaaatacaaaaattagccaggtatggtggtgctcgcctgtagtcccagctacttaggaggctgaggcagaagaatcacttgaatcctggaggcagaggttgcagtgaatgaatatatatatatattcattttcttaagctggctggtgataatattttgtttctaaagttgtgtggaggtagtacatagatgttgttttattattcgttaaactatatatatgtttaaactgtatatatgttttatactcatttttgcatatatttggtgtttcattgtaaaaacatttaaatgctcatttaaatctctgtggatgctcttgaattatcctccaaaaagactgtgtcattttatacttctgcctacagtgtgtgagactagccattaccccacactttcaccatgacaaatgttgttggactttgtatacttgaccatctgacagttgttcaaatgtcccctcctgtgataacaaatacaggtctaggtatgagtctttgcattggtccttcagggcaatttgcgggcattagatgtgaaggctaagtctgcctgcagctcaggggaagggctttctattaagtctgtgcttatttcctttccttttctgtctctgttctttctcctgaaaggaccttgtattatcagaatgtttacagtagcaggtgatggaaacacagacattaccaacttaggcaaaaaagaggaagcattggctcacgtaactgggcattcccaccttgctgaatccaagggcccaacacttttccctttgtctggtcttctgcttcctctctttctctaccctctttcccccttctctacctccatcccagccccaacccatctactgctctttttttgtgggcccttctctcccctattgacaagggcccttcgcactctgccttggggagaggccacttagagctccaggctcacacactcccaccttaacaatctctgagagccaatctggctctttgcagagataggccctgattgctcttgctcttgtgtgggtcatgtacccgccccttcccctgctgggtgacagggaggatctgtctccagaagaggcaatcatgtttcgaaatttcaagctttgttgttcttgcgtctttccttttctatagtaatctgttatagtcttatcaatgcaacagcctctcagattcccccaagaaaatgaatttctgttttcccagatgttggagttcttctttactttttgagttttcttctgcttctagtaatctttgcctgtccagtcctgtttttgaatggaggaggaagttgatttgcataaggagctggtgttgtaagtttcttctgagtaaaagggggtagatgtggagagcacccctattctaagggatgaagtacatgtgagtcaccaccctcagagcacacagctagcctgaatccatcagagaaagggacctttggggaaaacagccctaaacaaacagtggagaaaacccatactgggcagctacacaaatcaattcgtgccttcattcataaataagaatgaaggaatagcatctttctggttgtttcctcctcatgacagttgagaggtccagtgttactgcaggctctgccctggcctctctccagcgtgatacccacagtcttcagtgggggcaaatactgtggcagcccagtctttttcttaattttcaattttaatttttattatttgtacaaatttatggggtacatgtgcaattgtgttatgtgcgtagattatatagtggtcaagtcagggctttagggtatccatcacccaaatagcatacattgtactcatgaactaatttctcatcacccatttccctcctatgccctcacccttccgagtctccgttgtctatcattccaatctctatgtccatatgtacacgtttttagcacccacttgagtgagatcatgtgatatttgacttctgtgcctggggcagcccactcttccatgtgttgctctgagctctggggctggagccctgacctggctaagccaatggatcttcagcagtgctttgctcagctcccccgccctttgatgccctcattccatcattaaggattgcattgcacgtaacctgtgcagggatttcaagcagcagttttgttctcctctgttttatcagttaacctgatcacattatttctttctcctattttcttttccttgtttgcataacattttatttgctttattatcttttacttcaaaattttcacaaatagggcatttgctagatattacatttctttgcattcacaatttgtctgtttggcacaaagctagctttctgcctgtgtcagctttgaatgtgccttcctcactaagcttaatcattttttagcttaatcattttgatttaaagtgagatacgtacgactcttcttttcacttgaagacttagaggctattgtagggttatcagttggtctaatttcaatattgttgtgtctcaaggaatagggaggcctgaggagagggagagagacggaaatgaccagtaagtagagcagtcaaaatgcacacagcatttaccagttgagcccattatcgtatatgattgctgtttatggcaccccaaaacaattacagtagtaacatcaaagatcactaatcacaggttaccataacagctatagcaaaaaagtttgcaagacatgacacagagacatgaaatgaggacatgcaattggaaaaatgacattgataggcttgctcaatgcagcgttgtcacaaaccttcgatttgtaaaaatcacagtatctgtgaagtacaataaagcagagcataataacatgaggtatgtttgtaactgaatttcttatataggtcaatttagacttttttcttggccaggcacagtggctcatgactgtaatcccagcactttgggaggctgaggtggacggatcacctaaggtcaggagtacgagaccaggctagccaacatggtgaaaccccatttctactaaaaatacaaaaattagccgggtgtggtggtgcacacctgtaatcccagctactcgggaggctgaggcatgagaatagcttgaacgtgggaggcagaggctgcagtgagccgagattgtgccactgcactccagcctgggcaacagagcaagactctgtatgccccaccccatccccccaaaaaaagatttttttttttttctcagttttggtagtttgcatcactctaggaatttaggaatttgtccattttatctgtgatgtaatttgttggtacatagttgttagtggtattctctgataattatttttatttctgtatgatcagtagtgatgtccccactttcattcctgatttctctaatttgaatcttcagcaaatttttcttggtcagtctagtctagctaaaggtttatcaatgttggtgatattttcaaagaaccagcttttgcttttgttgattttctgtaatgtttttctattttctatttcatttatctctgctttctagtctttattatttctgtccttccacttgctttgggtttagtttgctcttctctttctagtttcttaaggtaaaagctgaggtttttgatttgcaatctttcttttttgtttgtttaaagaaaattgtatttacaaatataaattttcctctaaccactcccttagttgcatcctataacttttcatatatcatgttttcattttcattgatataaaagtattttctaatttttcttgtggtttcttatttgacttgtttatgaatgtgttatttaatttgcacatattttgtttcacaaatttctttctgttgttgatttctaatttgattctattgttgttggagaacccactttatataattatagtcgtttaaaacttattgagacttgttttatgggctattctggagaatattccttgtgcactcgagaaaaataatgtattctgctgttattgtgtagagtgttgcctgttctgtttggtttatagtgctgtttaaatcttctatttcaatgtttatcttctggttagttgtttttccattattaaaaatgggctgttgaagtctccaaccattattgttgaattgctgatctctccttcaattctgtcagtttttgcttcatgtattttgtggtgctgttgttagatacatacatgtttataattgttatatctttctaatttatctttttataattataaaatatccttcattgtctctaataaccatttttgtcttaaagcctattttatctaacattcatatatctcctggagctctcttttgggtactgtttgcatgatatatatttttccatcctttttctttgaaactatttgtgtctttgaatctaaagtgtctcttgtaaacagcatatacttggatcatttttttaaaatccattttgctaatctctgccttttgattggattgtttaatccctttatatttaatgtaaatactgataaagtagaacttcatctcccgttttgctatttgttttctgtatgtattttgtgtttcctgcattccttgtgtttcctgcattcctccattattgccttcttctttgttagataggtagtttctagtatgccattttaatttccatgtttcttttactttttaaaaagttattttcttactggttgtccagggctttatagtatatcttaatttcaaaacagtctggtttagattaacaccaacttaatttcagtagtctgaaatgttactgtaatatagctcagctctattctctccccttcctttgtactattattgtcatacaaattacatatttatacattataggtttatcaagacagttttacagttattggtttgtatagttgccctttaaatcagatagaaaagtaagcaaaaatacatttattctgtctttgtatttacatatgaatttatcttgatatggttatatcagtcaaggcttaatatttatttcttaataacctattaagacatttattacaaagaatcaggttacacaactatagggactagctaggcaagcctaaaatctgtagggcaggttttcaggaagggcatgctggcatttttggggacaagatgaagatgttataaacacatggaatttctttgtctgggtaagcccatttctgcttttaagaccttttagtggccaggcatggtagctcacctttgtaatcccagcactttgggaggccaaggtgggaggatcacctgaggtcaggagtttgagaccaacctggccaacacactgaaacctcatctctactaaaaatacaaaaacttgcctggcatggtggcacatgcctgtagtcccagctactcgggaggctgaggcagtagaatttcttgaacccaggaggcagaggttgcagtgagccaagatcgcaccactgcaccccagcctgggtgacagagtgagactctatctcaaaaaaaaaaaaaaaaaaaaaaaagacctttcaactaattgaattaggcccatctagattatctaggataatctcctttacttaaacttaactgattatgaacattaatcatacctacaaaataccttcagccgttcagacatgtaaagagcttgcccatcaagctcctgctctcacaacaaggaaagactgaacaaactgaaacaatgatttttcttagatctatcagagagttgaggttgcaggacaagtggccaccccaaaagctggagatataggcaaatactgagaatacagatcagtttacctgaagcagaagaacacttaaatggtagtttcaacaaattcctggtggctaagtgtaggctagcttaagagtttaaaaatcctgggggctcagtaggttctcatggtgaaaactggaaaaaaaattctctcttgtttagccagggtgggatggggaggggaagtaaccattctgaaatacgcccagaggaaaagtgaaataagccactttgaaataagcccagagtgttcttgcaacaatttctcttacacccgagatttctactttttgagcaattataaatggtactatattttaaatttcgatttccacatgtttgttgttagtatataaaaatgtgattcatttttgtatattgatcttatatcctgaaactttgccgaacccactcattaattctagagtttctaaaaatatagataccttgggattttctacatagactgcatgtcatctagaaatagggacagctttacttcttcttttctaatcagtatgccttttgtttcctcgtgttccagctaccttcctgtgtatgctgaggtacagaagccccatgtgtacctacagagcagccaggtggaggttagaaatctctacctgggtgtgcccacgaagacaaccatcacacttatcaatggcacgctcctgcctacccagttccactggggcaaggtgagtgagcccacagcatcaggcagcagtctgcagccctcagccacagaggcccacatagaggggggcattgtcccccaaatatcctcacagaacagagatactcagcctccctcccacagcctgtcccttgctcgtagtgtgcataaaagctcctcaaaggagcagcatatctggtccagctttttcttgccctgcctctagggaattccagttccctgaccaagaaggagtttctggtgaacatagctagagcctcccagccaacatagcccatgactggcccaggtagctgttggagcccagttgtggtgctgctcctgcccgtggctgactggggagctctgagtgtcatgggacataaggccacatccatgtgcaccagaagcatctgccctctgctccccatccctcggggccttcaagggcagtttcttttgtccagataacctcccaacaagtggtaaagtccatccagggttggggaggagaggagaagggacccgtggtttatccccagaagtgagcacccagccctgtcggttttgctgtgggccccagtctgccagtctccagcattgcatgcagcagtgctgagcactctctggatactggtccattctgggagcccagtaagtgacaacaggctcactcatgtgtctgccagctcctcggacaccaagcagaattctgcatggtgacagtctcccccaaacatggcctgctgggcccaagtgaggagtgccagctcaagttggagttgactgctcatacccaggtgagtaaggcaatgtagggcctgagtgaccgggaaggcaccctgccaaccatacgcacctgtgccaccagggaggccctagcttaggccacattgctggttcttgtgggtggggaagagatttcttgcatttgggtctggggtccccattcctgctgggtctgctccctagggacacatggtcagagagcctggagtaggcctggggatgtgccctgagacccactggccatgcctggcctttggcatgagtttttgccctccccaggccattctctgtggccgcaggtgggcccagctttctgatttgcccagagatccagagcagagctgttgctcacagcaggcactgtgccaggtactacccagggaggctaactggtacctaggtttcccgctggaggccaccagggtggaatatgctcagtcatagggccgttcctagctgtccctttgtggttcttgtgggaaaagaaacttcctccttacagagacttgcaaactcaggtctcagctccccctggcaaatatggggatggccggcctgagctctgggacgacagacaggcaggcccaggtgtggaacagatcttgctcagggagggtttgatttctagggtagcagcttcatcagaggaagtgcgcagcttctccagaggccctctctgaggggtctcccttcacgtgggcatgcccagatatttggggcagactcagacagccataaggcctgaggaaagggccaggcttcctggggctgagggcgggtcgactggctgggctcactggagggactggagatgagcctggccagaggtcaaggctccacagcaatcccctgtgctgcggaagaccatctgggctcatcttcagaggccccaggcctggtctgacccctggatgggctttcttataggaagagctgacccatctggccctcccttgtcacgtgtcaggcatgaagaagccactggttctaggcatttctgggaagccccagggactgcaagtggccattaccatctctaaggagagctctgattgcaggtgagcccagggttggtggtctgggggtggcagtggactgaggaatgaggcagccgcgcccaggaccagcacggcactgtggtatcagtctgcgcccatctgattcctgcaggcaggaaaacgccacagtgttattgcggccactcaccactcctgtggggacagctccctttaccccatccctgccctctgtgtggtctccccacacacacttggaggcgtggtgccctggcaggcaggagatggcaggggacagggctgtaggtaccctgggcttgcccacatgaggcccagcaactgggagccatgccagcatgccgctggccagggacggtttgtgcagagtttgaggcctctctcagcatcatgggtgggcaggaaaggtgggtctgtggttggcagctcaatgaaacaggagtctgaggatgaagcctggtgtctgggcagcttctgcatgcccacccaagatggctccctgggcagggccaagggtggtgtgttacatagtaccaatgggcacaggacagtgttttcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagcctgtaagtcttgcttctttcacttcccagggcagatgaagctggatggggtgtaccctgttgagcctctgtgtggcttaggtggccagtggctggtcggtgtgagagatgggagtgtgtgtttttacaggtagacatggggacaggcagagaggaaatggctcctgctgtccacctcccgggccctgagtgggcgtgtgggagaggctgggattgcggccccttttcctcagcctggcctgctggagtggaggcttctgatggaccaggcagatgggcctgtagtgagggagaggttactgtagacagaaggaactgtgcaggccaaagggtgggaggaatagttcaggagtagggagtcttcagggaccactgatagcgtgcctgggctgacatgtggagagtgagatggggtgccccatagatcagacagtgatcagcaaagctactatgtgtaaggacagaggcaagatctagagtgctgcttacacagacacacacacacacacacacgtacatatacacacacatgcatacacacatacatatacacatgcatacacacatacacacatgcatatacacatatacatacacatgcatagacacaaatatacacacatacacatatgtatacacatatacacatgcacacacacatatacataaacatacatacatatgcacatacatacatgctcatatacacacacacccacatacacacatacacataggtgtgccagaaccagctagcactggttcaggagaactgattgttaaatattcaggaattttgcaaatctctaacttgaaatcaaacattataatttaggactttttttttctggaatctccactgtgtggacacctcaccacctaatctagtgaagcaagagggcccaacttagaaaccacggctatgggtggaaggcgacccatgaacagtttataaggcattaactttctattgtggaaagctagtgtgtacccaatgctggacagatgtcagcaggaaaaactggaaatgggcctgttgcagaattctgggctagagatggggagtctgggctgggtttgtgtccaggagtaaccatggcacagagcctgtgggcagggagtcctgcttcagagcccgcctgggtttctggggaggtaatccctgcagctggcgggtggcccgcagctggggatgtttgaatggtaggggtacagtgggagcaaagaccagagaaggaggtaaaggaaagaactgaccagctctcccctgggaagagcaggcagggccaccttcctctgctgggcacctggtagaatgctggttgctctagaacctggctcaggtcttgggacaggcttgtctgacttgatactatttctgtgtctccacttgtaaagtcccaacatgcctcctgccctgctaaagacagtgcggatgcaagagcacctggccaagcgagagcagctgggtaagcgccaccagggtggggcttcggggcccaggccacggccagagccacagccttctgtggatgtgggctggcagctgccagggagcgggaccaggaccagagactgctctcagatggccaaggcgctccacctgacaatgcctcttcctgttgaggccacttcccttctagggcacaggctcatgcacagggcctggactccatttgggatgggagtggctcatgagggagggctcccatggggacccagcctctcagggagtagagaggctgaccacgcaggaccctgagtagcttgcctctggattccaggctcccaggaggagggcacatgtagcctgaccaaggagaggctggagggtggcttatcggggacagtgctttgctcacacacgagggtttggacctcactcccaaccccaggcccgtgaatcccccacagtcgcggttctttcccagattttatggagagcatgctatcccacgggaaaggagctgctttcttccctcacttttcccagggcatgctggggccctaccagcagctgtgcattgacatcacaggctgtgccaacatgtggggcgagtactgggacaacctcatctgcacggtaagggtacacaagagggcagtggcctggggggtggagagtctgcccagccctcgccttcagcctctctcccctccaacacctggccctcagactctcaaacctcaccaggttgaaacgcgatgcccaccgagcttgggatgggcattcgtgtctgaggcagcctctggggttctggctgaggcatttcaggcaggaggggtcctcataagcagtagaactttccacaccttttcccaggagatgcagggctggggccatatcgaggagggaagaggagacagtaggctgctgcctgggccaggacccaagacttggagtagggagtgtggagtggagggacagtagcagcctcccagagccaggtccttgccccgcccttggtggggctcacccaggggtccatttaattgctccagcactcagcataaatggagtatctactgtgtgtgggttcctgtgtgggccgctgtagtgtggaggatacagggatgaataaggtaaccagcaaggcacccctagtttagtctggagggatgaaacctgcatacgttatcctaccgttaagttgttaaatagaagattttcatgaactatttagtaaattgaacagattaattatagtagatatttgctttaaattgtgtgtgttctgtatgacaaagaattgatcatgttaatataaaaagggatcttaagtaacaggaagctggggaagagtatcccaagtgggcaaggtttgaataaacaactccaagaaagacaaatacagacagacggccaataaacatattaaaatctgtcaccaccactgataattaaagaaatgcaaaataaaagagccacaaaatactggttttgacacattagcgaggtttaaaagttgttggtgaagatacaggggaaagggtgctttgagcccccttctccacgtctgtcagtagaggagtggatacagacattgggccacatccctaagggaattctgcacagcctgttatatgatgctgtaaactctttattagtaaaaattaatcctatattgttcgctgggtgcagtggttcatgcctgtaatcccagcacttagggaggctgaggtgggtggatgtcttgagctcaggagtttgagagcagcctgggcaacatggcaaaaccccttctctacaaaaaatacaaaaattagctgggcgtgatggcatatgtctctggtcccagctattcaggaggctgaggtgggaggatcacttgtgcccaggagttagaggttgcagtcagccgagatcatgccactgcactccagcctgagcgatggagcaagactctgtctcaataataataataataataataatcctatattgttaaaagaaaagattattaaaggcatgtgcagcatgctccccatttatatctgggtcttcacaaaagaagtgtagacacttgtacactgaaatgctaacagtaagtcatgctgcagaggtaggattggaggtgattatcacactcttatattttctaaaaataagatttattacttttgattagcagagaaaagtaataaagttcttttcatttaaaagacagaaatttgatcaaagggactaccagaggccgaagagcctcaggcttgccaggtgcagtggctcacacttgtagatccaacactttaggaggctgaggcaggaagattgcttgaggccagtagtttgagaccagcctgagcaacatagtaagaccctgtgtctactaaaaaaaaaaaaaaaaaaaaaagtcctcaggctgggagctttgtgcaggctgcctggctgggagggagagtggagatggcgggaagtgggagagaagacagagtggtacacagtgaggctgggaccaaactgtggggcccctgggctggctggacaagtggaggccttgcccagaggggatgtggtcgcaaccggtgacaggagtgacaaagggctggggtgtgtttgcaggtgggagacctgctgccggaagtcatcccagtgcacatggcagcggtgggctgccccatcagctccctgaggaccacctcctacactattgaccaggcccagaaggaaccagccatgaggtgctccatgctcagcctgagcctctgctccctggtagcccctgaaaccctccggcctccgggctgggctgcccacgttggcttgttattctccagctggcctagggccattggtgccacctacaagaaggttccaggccagggtttccctgggggaaggtggcctcaggggacgtggccaccacctggacatctctgagggattttgtggggcagaagtggcgagtagtcagtgtggtccgaggtcagcaccagccctggggcccctggcacagttgaactggaatcagcatagtctgctcagggcaggtgggtgggttgccagggcacagggcagccccagagcccagctcacctggtgccgcctggggaaggcaccagccccaggtctcattaattctcgagtgaggccagaccactgtggtatttccccctgcctgagcccccagtcccagccctcctccctacctgcaaggtgtacgctggctgtggctgtactgagtccagtctgtccccctccaggttcggcacccaggtctccggaggagacacagttacccgaacccttcgcctgaataactccagcccctgtggtaagacatgcatgagagaagtcagtgttcttgccacaggctgtgccttgtggtgagccaggctgggagggaaggtgggagggaagccgatggcccatgaacaggacccaggtgtccagggggcctgtggttacggaagtgtggatgggcccacagatgccctgctctcatcagggttgctgtttggaggaacagacaataagaggggatccctttctcattcctccagccggcaggacctgacctgcctgagagctgctggggatacagcggggacaggacagcagggtttctgccgaggggcttccctcctgatgggtgggacagatgtgactgtggactgcagtgtgtggagtgtgtggcatacaactgaagggaaggccggagtgctgggggaacgtgttgaagggccaggctcccctgtggaggggaggcagagtgtaggctgagtctaagaggaagggtaagccgatgtgggccaggggagcatgtgggggcaaagagtgctctgggcctgagaaagggttaggagaggaagctggtgacactgaagagggggccctggccatgcctgcccctgaggagagctgcgagcaggactgaaggcaggaggggaggggaagatgggttcgatgcaggcagatgtctaggtttgggacaggactttggggacttctcagcttgggggcttctgggagatgaggtggggctaccggctgggtgtgggaaggcagatggaggtgtcagaggagggcagggacagcttgacattgtcatggtgcaggctggagagagagcaatggggagccccagcttaggttggggacagattgatgggggtggcaatctgttcagctgggggacttcccccagtggtactcagagggacggcacagttcagttctttcagggttaggtgttgccaggtgggtgcaaagggagatacgaggatgctggcaagacagaggtggacatggcggcccccaaagactagtctgcctggggaaggacgtgaaagctgacataggctgatggatagatggggagaaggaagggcatgtgggggttagagagcccagcctgcccacaaacaggccggaaggagaagcagctgtgggagagagcagagcacctgcattcaggcatctggacatggagacctggtcttgtgaccatgaggacttcaggtgatagagccaaacggcataagcctgtaaagcctttttaaaattttaaatgagaattgcctggaagtggcattagagaggcagagaggcaccccctccacctgggtatgggagaataggtcatctctgtctgggggtatgaggaggagggggccccggggggttgtctgctcctcccttattcctcaccctgctccacacatctgccccagacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagtgagcaggggtggaggggcggggcaggctggccactgagggccactgaggtgtggccagtaggctagttgaacctcagtgactgcgtgaacctcagtgattccttggtgacaggttgagggcagctccagtgccagcaatagggtggcacagaagctcatctcagtcatcctgcaggcacatgagggggtgccctccggccacctgtactgtatcagccccaagcaggtggtgagttggggtatgggctgggagctgtctgcattggccggccagtgggcatgggacagtgctaaggctgctgtgtctatgccaggtggtccctgctgggggcagcagtaccatctacatctccttcacccctatggtgctcagccctgagatcctgcacaaggtggagtgtactggctacgccctgggtttcatgagcttggacagcaaggtgagctcttccggcctggggtgggggccgcagccactgctccctcctgggtagcatgctgcctactcagcccagggatcagctgtgatcagacttgggctcagtaggtggaaagggagattccagggaagaggcatcgcctgcaggactttgcggtgggacccctgaaactggacctgcatagctacgtgaggcctgcacagtgagtcagctggggtgccccatctcctttcatccccatggggtgcaccctcaccaggcactggtggagccaggcagggttctcagagcaaaaggacgggcatgggtggagaagtcagcagaggagcccagggaaaggctggcccgaggctggatgagcagagtgggggcagccagaaggccccaggcgcccggcttgccccaacaatgcctattgctgggcaggctaagtgtggagctggactacggcggcagtatggaattccagtgccaggccagtgacctcattcccgagcagccctgctctggggtgagtgtgctgccaccctctggccctgccagcttacctggacctcagatgtctctgtgtgcccttgtgggactcaggccttatagtctgagcccaaatcccctcccccagccctcccagccctaccctagagccatggggttgaagagagagacaagatgcattccctgcctcctacctctgtggctgcccaggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtcagtgggggagtctgcagcccttgcctcgatggcacaccctcacatgtgtacagacagcacccctgcacgccaccctcaggtgcttgtacccagacgcaaactgcatgcctgaccctgccataccctgcatgaacactcgggggtgcactcccaccagagacaccacattcagcacctctgcacaagtggctcacatgggcatggccacaccagacgttgtgttcacatacatgcatgcacgtgctccataaatgtccccagacttccctttccctcttagtccccactgctgagatgctggtggaggctgatgcattcctgtgagcacctccccttcccacacacacagactccgtcctcctgtgcaagctcagggtttgtgtcccagctcaggtgagcccatggggttgccataattgtaagacactccaggttctaacgtaaaatttcctcttctgacttattctcagtgacaattggatcctggattttcagagttggttaggtaggggaaggtcttgggaatgtcaggacctcactggaaaccatcaacttcctctggtctctgaggcaactggaatgaggctgagtgtgcgcacacccatatctgcacagtgggcttccagggtgtgcagaggcaggctgagggtagacagcgccgccctgtctcctacttcccctcctgcttcagaggccctctttcttcttctcggagggcttccctttatgctgtgctcccttgagctctgccaggtcctagcctcactctgcacatttctgggttgtctcatccatttccagagcctcagtgaacagccatattatttctatccaatgtatactccactgtgtagcgagggcctgctgtgtactagatgctgtgctaggtgatggtactccccgaggacctcatcatggaggtcagggacacacacggatctgcagaagacagaatggcacccttgacccactttgcgtttgctcccttcaacgagctaaatggatgggaaggcccagagcacagccagaggttccattccaccagagcttccaaggagacacggcggttagccaccaggcatttaaaagtccttggcagctctggggaagcccaaaagttccagaaaaaggacatcacataattaatggtgctgcatctcaccctccatgcgctaacaatgctcaggcttctggctcctggccagaattatctcccaggctctagagccaaactcaatctgtccaaagtgaactccccatcccctccccaccttgtcctgccccacatctgtgcctcctttttgtggtggcattttgtctcagcaaataccaaccccagcccccttgctcatgcccagagctctggcaccccttgtcctagacccatctctgaccaagccaccaagccctgcggatgccccctcctaaagttctcccaacactattctcttttcttcatccctacacccatatcttggtttaggacagcagtttctaagcctggcaatagatcagtggcctttttttttttagattgggtcttgctgtgtcacctaggccggagtgcagtggcgtgatcatggttcactgaagcctcgactgcctggggggttcaagcaattctcccacctcggcctcccaagtagctgggaccacaggtgcatgccaccatgcccagctattatttgcagagataaggtctcattatattgcccaggctggtcttgaactcctgggctcaagcgatcctcccaactcagcctcccaaagtgctgggattacagatgtaagccactgctcccagcaaattagtacccttgacaaagcttgttaaggcagcagctcccagaccccacctccagacatgtgaaggtctgggtgaggcgcaagaatttatatttttaacaagtgcctcaccgttgattctgagaagcttgtaccaaggacctgtgctgggagccaggagtccaagcttcatcctgtccagcctcagttacagcctcagcccctggtctggcatcatcacactcatgtgtggtctgcagcccacctccccaccaggtcagtgacctgtcagaggctcctcactatcctcagcacacagaccaagtccttcctctgcctctgagcccaaccacagccctgggcatttgaagctgtaaagggcaacttgctcatgtcccttcccttctagcctctgacctctgagggcagacatgacttgtccctgacactagcagggtgctgggcagagtaggtgctgggcagcgcttgtggaatgaaagcaccaggttggggagctgctgggctgttggctgggcaaggctgggcctgggaggaaaggaggatggagctccaggtggggaagtggccacctgccctctgcagccggagttgacaccatgtccacatctgctcaggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggcacgccccaggcccacctacatgtggaggagggtggaagtgggctgggctgtgttctgctggggccagaggaggaaagacctagcagggccctcagaaataaggagcccctgcccctgtcctggggctcagtctcccctagaagaggccctgtgtgcagagagatgagggccatccaacctcacctgcctcatgagctcaaaaccaggtgaggggccagagtgtgggaaatcagggaaggctccctgcgggaggaaggacatgaagcctgaacaccatttaatcaaggaagggaaacacgttgacagccaggccaaaagaaaggcctgatgggtgggacagagcacctgaagcagctgcgaaggacagccctggggcttgccaggcttcaagcaccagggcgagcaccatggaccaggtcaccaggccgtagtgtggaggctaagcaggggctgctagtaaggagtgtgaaggagtggcctggggaagactctagagaggccgggggcaggaggctgagcagtggagccgaggcgctctagcctggcacctgggcagctgctggggctgaggctgtgggatggtgcatggcagtgcctgagtgtgatgcaggggctgccaggagatagaggagggcacaggtggggcctgcggccaaggaacacagacaaatggtccacggctgagaggagctgagggctgggccttgggggccaccacaggaggagcagtgaaggagggcagagcccaaccagccagggtgcagggactgaagctttatgagttagggaggcagggacagcgggggaatggatggcatcaccctggccctttccctgtgcagactcccagtagcagcctgtggccttttaaggtggcgctggtcccctgccaacttctgggagcttcccgttttcttcaggagcatcagcacttggggtcagcagggttctgtgtgtcccagaggccctggctcagagcccacccagaatggacaaggttgcctggtctcccacaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggtatgtcctaccctgccacctacccaccgttcccctacagggctgtgccaagagaagaccccccaggaaggggcccctgtgcgccgtccctgcatgctggctcccagggcaggcaccacttggaatttctgcagagcagccagtcccccaatcccacatgatctcagggttgccctgccctgcagtgctgagcaagaccagaggtacaggcccgggggtgggtaaagtcttcctgtgggagtacatggggctgcctgcactcatgtgtcttcccttccctttggtgcaggccagcaggagccagccaaggccgctgtggccttcagggtctccccaaacagtgggctgctagaagcacgatccgccaatgcacccccaacctccatcgccttgcaggttttcttcactgccaggtgcagccccttccaaccttccccaaactgcccacagagcctggaccccctgcccaggtgcctcctaacctcagcccccacatgctccccacaggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcacttttactatgcccattgcacttctcatccatggatttgccttgccttaagaattaaccatggccttgtggcctgggtgacccaggctgcttttatcttgcacagctaaagagggtctgatgggtggctcaacaccccacccactcctataccatgtcatcagtgttcacattttccaaatgagttgaagtgccttgatctgtccactgcca

SEQ ID NO: 134 - DNA, 22709 bp, Homo sapiens
ctccttgtttatggagaggtttccggtgaatgttagacagcaactaaataattaaaaggtttagagagcgctgtgagcaggagaagatgcgggcagcctggctggcccaggagagacgagtggtcagagaatgaaaggaaaatcgatgcctcttaactgggccgcctaataacgggagaccaagtgggctcaggagaaacgtggcggggggggggggagctttctttaaaaaattggggttctttctttctgtcctatatatggaaattcagccctgatttcaaacaaacatcagatttaagaaggtgaggactccaaagaagatccaaacgcgagaccaggaagattcacgtttccactacttcttccaatacatttcactaatctttctacagggatagtgttttaaaacacgacgaccctcacacaccaaggtgaagttgaatattgttgttgttccttcaccgcatgaaaggaatccttcagaacttactttcagggacggcttcttctatctcgaatttttgcatttgtagggaattttatggggtagaggagcgaagagggaacaatgtctccaattcaaataaaaccccaaattaagctctcagccccatcggtgggatagcctgcgggggaacccactccctctcctggcagcattgccctgggggcgagcagagagtggatttggagtcttcttttcccgcctgacccctgctcgcccgagcagcattttcgggccagcggctgcagccacccgggcgccgctaggggatgcagtggctcaaaggaccgagcgggcggtgcaggttggaacccgcggggcggaccaatcgcggctcggccacagcctcgcccgctgattggtccctccaggccccgcccccgctcgccccgcccctctcgctggggcgcctcggagccgcgtgccctccgccccggggtgcccattgcgcagagcgtggcctggagacccgcgagccggggaaggtcgccgtggagtcccgaccagaggccggggttggggtcggtgcagaccgagggctggtttccttgactgtgggagaaacgccgggagccggagtaagtagggctccgggcggggcgaaaggaaaagttgggtccctagagtgaagaccgagttctttctgtccgtctacactgagcgtactcggggaatgagttagagccagtctcttcctcccctccccccttctcatccctcactgttgccactcaagtcaaaagcacacattgattacaaatattaggtctggaaagggcagctgcaacagctgaagcgtgttcactctgggggcttgagagcgcagaaggctcgggaaagaggtgacaatgacaacaaaattgacgcggacgctccagtcaaaggcatctcccctttatccgatgactcaccctcttaggaagtcggcccgagaggcaaatctcaaaataccttgacatgaaacattttgtttttctgatcaatttaacgcgcacgtttccccacatcgatgcgctctcccaaacaccctgcattagatcctaataatgatccatgcgtgcctattttttaaaagtctgaaaaagaaaattctgcccatcgaaatgaacttcatgaatggggcaggctggctgcaccgggacggaatcgtccacccgacccgaatgaattggcaggagccgcggccacatttaaagggccagagcgcgcgttccctcccgtccgcccccaagccccgcgggcctcgcccaccctgcccgccgcccctccgccggcggccgccctctgcggcgcccctttccggtcagtggaggggcgggaggaggggcgggggtgcgcggggcggggggagaagtcctggagcgggtttgggttgcagtttccttgtgccggggatcctgtcccctactcgccagcgccaggctcctcccccccggcgcggatgacactagaacctccttaagttgcgtcgcgccacagctgtctgcgaacactgagctgcctggcgccgtcttgatactttcagaaagaatgcattccctgtaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggttggtactggtgactttttttttttttaagtttgattttttgcccccaaccacttgggaggacctaaatcaattttaaaaactcaactctcctcttttggaggttttctaggggctgagaggacggtcccgggaccggtgtccccgagggagggacttgccctccaagtcgtaacagtcagccctgggacttgccctccaagttgctcagccagccccggctcccgcgagccgggctgcagggacgtccccgagagccctgcgggctccgcggccgtgtccccgcgctcccgtgcgggtctcgggtgcgctgggcgggcgggcggcgcgaggggaggttgtgccactccagcaactcaggggctcatccaggtctcccattctctcccttgcaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacggtgagtgcgcccggggtgccggggctcccgccggccgcttcagccgtcccggctcggggaggtcgggagggacctgagggcggggagaggtcaagcgaaagcccccatctgccgttcctggttcatttacaaaaaaattggggcccggaaatgggcgaggaaggcctctggctcgtcgcgagagtgtgttttgaaagagtcgcagcaggcgcctctcccggctggtggccctggggcctggcgctcacctggcgggcgccaggccgcagccctccgtctctgcgcggctgcaggttttggggtggggggtctcgggatgtccccaagcgcggggtgccctggctctgcctccgcgggtccgggctctctgggcccggtagccggcgccggacaagcacggctggaacccggctcttccaaaaaacctggcgttccctgttacccgctagctctttctaggcgggtgggcggggtggagggggccctctgccagcgtccctcaattcgcacattttcagaaaggccccagagacctatttattcacacccttctccttgaccttttcccagagctagtgcctttggtttttagacaggtctcttacctcctggcttcaggaatggaattctgatgctgaaggggtttgggggggaagacccctgtcttaagtttgagggatctgagatttcccagattcccggctgcacagaattttcttgcgtctttgctttcaagtcgcctccttgcctgcaactcttgccttactctgtctctgggtactgccctccattagcctcccacctaagatgtaggatacacccccgtttaaataaaggcaattccagtaccacctctttctccctttcacctggagaagttcaggagagttctgaaatgtaaaaaaagaagaccaggcctgtgtagtttgaggaaaaaagatcgaacactttccagctctaagtttgttcctaaagaagaaacaggggtaaaacatcgggcagaaaaagtgtggggctttctgagtccagccagaccgaattctgccctgattcccctactcagagcctgccttgacacggatgacatagcccctccggcagcaggcgtcctctaccctgctgtcgccaggttttaaacaatcgtttctgcggatggggcgctctttgcccacgttctgtgcggatcagcagttaggtggaaatgcggtagaggcagacttaatattatttactatactacttcctgcataatatgaatcttgacccttggtgttcagagaactctctttccctctccactcccctccccttcctctcccttaagattttagtttcagtattgttcttaatggttgaatcgaatgtcaaatgctgaggcaggtactggctttaaagatcaagaagtgtgtggatttgcacttgctttttaaatgtacccctcagagtgtatgagttacagctaccttaagattgtgcgttttaaatgaaggctaatcagactctgtgtctgagtcatctttcatttaaaatatacacatcaactggaattttgtgtcttaggggctcaggtgaaaattcacccatggcactggtgggatcatagctttattgagggtgcatggggcttacgttatctccttctcctttaggatttgggagggtgagaaaagcagagaaaatggccatcccagggtccagccttgggaactttctccaacagcccgagcaatgaaaacgtccctgcaaatcccattttaggccttttgcgggcagcctggccgtttctgagcaagcactgggttaggtttccggaaactaaccctgaaagtctcctgacttctgtcccaaggcctctccttcctgtatttggtgctgggagctgggcctgactccagggtcgttttctggtgtggagcagttgtgtggccgggctccatccttcaggcctcctcactcacagccggctctcttatcaggctggctgggattaagtccgagtcagggaactcagggccattgaaggaaacccataaatcaagtcaggttctagagagagaccttggggaatgtgatttaggcggtgtatctggagaggccaaataagcaaaggggcccttctccccctctgcagcaacctctcgggtgtcagccacaggcccttcattctgctacatttgatgggacatccctgtgggagagatgggtgaaggattctgtccccagcctgacccccaggtgtgccaggcaggtactccggggaccgccaggatgagagagtgggcctgagcccgggcttttgctgaaaaggaggccgatgcgaggtagagattccccaggtgtccctgacggcctcccagggccacactcaccctccttctctctcctgccctttccccgttgccccacagggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacaggtaggagccagctcttccctggagccttttctcctccctcctccccttttcctcaatccagggccgcacccagagggacccctcaggggagccggggtgtcccaaagcctgctgagatgccattcttcccattcttcctgccgggaaggcactgcatgtcctcccatcctagctcacgcctggcctcggaagcagaggggaagtgggatctgatttaaaaccccccaatgagctgggataggaaaaaagacaaacaaaaacaaagtcatgccctcttctgcctgtcgcaggacttctggattgggctggtaacctttagtcagtttccaagaccaaatggaaggccgagggaataattcttgagtgtttcatgctaaaacgaaacctcctcaagcctaaacaaacacaggtccctctatgacccctttggcctctgtcattctgactgttcctctcgctcagctcaaaggggaccacgcagtgaggacagtcctttattagacgtgtagacacaaagtgtgtgtgcatgagcctggccaaagctgcacgcatattctctgcgtggaaaagggggctctcagctgaactgggagaaagcggtggctttgcattggggaagcagagttgaatgaaaatcaaatgtcgcctggcccagttagttacctgcagcgtctcctagagctctcagtgcagtcaggggcaggaaaccgtattaggacatattgcttggctgagctgcagccagaggaggtagaaaggaacggaaaagtgctccaggtgtgtatctcagcttcctgtgctctgttcctttccaaaatgcaaacgctgcctagcagcacgctgcatttttattcagttggtgtcattacttgcatgaagaaaaaccccacacaaaatactttggctttaaaaataaatcgatctatcaccaattccatttctaaacaaagtaattgagtcaaaagagagctagggattctctgatattgatttaactgtattattagacagggtttggtgaagattttgatgtctccttaggcgtgtccatttcagagtgggcatctcttctctgatcggctccaggtatcttgcctccgctgtctctctacagatcctatatagaaagcaatcgtgaaaatcacttgtcttttagggatgagatgagcagccttgaaaccgagctcccaaagctccggtttgaaaaacttcagagggagtactctgggagcccagtgaccatgagatcagttttcagggtttttttccagggtgacattcactccgactgcctgagcaggactgtctctatttagttgatatgttttagctaatccaattattttcagactgctgcacgcgacagttgcattgtttatcctgagccaggaactttaatagagtccggatgcggttaggctgacagaagaacccagacctgcatgttcagtacatgaaagtaggcaggagggagagggaggcaggctagctggtggagtcaaaaagaaagcaagaggccgggagagctggaggcacaaagtggccacggtgcctggcaggggctgggcttgggggtggagggaaggattaagaagtggggtgcagcttgactcagaaacacaggctggggagctgaatcgaaagagagcagacctatgcattttgaggttgtgatgggatttcttttctttttcttttttttttaaagttctcttttctggtaaggctatgaggttggggagagctcgtggtatctgaggccggcgtagtggtttgtgcggggggaggggacagagtgacttttccaagatactctggtttctttaccctcatttccgtgtttgatttctccccctcttgtgcacactttctgccttaagtttagtcttttctttcctctcatttctttccataagactctgaacatggaggggagaaagagagggccgtggtttccctaagccagagctaggaataccgatacaccgattttggtttttttggcgaggaggagaggaggccatttcaatttggcctttttacttcctccttcttaattcctttctcacagtcgtgaaaaccgagaacagcacacctggcaggggcggcgagcgagctgggacttttgggagtgtggaggggaagtttcgagaagcccctccttttgcagggggtggaggtggtgggaattcttcaggaggggattctcttggttttagtggttgctctctctctctctctctctctcttttttacccctttaacctcttctttgcaaatgcatttgctgaaggaggacacagagaagagagagtttttggggttgtcgctggaaacggttgaagtcgtggttagggcacctattgctgtcttaacgcctgggctttcggggctgggacgaagcttttgcaaacaaaagacagagtctttgtgtccagggccgcttcttagctccactgccacctttccagttgggcatctccctccactgtcatctgatcgagctcctgccctgctccctaccccctcccacagcctggtttaagggtttcaggccaaggcggagcaagaggcatttgccagcagctgttgaatgtcaagaggcctcgccgctctgtggttcttgtcacctaagagagaggtgtctgcctgagcagctcacaacaggcaggggtgaggagaggggaggaaagaaggcaggagagagtcagggcctccattaggaaaactggctgtttgctgaagtgacagaccagaggcagcaaggaaaaaagaagaagaaaagcccataggaggcaatggcaaccttgccgagtgaatcaagacagaaaattaccctagtgtgcagaaccttgttgaagaggtaaccgttgctagctttcaaggtgtttctgaaaaggaagctatcaccctccccaccaccctgcaaatgagaggaaatcagactgatcatgtcaggctgggaggtcccccagcaccagggtgcccaggagccgggtggcaaccacgctccccgcctccaaccacagcggcctctcctcacactgccctctgcccagtgcccaagtaggggaggagcccgagggggtcccctgtctgggcagggtggggagtgggcctgcagtcctagctgggacagggccagtgctgccccagaaggggctgacccagcagccaccagcgacacaaaaaggcaggcctgcggcctggcttgggctgcagccggttactcgcccactcacccttcactctttccttccagcctcccccacatccagtctgccacatccctcaggcttttgaccccaactgaaaggtgtctgggtgtgattcaggcctgagcctttttcaagaactgagaagagccgttgggtacttaggaaggcgcctttggcatgcactgcagcgtgtttgtgtttaatctcaggggttctggggcacagcaaaggctctctggggaccctaggctaagaatcttttggaatgtggagcaaaaaaaaaaacctctcttacatcctcattttttttttttttttaaaaaacaaagtagacaaaaactagtgggcaccatccctgactttcaagggtgcaagaccctcttccatttgcaaaagtctttaactttcctgaagaacttacccctggagagtatcacaggcccccaagtgtgaacccccctagttccctcctacttgatctggggctttccaaaggcccaataggtcccatatctgccaaggcagatttttcctccttttaggggaatcaaaattctcaagcaccctactgggttctcttcttctaccccagtggtccgggcaggttggaggtcattaattactctcttaaaacaaaacagtcttcagagctcatttttcttccctacctaccctccggggtcctcctctgggcctcccctctctgggggaccaacttgagttaagcctcctgttcctgcaaggaaggggagtcctggctttctctgggcacccagagaactgggcgctagagacccgtgtgtccctgggtcccccaaaaccaaggagattctcctagaaagcatctttctcttcctcttgcaaagttgaaatcagttagccaactcccccatgtcttgaaatggtaatttaagggattcttccaaggagctttctgggtgggtctgggtcgctttccagcctgggctgagggagtgaatgctgctcagacttcctaccggcctggctggtttttcgtttattttgtttgtttgtgtttttgggaaaagagaaactgtaggcaggccttggttactgagcagccaccccgctttgttaacttgcctcttctcctgatcttcctctgatcggcttcactctgtcctcccaaaccttcccttttcctttttccctccctccccctcttccaggttccctgcctaaagtttgcatttcccccttgcaccccctggctggggtcatactttaacttcagtctccgtaacagcggctggaaagctatggaaacccctgctgggtcctaatcgcttcctttccagccagggacatttgcagtttgattggaagtaaaatctaaaaccctagctagtgaaatcaatcagccgattgatcaatctatgcatctatttattatctgttcacctatctagccattgatgaatccttcctttcccccatcctaatcttcattatttaatcaatctctatagacagacccatgatgataatgggtcacctttgtcttcctttttttcctttgagggaaatgaatggaatgtttgccttttgccaccatccagggctcaggattttctcagggaagtatttgtagctggaatctgcattcctccttggtcctgcccgatcttctccatcaagtcgggcaagccaagaacagggttctgttgcaacgatgcatctgccccttctgcgggcgcctccgtgtgtgtcgggggaacggtcatgccaggacagcattccccagctcaactttggagcatcttggaaagaggtgggggtggacacgctccccaaaagaggagggagaaggaaaaaagttctccattttacgtttctcccccagttccaaatgctgtcagctttcctgcgtgttttccttccctaagtggcttatctgtgcttttgtttccagaaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctggtaagttctcgggaagggatggattccatgctgaccattctgggtttctcatttcctctcttccggaaggacagctttctgcaggaaattgacaggatagcctccaatcgtgtcagctggcttgggacagtttttttttttttcctttttctttctttcttttcttcttcttctttttttttttttttttcaaatttgatacacagaacagctcttttcccctctttttccccatccatgtttcttaagtcgcttgtgaacattttaaggagactgaattcttggttatcaaatctgcagtgtattcctgaatagaataatggtatgaacaggaccagagcagctggtttaagtgcactgatgagcaccgtttgacagatagagacatttagtatgaggacggaatgttccagaaaccatccagaatgggttcctgaagttgtggcgtgtggcttcccaggaaggattacagactcagtgcaatggatggatttgttatgctaatgcttcaaaatggttggagctgattaaatgaatttcagaggcttcaccagcaaccagtgagcctaatgccactttcctcctttcttggtctcagcatttgagaactttccacaggcaattcctatgggaaacgtcgtgtgagtcctctcatacctggcatttggtcttcttttctctttgaactactaccagtaaggtgatagttttttctctcctctctcattattcttttaaaaactttttaagcatgagggatccttgagaaaacctggctctgtcaagcatttataaggaagacaacttataggggacattcatttgcaagctcctctttggaagtttgaatagtgaatgtatgtgacagacaaataacaactctagccacagctaagagatcaaaatgctttatgtggtgctgacattcaccaagtcgagatgggaggaggggaatttccccacgcagattaatggataaattagcatccatcaatttctaaggaaggaaaaagaacacctctgtattctttttaaagaatactttgccctccccatcagattgtagtgcaactcaacacctttcacatcctattttgaagaaggaaaaactttctttttttttttttttttttttttgagacagagtctcactctgtcacccaggctggagtgcagtggcacgatctcggctcactgcaacctccacctcccgggttcaagcaattctcctgtctcagcctcctgaatagctgggagtagggacacccgcccccacacccggcaaatttttgtattttcagtagagacagggtttcgcctttttggccaggctggtctcaaactcctgacctcaggtgatccaccgcctcggcctcccagagtgctgggattacaggcatgagccaccgctcccagccaaagaaggaaaactttctagggatggaaatgtccacatgactttaatctttgacaatcctggatatcgaggctttattctttctgatctttgcccccttctccaactttctcaaccttcccccacctctcctccagcagtttggtttttttttttttttttttttttttcctttctctcatgtgcaaagctgacttcctaggaaaaagctgccggatatctgagcactggagataactcataaacaacaactcagcttccccaacctaaacaccaagatgtttgaacgtatcagaacaagaagtgtttgaaaaaaaaaaaaaaaaaaggctagaggtgttagtgcagaatgaatatgatcacaccacaaaagaatgttttgaatcactcaaaaacctggccttagtaaaaaaaaaaaaaaaaaaagagagagagagagagaggaaaaaaaaacaacaaacaaaaaccttcttgttaaaatgtgtcttggtaccattatagttgttttttttgttttttctgttttttttctaataaaagtaaagaaggaaaaagagggattaaaagtctcaaggcatgggctgattggtgagcaaaagtttatttgacattttcttgggtcttcttcctctgtctggtcagattgcagaggaggatcgtaattccattttatgcaattttatctccactcacctttcataggaaatctctagaactctgagtaataattgctttgaattttagagttcaatgactgtcacattttcatctgtcttttctttcttaatcatctgtctttggtggtttgatgtttttagttctatagaattcataagctacagggaggtagaacacaggacacactcagatttctttttctttctttctttctttcttttttttttttagccctgagatgtatttgacttctgaacacctagaaccctttgttttcttctttcctgtattccctgaccctttattccagttccagcttgctatttttgtttgatacatttgcagattcactgaagaccacccagcccatatatagctagctcttctgtgagatgtgtatttaaccctgaaaaaactaatgcaagaaataggagagatgaccgaagggaagactcatagattcttttccccctggcattgccaggattttcatacatctcaccactagtgagaggctgagctgcttgctttaatatactgtacctcctgctagtgacccaaacagtgtggctttgagagaccctaagttcccataaagtttgtagtactggaagcatcttcctttgcttttatttagattgctgtcaatagactgcaaaagattacatgctgtaccttgtcatctggagctctgactttaccagttggcattatatgcttgtactctgtacattcagaattgctgggctaggaaacccaggtgcctgagtgatattaatctgctatatctgagtagctcttctaaaaaaaaaaaacactataggaagataataatcacatataatttaattgtcaaaatcattaagcactggttttacgtagtactttctcccaaaaagtacacaaatgaaacagttgtttaagcattaaattaccatatttcataaaggcagtcgggcagaggcatatggggttagatcagcactcatggacaatgtgaattacattcaagatggacagcaaaagactcccatcttctcccttatgataggccagggcagtttttagtttccagttccttagaacacagaaaagaaagaatttttttaaaaaggtcatatatactctgttatttacatcccacagaagcatatctgtgaaacaatttagcaactttgaaagaaaaagggtcactcaggttaattcaaaattgtcactgggttctccatatctggcagcttcgggtgttggcttcaactttttgcttgataaaatattgatataaaactgtaccagaatcccaggccgggtgcggtggctcactcctgtaatcccagcactttgggaggccaaggcgggtagatcatgaggtcaggagatagagaccatcctggctaacacaggtgaaaccccgtctctactaaaaatacaaaaaattagctggggcggtggcgggcgcctgtagtcccagctacttgggaggctgaggcaggagaatggtgtgaacccaggaggcggagcttgcagtgagccgagatcgcgccactgcactccagcctgggcgacagagcgagactccgtctcagaaacaaaagaaaacataacaaaacaaaaaacaaaaaacaaaaaacaaaactgtaccaggatccctatagttcttgttctgtgttcttataaccataccagaattttcttcatcacagacagagactaaactctttcttctcttacctttcctttgataatatttttgatccaggaatggggataattttgcagttaaaattttctttttatgatggaaggtgaggaggagagagaggtttacattagaagtgacccaactccattttcttccaatggtttttttcagttttatttttttaaagcgtgaacagagaatagtcacctgatcaatttaaatatgtcaaaaagtgaaagaaaaatctctcttttaaaggaaatgagggcagtaacacaaccaaggaatcaaaattcaggttgaggctgacctttgacctgcaactatgctactccatgaacagcaagtaggaaatggctgatttcatgaaggtggactggcatcagaggaggcgagggatccagggttcctgatgagtggcaacattccttggtcttttgagtttgtttgattggtgaatcaaatttaggtgacagccagctaaagagagtgagggtggctgtcttgtgaatgggaagtgaccaagcttgaaagcacagactgtggtggctcacgcctgtaataccggcactttgggaggccgaggcaggtggatcacttgaggtcaggagttcaagaccagcctggccaacatagtaaaaccctgtctctactaaaaatagaaaaattagccgggcatggtggcaggtgcttataaatcccagctactcgggagtgtgaggcaggagaattgcttcaagccgtgaggtggaggttgcagtgagctgagatcgcaccactgcactccagcctgggtgacagagcgagactccatctcaaaacgagaaaaaaagaaagtgcaggctgtataaatttaggaggtcttgttgacctaggatgtcctacttggcgcttcctcaggtgtgtcacccatgtgtatgtgccacacacttgcacagacattctttgcagaatttgctgttgtgttggcacactgttctctttataactcagcatttctttatttgcgatccagagtgtttttggtgcttggctttgcgcctcctttgctgtgaatgcatcctgatggctggagcctgtttgaggatggatattcttgggagttgtgtttgaaaacaacctcttgtggccctggacttggtgaaaaaggcaactgaaagcccagttccaaaatgaggctggctaattcaaaattgccacccataaaaattaaccctctggtgtactttgtgggttgagggtaggaggctaagactgccagggaggaggccccggcttcctgctcctaccggggagcagcaggtgaaactctgaccacgttactgcaatcctgacatgctccagtggagtggcgacatttttcttctcgaggcagcttttggggatctgtattactttcatgtggaccacttgctagttttgatttcaatgataatttcttccttcctttttttttttttcaagcctgtcttcatagtgatgacaacacatttaacatttgttttgatttcaccctctcctctctccccactctcagtctgcagccaggagagcagggacgtcctgtgcgaactgtcagaccaccacaaccacactctggaggaggaatgccaatggggaccctgtctgcaatgcctgtgggctctactacaagcttcacaatgtaagtggactgggatcagcaagaacagggctcgcttcctgatggtgaccagcaaacagcgtcaccaccaccctctccaagtgaatcgctcaccatgggggcagatgacaggttccaaataattgatgcaataggacctagcttggaaaactactttgtctagcatagccgtgctgaggccgagggggctcacagcctggcagccacacaacccccttggtatgcattggacactccacataccatgcagcaatccgatgtgctgagtgggcctgtgtggtttataaggaaaaaaaaaaaatcttccttttggaaaacaaaaaaagccaccggtcctattttgttgtttccttacattttaaactctttgcagaaagagagaatgaaagagaaaggtaaatagaattgtaatgtgtggcagggggtctggaaactaagaggacccatttggttactgagaggtaaaaagtcttggctaaatctgtgctacaaatttgaaatggatcctctgtataaaagacatggaaaaaaatgtctgacagatttcgtctgatgtctttgtccgaaccaactttcacgtgtagagagctagctcctgaggaaggtggctggcctgggggatgttaccataccagggaaaataaactgtcattttctccttttatatcatgttagcagagcggtaattgccagtcacctgaatttagttgtgtcatttctgatctttccatttggggtcctctcattttgtaacatatcttaatcttaaaaaatttttttttcagttttttttttttcctgaaatcattctggctcagaggccatgattctagtgaggcttcaagtttacattaactctaaagacaaaaatggttattttggtctttctctgtgttgctctctctctccttcctttttagctctttctgattctcctaaattctcttggccaacctgactttggcaaagtccggggctgaacagggaggagacagggacttttgcttgcggcggttctggcaatgaactcatcttactcaggaatacctgggaattggggaggaagcttttctggttggattttttgagtcataaagaacttctcagggtgaccccagcaccctgcttctttttcacttcttgggagcaagttgctgtgattccgaggagccctgtacgctcattccctgcctgtgccaactctctcgctgtggccctggtgcagtgaatgaaactagagtcttactacgatcccttattctcccttaggtcctgggactgtggtctatatacatttatcagcaattcaatccaagttctattttcactttggggaatttgcttgctgactacagtagagatagagattcgtgattaaaatctggaaggcttgggcttataagctattaggttattagcattagggtttattagctatccagtcatcagcactgcctatgaaattatttttgggctgtaatttatggatttcaaagaactttcatgttacttgattacatttgagcctgagatagtcccatgatgtagacagggcagaaattatttttatttcagttttacttgagggagttatgactcagaaaagcaagtcgcttgcacaaggtaacgtggctgagaaagtataagagtcagggcccatttcagagtcaggaggctttcctgggaagttggcagtgtcagaactaagaggagaaccaggggaaagggaatgctctctttttttagagtataacaaaattgtaacaaattgtgtgtgtgtatatttcatccctatattcgtggaagtataggaattataggagattaactagctatatgtttttttgaatagttagctgggatgagatatgatctcacttgtgtctgatcacatatatatatatttctgaagaacatgaatttctcaaatcaaagtaaagctgaggaatcctctccatggctcacttctacctcctcaatcttaatgagcttggtcttcatggctgggctccagtgaatgggagacagaaacttcctcatcctcaagagtggtttttctgtcttctctggtttaccaggaatttgtaaaaggaggcgattgatgtgtattgaacaataagagataataatctattaacattgtcatcacgttgcgttttgctctgcccttccagacatctctacatggatgccataagctctttcttcttatctaggtgttgagataactgcctacctcggtatcagcatctctcagtggtgttgtgactggttatctggggttgtgtggctactggtgtaactagatattatatttagatacctggctatgtatagctagatatcggcatcagagctgtgtatctggacattatcttggtgaagatttgatgtgggagtagattcctgtcatctctgtaggctgcatctttatcttgatgataactttgaagaaggaacctggagatgttcctctggcagtgacctttctgggctctcctgccatcggtcacgttgccttcctgggcttggggaaaataaggtctcagctccagtgtggggctttgtttccttctccaggtgacctctcccagctcagcttcgggaagctgggtgttggctgctctcagcaggttggccatttgaattcttcctttcttagctgtgattttctggctttgggaacagacaggtaaaacccagagccaagggttctccacccttgagaactgtggcggaaggcgatgctttcagcccgggaagtcaggaatggccaggacactgacattcactccttgagtctgtttgccaccctcccctgggaacatggccagatgtggagtttgctcttccgggcagatgtctgctgttggggttaatctgcttctgcctccctgtggggagtaacttctgtttactttgtaaagtttcctttcttgattctgggcccccaaagcaaatgtatttttaaaggcaaatgaggtttattaagaagagagaaatggcagatgtctccgagactgaagtctcttgatcttgagagtagggtctggtctctgtctctttactctagcacattcttggtctttccttttcaagatgagtgcccttttgtgctttgcaccccataggtggttattaaatacatgttgattggttggttggctgtttgtctggttagaagtggagagtcagagctaggtggaaatagcacttgcaaccattgcagctgctgttggaatgacacaggcaagagatcacttttgggccaggcgcggtggctcatgcctgcaattccagcactttgggaggccgaggtgggcagatcacaatgtcgggagttcgagaccagcctgcccaatatggtgaaaccccgtctctactaaaaatacaaaaattagccaggtgtggtggcaggcgcctctagtcccagctactcaggaggctgaggcaggagaattgcttgaacccgggaggcagaggttgcagtgagccgagatcgcgccactgcactccagcctgggcgacagcgggagacttcgtctcaaaaaaaaaaaaaaaaaaaaaaaaaagatcacctttaagaaaggcatggtttcataaaatacaacccggctacatataaattctagcggaagattttatggcacctcttaaaggccaggtagaagagaggcaaccgaaagttactcagtagaacagtacagtcctcatttcttcaaggcagacagccttaaccacctagaggctgatggcctggggagtacttttcaagttctgaagcagatttgtcaaagtagccaaaatggcatttccctcctgaagattcttcactacctcgattcttatgaaatagtctaaggaagttctaaagaaataagacaagtgaattctattttcgttaccagagaaatacaatcgtactagacggggctgtaatctggtaactgtatgtattttagttcttcagtccctgggaaggagacaggagaaggtgggagggaggaaggggccagctgaaatggaaacagatccctgatccggggcggtcagtggaacccttcttggtgtgcgagagcctgtgcatttcagaggcagcaaaaaagtaaaaaaaaaaaaaaaaaattgatctttgtttagattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaagaaaaaagttgtaggcgaatcatttgttcaaagctgttggcctctgcaaaggaaataccagttctgggcaatcagtgttaccgttcaccagttgccgttgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaatttttggttgaataaactagattacattcagttggcctaaggtggttgtgctcggagggtttcttgtttcttttccattttgtttttggatgatatttattaaatagcttctaagagtccggcggcatctgtcttgtccctattcctgcagcctgtgctgagggtagcagtgtatgagctaccagcgtgcatgtcagcgaccctggcccgacaggccacgtcctgcaatcggcccggctgcctcttcgccctgtcgtgttctgtgttagtgatcactgcctttaatacagtctgttggaataatattataagcataataataaagtgaaaatattttaaaactacaaaatgacatcgtatccacgtggtggccgagctcttctagaatctggtagctctagctaatttcagagaaaggagttaaaagaaacaacttaacaaccagacatgttaagttattcactaggaaccgatgctaaccccagagagtcaacgtctattttggggggagctgggaatatttggagttctacatgcgacctggagg

SEQ ID NO: 135 - DNA, 5183 bp, Homo sapiens
gggggaagggatgcaagggtttactaaaaacactccatttcaagggtggaatatatcagaactctgcctgacaatccaaaaagaaggaagaggagtggaataagggccccatcctcacaacaactttatactggagctaattaaatgtgaatctcttagctcttggttcactgatgtgaggaaagactgactgaagacagttttggcttttgaagggagttctgtttatatatacgtcaacatccagttggaggtgaaaaggttagcacttgacccaggaagtatccatgtttgtttcaaaaataaatctgcttcataaatttcttcatcagtctttttttccattatgagctttgattataataaaggagctgttattaacttttattcaagaaaaggcccatctctttgaaaatatttaccacccttctccctttcccctcatgaaatgtgccaacttcataggaattaacaaattgtagcccagccaaatacacggatgcttaagcatacctgaaacttgagtatatttatttattacagacatcctaagacccgtaaactctgctctggatcatatcactccaggatctcagagctgttcatgattgtacaggaaatggggaatatcataggctcacaaaggataactgatagaactcagtgtggtactttggggacatcaaacattgtgcgacatgcaaaagactattcacgaataacacaaaatatacattcattgtgccatccatcacattaacaattgagctgaaaatacattatatccagctaagataactgtggaaggaagaaattggtttgaataatacttttaggttctgaataacccagcacaaattttaaacagagggtggcccgagaagaaaggggtagagattgggaaagacttagcacaggaagccgggtttctgaagtttgtgctctgcagggcttcttaactgtaagaacaaatcaaggctaccctctgaggcatctgattgggtttaaatgagggaattttttctttcacctataaaattgtaccagtttagagagtttgcccaccctgttttagtaacctaaacatttctagaaaatctgtataaagataaatctcttaggacaaagtatttacaaccagcaaactcacacacatgaaaatgacttaaattaagggatgaattaattgtgtaaacatatagtgcatctcttcttcctgagctcctggactcgcctttcgctatatcctactttcaaggacaagggaggggagagctgtacatatagttagataaaagatgagaagattccttctggcatgtttctgttggcaaagggaactattttccaaaaggtcatctgaaaggaacagtaggttctgtgaattctcctaaaagcaggagggatgttaaggcccaccagaaaatgtatgctggcacccaatctggatgaaggtgttaaccccgcaccaagtctctggtccagaattatctgcaaatatattatcctggccaggagctccccagataggattagaaaggaagaaagagactgtaaatggaaagaaagataagctaagcatgtgctttgggtaagaagtcccagcccaaggagatgcctgggctgttgtctggggctggagccgcctcagtgggaggtagtcagagtgtctgaggtagaagaccccggggaaggaacgcagggcgaagagctggacttctctgaggattcctcggccttctcgtcgtttcctggcggggtggccggagagatgggcaagagaccctccttctcacgtttcttttgcttcattcggcggttctggaaccagatcttcacttgggtctcgttgagctgcagggatgcagcgatctccaccctgcgggcgcgcgtcaggtacttgttgaagtggaactccttctccagttccgtgagctgcttggtagtgaagttggtgcgcaccgcgttgggttgacccaggtagccgtactctccaactttccctggggcaaagtgggaagccatgagacggaaatgtaaaaatttttaaatcgacttgagattccccacacgcttcatggcaacactcaggtaaagaaaagatcaagaactcagcacaaatcgggctgtggagggtgagtgatgaggtgtaaagtgttaacctgatgtaaaccattagcatggtcagaccggtgattaatggagcctcaagatattaacagaacactaccgtcacaataaccacccccacatacttcctatttcccaaatgtataaaatccttgaaaacacaccaatccctgagacttctttgccccaacacctctgggcaccctctccatgcactacaacactagtctgatacaaaagccttttaaaaaaaagatcattattaatttccttggaaattaagcataccagctccttccagaataatcaaggagcatccaccaaccagcaggactgacctgttttgggagggtttcttttgactttcatccagtcaaaagtctgcgctggagaagatgtctccgatgcgggggagcgacaggcttcttggtggctggcgtggagaggggacaaggagttattatacgtagccagggccaggctctggtgctcctgtccatatgagtggtgaatgtattgaggcgagcccaccgcgcccccagcataaccctggtggtggtggtgatgctggaccatgggagatgagagatttccagagtaaacagcgggagcgcactgggggtacccaccacttacgtctgcttcctgatttaacgcgtaggggctgtaaggcgcactgaagttctgtgagccatagcttggaccacaacttgagtgggagtaggacacccccaggttcccggaagtctggtaggtagccggctgggggtggcgatggtggtggtggtggtggtggtggggcgaaccgatctgcacccccctgcccactaggaagcggtcgtcgccgccgcaactgttggcgctgaccgcgcacgactggaaagttgtaatcctatggtccgaggggtaggctcgggctgagcaggtccccgagtcgccactgctaagtatggggtattccaggaaggagttcattcttgcattgtccatctgtcactgagtgacctggtcctgcgaagcccggcgtgactgtgccaactttctcacttcctccatggggccggagaagaaaaatgatatgaatgtacagtgcgcaagagggggggcgggagggcggaggacgctggaggaggggcacgtgacggtgtcagccaatggctgagcctcctgcaaaagtttgccggcttccgcagtgatggatcaccgttttagtggcatttaaatccccggcgctccgccgtctaggtgacgcgcagtcgcccccccaggcagcctaggcggcggcagctgctgcggcgactgcaaaggccgatttggagtgctggagcgaagaagagcaaaagctgcgttctgcgcgcgcccgactccgctgcccgccccgccaggcctccgggaggtgggggctgggaggcgtcccccgctcccgccccctccccaccgttcaatgaaagatgaactggcgagaggtgagaagggaagagggctcccggctctctcggggcgggaatcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggctcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattcgacttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcacagggccggtccacagctccaacatagtagctgaactcccttcgttgcgttcctctttttctggaggggaatgttagaagagagagagagcttccttttataaccttcctcattctgctgcacgtctagagtgggtgtgggggctggcaggtgggaggggcggtggacaaatggctgatggtggacgggacactttaccccaacgacacctcctcccctttccaactggctgtgtagttgcttatgagaaccttcaagtccttccctagagagacacatgcaaatctgagcctcatcccaggccaggggtcctgttcctcatcaccctacttccctgaggctgctgaggtcgttaaattgttgtttactattaggtttcacgtcaaccctgggcttgtagagagaaaaagccaaacggagaccaagaattgatgcagtcttgggtaggagaaatcgagagcttgtccaggaagctttgctgtataaattataagcaatgctgtataaattttactccaaccatgtgtacaatgttggaatcagatgaaatttatagtgaatgaatgtatgtgggtttggggtttccactcctcttcagcctttcctcccgttagaacaaggaaggttttttttttttcaaggaaggtacatttcaaatatgttagtcaccctttcagtcttctgtattctgttctccacgtaccgaagttcccccaaacctgtcctctcaagagaaaaaacccatgctgactctggactccctcagtaacaatgaaacattctccccaaacatttcctttcagaatagtatttgtgactttgatccatcccaagcatggttaagagggagcacgggcaggaaaggc

SEQ ID NO: 136 - DNA, 20899 bp, Homo sapiens
tgcacgacagtgagtctgagagtctggcttccagctctctcatttctccatgtatgtgatcaggggacggagagaggtgtccacacccctaaggccttccttccccttccctcttctatccccctctgcctgcttccaggtgctcagccccttccctccctctggcagtccagtacccaagtcagagagtggaacactcagaagatcatgacttttaatgctttattgggattgcaagcgttacaaggttaaagacaaaacccaagcatgggattttgccggaaatattagcgttaaaggagttgagttgagtcaaacacgggccgcaaggtggaccgaggcggcaggcacaggtgacattcagtgtttggcgtgggggtcttcaggtgatggcagaggaggggacccaagagggggccccccactgaagacattggggacacggggaggagacaagatggagagccacgactaggcacggaggtcagacaggcagcccgggccaggatggttagtggcccaggggagagctgcaaacctggggacgcaaggggctggtcggcaagtgcccccgggaacacccactccggcgaggcagaatataacactgggtgggtgggtgtcctgacgaatgggcaggtaatttggggtgcctcgaagcgttttggatctcaggccaatgtgggttccacaattgtgacaatttggctctttgggcttctgtccaatgttccgaatggcccactcacagggcgcttgccgagggaccctctgcgactgaggcggactggcatggacgacccccggggtcatgccagccccgtcaccaggacccagaagcctcaggcctctagactgctagtcgggctgcgtgcaggggggctgagctgggggcacaagtgggggcgaggtaaacctcccagaggccgagtccctgccgcagccctaggcgccgcggtggtggctgctatggcatcaccagacccgtgggctccggggcccaagcaacctggtcgatgggcagacctggcagctctcctgctctgtgggctcagacccgcctgacctccctactccccggcctcaccccaccttgcccccaagaggtcccacagagcttcggacctcctggagacaaggcagggtgctgaggggcgggcaagatgtcaccgagggagaggggagggttcctcaagtgtgcggaaggcggccaccctgccccagcctgatggaaccctctgtttacacacctgctagccccttcccctccggccagcctcaggccagccaggagccccctcctgtggcctccgagcaccctcctgacacctgaggagaccctgcccaacccccccctccgccctcaggacttctggggaccagccactgtccccagaagccaggccggacagtggccttctccactcccctctgacttctccaagggggctcagtggccagtgccccccaggaggctccaccctcaactcaacccaagcaacagggacagatgaaaaacaaaatccaatcagggcgataaatggcggggggcaggacgtggtggtctccaggctggcttcgtgcgttcttgcttttgtcactgcccccctgttacatggggggggggtttaatttggtttctgagcgcataaagctaaggaggggtaaaaaaaaaacaaaaaaaaaaaaaaaaggaaaaatgccccaagaaacaaagagggggaatagatcaattgacatgaaatttgggggttcctaatttctctatgtaattctgcaagtctgctgtcaatcctcctgacttttccatccaaaatctcccgggaccacttcctaccccagaactccccccgcccagcccccactgccccccacccacccctccaaccgccagacttcccacactccccgcatcagtgcacggcccccgaggactccacatttcttggggggtccccaggagacgggcaaagatgatccctaggtgtgctccggtgggggggtccccaagatcttccttccaggagcacaccagggagtcaggctactcgtgggggcatgtctgctcagctaccgccatctccaatgtggccaaactccttcctcactctggctgggccaacacacagtaagtaaggtgtatcgggaatgggtggggtatggggagcatcgtggctcacgctgcgggggccgtggggacaggcgccaaggaggccagcctcacaagggcatctctgtcatggtggaaagatggaattaggcctgggacacaccccgcccaccctacgggtgtatcccaaatgccgccggccgcacactcaggccgcaccatctgagccccctcctctgagaggcagggcacagacagggccgaggggcagtggagatgggaacaggagcggggctcagaccatgaaaacattggagaatcttagcgggactttggcctgatccatacagatatcgtagttgcttagatatgcttattgttttcatccaattttgtgggggtgtgcgtgtgtgtgcgcatgtgtgtgtgcaggtgggtgcttgcgtgtgcaacgtgtgtgctgcgtgtttgtgtgctgtgagctgtgttcatgtatgtgctgcgcatgagtgtgtgtgctgtgtgtgcatgtgtgtgctgtgtgtttgtgtgtgtgctgtgttcatgtgtgctgtgcatgcgtgtgtgctgtgtgtgcatgtgtgtgctgtgtgctgtgttcatgtgtgtgctgtgtgtgcgtgtgctgtgtgcatgtgtgtgctgtgtttgtgtgtgtgctgtgtgtgctgtgttcgtgtgtgctgtgttcgcgtgtgtgtgctgtgtgtgcatgtgtgtgctgtgtctttgtgtgtgtgctgtgtgctagtgtgtgtgctgtgtgtgcatgtgtgtgcgtgtgctgtgcgtttgtgtgctgtgtgctcgtgtgtgtgctgtgtgtgcgtgtgtgctgtgcgtttgtgtgtgctgtgcgtttgtgtgtgtgctgtgtgtgcatgtgtgtgcgtgtgtgtgccgtgcgtttgtgtgctgtgtgtgcatgtgtgtgcgtgtgtgtgctgtgcgtttgtgtgtgtgctgtgtgctcatctgtgtgctgtgtgtgctgtgcgtttgtgtgtgtgctgtgctcgtgtgtgtgctgtgttcatgcgtgtgctgtgtgttgtgtgtgtgtagctgcggggatgcataaagtatgagtgctttttaggatgggaattgagatgtaagatttgggggtgagggtcgtgccaattacatttcatttgcatggattttggttttcatgctctgtcctcccctcctttggtcttactgggtccctctgactgctctgtgatttttagtgatggaaaagggagtgaggagccagtctgggttgttgctattttcggatggccagtttaccctgaaaattcccgtgagaagggagatggcggtagcagcgacgtgcccacctgtgatttctggggtccttcttttctctttgctggttcagggactcaagtccaggccaatttgactcaaagtccaagggagaagagaaagaggggggtggggagtgccaaattcctttattttgccaattgtttctcagccaattcgtttttaatactttttttttttagccaattgattttttttggtggttgttttttttaaagccaatttctgagcttttgtggggtgtttctaaaaagccaattagttttaagagggttgttgtgggggggggggaagggggttagtttaatgttttgattttttatgtgtggggataattggggataatttggggggagggtatgtgaagggtgtttaaagccaatcgattttgtacatgtttgaagatgctgctgtgcttcctcagcccgatggagggggccgaggagagtagcctgtttcggggaggcggggcacggggactgggtcaggagaagccccagggggacgtggaaccgagagattttcgggatggaacctgatggaaacgtccgtggtcaggaggaggctgcaggatggtggcgccgggctgcagacttgcggcagttttgctcacttccgattgctggccatctctgggggggcgcccccgtgggcggggtcttgggtgggtagagcaatcaggggacggtgacgtttggcctccctgaacgcctcgagctccttggcgagcacgtgaccccggcgggcacgcaggagggcaggcaggcccctgcgcaggcgctgggtggactgcttccaggtgtcatattggaagaacttgcccacggggtatctggggaagttgtcctgggaggggaaggggctggtcagcaggtgcctgctctccacgctcttccgcctgagccgcccgcctgacctgacaggccacccctgtgactgatcagtgacttgagctaatgtccacgggcagagggacagaaggagccagcgtctgagctgctcccgggccacacagcaagcaaggaagtcacgggtccttgtccctggccaagaggtcccagaggccacaggaaacgctgggcgcccgaagccctatttctctgtctctagagagtgggaaaggggcccaggaccctcaccggaagcacggtcggaggggtcgacacgtccctctcggacttggcgggggtagcacagtacgtctccaggagggccaggtcacagctgcggaaacagcactcctcaacgatgccacggctgcgacggctcacacggcttgcgggcctgcctggaagtcccacagcacagagagagccgtgttagcaccgcactgaccccagcccccggaggctgaagggggagcaaaccacccctgccctcaggccaggccctggaaggacgcagccaccctgcgggtcaggggagggaagtgagagctggcaggcagaggcgtcccaggaagaagagaggtgagaggggaggtgagtgggacccagaccagcccgtggcctctgctgcctccttcctcagatgaaaaatgggcacaagctcttggtcccacaaccagagggacaccaccaggaccaaaggctcacaatgggagtggtttggaaaatgtgtgggatgtgagcccagttcaggggcccccacaggagggactgctgtccctgagcttggactctggcctggcaccacctaggaggctggaggggcccacaccacccctggagctgctgagacagggagacaagggcaggagaggagaagacgggaggagaggagtgaggaggcgtgatggaaccactcccttctttcctcccgtcttccccctctcccccacagcaatgctcagctggaaggggaaggtcgctgggggctccaccttggggtgccaaagggcaggtgccatcagccggaggagggagcaggagccccatcacgggggtcccccaagtgggggcttggccctcccctcctctcaggaaagcctggtgcagggaagcttctccctgggcaaggactggctggcaccaggccctgcagtgccacttcctacccccaaatggggcaggcaagagagagggcacaggagaggccagggcgggcaggggcttccagagtcaagcagcaggaacttttcagagagaagctttgaagtgcatttgcatcctgtgagcccatttcacagcgtgagtaagcagtggtggtaaagatgtcacgtggtgagtgtcaggtggaataagccgtgcggcctctgccagtaaggagcggcccctcccctgccccatcaggcatgcccaggcaccatgcctgcctctgcatccacccagcccccctatctgggggtggggtctcaaggacaatgggccatgcacccacctgccagcccccaggctggagaaccaagagagaaacatgaggaaaggctgaagcgtccttgaggtcagcaggtgggcaccccccacggcagccttggggcccaaggaggcgcatgcaccgctcacccctgccacccaccaactgcacttgtcttattgattttaattatataaatcactttattgattttaattctgatcattcaccgaacgcacgtcccttgtcagaatgtccaaaaggtgcaggaagaaaggcaggctcttcctccagagcctgaagccctgcactaggcgtgcggtgcctcaggagcaggagcctcacggcccccaacagaaattctgatgcccagggagacccctgtgagtgcccctgacgtctagggggcacctctggcccacccttcgaaggaggcgtgtgatgggaaaggcagctggtgtggatgccctgggacaccgcacgtgctcagaaacgcggcgggaaggtcaaagtctcagagcaagcggctgggctgctgacctaggagtgtgctcccctggcttgaggttgggcgtcctcaccggtcactctaggggcctgaccaggtctgaggaagcccctcccagctacttactgaagtagaagccgcggtccccacagacgaactggagggtgtccaccagctccccgccgcacagggtctcactggggcggtaagcagcaatgcagcacgaggcgaaggccaagaaggtgagaagcaccagcatcgacttccccattgggattcccattggtgtctgggggcgggagagaagtggcgtgagcggggcagccaggccaagccccaggccagaggtgcccctcccaaaccaaatttgccaacctacaaattcagttgaaaattgaaagcacggctttcctataaacattatttttattacaaaagtaacacacaggtcataatgccgaggtgagggcgcagggccatgtgcagaatgaagcgtccagaagcacacagaaaaggcccagttccttccatttgcaagaagcactagtaattttacacgaggggtgaccatctccacggtcattattgcaggagctcagcggcatccacagctgcaggggcccaggctggacacccgacctggcctccgtcctatgacaccatgggggcagggccagcccagcgtcacatcgccacttctcaggcctccagcgccagccaagatggcagacagccccacccctacagagcatgtgcatccaggaggaccagtcccttcctccccacaacccccagctgagcagggggggtccaggaggaccatcgccctcaaagcagcaggccagtcctgctgggccagccccgcccctccccctggcttttccacctttccagtctgcagctgagccaggcctgggtcaaggactccaatggttaacacaaccacgccacccatgctctagaaaccttgttttcccagtcacccagttctccaactccagtctgccttgggtacccccaaacacacacacacacgcccagagcctcctttccaggcctcaaatcgaaccagtaaggccaggggcctccagaacatctccctatttgcgctaccaaactctccccgtgggagctggagagaccagctcaggccacctgggaagtccgacaccaggttccccagactacaatctggaaggggaggccagtcttaggacacaccccctccacaggctgcagggccacagggccgggttaacccactcgggggtgggaggccgggagccaccacagcaagttggccctgcccctgcagaaggtggaaccctccaggcgggcagccccagccttcgctccgcagacccaggggagtttttgatgcaataaattatgtgagcgactgagcaggcagtgggacagaagcacaactttgcatgccctctctaaagactagtgggcagctgcgccgaggatctgaaagcctccttggtcatctccttgactggaccctggccagtcctctcaccgccccctctgccacccccttccaaattctaagagcacactccgccagctggccactctagccctcgccgcgcttccgcaacaagccccaccactctgaacttggaggtccgggtcaggggaccggcagaaagcaggacaggaagcatgcagcggtgcggagcaggtgagggcccaggaaaagtcctgagctgggcaaggagggggccgaagggaaggaacagaaagggaaggagcaggtgagggagcagagaccaggtgggggcaggggcagaggaaaagaggggaggggggtgctgtccgagaggcagcgggctggcggctgcagggcccgaggcccaggcgtgggccgtgccccctgctgccctgcctcaggctggagtgggatggcagcgggggtcctcactccacagccctggttacctacagctcagcagaaggctcgctggggcaggaggaggaggaggaagaggaggaggaggaagctggaagtctctttcacaggagaagctaatgtccagtttgcaggctggtcagtgcctcagcttttatgtgtgagccgactcctcccagcccgggctccaccctaccccccacccctctccctgctgaccactcccccgcgcctttgctcccgccctctccctcctcccagccagtctcttctctcctgcacccccaaccgggagccctggaccatcccgtagcgaagtgccatgggctcccatcctgcacccccggctcatctctgcacagggcagtgaagggggggggggtctccttcccacctccttgtatggaaacttccacgctgcccactgggcaggggccgcggcctctctccgggtcgaaggctctgcccttcttagcctcagaccagcagcccctctccccctctcccgggactcctgtttggaaatgttgcggacagagccagagggggtgtgggggagatgtcgcgaatgtggcgtctgccatgactcctgccaactcggcccctctccatcctggccccgcccacccccgtcttcctctcgcggtctcgctggcaccgcgtcaacataccagggtgggcttctgcggctccgcgcccctcctcgttacccagcaccccggaggccagggcccgcaaggcacgaatcacacatgtgaggcggcaccccctgcacccacagaccgaccgggaagtcgcccctgcagacacctcacacctccctcggcccttcccgacgcccccaccccacccccagctccgccgccagggtgagcgcggggctccgcgcagggaacgggacccgcagccgtccgtcctcctcctcctcctcctcctcccccccgggctcagccgccccgccgagccccgcaggccccgggccgggagcgggcggaggaagggccgggcgtccggcgcaagcccgcgccgccccagccccggccccggcccggcccgcacacgccgcttacctggaagccggcgacgctgccgcccacctccctgctgcgtgtcgcaaaccgaacagcgggcgttggccctcctgccggacactcctctgccagcgccgctctggccgagtcgcgggggccgaatgtgcgacggggcagagcggggggatggcttttttttggggggggggggagaattcgtctgattgtccagggaggacgggctgtcttcgggctggggcgggccagatgttgtacttttcgggggggaaaaggtatcgggaaatgaggtcagctgttgtatcaaggatagaggggggcagagatagtgggagagacagagtgaacgtgaaaggggggggccgaagagagggcgagggggagagaggacagcgagaggcgggcaggcgcacagcgggagagaacagcacggagagaaacagaaagcgtgtaattaatccactttggttcggcgaaggcgagagggcgggcgtgagggggggagggagtcggaggctaggagctgggggggacgggagggagcgaagggaaggttgcgggagaaagagcgggggccggggccagacgccaagaggggcgcggggagcacagagaagcggagggaagggcgccacgtcgaggggccgggggaggcggtgactggggggcggagtggaggctgcacccggaccgcgggcgcccagctcggtttgggccgacggagccctctgccgtcgcgagcccgggcctcgggagggggacaggcggtggcggcaccggggccgctccgggacgcagcgcggaaaggggagcggcccgaggctgcgcgccggggggagggctggagggggagcgcgggggggggtgacaacgccggcggcctgcgagccggactgcctgcggggggaaccgcctcctcgggcgaagcggggatggggggagttgaggtagatgaagaggaggcggcggggaatccgcaggcccggcggagcgcgaccccgcggacggcgcccgggacgggagtcagcagcgaggcagcgggcggcgtcgacgcggggccgccttgcccgatggaggcgctggtgggcagagcgcgggcaggcgtgggccaggaggcgggggcggccggaaggggggggccggggccggccgggcctcacgcagctccgccggagagcaggcgaactgcgggcgcccacgcccggctcttatagtcgcgccagcccgcggcccagggcccgcgcgggcctcgctggcctcgcgcccgcgccaatgggcgcccgcggagccctcgccccgcccccggcccgcccccgcaacccgagccaagagcggggcggggggtgcgggctgggggccctggggccccggggggggggcggcggtcgcaggggctggggggtgcgcgggggcgaggctgggtggggggcagggagccgcagagcgccaaggccatgctgaatgcccgttctagagaattcaggggccccatcccgggtttctggggtgcccgggcggcctgtgctcgtgagctggggtctccgggcaggcaggggcaggcgggctcccagcgccccaccaggaggctgcactgcgggtgcgccccgtctgagtgcagatgcaggtggcttggggctgagtcggggggtccttgctggttgttgcggctgagggggcccctgggctcgggcggggcgcgcagccgccacctgccccagcaggaggagccggccacgcggcgcttggagcctcagccagatcccgagcgccccccggtgccgcgccggagccccggagcccccgccaggtgcgggacgcgcggaaggccggctgcgccgggccgaatctgggccaggcttggagcctacggaggctccggccgccagaggagagaggatcagggcgggaaacacagctcaaatcctacctgcatggccgagctcaccggggtgcgtctaagtagctcgcctttgcggcccacccaaaatatctggataatggttaccccgtcctcagtgcgttggacttgcatagacgcgagttcggtctcgggggccaccacgataatttgggggtctggggaaaccatctcctggagagtttgaacgatgtaagaaagcactgtgatttttaccaagtcaaaaaccacgcacaaaatcccgcaccccgccagccccccgccgcctaagcctagccaaggggaaggggccgccggcggaatctcgcgcccccctggcccccctcgcccccctcgctccgccatcaatcacttcgcccgcgctccgcgcgcgcctcccggcggagtcctaggcccgcgggctagaggcactttaccgcccggcgggagcgcctctcctccgcgtccctcgccccagccccctgcccgccccactttgggaccctccagccgctttccccacaaatgagatctttgcaatgagcaaacgaaagtggcgcggatttcggggcgcccagcaggagcgagcgcagccgccagccgcaagtccgcagccgtgtcccgcgccccacgccggcctccccggcggcagccggagacgagcgccagcaccggcgggacagcagcagatgcgggccgagagccggtcaggggcgcagaggcggaggggatcggcgcggcggggagctcaccgcgaagctggaggctgcgtccgcgggcgcaccaggagctcaggcagcgagcgatcgaacgctctgtggcaggcggtggacgctgctgaaggtgagcgagaccccggggccagtcctcagtgtccgggagcaacgcccagtccgttggaagacccggggacaatgcccaaatttgggggagactgggggcaatgcccggtcgctttcctggacacggggaagccctccctgtccacgtcctgagggcgcgcggccgacccaagtgtgtttgggcaacgctagagagaaatttcccaaatccgagttgctctggggacttcgtaggagacagagaggcccgaaaccagtgcccgctgtgcgcggggttggggaagctgcagtgggtggccggcgagccgggaacaatgcccaaattttggggaacgcaaggcagagttctttctgccttgcgggcttagcgaatgggtgtcctggaggaggggaccccggggactccgttaatgtgggaaccgtgattaatgactaaactcgagactccagaaaaatagattacaggtttgggggatgagagaagttgctccatgcaattgggaacatagagaaagaggtctcaaataggggccagctagcttgggggaccaatttgtgaggaggggtagttaaagaaaattctccatatgaaattgggaattttgccgtagagccatattacgtaaaattggcagatgaaagcaaggaacacattttggggatccaaacacattcttggtgtgttagggggaagctgagattaattttcacatcttaagaatataagttagtggcctggacgctggcagcagccggggaaaaaataaccttcataattactgtggcttcagggaaaggttttaacacccttcagagatggaagaaagcactgtctagattttgggggagcctggagtgtgatcagtacatttggggaaagcaaaataaaaaataaaaaaataaaaaatcagtattatttttctatgctaatttttaaatgatttccattagcttatttttggtaaataagaaaaagactatatattttcctggatgtcgtctgcatttgggggagccccagtgaaacacatttcaagtttttgggacacatggaaattacccaatggagatttgatatctaaatttctggaaacctagttagtagctaggaaacttataggtcgcaggtttttccatgcctgggatttcttgggacccagggacattttttagtgtgctttgggggtccatggaacattttctaaatgtagggggacccagggcagggaccataaagtcaggagactcataaatcagtattaaaaaaaaaaaaacctcaattgttttgtgaagggaaaaaaatctcaatttgctttggaaggctgggagacaataccgcaatttgggggctccaggaaaatcgtttttgaatctaaagatctagggaagttgctcagagtccttggaggacttgggggtccatatgtacattttaaagaaaggggattcagaattcctaggtcttaggacttaggaattttcagattttgtgatagggagtgtgcagtgtgcttgaaggaaatattgcttaactttgagatgactcagtgggttgtttggagcccaagaaatcagtgctgtcctgtgatccgagggcaatgctgaatgttcctagagggcctggagggcagcgtccagaacatccaagtatgggggaccaggaaaagggtccagtgtgatcctggccgttggggtttcagaccaatgcctgaattttagaaaagcaagattcttgttatgaagctcctgggacccagagaattgtttaatagtcaatatgttgtgatgcagagaaagtgctcggaatgtttgggaactggggccgttagcaacacctggcataacagaaataaaagtaggctctgcccaaggggtccttttgtgcttggtgtagcccagagggacccgggagaccctgtgtgatttggggggacctggagaatcctgggtcacacttgagcacctcctggtaactgctcagtgtgctccagggacctgggtggcactgtctacatcttaagggacctgattcgtggccaggcagcatatagagccatagacgttaatgccccaaagctttgtgactcacacacccacaacattctcaatagctttggggaatcactggggaaatccctccattttatgaaactcaggcaatcagagggcaggtcgtttatgattcagaaaaggattcaacatgctctgggtgtaatgaccgaatttgggggaaggtatgggaagcaattttcatactctgagggttccaaccttccagccctgctgagtgtcatgagggacttgggattcaacgtgtaaagtttagggaacccaggttagtgtgaatagatttgcgggacccaacagcaaatgtcccatgctgaggtgaacgggaaggggcgcgggggtggggtgggggggcgcggaatggggcggacgtgtgccggaaacagtaagcttaggagaccctggagttaatattcaaaattatgcgggaaagttccacttgttttggaaacaatgcctaaatgtggaaaaggcactgtccacatcctggggagccaggcaaattggtcagcgcgaccaccacggaccaagggcttcgtctttaaaattagggaagccgggttagtggcctgtaaatctgtgggacctggagggggtgtataaaactgtccagagcctgggagaaagcacatctggggccccaggccacatagtgtaagtctggaaaagcccgccgggactgatgtgttttgacgtccccggaaattaacgtccaagaaaattattgtgacccgtcgaaatggtgagtatatttagaagacttgggaagcaatgcttaaatttagaggatcccagaaaaagtaaaatgtccgagttcggggaaagcagggaagttgttccgtggattggaatcccccgaggatcaagggctaattgttgagctcaagcttcccgggcagcggaaggaaggcgctgccggggattcaccttggctggggcgcgcgcggagcactggcgccctccccgggaacccgagcgcgggcggcgcgggcaggtagcgcggagcgccctggcgcgcacggccggctgaaattctgcttttcgttctttggggtttttcttccttttgcttttatttttttttttctttgccttctccacacggagagcgcgtttgtggcggcagcccgagcttagcgggcgtccgggtgtaaggaagaaacccaagggccgcgagggagcgaccaggacgctgcttcccgggcgctcccgggactcccagatacctgctcggtccccgcgtgggaggtccgcaggctccccctcgccactgcgccccactcgcctccgcgctgcgagcctaggcgaagccgcggccgagccgccaccgggggcaggctagtccccggcttggcttgggggcccggagcacccccggtggccacctccggcctgccccggagctttgcgcgcgccgttcgggccttcgccagcaccaaacaagggtgaaaccagttttgtttgggtaacactgaagagcagaggaagtggggaggaaaatgagaaacacggggcccgggaggaggggggtgcagggctgcacgccgctggggtgccaggggtctcttttcgttctctccaagcgaattttcagggaaagtctgtccactccggctggggaaagcccagttccttataggcaaatattaaacccgcatgcaggcgcccaacggccctgtcggcaggaacaaggtcaccccttggcgttgggcaatgtcgggcgatggggcagtggccctaaggggacctgtggggtgggtgggggtactgccagagagggggcaccgctggggaccagcagaatggtgggggatcctggggcaactacagtgggcattgcttgtccccattgtcaccccataggaggaccccggctagaaggggggcatctcaaagcctgacactggggaggcagaagttaatggccttggacaggtgtggggagctgggcaggatgaggcatctctttcacattagcttggcaagacagggagaacccgcccccaccatgaaaaacagcccattttccacccacagaacaagacacgtgggaatgtccccttcaaatttctgtctgcatcaatcacccccatgtcccattccaagaacatctggcccatctctccccacccatcactgccccccttcccaccagccttctgcagcctccccgtgtccccagctctctggcctctccggctgtgcctatagaagggggagcctccagcagagaacccctggctgtgttgatgttttcctctgcagggtgacttgtaaatttgggggtgaggagcatttgaaaggtgcctgtctgcaaacctggtccccgggagagcggactaggttgccgaggctcccgtcatggacaaaaccagggcccccagggccagctctaggctccccccaccttctcctccacgcctgcttcccaggctggggacaggttgggcatcgggggtgagccccagttccgagttgtgggttctcctcctctttgggggtgctggggacaattacaccagtgacctgtttgggggtcccttccctttgttctgccctgccgaggtgccttcccccagggggccaccgctcatgcttgaaaatgcatgcctggactttttaaggtaggaagaaggctgagggtcaccttggggtgcccacagcagggtgtagtggccctgtagggagggaggagcaggtgggggagtgggggtgcacacatgttccccctccctcgtggggctgcctgctgagtgctctccttatttagtcagaagtgaccagggcaggctggaggctggggcagacgcgggtcaccctgaggctcgaaaagcacaccggctcccctctagtcaagaccagcatcggggttcttcctcaagactggctcctcccccactacttccagcccccggaggtaggaagggtcccgccagcagtccaagggtgttgggagggggccagggtctcctcccacccagagcttggccggcaggaactttagccccaagcagcgtccgccccccagccctgaaccagcacctcaccagggcaacgctggtctcctctccactggcaaacccacattccacagaggatgaacatcccctcaaggactcagactcaccccatggagcctggcccatgccccagcctcggcctgtggctgctccccatcccctcgctcaccagccctgaagtgggcctttctcattcccatttcctccccagctctggctctgagctcaccgctccgccgtccgtgggaccaagcccagcattttacaaacccagctcctttctccaagggtcctcagagcgcccctccgtcaccccctgcagggcgccgcagacgaggcgctgaccttgcgctcactcccctcgctggggaaggacacactcgctggcgtcagcccggccggcctgggaagtaggactaaggacccgaactgcaaccctccacaccagacagcacagaccaccccaaggctgctcaatctgcccaaagccaaaagtacgtgggggatatgggtccaggttggggtgcttgggagagggccctgggagaggggttcagacggtgcacactccaaaggactgaggcggcgccactgtgttaccattttattgagtgtctaaggtaaagacacctttgaaagaacactcccggcttctatctgggatgggcaaatcagcctgaagagtcacctgctggatccctccctgcaggccctgtcgtggggcaggtacagggactccaatccatgtgcctccagctccaacgctccccaagtcctggagcctcccctgtcaccccagtgcctgaccagtgaatgggtgctgcccccactacagagctccctctggctgaggcagaggccactggctgggcctttctagccacctttcacccctcttgcacacgggaagccccgcaggctcctgaccacaatgggatcctgacgccggagccccttaggccctttgctcagaaggcctctggttattacctcaattctgaacagccaggaggcctgagactgtcacccactttgataaatacagaccgacagaaaggtcaggccattggtgcaagaccccatggccagcagcctggggcggggagaacccgggggtctcacagcccccagcagagcccagctttccttgggtttttaggttcttccccaatgatattttccctttttccctctctacccactttctgccccccatcttctcccctttggctgcccgctctctccctgcccctctccccttctttgccctctttcgtctcccaggagctcccctgccaggacctcggtgccgtggagactgcggggaacctgctctgcccacacctgctctggcccctagacggaagcacctggagccaaccacggaactccagatcccagctgtgtgactgaatccacgccagcctctctgagccaaagctgcttgcagaagggggagatcccagttcgaagactcccgcgcagagcctgtggccctctctgccaggcctcagggtgcctgagacactcacctctctgcctcgcagttggggctgaggctggggctggctgccagcctcagttctgggagcgctggggtcgcctgggccacaggccacagcagctcacctcaggactgggctctctggcctgctggggctcaggctgtggggcaggctgggcagggggctgagctggcagcgattcagagccctggggctgggggctggaatccacctcctcccacacaagctcggtggtgactcttcggcccctggggaaaaacaaaaagatattgctgagatgacctcttttaaaagcaaagcccccctccccatacaccccaagcctgagccctgtcccatccccctccccgggttccttcaggtcaccttgtcaggatctgggcagcggcttccccctctagcccctcccctgcctagagctccctctttcaaagtataagggagggaagaagtggtgagaagtttgcctagaaagggcttcccggtgctgatggagaggccgagacccttctgttggacaggctgccctgttcctgggtgaggatgggcttctgcctggcactgggggtggagggtgcacacgaatggcccgccttgaggggtcatggcacggaatatgaaagcctcctccacctccaaacacccccaccttggaaggagataaggagggggccccagcaaaagccactggacacacagctctgcttgacgaggccagtgagggacggcgtggctgtgcttcctggggaaatgaaccccctccccacagacaccaccctgggtggatcgaggagtctgggtccagggtgcaacagagaaaaacttcatgcatgaatgagcattcccagggaaactgccttggccccagggcgcctctctgtgccagggaggctgggagagcagcaagggggaccaggtgcgccatcaggaggagagaagctaaacctaggggggacatggagggcggttgttgcctctcccggcatttctcctcagtctcctgtccaatttcttgctggtggtcaggaggcatagggaggcaggagggaaggaagctttacctgtaaaatggtgtatatatgtataaataaaatctctgcgccagaatctcgggcccctggctcctctgcaaagtctcctgtttgtctctgggaatgggatgggggatgcaacgggaggaaacttttcacacagaaagactcttcctttcacacttgtgaagacagctgtgtgttcccgctgggaagagcggcctagccctcctcccctacccctcccattttgcttggtgaattagtcaaggaaaacctattttccttgcaaaagcctcagtggctttgtgcagccctaaaggagaaccctctccacaatggcctttcctgcacaccccatccctgaagttgaggctgctctcaggaggcttccctgcaccctccagcagcagaagttcttcccctccttcagaaaccaggatcctggcagctgccccaagctcccggcccacccacgcctgaacacttaaagtgcagcttttctctcacactcaagggatgggagcccagttacctgtactctagtccctgcgcagtccccgcagctcctggacagtggataaagaggaccggggagtcactggtgcccaaggctctctgccgaaactgcctggacgatgatccgccggcctggccaatattagcagtcaccaccaaagcagggggtgccctggctgtggcgtccagaccctctggccaggttgacgtggaggaggagagggacaaagctgaggctggagaaacgaagggcacttttagagtgtgcatgttaatacggcccctacagatgggagagcctcatctccgctgagcatggcacctgctcaaatgccaactgaaatgatgggtttacccctcacctcctcatcccctccactcgtttccctgagcccctccgaatttggggagctttgtgccaacttggtagtgctgaggccgctggggcagctggctcaggcactttccagcaccagggcatggtacattagcgggtggaggtttggcccacccctgacctggcagaaaggcgcctgtgggcgtgggcataagccagaagctccctgccagctaggaggtgggggctatgtggaggtggtggggagtgggtgtagctttacttagagtgacacttggcagttacttgacaccctggaatgttggtggacgtggcactggtaaaatggcggggggggggggaa

SEQ ID NO: 137 - DNA, 51912 bp, Homo sapiens
ttttaatcactgctttaaaatttaaaaaatgctgctggtcaagtaaaaatagcaatagataaaatctgccctgagcaaacagaccatacatcaataaatgaatacttagcttaagcgattttccatgagacccatgaagcatttctaattgaaacttaacaagctacaacccaacagacactccaatcttcacttctagaagggaaatgtgatactccatgtagacgtagctttttaaatttagctggaagacagcgtgacagtgaagttgtgtgctgtaattttttaaaattgctgaagtgtcatggtttgctatttcgtatttattgaaaaaatgtaaatgctatatttaacagaatggcagtaactctgtttcaatctgaagacttaatcttactaatcatggtaatatatgctggctggagttgggaatatttcataaaatactggaataaatttgtgcttatatttcaggggaattaataaaagcaccttcatctgcaacatttaaaatgttattgcctttaaatttgtattaaataatgcagggaagatagatcactgggggagaatggatgcacctctgtgaggatcttggtcattcaacacacgtgtacgggtgaggaaactaaggcacgacttactgggtagggaggtagggatattagcaagatccttcacttgtctgggctttctgtctttgagtcacctttgcgcagtttttcactggacttcacaagcctctgaggcggcagggcagacaggacatccttattttatagaggaggaaacttaggcttacagaggtttcctgccccaaatcacaaaggtggagcctagaccttctcagtctccaccaactgtatttcggttagccacaatcctatctacccacatccaaatggacactgtggctctgcaacttctgtcaaaagggctctttggcaacaggaaaaacgtcatggctccattgtattgtagaggatgggaatgggtgttccggctaaattctccctcccctttccctccacagctcagatggcaaatgtgcgacccagggacctcccgctccagcagacctgtgcgcacaactttgcacagattacctgctaagtcagagccgaaaggtaacacagatgccaaaggataataaaggtgaatgagatttactcaaaattggaaacttggtgtttggtttttcaggagaacaatcaacgactgtgatttgaagttcaccagggtattctgagagatctaatcaaagatagagtgctggtttgaaattattaaaaggtaacagtaaaagggagagcaaaaccccagtcccaacgcaacccataaatctactttgtcttcctcgaaagaggggcgcgggtgggcgcgtctccccgcgagcatctcacctaagggggaatccctttcagcgcacggcgaagttccccctcggctgtcccacctggcagtccctctaggatttcggccagtccctaattggctccagcaatgtccagccggagcttctttgggcctccgagtgggagaaaagtgagagcaggtgcttccccagcggcgcgctccgctagggcccggcaggatcccgcccccaagtcggggaaagttggtcggcgccttttctccccgacgaagccgctccagggctgctctcagaggacgcgcggcaggcaaagagaatgaacctgagcgtccacgaaacgtcctgcacggctcccgggagctgggagaaacaggtgcctttctccgacgtccgcgggcgacgcctgccgcaccttgcccgctgccgcgcccctcccgggcacccctcgccctcggcgcccctgcccccgcccccagtgccagggcggaggcagtcccggctcgcaggtaattattgccagcggagcccgccggggagcgggggtgggcgcgccggcggtgggcgggcgggcgcggcggggcgcgggcataaaggggcgcggcgcggggccccggagcctggctcccgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggatacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggtgagtgcgaggggccaggcggagggccacgcaggggagacagagggcctccacaggggccagggggaagtgtgggaactgagtctcccccagacgaggcttcacttggacacgtgtatgtggtcaccgggggaaactgagcagttctgacttcccttggaaggcgtggaattaggagagaaatcccttagtgggcacacgagtgagtgccccttggagtccatctgtggaaaggaagcggtgataggtttccgcagtgaggaaagaaactcctttctctgggtgtagaggaattcctagaggtgagggcggggaggatttgctaggagtaactgcaggaagagaatgagcagggtggatgaaagaaacacgtttgttcttaagccgcacagatagcattactctctggagctgtcacgagttcagtgttaatccaataagatctgtcttgcttgtggcacaagttcacactgttgtgaaagtgtcaaaacacaactcccggagagtcagatttaaactgtgtttggaggtcccttctgcggcagggcagggaactgcatccaccaatcttattcaccggggtgtgaagaccgctttatacaatctcaaacaaagctagtcatagaaacacagaaacaactgcagggtgatatagattgttctaccacatctatatttccacagtgctctctacagttgaaagggttcctcacttatgacattgttagcctgataaaattaattgtaacacccttgtgcaaaatattttattaattttgacagcaggaaatattgctatgccatggtaaagttgtctcaagtatttcttcctccttttttctccttagtgttcaaatttaggcaccattgttttggggattcatttataatcatgtcagttgttagtacactttgtacagagttttgtatcacaataaaatattttatgtacatgtataaacattttaataaaagtgtttaaatgtacaacttttggtacccaattctgatcacttgtgggcctactggaagacttatttttaaatttagaattcagccacatattctgaacaaagtcagtactaaaaccatttctaaacacttttaattaaagccatagataatatgggcagagcagtactgggttattgaggtgacttagtgctctgagctgctggtaatgttgtaataatggctaaattagattttatgtcagttccacaaaacctgtttgctgctactggccataaaagaatgttggatttgtttggaaacacattgtgatttttgtgatttcatacttatgtatgtcttttcataaggatgttttagagcggtgattcttatactttttcaatccttttatggatctgaaaaactctaaagaccaccagtgtatggctggtgatagaaaaactatgggaagaatggtctcactttttgaagaaaacataagcaagttatcagttcatactggaagcaaataaatggatcagctggaggatctaatagatcatgcccataaaatctttactttagatttaaatcctacaagttctatttttagagtccctaggataaacttgcatatacaaagtagtcaattgttattatagtgacttataggatcattttattataagataaagacttgcgtgctctctggtgctctggtgttttaaataatcaacatgttttagatctttttgcccactcatggccctctgattaacttctcagttatatttttcaatgcttacacaaaaaatttgccaaacactaaccatccttcctagaaatgcagtggactttgtatttagggaaattagtaacaggtgaatgctccatttgctgatgttgcaaacaaactgttagttggtgtaaagtattaattttgctttcacatttcttttggtttggtgtttagtcattcttgtatcttatttagaagcgagttcccattgtcaaagaaagtatcttgaattaattttgttgtatgagatactttcattctgttttcaatgacctttctcggtgtgtatataggggttgggggaagcgagaatagaaaaatttgagcttacctgaaaaagataaaacattctgcagattttgataaaagggcattttagctggggcttagatattgctgctgtacagatataggggccagttgtgttccgggatctgatgttggtgaaggataaagactggctagcacccttccctcactccctctgtgtttccactaacttacaaatgggctaaggagatcccctgggatgatgggaagcttgacccctcctagagagtcaagaatcattgatggcctggaggacaggaggcagaacaaacaaacagcaggacaaataatggaggccctgctcagaatggaggtcttggtgttctttgtgggttcctcatactggagtgagccttggcaaaaatggtgtgtgtgtgtgtgtgtgtgtgtgagagagagagagagagagagagaggagacagaagagaaggagaagaggggagaggggaggagggacagagagagagaggtctcctacaaagagcttggagctcaggctgctttgctcatttgagtgtaatccaggaggatgcaccttttctctcggacttgaagaccaactgctcagccttcacagctcttgaaacaaagttcttaatgtcccctgaaatcagcactagggactgtagttggggagttcagccccagcagtgcctctgagtctttgttctgtatatgggttctaagaggattagaatcaagttggaaatacacgtgttcccatttcccaccttcaactcccctcaccgcctgagattcttgcaaacatttgtgcaaggaacctgtgaaaaagacttctttcacgtaaggaagtagggctaggagatattaatctgggcattgttgagcattagcatcagtgtgcaggtctcagcccatctgtctgcaatgtttgttgaagccatcacttcttgtcccttgaatccttcctcaacttggatttcaggccctggctctcccttgcttctcctctcagctccctggcgattccctcttagtctcctttgcttgttcctcctcaccttgcctgtaaatagtggagggctcagggctctgtctagattcactccaggccattgctttgaatactgctgcatcccgatgactggagattttgagtctccacccaggtttccccgagcatcagactggcatagacaaccgccttctccacgtggatgtctaatgggcatgtcacatcgaacacatcccaaaccaaacccctgcttccccttctctattatgatgactttttactcttccagttgttggaccccgaatcttaactactcccctttttcatgtcttgtttctaatccatcaacaaatcctgcagctctacctacctccaggatgtgtccagaatcaaaccacttctccccttatctatgactacgatggaggtgcaagacaccatccaaccttgcctgggtaatgggaacagcctcactgctggggttcttatttctgccttgccccctgcagtgtgccatgatggatgctctacagggtgacattatgtgtggacaagacagagtccttgctttttcaaatcccacctgttcttctggagccagctaacacgctcccttgggccccatgcctgaatgccatctcttccttctatggcatcctgcacaggacttcgctttgctcagatgcctcctcccgcgctcttccctttatttaaccatttgtctccattttaccccttcgctatctggggtaatcctgttcccttcatctgtatctctgaaaatggcatcttgccctcccttggtgctcagaaggtggcttctggtttaccgaatagcctgatttcacctttataaactcatgctactagaattttctctccttgtcagtctttctagccactttccaatggaacagagactaccaaatcctaatctgataaggaaaaataggtaaacataacgtggcagactctgacatctgcagtgaaaatttaaggttcatcatcaaatgtatgattccattgtgaaaatgtccagttaaaagctatctgtagtcaccatgcagcattatgaagaagttttcagaataagggcaggtggtaaagtctcctggccagctttaggagtatatattggaaggggctttgttagctgattgaatttttattccccaagtaattagtatgagcgatttgtctactgtatatatgctcaaattacatatactatgcacttttgagaaatactttacaagtttttctttcattaaaatgtatttggggccgggcgcagtggctcacacctgtaatcccagcactttgggaggctgaggcgggtggatcacctgagatcaggagtttgagaacagcctggccaacatggtgaaaccccgtctctactaaaaatatggaaaattcaccagacgtggtggcaggtgcctgtaatcccagctacttgggaggctgaggcaggagaatcgtttgaacatgggaggcagaggttgtagtgagctgagatcgcaccattgcactccatcctgagcaacaagagcgaaactccatctcaaaaaaatgtattttgtacataactagaataatcaactggattgaaagttaatataaattttagaatactactgaattcaatagtgcatttagtcagaaatagttaaaatatctcccaaacagcttgaatcactcctttttgaacacattgttttttgaaggttacagtcaagtccaagaaaaaattttaaaataggaaaagaattaatcaaatcatttcaaaatcatagcagtgttttaacaatgccaattattttgagttgaagaaaagaaggaaaatgtaaactatgcattcaagtaatgtcaatgcaccttctcaggtgcaaaatgaatgaacaattaactgtgccagctgaatatgtagcaatcacggcttttgcacatagaagccttctgaattatcttatattctcaaaaatatcattgctctaaactagaattttattataattaatttgtgcaaaagttgtctttctttcaatgaatgttgtctttttgaggcataaaggaaattttaggtggaggaggagaatagaatacatgcttactgggaggacaagtaataataggtgagtaaaaacacacagcttattgaattgtctcagatccacattttctccagaaatgcaaagttatacttgaaatctatatttaaacagataagcagaatgtgacttttatatgctctattttgatgtattctgagtatgaagataacctgaaggatgcctttttcccctctttatcttggggtaaactcttacttacccttcagagacttgactcaaatattttcattctgcaataaccacaggtagaatggatcatttactcagttgtggctctcttaagagcacagactacctatcatatttatttcaaaatttgtagtgcttatctcagtgcttggcacagaggaaagaaatacaatttttaataaaggcataagtggagaggtaaaatacatatttctggtttcaacgtgtccatattctttcttgtaaatggaatattgcgcttgcagtctgctctcacacaatatctgggaaggagttttaaagagtgaggaagaacagtaaagattttcctaggcagatacgttatgtgacctttgttgatttccagagcacataatatcccaatttcatccagtggacaggaaaagagaggaagagggaaaaggtggcctctcaagtgcctgacctggaagctgcacctatcactgtcccttgggcagaactcagtcacatggtcaaaaggagtctgcaaataattgtcccctgaggagccgggtgctcagtgaatgattctattaagttgaaatcagatgggaacagatcatttaggataaccagcaggctctaccacattgcctaactcccaggcatattgtgagaattaaaagcaccttatatatgtcaacgtgttttgaaaaaatacaaaaagctctacaaaagtgagctataaatttatcattaataataatagtaataatagcaaaatacttgagaaatggtcctcttgagctgtttagaaggaatcatacaaatgcattagacatggtagcctcacttaactacttaatttgcctcttctttgaaattatttcaatagcatttgaccaaaaactatcaaatcatttttgaaataacgtatttttacataaaacacattatcaaatatctttctggatccagcttggtggtaaaaagatacatactaaagtttatgactgatataactttatatattgactaaaccaaagataaatattgattgaacttttgtggccccagtttcaatagatttttttattaacattttttgtttgaagtacagatgtcacgtcatccatgaaccggtatcattatagcttgataaaatactcaaactgaaagcagtgatgtacattaattttaaatataatggttaagcaaatgttatttccatatctataagtgcattttatttgataattagaatgttagaatcagaaggaatttggaaaatcccaggttacacttctctccaggacgaactccttacagtggctctcctggggtcagctagcttttgcttgaccctttgaagcaggaggaactcagttccactcaagttgcccccttgattttctctttcatattgaacctgctgctgcacaggactcctccgtgactgtctctttgccttcctaaatctcaaagaataaagcaagtcactttttgacaagacatctttcacatatttgaaaagacatctttcacatatttgaaaagaccagtacgttttgttcttcctagaattttctccttcatgctaatgtctgctccaagaagacatggaggtgactggacatttagtcaggaacatttcttgagagcttaccctgtggcaggcaggtgcaatgttgaattctgagaatatgaatgtaacctttgaacaggtggctctgtcttctgacgtttcaggataaggtggaggagaggagaggggaaagtcgacctatctccccagcggggagggtttagggttgtctgtgggacctgcctctgtctcatcatccatcaccattgtcctgctgatgggtgcagaggactgaggacgagtggttggagttctccctgtgccggaccctgtagagagtccagagccctggctcccaaaggaggcatatttgtagggctcttttcgtgagggtccagaggacggctgcaaagctgcaggggaggatgggggcatgggaggcaagcccgttgccctgtcagagcctcttggggatgctgctcttccccgcctgtcctctcttctctttgatttctcatcatgtggtcctctttcctctgccttttcctctcttcggtgtcccaagttcttccatagagacctgtgtccccttgttcccatcaggcctttatgccagccctgcacaggtgcggggacagtggtaggggcgtctcactcccgactcaactacattctcccagaaattgtctgcagtcaaacacaactcagcgtggacattgctcaccaaaggtatactgcttgggctgcacgagagattcagttttctcctatctatctggcatgggctgtgagggggctcctaacctagggggcctttttactccttcctggccagagctgccatttccaagtttctgcactgtcagaaaagagggataaggtaagattcctgccctcatgtcacagattagtaggggagaggtaattgtcaaataattacagtaaaatgtataaatgccttaagagaaataagtacttgcttaggaacctatttcaagaaaggagagataggttagcgttttggggaggtagtacgggagcagtcagggaaagcaatacttgtaagatcagaggctggcaatctttttctgtagagggctaagttttggactttgcagatcctacagtgtctgttgcaactattacacagttctgtggttgcagcatgaatgcagccatgggcaatgtgttaatgaatgggcacagctgtgtttcaataaaactttatttacaaaaataggtagtgggccctgctgctgggcttggcttgctgggcacacaaagtgagaagggcattgtgcctttctaggaaacatcccttgcaaagtcagtacaggtgagacagtgtggccattcccaccacagcatgaggtcttttgaatggctgaagcgtcaggtgggaaaggatgaggagctgaagaagaaagcctgggaatttccaaggcctctcttaacatttgctgtgcagaaccaagcagtgccccaggtgttcagagtaggcttcagcgattacatttcttgttagacactgaattttgttcatgccgcccaagattgcattaacaattttggctgtcaccttaccgcggactcaaattagtttgcagtcagctaaaacctctcaggttttttccccccagcttgtgaattgctgtgaagccaaacatccctgtcatctctttggtagtttattttcaaactttcaatcttattaaatttcatctccaatgtgcaaagataagaggaagtttaccgctgatggtggtttattctttaaaactggacatcagctaaatgtgttaaggtaatccgttagaggaatgttggtacgcttatacagtggaatactaattggttattaaaatgttgatgtatgattattaaaaggcagcccatgttatgtctcttctgtatgaataagtatgtaaaaagtatgtaaagattactgtatagttcatgggtgggactgggctctctctagcctctgtccttcattctccctgccagtgccttttcccttgcagtgtcccttccctggctgcatactcaagactggatttgcccagccaaaccccattaactcacagaagcaagaggaaaaaaataaattcttattagttcaattctccaaattgggggcggtctatttcacagcaataggtaactgacgtaaaaggaaaggaaacaatgaagtaattccagaaaatttcctatagctggaggacatgcattttcatattgaatgggaagaatggggtgggggggtcatacctctgtgttattgcagggtcctggctcctagggacctaggcacctcttcagtcagtgaattatagcttggaaaattggctaagtcggggaactgtacaaggggtcatcactttttatgtagccatgctctatgaaccatctttataactccctggcttctggcagttaagcaccactcactatctggcctctgtaatttcaacttctgaccatccccgtgggtggcaacaagcccagctctgtgacacctctgctaccagcagccctggcctggagagcggtgcccccactgaatgtctcagtgagattggcacccccatgagcatattcctgagggtgcagtgaatgctctttctccctacttgggacttctgggaaacactgtcctctggtgggttgtttgacctcacataatatactggttcttgcatgccagcttctctctgcttcttgattcttttatcagctgttagggcaacaatgtcaggcatttccgcctgctcagcattgggcatccctttttacaggcttctcagagccaccctagcagcaactttaccgcgtctcctggggtccttgctggatcgtgaaaacatacttccggagaaagtgttccctagataatgaattatttcttgtcctgtgttaagttccagttccttggtcaaggaccccagcgctactcctcaggatttgcagtgcatgctcaatcttgaagcaatgttgggatatagtatcttttcttctctatcaggcccagctgtctccaggtgggttatactaggatttaatcctcgttagtgccgggtcagctcctgaggggtgcacctgttgctttttagggacgaggcctcttcagcataaagaagtgctatctcttactagggaagaatgggccacctctgtaagctccaaatattcccaggtttccccaaccggggccttgaccttggcataactgatctgccttggctgagcatttaaacatccctaaatctctgcaagtctatcaggtcctaggcctgctgctaagtttctctactcttccactgtaggagagaaggctgtggctcttatattgagcctttaactgtttgttattggccctcagtttctcattagctctctgtagagtctcaatacaatatatcagaaagcattcaattccatctccttgtaggcagggaatgcctaaatcattgcacctacaatgacattctccaccaggatatttcccaggttactgctgttgaaatatttagcaattgaagcaccatttgtgcaaggggactatctgcccctacacaacactcagaatggcattctctttgctttccagaaagtgaatgagctggttccccaacccctcttgtgttagtttgagtcctgaaagaagtaaatgtcaagataggattagatgtacaagaaatttattggggaaagaattgtgaaggataaaggggaaggagctaggggaggcattgaacctttggatcatgatgtgtgtccaacaactatgaaggagagtgggcagggagaaggatgggctgggaagagtttcagttggcactgtgggtctcagaacaacccaggcataggctgatggggacgccttgagccaatgttgcccattggcggagtccacatcttgctgaaatgggcctgcattagttcccctgccatgtttagtcatctgggagtagccgatgagaatcatgatcttaggatcaactgcaatggcagattcaaaggggtagcaactgatggcctcagtcaactgtgctccttatagcaggaacactgagcagtgcatttcttggccatcacaaagactagtgaggagtgcccttcagagaagggaatgaaaattatttccagcctagaatttgatacttatctaaactgtcaatcattcatgagagtcaaagtcccaaaaaataaatcttccataaaccctttctcaggaagttattggagggtaaccgccacataacatgaggaagacaaggaggaagacatgggatctatgaaagggcaggtctaacccaggaaaaggatgatgaactgtagacccatgatgtcagatgtgcagcagactaagatcagccagtgcagaatgggggagattccagaagtgtgtccccccaaaatattggaggctcatgtgacttccctggggaagtttctgctgagaggctattggaaattgagggaagaattagccacagtcccaaagaaaacagagccaatcaaaaagcaatgcaattatgaacttcaaagaaaacaaaaataagaaggaaaacagtcttacttactacattacaaggtccagctgtgaatgatattcatgttggcagaataatgtcaataccaaatgtcggttaaacccaaaactattgtataactaaattgcctgtgtaagagagctaaacccttatctagcataataggaagtcagtggatacttcctgaagtgtggatgtgtggagatgtaaattccaaaagaaaacgtcttaagagtcaaaagtggttgcctctagagagaactgggggaattgtagggcaatgtaggacagggaactgtgatttttcttgtaagttgttctgacattttaaaccatgaacatatattacttgtatttttaattttaaaaagacataaatattttttctatcactttaaatattaattttgctagttatagcacatatttatagcattacactctgtagagctcttttggattcaagttttggagaattttcaaagttttagattaatgcctttgtgagttttcatccctttgatgataacaagttacaaagaaatagggttatgaataaaccttgtgggatattgttagtcaccttctctcaagtcgatctgtcccatgaatcaatgtttcaaacattgaccagcatttgatacttaataagcaacgagtaagtttttgttgaaccaatgaatactcttaaaatatattttttcaagtggcaacagtactatcttatttgcactctacttttctttttgaccctaagaatgtcacaaaaatgtttagcaactgtcaagattattacatacagagatgactattgtgttctcagatatgctgtatgtcttagttcattttgtacagctataagagtagctgagactaggttatttatttatttatttatttattttttgagacggagtcttgctgtgttgcccaggctggagtgcagtggcacaatctcggctcactccaagctccgcctcccaggttcacgccattctcctgcctcagcctcccgagtagctgggactacaggcacctgccgccatgcctggctaattttttgtatttttagtagagacggggtttcaccgtgttagtcgggatggtctcgatctcctgaccttgtgatccactcacctcggcctcccaaagtgctgggattacaggcgtgagccaccgcgcctggccctattttttttttttttaaaggaatttatttcctcacagttctgttggctgggaagtccaagggcaagtctctggcatctggtgagagacttcttgctgctttctcccatggtggaaggtgagagggcaagagagagacaaaaggaggctgaactcatccttttacaaggaacccatgcctgagatattgaacccacttctatgataacagcattaattcattgatgaggacagagacctcattgcctaattggcctaaagtgagacctcttaaaggtctcgcttaatactattacaatggcaattaaatttcaacatgagttttggaggggcaagcattcaaatcatagcaccatataatacaataaaaattttctgagctaagtttggtaaatttattctaggaatccatgttgtctcctagttatcttcccttccatagtactgatgcatttttgttaaccattacctaattttgcttgagtctattatttctgaaattcacattatcttcccttttaaagttgagaaaattttcattcttcaagcgccttattttctataatctctcaaagtaactgatggctgttgcatgatcataagtgcaaattattttgctagaccacacttggagatgatgaatttggaatggcatgcagactcccgacatcaggagtcttgtctcctgcaataatcaggaacccaggcttaaaagggagcaggtacaacagaagggcaaggggtgacaatgctggtgaaagacatttgaggaaagctatcaacatgaaacagaataaaataaacagaaaagcaaaccagggaaaataaattatgcaggaattaaacacatacacaaactgaaacaggaaccatcagaacatataaaaaattcttgaacatcagtaacacaatagttgaaacaaaatatttagtaaaatatttgaaaagtaaggtcaaagcaatgctgtaaaagtagtacaagatgataaagaaatagaacacatttttgaaagggaaaaagatttaaaggatattcataaagatccaacatcagactaatagaagttctggaaagagagaataaggaaatacaggtcaggaaatttgtaaagaaataatataataaaatgccccagaactgaagaacatgagcttttaactttaaagagccgactgagttcctagctcaatgaatgtatagacatgtaagggtattgaaagttcaccttcagtgtcatgtttcctaagaagctaatggaagatatgcaccagcaaaattgtagtaaatacataggaagaaatagtatatagaaaaagtatggtttcaatccataagaaataaaggaaactcccaggacgagagcagctcttgacagcatctagtccaaactggacttggaggctggaaacttctagcagggaaggaagagctctgggtgaaaaagtagactcaacagaatagatacgatcatagaaaacatgatagagaatcactaacacattgaaaaaatcacatatagaatattctgcacgcttaataatgaggtcattatttattcaagggaaaattaaaagctgtttagaaaagggaaatgttatagtgccctatttggctctaaaatgaacatttatataggaatcttcatgtaaatactaacaatgatttaaataagaacagacatttcggaaaataagggaagaaaatggggcatgtaaaagagctaactcctcattatcctaatgaattattaaatttcacaatagcatagtatttagaaatatgatagttattacgagaagaaagagctaaaaggttgccagtggggagcaggagtgagggttagagacgggattgggggagatgcttactgttttcatgataagcctttggtactatttgattttaaactatataaatgcatttattaatttaaagtaatttaaaaaacccataccactggataatgcttgataatttctagagtcctttttttttgtattttggggcaggtaaattcattgagagacccagagagtttagctgactttcctgtgggtaccaagggtcagagctggggtcaaaactcaggttttctgaacccctattcccagtgtacattccatgactccaggctgcctcccgcattgcacaggttacatctaggggtgtgctagcaaatgcctagaccatcctcgtccacatcagcatctgaaatggacaagaatgttagtcatgacttgccactaacgtctttaaccttaattgacatctgagagtgtcatcattacatcattacaaaaacactaacccagatacatctgttcccattactatttctgcgtaattcccccagacttaattgctttaaataaccattttatttggtttacaaacttatgggtcaggattaggggagggctcacccacgcagtttttctctggtccgcagtcatctgaagcttgaacggggtggggcatgcaagacggctcacacatgtgatccgcggttgagcctggctgtggaccagagcatctctgttggcctcgcttacacaagtggtctcagattagtagcctctgtacatggaaactagcttccctcccggcaagcatcccaagagaactaggaggaagtggtatggacttcttttcttcttcttcttcttcttttcacttattcttgatatcatgtagcttcatttctatcagagcagtcacatgcccacagattcaagggggagggtccacagatccgccaatgggaggaacagccaggttatatcgtaaaagatcatggggcatgggagatacccatctattttctgtaaaaaatacattttgccacagcatcactggctttccagctcacagtgatctgcctggaatgcctttttccgtctctccaggatctacatctttcaatataaggtttagaaactacctcctacaggaagacttccttgatttccctcagcaagaaagaatctttccttcctctgaatcgccattgcattaaaaaaaaaatccatcttctggcgttttcactttcagacttatactgtaattattctatgtacctatgtttgacccctcacgatgcccagcataataatttgtctattgagtaaatatttgcttaatgaaataatcattacatgataactcaaatagcagtcctgaaaaagtgcatttcaattcagatctctcttttttcttccttcacaattctcatttccgaaaaatgaaagaagccagaggatcctttatgaggagttacagtataacttatgcgtggctgtttcctgtgtttactgctactcagtgagaaatacgggagatgggagagtgaaaaaccatgtcatttacaatttgattaaaaagctttttatcttttcctttcacgtttaagccttgccgttttaaaaatttccctttcgtcacaggggatcaagcagcagttaacgctgcagttccctgttctggaaacactctcaaaggtgtttcaacacattttgtctcaactctgactcctgccccgctgccccacgccatccagccacactgaaggtcttgcatttgtgccttggggcattatttttttttactcttctccctgcctggaaggttcttcccaacctgccctaccgccatagccacagaaccaacccttcactttccttaagtctatggtcacaagctccttctcaaaggaggcacacctctaaccacccccatttggtgacttcctgtctcctggaggcccccggaactagtcttctctacttccagcaacccactttacgagcagcggagaagactgactacttctgggggcctcgaggagacaggaagtcaccaaatttacaggtgctgtggatgaaactgtgtgataatgaatttattgggcttgtttttttagcttctgaatagaagaaccaataagatcatttttttaaaaaagataaaaacagacaaacacaaaccctctagtataaaagcatttttttttaaaaaagatgaacacacaccctcagattgccttcttttgaaaaggcaatctgagattccttatgaaatccccagacagaagctgtttctttgaatttaatatgctgtacactgtagagccaagaggcttatagagtgttaattaacaccccttgtcaaacatttgtaaatgaatctggctaaagctcaaggaaaccaggtttttctgtgtgataaaatataatctttggagattatttatgatcacaaagggagactgtacagaaaattttcctagacttggaaatgaggcaggattattggtgtccatctggactgaggcctcaggcaggcctgcctagttaatcccattctcctatcctcattctctgggggtgaagaaggcagtgcacctttgttcaatttgctgcttaccatggattagggcattttaaattctgtaagggtagtttttaacttgtagaaaactgatagcgatgggaaggattcttgcctaatagggacacaaacggattttgttctgtagagatgtaaatgaaaagatgaaaatcacaacacatttaatgaaaggaaaataaagactcttgtgagtgccaccaaaaaaaaaaataaataaaatgtatctcctctccgtggcaccccaggccttccttacctcactctatttcttcatagcacttattgccttagaacattctttataatttacatttattatgtttgttgttggttgtcgctcctcctgctaaaatggaatctccgtgagggcacgggtttttctttgatttgttccctgttgtgccccaaagtgctagaatcatgccaggcacacaatagatgctcaataaatacttctggaatgaaaatccccctccacttagaccagtgagttccaaacttttttgatcttgacccatagtaagaaaggcattttccatgttgaatatacaccattgaaacaaaattttcacagaaaaaacttaccattattacaggcagtgcactgtgatatttcctaatctcttctattttgattttcaaaattgctgaggctactcataggttgatttcacaagtggagtttgtgttatgaaaaactttgacttaacaccatgtcgaaactgctaccacaaaaaggcaaatgcgaaagaagggggaaagagcaggccgatgactttccgctatccaccactccataaagcatatttcattttcctgtaattgtatcctgttcaatgatgtagaaatcctcacacactcacatgccactttttctttgggtgaaaagcgttctctactgcaagatgaattgagttatttcaaaagcaaagagctataaatgagcctgttaaagaaagtctcaaggagagtctgttggcatctgctgttgataacttaaagcaggagaattagataaggaggcagaagtagaatgtttagaaaataaaagtgaccattatagaggaaaaactgcttgtctcagttttgttgatattggagagtagctctttcatgagggtattgtggaattattggcaattatactaatagatgtttactgaaaaaatcctatttgactgatgaaccatggaatacttttgctgaccttgtggaaaacatcacttatctgagttccttatcttcttgtctcttttttctcatctagcctatgcctccctacctgttccctcatggttctcattttgttgctattagaaaaacagagatacaaaaaccaggaattggaacccctctgtgtctccagtaataattctgtgattaatgggttagatggattctggtcacaagctggatattttgttaacaacctagcgtcaatgacttggaatgattttcaccgcagcatgatttagtattgaatagaatgatttaactaatgttaattagttctgtacagataaattaatgaagcaagaagctcaatctctgatttattgatgtatttacccagtgtaagttatgaaatcttttttatttcatttgaaggaagtttttatttaaatacaaataaataagccctttattgtcacctactttggaaaagtccagataaaacaatcttaagtaacaaaactccaaaattacaacatgattttcaaaaactaccctgacctttgtcttgcctggttgttacagtgtacttttaactaaacggattcttatagaatctcaagtttggttatatttgtattaaggaactctatatttgcatttgaccagccctaactaaaacaagcttaaggaagaaaagggactttacgacaaggacaaaggattgaagaagaactccagggactttagatgttaacaactgtatttgtcactaaagtaaccattactgtcaaggtgggttctccttctccctcactaaacacatgcacacacaccacacacacatacacataccacatacataccacacacatgcacacacaccacacacacaccacaccacacacacagaaatacacacagacatacacacatgcacttatgcttgggtcagtttggcttttatcatcccagagagtctcttcccatgtcagcaactccagattcacttcctctcctaatataggacagtcacatgtctctattccagcaaaacaatctcagggaaggtatctcattggcctggcttgggtcattcaacttgaagtacaagaagagaaaacagtattcttttatttttatagatttcctgtaaaatcagtggataatggtaaaaatttcatgacagcaggtgttttaccttatttatgtttactatctctagaacccagtatgatagttcataataaatgcttactaaaacaattatcaaactgtacacttaaaaattaaaagagtaaattttaagttgtgtatgttttaccacagtaaaacaaaataaaataaacctattattgatcttattgtctatttctcaaaagtagcatacgtcataatttcatgtgatttctaaaggagatctaatctcaaacttagttcttagagtaaaataaaaggttttggcaatcatatacagcagtagactttaccttgaagatttaacaaaggtttgaaagcaaaatgctatgatactgaatatactaatgtttgagggcttgtgaaaaggtcttaatataggaatcatatatcttcttttagattgtgtcttggggaacattgggggtcagtttttctatcagtgttagtatgtagtaagtaatggcatacatctaagcttgagattttgctcatttctgtattcttagcacttatatatccaacatataataggtgttggataatatttgttgaataaatgactaaataaatgtcttggcatgagaattatgccatctacaaaaccgtcacttttaaaaaaaacaacaaagatttttgaacctgtagatccagccagaaagcaagaaatatcttcacctttccagactgacttattttttggtctagctgtgtactatgcatgagctgtcaactttaatactttattttttaatgcctaggtctagtgagttacaatgtgatgtagactgattgaattaaaggccccaatgttgtcctctcttcattgtatccatgccttttgtcatgtaactttgcagtgtcctctactctaggtgtccattcagcttatcctttgactctggccttcttctcctttgactctggctttatccatgtgacttactttagccaacaatcataatgctggcaaacactgagaaaatgcttattagtgtctgcttagtctcttgcttctctgcaattgccatgagaaaatgcccaagctagtacactggaggatgagacatgtggggcagaagcaacctgtcccatttgtcccagccaacaccatcctagattaaccagatgagaccagagcagaagacatgttcagtggagcccaacccagctcacgaataatatttcttcatgagcatgtgagcaatgtgtaactaatgcaccatgctctttttattctgcacttccaaacatctctcagattgccctgttgttttgcttttcagtagtcatcacctttgtccagaaccttaattgtatctgcattttggcagtatcctgccaattttccacatccagctgttcacattctaatgcattctgcaatggatgattttgagcatatgactgatcatcactgtctcagaaatttatgctaatctattgtgacctattctgtcaaatccaaataactttacattcaaaacttttcatattctggccccatactgtctattgtaatcttattttctaaaagccacaaactattaatcctgtagcctaattaggttgatatcatcattttcacaacacgttgggtaaattcttatatctgttcctttaatcatagtttccatgcttagacactccattgccctccctaagcaccagccagagtccactatggggggatattttaaaggctcttttcccctaacccatctgccccagaggtggcacaggctagaaaagatagtccaattatttggcttaattatttggatcttacagtttttttgggagagttccagatgatttgatgaaatgcaacatggtcaaaaacattttggtggagaataatttaatcaactagaccatttggtgaaaaataaatcccagttactagacttcccagtattaataattttggtatgccaggaatttttaaaacatttctaacaaattttttcagaaatcagaatgactgaaaggtataacaataggaaattaggaaatcaataagtaatcattgaaaagtgagtgattgaattagttggaacaatctatgccatccatcctgtgggggaaaaaatgaaaacagctaaacaagcagagcagacatcatcaacttagaaaaacaatatagtaaataatttgaactagaaaattttccaaaattgaaaattccagttttaaaaaatttgtgttttcttattcaaaaagcaatacatatttcgttacataaaagtcagaaaatcagagaagcagaagaacataataaatgcccactgtcctactcaatagagactataactgctatctctgtacaaatcctttaaaatcctgtcttatgtgtatttattttacatctgtacatatgattccaaaattaggtaatactgtacgtggtctatctatagctaactatagtttgtaatttaataagctatatttgtccatggtgatcatttattgctcataaaattaataaattataatttatttatcaacactgatcatttgttgctaataatttatttcatttaatgtcttattcctgggttattttaactaatccctattgttagccctttaggttgtttcaactaatttaagaattataaatggcccatagtagttacttaataaatatttgagtgaaaggataaatgaatgaataattccacattattggatgttcaagttgtttccattcaactttattgttgtgggggagtataatacaatcttggtgaagagccaccaacttaggaagaactatgaagaagcatgttatttactcctgcttgtgggtggggtgcattgggaaaggaatgcctaaatgcacgtggggagccaaacaagacttcacaggggagatgggaattgagccaaatttggaagaagtgagaattttcagttgataattggggaagatagtactaagagtaagtggggttcattaggaactacttcttagaagaggcaagtccagaacagaaggcagaaagggatatggatatgaaggaaaagtagaatgcaacttcagggctagtaggttggcatccaacgtaggtacagccctggatgaggagtaatgagaaactgacctggctgtagcaaaacagctaggctgggaagtgatgctgtttacatttatatgcgattctactggtcttcctgttactttgtagaagactgtaaggcttggtgctcagagctagaaatgcaacttatttgatttgctaagaagtccaaagcaggtaggggtgccaagctgctgcctgttcacacatattcgtctaactgggtgtcagggaaagcagatatgagcccccttgcattggttaaatcctgagcaacttttaaggaactgcacacagagactactggctattttttgtggataaagttgtagatagttatttttgggaaattatttatgtgttctattaggtggttgttttgtgggaggctgtttgaaattctgtcttaaggaactgcagcttataaaccatagtgctgatagaaataagagaaataatttggtctgcgagcacaaacatcaggctagttggcatgcttatgtaaacaccacacagtagcagtgacttttaaggaagtcctcagacaatgtaatcccaatactcttcttgaagttgaggtaatagggtgccagaaagaaaaagaaaataaatctctagtgccttctaaaattttttcaatcctttgacctttttgaaaacggtcacctttaattcagaactaaagtaacatctggagggcccttttcttagatagggagaagacataaatgagctatttgaattattttctgcttatgggctgcatttcatttcttccaccattggtctcagtccatttaattaagattatttgtaggattaaattaatcctttaagaattattccatttcaatttttaaaaaatctaatgaatgatagataacaaaaagcggtccattcagtattacccctgaaacatatttgggtgattggtgataccatccatgtctctccaacttcagcttcatatactcagctgagtaccaggcatcttcattgaaagctagacttgtgacctaaatagaacttgatcccttcccttccccaactccttattttttgttttctttgagttccttgattcctcttcccctcctcacatgcaacatgtaacatccaattcatcagcaggttctacagattctgccttcaataatagcctaaatctagccacttgttactatcttttttggtccaaaccatcatgatcttttgcctggaccattgcaatagttgtctaactggtatccttgctcccattttgtcctcctagatcctattttccacgtagtagccactgatttttggaaacttatcaatcattacccagacacaatgagtacatttacatagttgtttgattccatttacataaagtcccacaatcactctatgtactgggaatcacaacagtggtctcctatgttgagaattgattaagagtcacaaggaaacaaggagtaatattccattgtattaacagaccacactgttcatacattctcctgtaaatggacatttatgttgttttcagtttttttgctattgtgattaaagctattaggttggtgccaaagtaattgcagtttttgccattactttttaaatggcaaaaactgcaattactttggcaccaacctaatactgtaagtatctttgaacttaccaatcaaacattactacaacacttgaataagaaacacttccatagcatttacaattctaagtgctttccatgtattgacttagttaatcctcacaaggatataaccatgaggtgctattactatccctactttacagatgaggaaatagaggcacagacttcagataatttgcccaaggtcccacagctaataagggggcagaattaggaaagcctggctgagtctatgctctcatcacttgctcaactctgcctggaatgcccttcccgtaccctctaccgcctctgcccaatcctccgggttctctgctccttccacacacccccatctcaggtcccagtcttttttagcattcttcactttttctgttacagatcctcagacaatgcttccttgaagaagacttgcctgtctaaactgccttcccatcccaatccctgttaccttctatcctttctctgctttgttttcatttgttatctctcttcttcccaagaatgtaagctccataagaacaggatcatattttgaatcccctagaaaagtgcctagtgtaatatttgttgaatgaatatgatccctgcaattaaaagctaaatatatatatttttttaactaacagattactgtagtagtttcaaagatgaatttatgtttcggagaaaatcagtattctcttgccacataaattgtaggtaattatatttctatacctgaatagctttgccaatgactaagatattaatctattatatatttattaatctatagatctttaaaattgatgcacatgttttataagcaatttgatgaattttgatgactacatacacctgtatgtgtatggatatctgtaacaaatatccaagtaaagatatagaatattctcattaccccagaaagtttctttgtgacttctaatcaattctcacctccgtaggaaaccgctgttgtgattcccatcaccacagactgattttgggactttatgtaaatggaatcaaacaactctgtgaatgtactctgtgtctgagttctttcaatctacacaatctttttgacattaatccatattactgcctagaagagtagttcactctttgcattaatgaatagtattccattgtataaacaaaccacactgtttatacattctcctgtgaatggacatttgtgttgttttcagttttctgctattgcgatttaagctactataagcatttttttttaattgtgatggggtttcgctcttgttccccaggctggagtgcagtggcagcgatctcagctcactgcagcttctgccacgtgggtccaagcgattctcctgcctcagcctcccgagtacctgggattacaggcatgtgccaccacacctggctaagtttcgtattttcagtagagacggggtttcaccatgttggtcaggctggtctcgaagtcctgacctcaggtgatccacccacctcggcctcccaaagtgctgggattacagtcttgagccactgtgcccggccagcatctttgaacatatcaatttgtaagttttatcttaatattgtacaagtcttttggggggcttatgttgtcatttctcttggtaaatacctaggtatgaacttgctagattatagagaaaatctatctttaattttataagaaactgtcaaatagttttccaaagtggtggtactatttatactcccaccatcaatgtatgaaatttccgttgttttacgtccttgccagaatttgttggtagtctttttttttttttgaggcagcatctcactgtgttgcccaggcatacaatggtgtgatctcggctcactgcaacctctgcctcccaggttcaagggattttcatgcctcagcatcccaagcagctgggactacagaggcgtgccaccacacccagctaatttttgtatttttagtagagatggggtttcaccatgttgcccaagttggtctcgaactcctggcttcaagtgattcgcccgcctcagcctcccaaattgctgggattataggcgtgagtcactgtacccagcctgttgccagtatttttagttgtaggcatcttagtgggtgtgagtgctcgttggggttttaatttgcattttcctgatagtgttgatgttgaggacatttctatgtgtttactgagcattggtgaagattctcttgtgaaatatctattcaaatattttgctcatggtgggaaggggagttatttttcttttactactgataggtaggcttacgtatttatttcggatataattattttgtcaattatatactaatcataaacaaaaactgataaattggacgacgtcaaaattaaaacctgctcatcaaatgttagcgaaatgtaaaggcaaatcacatactgaggggagatattttaatatatgtatatttatatagtgctttctgtgttctaagaagtattttcctactccaagataaagagactattctcttacattttgttctataagttttatagttttagcttttagctttggatctatgatctgtctcaaatttttatgcaagattggggtttaattttttcatacacttttccagttgtcaaggatcatttgttgaaacgtctttcctgttgccacataattgctttgatgcattcgttagaaatcagttggctgtgggtttattttggaattttctgttctgctcctttgatgtatttgtctatccttatgccaatatcaccctatattaaataattatagctttataataagtcttgaaatcaggtaatgtgaatgtttcaactgtgtttttcctttttctagttattttagctgttttatgttcttattgtatatattttagaatcaacttattcatttctacaaaaagtttattgggattctggatgagatggtgttgattcagtaggtcaatctggggaaatctgataacaatattgactcttccaatccatgaaaatggtatctcattctttatttacatattctttaatttctgttagcaatgtgttataattgtagcaaacttgcacatcttttgttaaattattttctaagtattttacgattttggtaccactgtaagtggcattgtatttaaaatttattttctgtttgttttctgttcatatataaatgcaattgattttcttttttttttttttttttttttttttttgagacagaggcttactttgtcacccaggctggagtgcagtggcgtgatcagcactcactgcagacttgaactcctgggctgaagggagcctctcacctcagcctcccaagtagctgggactatgggtgtgagccagtgttcctggccaaatgcagctgatttttgtattgacattgtattctgccaacttgctaaattaacttattcgttttaatagtttttctgtttttttaaaaatcttaggatttctacacagacaatcatgtttttaatgaacaacaaagtttgtttttttgtttgtttgtttttcccttttcaatcaacatgccttttatgtttttatttgccttactgcactggctaggacctccagtacaattttaatagcaatggtgagagtgtttaaatgtactcctgtgtatattttattcttttggaacttattataaatggaattgttttcttaattttctttttggactgttcattgctattgtacagaaatacaactgactattgtgtgttgatcttgtaccttgcaattttgctgaaatcgtttattttttgcaatagatttttgtgaattctttaggattttccatatgtagaatcatgttatctgtgaatagggatagttttacttcttttctaacttggatagttttttccttcctaattgctctggcaagaacttctagtacaatgttagagagcaatagtgaaagcaggcatcttcctttcaatcctgatgttaggggtgaagctctcagcctttcactgtaatgttggctgtggattttcataattttttgtttgtttgtttttttgtttgagacggagtttctcttgttgcctgggctggagtgcagtggcgtgatctcggctcatcacaacctctgcctcctgggttcaagcgattctcctgcctcagcctccagagtagctgggattacaggtgcctgccaccacaccgactaattttgtatttttagtagagacggggtttctcgatgttggtcaggctgctctcgaactcctgacctcagatgatccgcccgcctcggcctcccaaagtgctgggattacaggcatgagccaccacgcccggcccataaatgcttttcttaatcatattaaggaagttcctttctagtcgtagttttctgagtgtttttattatgaaagactttcagatttttgtaaaatgcttttcctgcgttaattgagataatcatatgggttttctccccctttactctattgatgtaatgcattacaacgattttttttaatgtttacccatctttgcattcctggaataaatactagttgattgtgctgtataattcttaaaatatgctgctggatttgttttgttagtatttggttgcattcttttgcatctatattcataagggatattgatctgtaactattattttcttgtggtggctttatctggctttggtatcaagataatgctggccacattggctaagttagaaagtgttctttcttctattttttgaagagcttgaaaagagtcgtgttaattcttctttaaatatttggtacaattcactattaaagccactagtcctgggcttttcttagtttgaaagtttttgattactaattcaatctcttttacacctagattagattttgtattttttccttagccacttttggtaatgtgtgtgcttccgggaatttggccaggtcatctctgttatctaatttgctggcatccaaatgttcataatgttctcttgtaatcctttttattatagaaatgatatacagaaaaggtcagttaccactttcttttatgattgcattaatttgcttcttttctctttttttctctagtcagtcttgctaaaggttggtctgttttgttgatttttttcaaagaaccaacttttgattttgttgattctataatttttctgctctgtattttgtgtatatccattctaatttttattagttcctttattctgttagctgtgagtttagttggctcttcttttttattttcttaaggtggaagactaagttattgagatatatcttgtttttttttttgatgtaggtatttaaagctataaaatttcctctgagcattgcttttgctgcaatttataagtattggtatgttacatattcagttagttttttatatacacatttaagcttttgctaatctaccttgtgatttcttcattgacttattgcttgtttgagtgtgtcaacaatttccacgtatttgtgaatattctagttttccttttgttattgatttctagtttcatttcattgtggtaagaaacaatactttttatgatctcaacagtttaaaatttattaagacttattttctggtctaacatatgatctatcctggaaaatgtatcatgtgcacttgagaaaaatgtatattctgatttttttaggtgggtggcatgttctattaatatatatgtctgttagctctaggtgaattatagtgatgttcaaagcctccattttgttattaatataaccatgccagatttttaatgctgtccatttgcataatatgtctctttccattctttttcttttacatgatcactttatatttatagtatatttcttgcacacagaatgtaattgaaacttacttttctaaaatctactttcttttttttttttttgagatggagtcttgctctgttgcccaggctggagtgcagtggcacaatcttggctcactgcaatctctgcttcccgggttcaagcaattctcctgtctcagcctcccgagtagctgggattacaggcacctgtatttttagtagagacggggtttcaccatgttggtcaggctggtcttgaactcctgacctcgtgatccacctgccttggcctcccaaagtgctgggattacaggcgtgagccactgcacccagcccctaaaatctgctttcatagcatctgtcttgtacttggaacatttagtccatgtgtatttgaatatttattgatatgtttgggtttatgtttacaatcctgctatttgttttctttttgttccatgtgttttttgttttttatttctgcatcttttggaaaaatcagattttttggtaattcatttttcttattttattggctttttagagaaaccttttaatatctttgtgagttttagggattacattatttattcttattattattccatttagaattaatattgttaatcccattcaaaaatttgtttatttcgcttttcagttctagaattttcatgttttcttcagttgttgtttctctgttgttattctccatttgttcattatatctatcttttctttgaaatccttaaaaatatttataatagctattttaaagtcctctgctaatcccaatgtctgggacatcttggcttctgttgatattgaatacttctttttttccccttaattaagggtttcattttcctgctttttcacatatctagtagatttttattatgctctgtgtgctatgaatgagatattataggaagcctggtcaatattgtctctttttaaagggtgttgtatttagttctgccaagaagttaaattaccagatttacttgatgtggctttagtctttgttagagctggtctattcctgctttgttcttacttctcaggtaatgaccttcctgagtttcagctggatgcctgaagtgctcagctgcatttttctactctggctattctgaaatgcaatattttccagacctacccaacctttggtattcatctcccagacctgtggctgcttctctttgctgagcctcacaaaatcttgtcctgtgcatggacagccaaggatccttgggaaatctcatgcagacttctaggtccttcctttgtgtagatttcttctctccagtacgttgacctgcttcagagtcctcatcattgctttcttccttttcagctcagcaatactgctgtgtattgtgtgggcttcatttgcctcagccatacctagaacacaacccaaggcagaaagctggagtggacctgaggctcatcacctgtttccttccacccaccatttaaaagcagcttatttgtgtgaaactttttgttgggttctgtgggggatacgtataggcaaatgacagggagcttataatttagccaaagagaaaatgtctatatgttctgtggaattcagagtattttcctcgacttccaaaattattttcctcgacttccaaaatttggggctactagctagttggtaggaaggaattccagatccatttttcttctagatttttttcagactccatgtttcaaaatctagatggaaggtaagaaggaagcaaggagggcatcacatacgagagagacttataccccaaagtggatcattagcacattatgagataatatggtattattctcagaggcctgccatataaaattccttctaatttattttttaatggtatgtgcctgaaagttttctgtctttcatgatcttgaaagcaaaataagaaccagagtagcttatgagagagttttcctgcttcagcccagaaaaatgttgcttctgtcctagaccctttgatctggttcttagtgccagccttcattcctctagatctgtttattgaatactggctctgttgcagagactttgctagaatctgagagataaaagactcaatgccttcaaaacacctacaatccagacacttaaataaatgcaataatatatggttaaggtcttggatagaggaccatcatagaaacacatagaacagacatttagtccatgctagggagagggaagatgtcaaggaatgcttcctggaggtggcgacatctaagctgagttttaaagtgggtgtaagagtgaaggaactgggaataggcaaaacataccttagagagctgcacctccaaagcatggaaggctagataatcttagaacttcaagtggggttcaatgtgcctgggacttggatttcaggcagagaccatagggcaagttggagaacaggtgggcagggtgagatgaagcagagacttttaataaccatcaaacaggcctgccatccaactgctatcagccattttccctttttgaattttatttttttaatctctagagcaatacatgtttatggtaggaaatgaaaaaaatatatagatgggtaaaatgaagtgaattataccacccacaatcctgctgtaaaacaggttttaacaagttataaatccctccagatcaaagtgctactaaactctacttgctattttataacctttttctgttcagagtattttagaaacgtttttacatgttaattgatattcttttgcattatcctgaataatggtatttctttagttatactatcatgtattaaaacattcatacatggtaaacatatttgaatattagacatttcaattgttttcaatgtttggctattaaaaatagtatttagatgaatgttcttggccatacagttaataacttcactgagtccttgtcaataactttattaaatcccaatcttaagacaacaagcctataagattaacataccaggaataattagaaagcattgcaagactatatgtaaccatctccctgttaatcatccttatttgttgcaacatcctaaatagcgaccttcccacactctgcctcataatatttaatctgtcaaatgtaccatccgcaaagggagtgaactggctcgtgaagaggtggtgaagctggttcaactcagtttaacagacaatgagggcctccgtgtgccagggagggagtgagggaactccacagggagctcattctggggagggatgcccctcattatctgcagtaaatgatattagagaagtatgtgtgagactcttggtgtccagaggaggggcatgcagcacagtatgggggtccatggggttgcagcgatttcttagagacggtgccatgcctgggatgaccaccaagttaggatgctgtaaagagtaatcaaataagtttcaacagggttttggcatgaggtgagcagttaatccaaatgatatctgaaatgctttctaatgctgcaagtgtattcctctgtaaaataatcaactacttaaaagacactctcacttgcattatgtcatttaatcctcacagtgtccctacgggacaatagatgtcattcccacttgtacagagcagtaagtgaggctcacaccggtcatagttagaggagtagggaatctaaacctaagtctcttctactccaaaccccaagttttatcagtatgtcacatcgctactgtgggctgaattccttagcaggggttgtttcctccacctgcaatattcttccttttggtttgttcatcctctagagagagaagggatacgcattcatggagatcctactgttgcaaactctgcattaggagttttacatgaattgtctcatttagtcctcacaacagtcctgtgaggcacaggaaagttagatttacctgcccaaattaaggaatgtggccaactcaagagtgacgaaggccaggtgcggtggctcatgcctgtaatctcagcactttgggaggctgaggtgggaggctgaggatcgcttgagcccaggagtttaagaccagccagggcaacacagcaagatttaatctctactagaaataaaaaagaaattagccaggtgcctgtagtcccagttacttgggaggttgaagtgggacgattgcttgagcctgggaggtagaggctgcagtgagccatgatcccatcacttcactccagtcagggtgacagagtgagacccagtcttaaaacaaaacaaaacaaaaaagagtgatggagcaggaactttatctgccatcagagaccatatatgtctttccttatggcccaggtcatttatcatgtccttgctaaacctcctcctctgagccttgttaaagtcctcaaggttagaagagtggtctataattataaaaaattccattgtatgacttcagctacctgcaaaactgaccgagattaatgcattctttgtttgctttcactctttcattccctgttcagcgcttattctacagaaaggtgcctggtagatttaggacatgactgttcataggcctcaaatgcggtcaaattaggaaagtcccctggtttttggtctcaagaggttaattgctgagtactagcctggactgctcaatggattttatgtttaactgttgtgtttatttgtttgtttgtttttgttttgtgagacatatctttctctgtcacctgggctggaggtcagtggtgtgaacatggctcaccgaagcctccatctcctgggctcaagtgatcctcctgcctcagccttcctagtagctgggactacaggcacacagcaccatgactggttaagttttggattttttggtagaaatggggtctcactctttgcgcaggctagttgtgaactcctggtatcaagggattctcccaatgtgctgggatttcggcctcccaaagtgctgggactgcaggcatgagccatcatgcccagcctctgtttaactgttaacatcatgaggtttcctttcaatgaggaagggaggcctggggaggtgtgatggggaagatggagaagggtaggagacatcataaaactgacagaagtgtggcacgattaagaccctggtttcttagaccacataagcaagtgccactattcttttgatcaacatttgattctctatttccttcttagcatatagatagctgcttcaggtcgtgaaaaaatacatttagtgaaatgaaacatagtagatatgttcaccaagaaactaaaaagaaaagttagccacaaactatcttatttcattgaaatgtttggctgaacccataagaatgttgatgaggccattcttggatgcctgtactgaaatgaaccacgagaggaatatttaggatatgttgaagaggctgtttggcttaatgaacaaaggagtttctgcaggcccagggagtggaatgaaaattggcatgatcattttggagaatatatggagtcaaacagagaatttgaatggagttttcaaagaggatatgttaggggaataaaggctgataaacaacacttgtatttgtaggaaaatagggagagtaaatcaaggaattcaaagagaaagagaaactcacttcaagtaggggagaaaaaacccctataattttcactcttccttgtaaataaaaaggaaacaaatgaaaataagatattagaagtcagtaagaatttatgggagtataaagttggttttatggatgcaaagcccttttcactgctgtacgaaactcctggctgcatgctaacaatggacaactgatttccttgcagctgtattttgctgttttttgctcttggcttggacctagcaccctgggtctgtgggaaaccagaactgtcccagagttctggagggtaggccaaggttagatgctggagtgggttctttaatttattgtactgattcttcttgggaagaaagaagattgcttgttagaattttagctacgagagatgactatgaaacagtaaattaactccaacgacctgagtcattttgaaaactcccagtctcaggataaaaaatataatcctatttagaaattcctggtgtgatcacagatgtagcattggttcttttcatgaaacccgtaaattaaaaagtacataatccaaagtcaattaaatagtaagctattataacaaattcttttatttcattagcttttcaaaatgtggataactacacactcaacccaaggaatctacatttttccactgactgctaaagaccaatggaaataactctagtccccgtagcacctcactgtggggtgacctacctttgaaataatgtattggttctagctgatttttatattgttagtcattaagttaggcttgatgagaaacagatataatctgatttggggattcaagtattatattgcatttctcctcacaactagagataaatttgccatggtttttctcttcataggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaaggtatgattgtgggtaaagttctcatttcctgccaaaatcttctggaaaaaaatctctaagattatctaacataaatgatgtgaatttatatttttaaatcctaatggagacattcattttggcaatagtagaatgcattcatttaacacctttctcatttggagtcttgaggaacttgaattaatttttaaaaacccatttgtaaatgagaaactgggttataatatttgtaattacttaactttcagttattaatctagatttttagattaaattgaacataaaacaaatcccaggatatctagctctctgcacatgtttttcagttcttgttattttggttgaataaaacactttaaagaaaaaggaatgtccatgttttctagagaaaatagtataaatagatcatgcttttaaagccttcatttatttatttattgcatcagacacaaagctgggtgtctaggatggaaagtggtacaagacatctttccagccctgtagaatatctattataaataaggaactattttttcaaggtgctcagaaatccaaaaaacatattagataggccaattttgagggcatttatttgtagagttatataggtttgattagagtctttcgtcaagaagaaaaatcattggcttaccaaacgagaagcattacactttatttatttaagtaggaaacgctcagctgctcttgaaccatgatgcaagtgcccagcgaagggtcatgttgctcttgtcccctcttccctttgcagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtaagtcagctgacaaaaccaatcagcagtctcaccaagccctatcactagtaagtagtgcttccttcctaggctgattgtcatggcacattgtccgttctttgagccaaaaacaattccttatgagtacactaagggcacaatttggaatgctgcacccttctctccaaaactcttccaatcttcatcttgtttaagttagatccaaagataaataaatttaaagcatatcaatatttaagatccgattaagacagtaaaaagataaaacactctcttttcatactgtggtttttgatcctttttaaggcagttgagttttttcatgaacaggatctaacacagaactccaaagcctctgagtttcagtggtgctgctgagactgaggcaggaacattaggcagagtcctccagaggcacaactgtgggctccacaaatgtgcagaaataccctaagaaagtaaaccctagatccaatgattcactggtcagaatgtcttttttagcaatagtcattgaaatgatacgaaatttcttcagaatgatcaaccaatatttattgagcatcttctcagtagtaagcccttaacattctttcagacttcctaaattttgaaggggcttgttttccagcatttgactggatactctagtaagcacttattggatgtctagtgtgtccgaagccttgtgttagttgctcgggtcgcttggttaaggggagtgcaggtagagggtatactgagatgagtaagggtaacctttgctttcaaaggagcaaaggagtctactgagcgaaaacaatgtatgcacaaatgatgcaatggagtgaagcgggcatggtggtaagtaacaagggcggggctgggggattgctgctgatagagtcccaagtgtgaaaatagccctcaagacagagacagagttcagtgtccatagacaagcagttggctttgacatgttgggttatggtagccaattaattggttctgcaaatcacagcttgaaaggaaacacttggaagaatgtgaaatgggttgctgttttcttgtaaatatccaattgaaatcttttatttataaggaaataaattaacaccatccttagtacattttttgctggttgggattattcttctttttcagaccacccagttcattttacaggcagtctcagacttaaaccctcgccttccatttaaaagatgactggctcacgcctgtaatcccagcactttgggaggccgaggcgggcggatcatgaggtcaggagatcaagaccatcctgaataacacggtgaaaccccgtctctactaaaaatacaaaaaaaaaaaaaaaaattatccgggtgtggtggcgggcacctgtagtcccagctactctggaggctggggcaggagaatggcatgaacccaggaggcggagcttgcagtgagccgagattgcgccactgcactccagcctgggtgacagagcaagagtccgtctcttaaaaaaaaaaatgactggatgtgtcatcttttatgccaggatatgtgagcccaggagaaaggcttctgagctccctcctgctcggtgtgcaattttctgccctgccccgactctctccttctctcccagcctcctgctatttgaaatctccttatcctaatttccctcctcagagtggattccactgtggggttcagagaggatctgaggtgggagaagtgaggctggtgaggaagaaggggaggagaaagggaagaagacctccgtagccttccttcctcctcctctttactggggttggggatagatcggatggtccctggtccttgttctatctcttgaccttctgcctgctccctgctgagcacggatctctgatagcagcctgagtctggcaggttcagtcctttgtatgcggcacaatctcccagccagcattgctgtgcagatcatgggaacgaatgcagaacaagagtgggggtgtcggagggagccctacttctcctgttctattcctcatcagggggctgtgcgctggctttgggaattggtaaatagtgagaaagtcttaagggtacatcctatttccttgagggagaagagaaaacgctggtcagaagcaataagtatagcagtgaatagcaagggagatgggagataattccttttcctactacactctagaagctattgttttagaatctgacctaaggtcagccactaattggccccagaggtctctctctcagatcacacggtccttttttcctcatcagcttggggaccccacccctcctcctggcagtctcctcctgtgcagaacccaacaaacacaaaattaagtcactctcaaacccacagcagatgagagcttctctggaagctccctggtggggaaaggctgcaattgctattttcttcttctggttttcacctcaggctttgtgttatattgacagtacccttctcaagctaactccctaactgacctgacgtagtcaaaataagttctttgtatgtcagttctgaggtgtgtgtgttttcacttacaaacagtactctacagctttaagacattatattaaagtcctgagaagtgatttttaaaccactgaacttcatcttttccctcctggctagtatttcagactttcagtgtttgaggcatgcatttcacctgaacaacttgaaaaataatatcctaagaagcacacaacctgactttaggctcattcacatggattgtcactttacttggacccactttctcggctgagaggtttgttttcccataaccacggatgctcatagttaatataaatattgaactcactatgtagtgaggacatagagcctctttaacattggtccctgttaggagaaagtttctcccataacatactaaatacatgttttaatagccgttccttctgaaaggtccaacttcactattttatttttttagtaaaatcttagttaacaaattaatggaggttaggtggaattttgccccaaaagtcctgtattttctttttttttttttctttttttttgacagagtcttgctctgtcgcccaggctggagtgcagtggcgtgatctcggctcactgcaagctccgcctcctaaggtcacgccattctcctgcctcagcctcctgagtagctggggctacaggtgcccgccaccgcacccggctaattttttgtatttttagtagagaccgggtttcactgtgttagccaggatggtctcaatctcctgacctcgggatccacccacctcggcctcccaaagtgctgggattacaggcgtgagccaccatgcccggcctgtcctgtattttcaagaaactttttttttcctccagaaatgataccctagtctttcatatttgttttcagatggactgaataaaagctgttgttttggaacaatcacggttaaaaaaaaaagttatgaatttagtcaactcagagctctataaaaataatccaaaaaattccttcaaactctgaacgcttcaaaagagcgtgcaaatattctgtccttcaaagctaaggaaacatgatttgtggggtgcatcacagtggaaaaatactctgacagcattcccacagcattaggggaagtgcatgtgtgggtgttctgcaagggacaattctccagaaaaggcaatttccctttgacatgctgtttttaatgacttttctttataaacacacttatctctccagagaaatagcagtgcatttgcaacaggcccgtaaaatgcaacaaaacctctgctatggtttctgacccctgcttttatacagagcatcagaccaaggaacctgttctaacaggattatttcagaggggaacacaggcttagggtgcagatcttccagctggatttttcactttgcattccctccacagcagacacatgaaggaatgattttgtgattttgattttataatttgcacacttttcctaaatactttttttaaatttttatttgggaggattttatagcatatgattgagaactataatcatcatcattgttacagaagaataatttagaaaaattttttaactacgttaaaaattccactatgggtggatgacaatattgttctttccttccacattctccctccttagactttcttttctttttttctattttttttttgagatgaagtctcgctctgtcactcaggctggagtgcagtgccatgatcctggctcactgcaacctctgcctcccgggttcaagtgattctcccgcctcagcttcctgagtagctgggattacaggtgtgcaccaccacacctggctactttttgtatttttagtagagatggggtttcaccatgttggtcaggctggtctcaaactcctgatctcatgatctgcccgccttggccccgcaaagtgccgggattacaggcgtgagccactgcgcctggcctctctctcggactttctaccatcagtcagattgaatttgttaaattctgtcactgaccctaaacccaacaaaaggcaagagttatgtttatttagcacttcctctacctatagcaaacctcaatttagagcgtaattttaagcacaatttaattataaatatcttttcattttcttacttaactcactcagttttttaaatcttcttttttgagacaagatcttgctctgtcactgaggccgatgtacagtgatgtgatcatgacttactgcagccttgacctcccaggcttaggtgatcctcatacctcagcctcccgagcaactaggactacaggcccgtgccaccatgccgggccaagacggggtttggacgtgttgccccagctggtctccaactcctggcctcaagtgaccctcccgcctcggcctctcaaagtgctgggattataggcatgagccaccgcacctggccaactcactcacattttaagttttttctttttttcatctagttttttttctttttaaatttgaaagcctcatgacattaatgatttcttacattaaaagaaaaacacccaaaaatactctgcttacataacaccgacaagtagtgtgcaagactcattagcatttgtcatctgaagtgaccaaatccagacttttgggggtcacattaaagaaacagttgaagagttagaactatgggtaaagcgagtgtgcatatcagaaagtggaatattgtcttcctcaggagctgacaatttatgaaaaatagttcacattctcagctagaaaggcttctatttttgctcatattcctggctagttttgctgaaataattgctttgaattacttcctcaggactgcccaggtgacgctaatgtttactctgcccttcacaggtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggctgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaatggaatcgatgacgggctgcatgctgaggacgaccagctgagggtgtattatatgcagaattacataaacgaagctctcaaaggtaaggagccctagctgcggctatctcctgaaggttatgtcaccagagggcatgacacttgattaaatctccaacatcaacacacactgccacccttggaatggagggctatccattttgtgcctcactgaaacagtccaagagatatctagcatttccccaaggataaaggagtgtagctaaaagtagaagaccagaaatccctagcccctactctggatctatgcaagcctagattcttgtcttccatcttggatggctccacagcagtcttaactgtttcatgtacataaagcagtacataaagatttaaccttgctgggcatggtggctcacacctgtaatcccagcattttggaaggccaaggcaggaggattgcttgagcctagaagtttgagaccagcctgggcaacatagtgagaccttgtctctactaaaaatcacaaaaattagctgggcacggtggcatatacgcctgcagattcagttacttgggaggagaggcgggaggattgcttgagcttgggaggtccagctgcagtgaatcatgatcacagcactgcaatctggcctgggtgacagagcaagacactatttcaaaaaaaaaaagaccaagcatggtggctcatgcctgtaatcccagcactttgggaggctgaggcaggtggatcatctgaggtcagaagttcaagaccagcctgaccaacatggtgaaaccccgtctctactgaaaatacgaaaattatccaggtgtagtgatgcacacctgtaatctcagctactcgggaggctgaggcagaagaatcacttgaactggggacgtggaggctgcagtgagccaagattgcaccattgcactccagcctgggtgacagagcaagactccatctcaaaaaaaaaaaaaaaaaaaaaaggatttaacccaagtatatcatagtagattgaattatgtaaaacacccatttaacaaccaggtccaggtttgttctctctgtgtagtaaatcaatcactgtgacacaggttttgcaaaagagaaaagatttatttgtaaggggaccaagcgagggggtgggagaataacttccaatcctgcctctctgaagacaaggcttaggaatatgtatgggttagggaatgggtggtctaaggcatggtgaagagtgattggcagggggggaaaatgaagtaacaggttagacacatgcacagaaaatggtggtgttagcatgatctgagggcagagttttgggccctctgacgtcaaaagaccacctctcaggcacttgtgcaggcccagtggaagggtcagtggtcttaactagtttgaactggacaggagctgccccaagttcttggaaaaacaactgaagtgaccattgccatggtaacctatgaatgtcatcagtaaagtagccagtgaaggttaagtttcagcatacaatgggacaaccttcagcttcatggaaaaaggaaaaaaaaaaaacacatacacacacgaaaagcaagtgaccaaaagcaagcaggacaggcagacctgatccaattaacccctgggtttcaaccctgctaaatgcagctcaatatttgtcttgataatttgcctatttggctttacataaaataaagccttttctgatgaaatctaattgagtctgaagttgtattaaatggtatcggaaacttcccagcaggaaggctacgtaaaagtggccgggcgtggtgactcacgcctgtaatcccagcactttgggaggctgaggcaggcagatcacaaggtcaagaaatcgagaccatcctggccaacatggcgaaatcccatctctactaaaaaaaaaaatacaaaaatttgccaggtgtggtggtgctcacctgtagtcccagctactcaggaggctgaggcaggagaatctgttgaacctgggaggcggaggttgcagtgagtcaagatggtgccattgcactccagcctgtgtgacagagcaagactccgtctcaaaaaaaaaaaaaagtgatgtgttgtgtgcaaaatacgtaataactactctcctatccttttgtttttccagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtctttactggctttcatagcttttctattttttgcttctattatttctctctcccttatattttactactcgaagaaaggcagaagaagttacaaatagttctgaacatttttctattcattcattttgaaataattatgcagacacatcagctgttaaccatttgcacctctaagtgttgtgaaactgtaaatttcatacatttgacttctagaaaacatttttgtggcttatgacagaggttttgaaatgggcataggtgatcgtaaaatattgaataatgcgaatagtgcctgaatttgttctctttttgggtgattaaaaaactgacaggcactataatttctgtaacacactaacaaaagcatgaaaaataggaaccacaccaatgcaacatttgtgcagaaatttgaatgacaagattaggaatattttcttctgcacccacttctaaatttaatgtttttctggaagtagtaattgcaagagttcgaatagaaagttatgtaccaagtaaccatttctcagctgccataataatgcctagtggcttcccctctgtcaaatctagtttcctatggaaaagaagatggcagatacaggagagacgacagagggtcctaggctggaatgttcctttcgaaagcaatgcttctatcaaatactagtattaatttatgtatctggttaatgacatacttggagagcaaattatggaaatgtgtattttatatgatttttgaggtcctgtctaaaccctgtgtccctgagggatctgtctcactggcatcttgttgagggccttgcacataggaaacttttgataagtatctgcggaaaaacaaacatgaatcctgtgatattgggctcttcaggaagcataaagcaattgtgaaatacagtataccgcagtggctctaggtggaggaaaggaggaaaaagtgcttattatgtgcaacattatgattaatctgattatacaccatttttgagcagatcttggaatgaatgacatgacctttccctagagaataaggatgaaataatcactcattctatgaacagtgacactactttctattctttagctgtactgtaatttctttgagttgatagttttacaaattcttaataggttcaaaagcaatctggtctgaataacactggatttgtttctgtgatctctgaggtctattttatgtttttgctgctacttctgtggaagtagctttgaactagttttactttgaactttcacgctgaaacatgctagtgatatctagaaagggctaattaggtctcatcctttaatgccccttaaataagtcttgctgattttcagacagggaagtctctctattacactggagctgttttatagataagtcaatattgtatcaggcaagataaaccaatgtcataacaggcattgccaacctcactgacacagggtcatagtgtataataatatactgtactatataatatatcatctttagaggtatgattttttcatgaaagataagcttttggtaatattcattttaaagtggacttattaaaattggatgctagagaatcaagtttattttatgtatatatttttctgattataagagtaatatatgttcattgtaaaaatttttaaaacacagaaactatatgcaaagaaaaaataaaaattatctataatctcagaacccagaaatagccactattaacatttcctacgtattttattttacatagatcatattgtatatagttagtatctttattaatttttattatgaaactttcctttgtcattattagtcttcaaaagcatgatttttaatagttgttgagtattccaccacaggaatgtatcacaacttaaccgttcccgtttgttagactagtttcttattaatgttgatgaatgttgtttaaaaataattttgttgctacatttactttaatttccttgactgtaaagagaagtaattttgctccttgataaagtattatattaataataaatctgcctgcaactttttgccttctttcataatcatatgagtggttgctagctaatttttttgtaattaaaaaaacttgagttgactaagccacctaagatgtgatgggagcagtggagaaatgggtgtgactgcaagaggcctgacccacgcggctggaagatggtaggggtgggagggcgacccaggctaggccatgtgtggagcagagagaatttcagagatgagacagcgaaa

SEQ ID NO: 138 - DNA, 2914 bp, Homo sapiens
ggctgagggccggagaaacagaccaagagacatccgccgcgagggtgcggcgacctaacaagcggctcaggtatccccgactgctttaaagctcccgcttcctccctccgcctggagagggggtcccgaggcggcagctggggccccatctattgcctgctgactaggggagggggaaagtaacagtgtctacaaagggcctagtggtaaggaatgaaacagggcgttgtgtggagcaagtctttgggcaggcttgggaaggagaaaacagggtcgccggggcggtaggtgaagtcttcggaggcggctgggctactggggtcagagagcggggaggcggcggcggcacctgagccccaggactccgcgtcgctggcggggcttgggggaccgggcaggcaggggacgcactgcggcggcaggaggcgctcccgggcaccgcctccgggcagcccttgatccgccaggcgcagtgtctcggccagagcccagatgtagttgtaggcgaagcgcagcgtctcgattttggtgagcttggtgtcgtcggggaacgagggcagcacgctgcgcagtgcgtccagggccgcgttcaagttgtgcatgcggttgcgctcgcgatcgttggccttgacgcgccggctcctgcgcagcgagtgcagcagcgcctcggagcggacccgcgtccggccgcggcgccgccgcctctcctgctcgtcgtcctgtgcccctggaacctcagacgcccgggagatattgggcgcgcccctgcgggccggcgcgggcggccccgaagcggaggctgcctgttggagtctggcacagtcttcctcgtcggtgaggaagccggataggtcactgccgctgctgctggcgcagtcgaggtcggagatgcaggtctcaaggcgggctggcatcgttgcgctgtgcaggaccgacggacagatagaaaggcgctcagagcgctgcagcccggactgagggcagagccgccagggcgcacttacgttcccaacagcctggggttgttactctgtgccagttgcgggtgcgagagcctggaagggtgcaggggcgcacggagaacttggcctggcctcctcgcctcgcctgcaggggccacgcgcccggccggtctcctgagtgatgtcgccggcgatcagatcagctcgtgtgagcaccgagtgtggcacacgactggcctcaggaccccttaagtacccggcgcaacaatgggcgcccccctcccttgccacctccgcccccgcggcagcccgggtgaatggagcgaggcggcaggtcatccccgtgcagcgcccgggtatttgcataatttatgctcgcgggaggccgccatcgcccctcccccaacccggagtgtgcccgtaattaccgccggccaatcggcggcgtcgcgcggccccgggagtcggctcgggctaagctggccagggcgtctccaggcagtgaaacagaggcggggtcggcgggcgattagcggccgaggcacgctcctcttggggcgggctgggcgcccctcgctggggtgggacggggaggcggggcgcgagcgcgaaagtgtgagccgcccagtgagttgcggaaacctggagggtacttggagtttgggttcgcatcccctctccagctgcttagtggtcgcgtgactttggacgagtaatttaacttccctgagcattgctttccccacctgtaagatgagacaaaagtttaccctgtggaggatgatcagatataatgtttgtggaacactaaatgtgcagcatccgctgaacagggtgaaaatcattttcaaatagactggagagtggccatgccagaggcacagggcgcagggcaaggataagtgtcgctgctccgttcaggctgatgaagaaacgggaaagaatctgaccttcatctggggagtgcgaagaggagagtggaaaagaggatcgggtgatttcccaggttgccttgagtcttggtctcacccttcccttctttcccttcccttctccaccctcctccgcacctctgcccacaagtcacctcaagattcttaataagaattaataatatgagaatttatataaataataatatgagaatataattattaatatgagaatttccttttctttggcgttcctgaaaccttgcctgccccatgcccggagaaatccgttgcacaccgtctcttggagccctgcttgcagcctctgtggccctcttcagggtgagccagccaggggatccagctcccctggcccgagagagagctggcccctggagggcagcaggtgacagtggaacccctttcctccaaaccccctcccgccttcggtgtcttaaactcgcctattccagcaggtcttccctctgcatgtcaggagttacttttctcttgtcacctacactcacccaggagccacaggggcccagacatcacccaactttgtacttggaggataaatagtaaggaacagcactcgattataggatgagggtattaaaaacaaaatgagcagctttcagcaaagtgcctgccccccacctgatatccaagtggtagcctcaggccggatgcctggcctgctgccatgggagcctagctgactctttgggttggggggggattggcccctttgagaaagggggctgtgtagtggcagttcccacctcgactcactgaccagcgcttgccttctggctcaggggactctgcccagctgtccccttccccgactgcaccctgcaggtacccctgatctcagtggaaggctaggacacagtcatatataagggctcgagatttattagaagtcacagaaagtggcttcgaccagctcactcaggaaagggcagttgttggatggatacgggggcttctcaagaactcaagggcttcgaggac

SEQ ID NO: 139 - DNA, 159782 bp, Homo sapiens
tcttcaggtctttggcaccagggttaagcttattttgaatctatgccatattagcaggcgaacattgccacactgacatttaaatgcccaccatattatcttaaggttcctgaagcaggggtaactctactttcagtaaacaaaaatcagattggacaatcggaactgtacaagttctacaaaagcatgttggagtcacataatgaaaaagcagatttttttattatgatgtttctccatatttggcattgctgtaaatggctaacatttactgccaattcggtacaaatgtgtggtttggtaataccagaacagcaaatttaaatgaaaaaataaaagttaaacatttccacacaaggttttacagtctgacatttcactgcgtaggtaaaaagacactttttttttaactacagattattattcagcatgaataaaaaactacaacttttatttttaaacaggagtcactggttttaatttttacacattttaaaattactgtgataaaaaataatgaaaaagcttcttaataatgccatacacagtataatatagatttgtccccattatatagcatttaatatacaaaatagaatattgacacacttgaatctatatgtagttaagcaagttatttgaggagggtattttcatacagcctttcatcagaaaataaaatcctttcagacattttctagagagaagcaaatcctttcctgaaaacctggtcactaatcctgggtggaccaggttgcttgaaaatagtctgggaaattacgaaactccacccaaagggtttaaagtgtcctccttacacttttatttcccttctgacactaaaaccagacacacacacacaaaaacacattcacctacagctacagtcagggagtgaccagccaagatggaaatctcactgaaggctaccatggttctggaagtttgacagatcaatgtattgtataacaatatttttcattccatggtgatgtagttttcagggtttttaaaagggaactaaaattatgagacttaggtgaaactggaattgctccctgcctctgaattctgaagggagcgtggctttccttcatggcatgcccagagctcatcccatgctaattatccagcacttcatagacacaaatcatgttagttttccttttggggtggccaaggtttcctcccatagttttaggcatttggatatatataccccaaaagtgttatgtcctaagtgcctcagttctgcttgtatagtatcccacagaatacctacaaacactaaaaatacttttcaggatttgttgtgagtaaccaactctcactgaagttactacaaacttcaacagtttgggttgggatggccagataacacatacataggaaataaatctgctttcaaacagcaccaccatatagcacttaaatccacaattaaacataattaagatgactttcttttcccccacgtatcctaaaagggcacagcttcttttcccatttaatgaaaagcctcctatagttgtcgatgagcatcagttgacttattattgacaacgaagtgcacataatcttctttttctcattgagttctattttttgagcgccaagattgttgggatgaaaatcagattaatgtgtgagatgtgctttctggttttaaccacataacattctataaaggaatgataatctacgttttagaagctctttttgaaacttaacactgtcattgataagaatattcaagcagttttcttaggcaccaaaaatttatccagccgggttacacaccatcttaaaatattacattcccttttagagagcattcaaaaagcaaatgattgtttttttattaaataatttctccaaaatactgaaaataacaaataacattcaaaaagcattcaaagaaaacaaaaacatgtcctcattttatttggaaataaactcttgttgtaggatagaaaggaattagtgtattattggcaacctatgagattctgcactatttacatattgctggtacctctatgcaaactattgccaaacttctgaagcttctgttgtcattcaactgctgggggagggctgtatgtgaaagtaacccgctattagatggtgcctttaaggatgtaagcaccaccttcctgtctcctgtttacatactttacatactttagtgcaaggggagattgagtaaactaaacctgcgctgacagactcactgttggaatgagaagggtggtcagaatgggaggcagaggataacttcctctgtaatctcactgggtcagagcctcagcaaccttcactgcacacaggaccagtctccatctccctcttcccctagagcaaactgtttggtttctgagaccatcgctgcctgtatgaatgcatgtacaaactataaatcatataggttatccatcagcatttctttgacccctacaaaaaatatataacatgtcatgataaaacaatctcatctaaaaatcattcttattttacactatacaagctattttacaatcattttaataaattgcatgtaaagctgcagtagcccttcccttcccagattagtgaataccaatatgatatatatctgaaactataactaaatataaaaatatattagaagttccatatttttaatattagattttcagttttctattacacaaataatttggccaccttgaatagaaatcaaatttcttgtggcttagtaaatatgttaagttttgagtttacagaaagttggtaaggtgcacacagaaagggctactacagcttctattttgtttaaaataattttcaacagtgaagaaattcacaggacttgtgttaaactctatggcacacattagggatgtgtagttttacaaacatggatgtctgacatacagttctaaatcacaaaaatcagtagctgagctttcctgtaccatcaggaaagattaaccaattggtgacagatgggaatgtgaaaatgggtgtctagccatttttgccatattagagatttagtttttgggtaaagtttagtgagaggaattactttgtctgattaaaagtctctcagctgtgttacagctggttatctggaatcacaacttttaagaagttatacaaactacttcaaaaggtcctgaaagacaaatagtttaccagctttcttgccatatagccattgcaaaaatagggcgttaggtacagacagggcctcttggtagttattttttaaattagtcttttgcaaccatcatccacagtttacccagcaggtcactggactaggtgctctataccagttaggactgttaatttgcacaacctatataattctccactgaagcagatatatacaaaatatgagcttttttttttttttttttgacaagaatactggagatttgagtcaatttttgtggtcttctgatagctaagtgccatcaggttagaagcaccaacccattttcacacagatgattgattaatgtttagagtttatttgggaaagctacgaactagctgcccatcttaaacagctgtacaataacttgaataaaaaattatgtaagaaaaaatgagcaagcgtagttcactaaatataaaggaaattgttaaaaccagacagtaatagctataaaaggcacaacttcccttttctgatatacacttgtaaactttttttcaggtttccatgcataaatcaaaaatgctatcctaactatacaggggggggatacaccaacagaaagtctagaaaatttcatccagccaactgtgaaaaaaagtatgaagagaaagttcatcacacagactttgggcactggtggtttaggtgccatccttctttgactgtggagattacgtccacatattaaggtttctaatttctgggatatattaactaataaatttcaccatctactctcccatcactgaaaagtgatgacgactcaactgcttctgttgccaagtcttggccctctataaaccacatgtagtgcgtatttaaaacaaaacaacagatgaaaacaataaaaaataaaacaacaaaacctctacaggacaaactgatagtttatacaataaaagctattaattcgactttctttaaggcaaccattcttattaaggcagtcacttttgatgaaacagaagttttttgatatttccatttgaatattttggtatctgattggtgatgatttcagctaacatctcggggaattcaatactcatggtcttatccaaaaatgtttggaagcaatagttaaggagattttcaaccacctgcaagagaagatatggtaatgatcaggcttccaaattggtcagtgggaacatctcatgtttgttgtcctctattttgaaaaaattatctggcctagaatataccaatctcactggaattccccagatgaaaaataagcacttccgtacaaaacacattttatatttctttgattgtatgtagaattatatagaattatttcatgaatcactgtagtaccataatatatgaagggtgcattattctaatttaatggattaatcatactttttaaaaacagtattactaaattctgtaataacatggtgattttatatacacatgactaggtgaaaggatatttcataattggccttaggaaaaatgtctacaaaactgaagttcataagttgaactcaagctatcaccaacatccacaaactgggggcgggggtgggggcgctgctggtatataattatattcactaatcaaaacatactttgtcccagaaaactcttatatttggctttatgtttgacacttacttcatgcatagaatccaagagttttgtcagttgataaaaccgctgccagttctggctggagtttccttccctcttgacaatggcttttcctagctctttgatgtaggtcattctaatttcatcaaatagctcttggctcttcagaccgtccttaggaactaaaaggttaagatgaagtcagttaaaggattttctttttcttttcttttcttttttttttttttttgagatagatagggtctcactgtgtcatccaggctggagtgcagtggcataatcatagctcactggagccttgacctccttggctcaagtgatcctcccacctcagcctcctgagtagctaggactgtaggcacaagccaccatgtctgagtggcataatcatagctcactggagccttgacctccttggctcaagtgatcctcccacctcagcctcctgagtagctaggacacaagccactgtgtctggctaaatttttttgtagagacaggatctccctatgttgcccaggctggtcttaaactcctgggctcaagcaatcctcctgcctcggcctcccaaagtgccaggattacaggtgtgagccaccattcccagccagatttcttgctataactttttatacatgcaagatgggcatttaacattgtttatgtactcttactgcactctaaaatataagcattttcttaggattattaattaaactacagccaagagaaaatgcaggataacaaagaattggaggacttaaccttgagtaaatcacttgatttctcatctataaaatggaagtggtgatgatacaccttctcctccttagctcacaaagctatttggaggaccaaatgaaataatacagtgatttttagttaactttgtctgccattctgcacttgagtttaattctagtactgagatagatagaaggcttcaacaacagtgtttattccagcaattatatcttggaatatctgtgatatcaccagttaattataactttaaaatcggcatgcaatactttttttaatgtagctaatagatatgtcttagtagggagcaaatatctgtccttccttatgtacatggattctggttagtgaaactagtataaaagttttggggggatacattactcttcagaaaatggtactaataaggacaaggaacagagggttaatcatggtttcacttaatcctgtggagattaggacttttgtagagtgctacatttttcacagtgtgctcctgggaacactgattctgtgttaactatagttagagcgagacaaaggatttggtggtcaaagtttgagaaaagctaaatgtttaatacatattaggcagacttctgaatttcagtacttcttggagatataactgtgcactctccagagaggggaaatgcattatttcccaaactgaaacttcactgctgctgacatttttagaagatgctggtatagaggaaaagctatggatttaggagcttctagaagtcttattattattatttttttcccgagacagagtcttgctgtgttgcctaggctggagtgcattggcatgatctcagctcactgccacttccgcctcccaggttcaagcaattccgctcaccttggcctcccaaagtgctgggatttcaggcagtaagtcaccatgcccagccgagtagtcttatttcttacttgccatgtggacttgaatataacctccttgagcatctttcctgctctttttcattggattatgattagaattagactaatgaatatgtatgaaaatgtttgattccataaagcattacaagacatcagtattaacatgaaaatgaagaccgcttaatcaggagtgataacggcattctatattaacaatgggttaattttacacattactatactacagaaaatctaattattgcaaaattgtaaaacagcgatggcttatagtttttttccctgccgtatagtttttttccctgccggttagtcctaattctaaaaataactatggtgaagcccaattcaatatgcatataaaagaatttcatccatcttaaatttttttttaatgttttaatattgaaatcactaacattacttcctcttttggctgcaggaagtaagtacagcctggaattcccctcctactggaaaactggacaacaagcaatacatgattatgatccctaggaaaagagaaacaaatacggtaagccatacctagcccaggagtaagaaatcttaattctaaacctttgtgcttgaaagtaattatcatactgcagtgaagggaaagggaacccagggtctagcaatcttgctgggttgaggagaaagagattgaagtttggggaggctaaagcagctttaatttatgggtcagactactggaaacgaaggaggtacacaaagaaaggcctccagaaatctgtacaatttatgggtcagactactggaaacgaaggaggtacacaaagaaaggcctccagaaatctgtacaatttatgggtcagactactggaaacgaaggaggtacacaaagaaaggcctccagaaatctgtacagtcttcggctgaataaaaatttgtgcatacttagggtgaaatcccttgaggccatagaggaaagaaagatctaattaaatatgccgggcattcagtagagacctaggggccacatctcagaagcaaggctaaattagtcccagaaaaaaggctacatagatcagtggttctcaaaagggagggggagattttgcctccaaggggatatttggcaatgtcagagatatagcagacaaatctaacattataaacacctttgtctcagaatcaataagaataaacaagacttaaatttgactgacatttctgaaacagtctacccaagaacttgcattcttttcaagtatacacagaacattaatctagaacataaaacaagtctgaatacatttaggaggattaagtcatacaatgaatgctgtctgacaaaaatgagattaaaatagaagtcagtaacaaacatatctggagaaaaacccaaatgtttagaatttgacatttaataagctatagattaaataaggcatcatgattaaataaggtatcataaaattaaaaatctctagtactgaaaacacagcatatcaaaatgtgtgggatgcaatgaagacagtgcttagaaaatttacagcattaaaagctttgattagaaaagaaaggtctcaattaattatatatgcttctaccctaaacacaagaaaaatggaaaggataaagagtagaaacgaataactaagaacatgcataaacaacaacaaaatcaagaccaagctggttctatgaaaacattggtaaaactgaaaaacttttagccagactgattaaaaaaaaaaaaaaaaagcaagaatatattaaataccaatgtcgggaatgaaagggaataacactagagatactggagccattagaaggatattatgggaatattatgaataacttaactttataccaataaattcaacatttgaaggaaacagttaaattccttcaaagatgtaaaccaacaaagctcactcaagaataaacatattatcagtaaacatttgatgaacttgtacttgaaaacctttctacaaaaaaggctccaaacaaaccaagacagcttcactgctgagttttaccaaacgtttaagaaagaaataataccatattatcataacaccaaagctatagaatatatccctcatggatttagatgcaaaaataccaaaattttagtacaatgaattcagctatatgtaaaaaggatactatatcataaccaaataggatttatccccggaatgaaaggctagtcaattactcagaaattaaacagtatattataccattataccatattagtgactaaaaacgaaaaatatatgatcttgaggcacaaaagcatatgataaaagttttttttgctattatgaataatgctgctatgaacatgggcagtcattaaatgcatggcaagtcacaagggtcaactacatactctctaggatagcgataataaaaaaaccataccaagctctggcaaggatgtagacaaagttgtaggatctagaacaactagacagaaaatcagcaaagatacagaaaacttgaattagtctatcaatcaacttgacctaactgacgttcataaaactctacttaacaagagcacagtaagttttttttcaagcactcatggaacactcaggatagaccatatgcaagtgcctaaaaaagtctcagaagacttattggagtcattcaatattagagtccttcaatgtacctcctacctcagtggaattaaattagaaatgaataggaagagatatggaaaatccccaaatatataaaaattaagcaatacacatgggtcaatgaaaaaaatcatgaaggacattagaaaatgaaatgaatgaaaatatacaaaaaatgtatagctttaaacatctatataagaaaataaggtcttcaactaacaatggaagcttctaccttaaactagaaaaagaggaacaaattaaatgaaaagcaagcagaaaagaagaaataataatcaatgacataggaaacaaaaagagaaaatcaatgaaactaaaaatttcaatgaaactaaaaattggttctttgtaaagaccaacaaaattgataaatttttaactagactgaccatgaaaaaaagatgatcaggcacaaattatgaaaatctataatggaggggacacctctatggatcctacaaaacttaaaggattacaaacaactttatgcccaagttagacaactcagacaaaatggctcatttcatagaaacacacaaattacaaaactatgtcaaggaaaaatataaattctgaatagatctatataacaaataagcaaataattaaaaatcttccctgaaagaaaacacagacccagatggcttcactggtaacatgtatcaaatatttaaagaataaataagatcaatactctataaactctttaagaaaacagaaaatacttctcaactcattttaagaggctagtactaccctggtagcaaagccagaaaaagatatcacaagaaaagaaagttgtagatcagcatccttcataaagagagatataaaaatgatcagcaaaatattagcaaaccaaattcaaaatatatatggaaaagattatataccatgatctagtcagaaaactagatcttaaaccatttcaagccattttcctgattttgcaaataaatttgtattagaacacaagcattcacatactgtatatagctgctttcctgttatagctgtagaattgagaaattgcaacagggactatatggcctacaaagacaaatatgtactgtgagtctctttacagaagactatttgtggaactatactctgctcagtagtattttagtagtatttttggaaagaggatttgatggtctccccactcctccaaagctggaattcctattctttctcaacaactggaatttttttttttttttttggagacggagcctcactctgttgcccaggctggagtacagtggcacaatctcggcttactgcaacctctgcctcccagattcaagcgattctcctgcctcagcctcctgagtagctgggactacaggcatgtgccaccacgcctggctaatttttttgtatttttagtagagacagggtttcaccatgttggtcaggctggtctcgaactcctgacttgatgatctgcccacctcggcctcccaacgtgctggaattacaggcgtgagccatagcgcccggccagaaattggaaatttaagatgttaattattttcaaatggatctatagattcaaggctatcctaataaaaattctatcagactgtgtttttgagacagagtctcactctgttgcccaggctagagtgcactggcatgatcatggctcactgcagccttgacctccctcctcagcctcctgggtagctgggactacaggcacaagctaccatgcctggctaattttttctattttgtgtagtgacagggtttcgacattttgcccaggctggtctcaaactcctgggcttaagcgatctgcctgccttggcctctcaaagtggtggaattacaggcatgaactaccacacccagccccaaaagactttttggtagagattgtcaagctaattaaaaaatacgtggaagaccaggcacagtggctcatgcctgtaatcccagcactttgggaggccgaggtgggtggatcacctgaggtcagggtttgagaccagcctggccaacatggcgaaaccccgtctctactaaaaatacaaaaattagccaagcatgatggtgggtgcctgcaatcccactgctggggaggctgaggctgcgatgagccaagatcatgccactgcactccagcctgggcaacaatagtgagactccatctcaaaaaaaaaaaaaaaaaaggaagtggaaatgcaaggaaactagaatatccaaaacaacagtttggaaaagaacaacagatttggagaattcatattaccaaatttcaagatttactgtaatgcaacagtaatcaagacagggtgttatcaatatgaatataggcatacagatcattgggtaagaaatacagatcgttgggtaagaaaaagagtctgaaagtagacccacacatatacaaacaactgattttctacaaaattgccaagtaactcaatagggaaaagagagtcaagttctggagcaaccagatatggattttggggaagaaaatgaaccttgtcccttaccttgcatcatatacttaagcatgtgagctgaaactacagaatttctataagaaaacaaatagtagaaaatctttttaaccctggattaagcaaaactttcttagtaaacaaagacacgaagctttcttcaaaattatacacttttgctcatctctacatttttttaagaaaactgtaaatgtaatccacttaaagaaaacatgcaaaacatatatttaacaaagggccacattgagaatatttgaacaattcttaaaacccagttaaaaaatgggcaaaagattaaaagaggcacaataccaaataagaaatataggtggccaataagcccatgaaaagatgcttaatatttttaatcatcagtatacctacgatgaaagaggctgacagtaccaagtactgaggaggatatagaatggatcttaagaagtctcatacatttctggtaaatgttaacaattgcggaaaagtttggcaattttaaaaataaatttaaacacacactcaacctatgtcccagtgatctcacacctcagtattgacccaagagagatgaaatgtacatccatatccttatttttttgtctgcttaatttgtaagaaaggtatagtaaaatctcattatttttactagatttatctaagtattcttgttctatgaatttttgtattatgtaatttgaaactatatatttacaattatttttcctgaacaaatgctttaaggagtattttgccttaacatctattttgcttggtaataatgtagctccttcggttttgttttggtcaatataggggccagcaaactttggcctatgggccaaatcctacttgcagcctgtatttgtaaataaagttttattggaacacagccatgcctgttctatttgagtaccgtcaatgactatgttcctgccacaagggcagagtttagtagctgtgacagagactgtgcaaagctaacaacatttaccatctggccctttacagaaaaagttggccatgtcttgggttatactatgcaaagtagatccttttacttcagcctttcaatatctttattcagatatagctttttttaaatagcataaatttggattatttctaaaatcctgtcagattagcttggagcattcagtccatctctacatttattttatttttgagacagtgtccctctgtcacccagtttggagaagagtggcacgatcttggctcactgcaacctccatctcccaggttcaaatgattcttgtgcctcagcctcccgagtagctaggataacaggcatgcaccaccacacccggctttttatagttttagtagagtcggggtttcgccatgttggtcaggctggtctcgaactcctgacctcaagtgatctgcccacagcctcccaaagtgctgggattataggtgtgagccactacacctggccccatctctatatttaatgaaactaaactactgatgtgtttgaatttagctgtactaatgtaccttatctgttacttcctgttatcatgcccttgtttatgcatttttttctccctcctctcatgtctttcattcttttggattgtttttcttaggtattctcttcccccaatggtttggtactttgcataccctgcataccctatttctagttgtcatccttgaaacttactttagttctactttttagccctcaaggaaattgttactgttgttattttatatacatagtaaatgtcagtttaaatgtatctatattatttaccacttttgttattcttcagtccttcttaaagatgggattacttttattattttttttctaagatggagtctccctctgtcactaggctggagtgcagtggtgctatcttggctctctgcaacctctacgtcccaggttcaagtgattctcctgcctcagcctcctgagtagctgggactacaggcgcgcaccaccacccccagctaagttttgtatttctagtagagatggggttttaccacgtaagccaggatggtcttgatctcttgactctgtgatctgcctgcctcagcctcccaaagtgttgggattaccggtgtgagccaccacgcctggctgggatatatcctctaataattttttagtgagcatctggtggcaaactttattttcacctcctagttaaaaaaatagctgattggtgtacttagagcattcaaatttaaagtaattactgatacagctggattaatgtctactatgtttatattgcatttgagtttgggggaatttcctttgacctatctatcttcaagctcactgactctttgcttggctgtgctcagtctactgatgagcccatcaacatcattctgcatttccttacagcattccttagcatttatttttagagtttccatctctctgcgtacatcacttcttgcatgttgtctacttttttccattggagcctttaacctactaatcataggtattgtaaattccctatctgataattgaaatatttgtgtcatatctgaggactgcttctgatgcttgttttgtctcttcagaccgtgggtttttcttgccttttagcatgccttgtagtttttttgctgaaagctggacatgattgatatatcaaaactgaagtaattagacttttagtgtgaggtttcatgctaatctggctaggagctgggctgtatttaatgtttgccataattgtaggtactggaggcttcagtttcctctagtttccttgtttttatttactttttcttctgttgtttttgggtttcctaagagctccttaaacagcttgtgtcttgcagctctctcagttgtaatccactgttattttatcctggagccctgtttatatggtggtaaggtgttggggagggggaggggaattgttttttaatctttatgattaaatctcagttttttttagtgggtctgaatccctgggctgtgactttcagaaatgagacaagaaggctaaggaagggctagaatcctctatttgcctttcccccaggtcacataagggcctgttgaattagttttccttacagggcaggccttttgttgtgaacactctgctacgtatttccaaattttaccttccctctactcctaccagaaaaaggagggaatttttcttgcatcttcaccataagaaccttgtggagtttctggaagttagaaattttgtggggtaaacccaagaaattgcaggaaacccccactaagactgggtccctgggagtttttaactctgaagctagtcctcactcagcctccagcaattcatcaaaattgccatagtcttcctggcttcagtggcatcttttcccaaattgccatagtcttcctggcttcagtggcatcttttcccagtaagctgatcttggctgtttctctgtatttgtctattcttctagattttgaagtggtggtttgtcctatgacctccattctctgagggatctaagaaaagtcattgcttttccagtttctatagctttgttgccattttcctgttgtgattttcagtacctacagatttcccttgtggtttatatacacaaacatatacacaatcattaaaaacaattgtattcttctgcttttagatccatccactgccttttcaactgcatttatatttccatcccttgtttttaaacttactaaatatacagaaccagtccaaatgcccatcaatcaacgagtggataaagaaaatgtggtatatatataccatggaatactactcagccacaaaaaggaacaaaataatggcatttgcagcaacctggatggaactggaaaccattattgtaagtgaagtaacccaggaatgggaaaccaaatattgcatgttctcacttctaagtgggagctaaactatgaagatgcaaaggcatgagaatgatattatggactttgtggactagggttggggaggggatgagggatgaaagactacacattgggtacagtgtacactgctcgggtgatgggtgcaccaaaatcccagaaatcaccactaaagaacttattcatgtaacctaccactacctgttccccaaaaacctattgaaatcattttaaaaaagattataaacttaaaaaaaccccaacttactaaacttactaatttaccaggttctacaaatgccgtcaaagagcaagttggcttgagttccacttatctctgtaggttcctgccttcacttagttcttaatttttttagtctagcatttttggtgggaggttatatacctattccagtagtctatcatagtagaagtctatatcttaaggtatatatttccatccttatgattctattattttttaacaagaagaactcgtgatattatttacaatgaaaaaaatcatatagctcaattagtctgggatgtatacaattgaaaccattcttttttttttttttttaaacaagtaaagttgttagtatccaggcactgaattataccttcatggtatcaatcaaagctatgatcagaattttatgtaactgcttaatcacttctttaacaagtgtaccgctacaggtaacattaaacgtctctagcaatgatctttatcgggttctcttgccttgactgaaatattattaatacttcttatatccattaacataaaataactttttgttgagcaaaaatagtgtgaaaacattaagatgaatgtgcgctttggaaatgtttaaatagatatgaaatgattaaataaaatcacagtcttgtgcaacatccatagcttacagttatttggcaactatgaaaccacagttactaatggaattaagactttttaaaaaattgcaaatgtacttatttgtatatgaaagaggtattcagctattaactcagtatttaataaacattgatatgtaatttttacttgaaatggcctaaggtttataataccaactagttcatagagctttttttaaaaaagactttttttagagcagttttaagttcacagcaaaattgggaggaaggtacagagatttttcatatacctcctgtcccacacatcatcacccaaagtccatagttgagggttcactcttggtggtggacattctttgggtttggataaatgtataatgacatgtttccaccattgtagtatcatacgaagtattttcactgccctaaaaatcctctgtgctctgcacatttatccctcccttccttctaaaccctggcaaccgctgatttttttttgctgtcttcacagttttgccttttatggaatgttatatagttagaatcacacagtatgtagccctttcagattagcttttttcacttagtaatatgcatttaacgtccctccatgtgttttcatggcttgacagcttatttctttttagtcctcaatagtattccatcatctggatgtatcatagtttatcacttcacctactgaaggacatctttgtctttgctagctaaaaagtaatctcacagaagttcgttttataaactcttgttgccattttctagataatgaatctctgacaatccagctcccatgctatgttaaccaatccccaatagtaattaagcacaccttttctaggatgcgcctttttctcccataatttctcatacatgctaatactcattaggaaactaaaatttttaaccaaataacagtgtagtggacaaaatcactgtagttagctttctttttccatgtcttcccatgatcaaagatcaaaggaaggaaggagaaaaaagtctacacagattcttatcaacagagatccctatgcagctcatatacctctctgtttctgccatacctatttgtcttattaatcttggtgtcacttactgtgcctttctaatattttacattcataaaaatcatctgactagtaggaaataatagtagacttggtataattattagtactatgtatataaattaacctttgtttctaggccttcatatttcatgcttttgacataaggtgaaaaggtgttctaccaacctgaagagagaagcagtaaggttttcatacagagatactcttcataagatacctgaagcctgtgtaactcagaggaaacatacagcatgtgtttacattggtcgtacatgcagggtagagtcattctctgcctgtgaaagataaatagcagggtattagttagaaatactgctacttccccccaaaaagcacatttttgttttgttttgcaaaactatgaactcataaagaaaaacaactactgcaataatattattgctaattccctataaaatcagaattttggagaactttccttaaacttcctgcatcttggctgtttaaatagactaatgaataatctaatgtaacagtggagatattattttctatcatgcatgccatgtattattttattatttaattaaagtgttagaattcttatagaacttattactagttgctcatttaaatcaaggtttatcatttgaatacggtcaattagacgacagttttaggtcctacacacttgatttttaaaggtaaattttttcacagcagtccatcctaaagacaaaaatgtgtgacactgttcacagttatgcagagggcgagacctagaacttgattctagacttctgatgctcaaaatctgcctctgacaggcatatgccttaatattctttaaactaaaggtactaaaccaattcttgcttatgattctgaagtcattacatacctatgattttcaaataggtctctaaagtttcctgacttgtgaaatgacactaagagcctgaaactgggcccagttcacagcttttaaaatgcttcaagatttttttttttttttaagtttctgacagaaagtcgtcttggacttaacaacagaaaggttattatttttctctactgaatatgtggtttattcctttatataaaataaattagacatgacttatatgctgccaaagtgatcagaggctcttcaaatttaaaatctgctcttaccgaagaggcacctccctagtccttaatagtaggtaaagcactccttttctgggaggcacctttttttcctttagtttcttgtacatggttatactcatataactgaaaatttcaacaaagttatagtgtagtagaataagtaaaaactcattcttgttggctgtaaaaacaacaacaatttttttttcccccacaacgttctgacctaagggcaaccatgagagactgtttgacagctctatagagggtcagaacttgaatgcatactttctgatatgcaatatctgcctgtcacagacaccagagcagtatggaaacatagtgggctaagaaaaaagggtggagggctgggtgcggtggctcacacctgtaatcccagcactttgggaggccaaagtgggtggatcacttgaggtcaggagttcaagaccagcctggccaatatggcaaaaccccgtctctactaaaaatacaaaaaattagccaagtgtggtggagtgcgcctgtaatcccagctattcgggaggctgaggcagagaatcacttgaaccctggaggcagaggttgccatgagccaagatcacaccactgcacttgagcctgggtgacagagtaagactcgtctcaaaaaaaaaaaaaaaaaaaaagaaaagaaaaaggtggaggactgcccatcttttaggcagcagcatgagaacacaagaataggaagtacatatcccttaatgaaaatgaaactaatgtaaatctgttgaggaaaaaaaattataaatcccactttatgtaaggaatgtatgtggcatgattagattttgctgtgactgcttaaagctaaatctgaatgccctaataataaaaaccctaaattaggttagttttataaaccaggataagttggtgtttcatacaaatctgtttatgcttttaattccacttaaatgccttcaaattacatattagaaagtgactaaaaaacaaatactgccaacatggtattttttaaacagcatggtaggattatgatgagtaataatgtcttcagtttccccagaaactaaatatatttaccagttaatttaaaattggatccaactacctaatcttgttacattgtgatgcagtagtttgaacagtcctctttttggcaataaaagtcaaggtgacttctgttttctatacaaacagaaatctccttcattttttattcttcttagaccaggggtatgtgtgtgtgaactccctgtttacattgtactaatagcaataagctaggggtacgaaaagtagtaatacaaggtagaaagtgagagtaactaggatgtgacttctctgctgtgtatctggtgatgtgaacaccaagagtctaagagtatgctggaaaggatggatgggaatgaagagtgtgtgaaggaaaacaatgggagaggaagtgaggtcagattctggaaagtctgaaatcatgcagaatatgtactggagggtcagtgggaagatactgaagacaatctgtgtactggggagatatgtgatgcagtcagactgtgcttgaggaagcaaacattagccaacatgatgaacgttacactggagggagaaaacgagtgaggaaacaactgcaatgaggtaaggggaaatggacacctgaagtatttcgcagacacaggaataagcttagaggataagagaatagctgatttataaaatcttaaaggcttggtcttctctcagttaaacaaaacaaatttgttcccatattcttaaaccacagacactgggtgagccttgccatgcaaagagatacctcttgtgtctgggtccatatgtcccaccccatcagcctagatatcctcatctacaattgtccccactgaatccacatgagttttaccatgctcctttttctttctggaatagggttatgtaaatgatatcacagtaagattccttgttgcttgcgacagactttactaacctcagatatgctgttaaatatcctcaaacatgtcctgggacagtaataatgccacatgtacatttgctttacattacacttgtcctgccccaagcactcataactctatttccagtttgcctagatcctagatacctagtaggattgtttcagtcctgaattatcacaatagcagtcaatcaggaaaacatcagctggttaaagataccctatgaatacagggaaaatgacacacatacaacttactcattaataatcagatcaggagcaaaacacagcaggtttgcacttgattgtctatatgatctccaccccagagcaaatgccataagaaacatccaggagtactgcagtagggtcatttggtcatccaggtgtaagttcctgaaacctgaattaagagaaataaaggtatgaggcaacactcttcagaagatcatctctgtgggaattgccaaggagcaatgagatcaattagccctgtcaaaacaagggcacccctaacagaaaatggaaattaaatactaggtagacacagttttcttctgtcatctgacactttaagactcacaaaccctcttgtgtttttttttttttttttttttttaattgagacaaagtcttgctctgtcacccaggctggagtgcaatggtgccatctcggctcactgcaacctccgcctcccgggttcaagtgattctcagtgccagcctcccaagtagctaggaatacagattcataccaccatgcccggctaatttttgtaattttagtagagatggggttttgctatgctggccaggctggtctcgaactcctgacctcaactgatccacccacctgggcttcccaaagtgctgggattacaggcgtgagccatcgcacccagccccctaggtgctttttaatagcttttaatgtaaaaaaaaaaaaaaaaagccagttttgtcacctctgtctgcttaagtaaacatgaactaaatagtaaaatagccaaaattcttggcttggcggttaccagtgaccgggaaagatagtggtgatggggatgaagcgggaatggttgacgggtgcaaaaatacagttagaagaaataagttttagtgttcagtagcacaacaggatgactatagttaacaataatttactttatatttcaaaatagctaaaagagaagatttggaatgttccccaaacaaatgtttgaggtgatggatatcccagttactctgatttgatccttacacgttgtatgcttttattaaattattacatgtaccccctaaatataaatatgtacagtaaatatgtacaactattatgtattgattttaaaaaacagaaaagaatcttggcttgaggtattaatcaatgagttaagcaaaacatttgccctgctattcacacctctttcccccttaataaaacaaggatgacaggaggtcaggttactttcttgctctctccctaactatttgcgtgaacacaggcttgtcaattccctgtctttaaagtcagagctgacactaacattgacctctgccattccacaccaaattccaatagggtaacttttatttaaaattatctttaaaattacattcaatgtgtagcatttcatttagtgaagggttaaaatcattctactttagtacaaattttgacaatcaacatacttgatgtttaccaatcttacaaacaacctgatttttaaaagtggcacaatgaaggaaaacaaatggaattaactaaaaacattttctttccccaaacttcagtgtaaaaggagttttgagtgagtcttgtaacttgaattctgatattacatcatcctatgtgaaattaccatcctgtgcataatgatttgaaaagcagggagtaatgtaaatgttttattataaactccctatcacctgtattcacctgactctccccttcatagtccccagaactaagagaaacaagataagccatgggctcacgatgatataaaagccaaagtgtttttgctgaagaaaacacaaaggtttatatagttgctcttttatgttttgcatcttacctggtattgcctttgcccatttcactgctgcaatcacttgccgccctcctaacatgttgagcgtagtcatgatcctccaagttgagtctggaacagagctatcatatcctgcatataacacttcaggttcaataacctccaacagtgacaccagggtaggggtgagttgtggtaacgttgcaggaactattgttttgttaccaggattttcagaggtttcttgtgagactcctgtagtggcctgctgaattccttttatttttttctttgtttttcgagctgtgggtatttaaacaaatacatagaaatgaactgtaatgggaaggtctgcgctacacagtttattcaagaagtatttttactttctaaaactattaagatgggagaaatattttatttagcaattatgataaagtgacatggaaaaggagaaaaaacttttttttttctgaaagcaaaagatccagaggaacctattcccaattaattttgcctacaaataggccagaaacttcattagagttattccttatacaaagtattataacggtatgttaaaacaatctgagtaaataacttttgtaaattcttctataaattatttttttatctcactttcactctaaatgcaacaatttcattggttatataaggcaaattactcttactataaactgaaaaaaaaatctaagcttggagtaacggattacaaactgtggtttaagattaatctaaatcatggtagtatatataatgaagagaattacactatttacacttgttcaaagccacttataaagataggaagatgacagcagattacatgctaaaaatagtattagttctaccagtagaaaaaattcacttttcacctttacataggtactaacataaatactgcgtgggactaaaaacatttgggaagatgaaatgaaaaactttacattacataaattataagtgggaaatttcccttttataaggaagatttatattgattactctataaacctaaagcagccattttcatattatatataaattatcttttaccttgacttggtatggaaccatctactcaaactacaacatggatcctgtagactttttagtagacttattcatactcctgaagttattttagtgactaaataaataagaattacattgttctctcagagggaaagtactcagaattccagggaaaggcaagaaatgtaatttatatcacgaagaaatgtacttgtctaaattattagggatgcaaaccattttgcaaagggaagagtaaatgtaaatcacctttaaaaatcatttttagatcctctgtccttaaaatgacacaccatatagtctatggaggacagatatggtggtgggaacgatatctcaatgtacaatgttagaatagaatggttccattcttattgtgttctatactaaatggggtaactgagaattgcaaaaatttttattaatagttcaaaatagaaacagaatcatgatagaaccatgctaattagtttaccatgctctcttggaggcacagtatgatataggactaaagggcagaaacctgaaatcagcatatttggatttaagtcctggttctgccatgttgtagctggatatctgtgcaagttactccctgactcttcatttccccttctgtaaaatgaggacaatattagtccctacctcatagggttgttgtgagaattaaatatgtaaaatgcttagaacagttcctggcatatattatagtaagtaccacataacaactatcattacctcaacttgcaggagaacatgtttttagaatattttaaatttggatatcacaacttaatagaggagtgataaaattttaaaaaggaaagacaccaatacataaagaaactctttaaacaaccagaagtatctcagtgaaatcttgatccaaaatcataaaatgtacttttgttgacaatgtaaaagagaacacacatgtgccaaatcaatacactgaaacagtactttgacagcctcaattagtcataactttaaatggtttggaatgcatatttctttactccacattagaacaaggaagaaagagtaacaagctggaggattaaaaaaaaacattttctatgactcagtttgtaattaatttctcactacttatatatagttctaaatgagaaaactgatgtttttcaatacagctcagaaagtacaattgaacccaactgtgctgtactgactagagcaagaaataatactaattaatttttcaaaatatcttcaggaaggagttaactgaactgaatcatttagttaagcaatcactattttaaagcaacttagttaatacaactttatataaattcctgacccattggagcatatagttgattagcagtcaatacaggagctccacagaagtgttcatgagtctgtggtaacactacttccttcttaatgaaagtagagaaatcttaattagcttaaaacctagtttataaaagttggttacttgaaaggataaacaagattgatagaccactagcaagattaacaaagaaaaaaagagtgaagacccaaataagcacaataaaaaatgtaaaagatgacattacaagagattccacagaagtgaaaaagatcttcacactattacaagcacctctatgcacacaaagtagacaatctagaggaaatggataaattggaacaaaggctttaaaaaatctagggtttatgtgtgtgtgtatgtgggtgggggggcgggtggagtttactatgaaagtatcatttttgttttcagctgacccccgtatatataaagccattatttggagtaagtatgtatgtggaaatggaaacacacaacctgcctagattgaaccaggaagaaactgaaattctgaacagaccaataacgagttctgaaattgaatcaataataaaaaacctaccaattaaaaaaagcccttgaccagatggattcacagccaaattctaccagatgtacaaagaagagctggtactaatcctactaaaactattctaaaaaagcaatctagaaagagggcctcatccctaacttattctacaagggaaacatcattctaataccaaaacctggtagagaaacaacaacaacaacaaaactacaggccaatatccctgatgaacacagatacaaaaatcttcaacaaaacactagcaaactgaatccagctgcacatcaaaaagttaattcaccacaatcaagtaggctttatttctgggatgcaaggctcgttcaacatatgcaaatcaataaatgtgattcaccacataacaaaaaaaataatgatcatctcaatagatgcagaaaaagttgcgataaaatccagcatctcttcatgataaaaaccttcaccaaactaggtattgaaggaacatacctcaaagtaataaagagccctgtatgacaaaccaacagccaacatcataccaaatgggcaaaagctggaagcattccccttaatgcaataagacaaggatgcccaatgtcaccattccaatttaacatagtactggaaatcctagtcagaacaatcaggtaagagaaagagataaaaggcttccaaataggaaaataaataatcaaacgatctcttttcacttatgattctatacctagaaaaccctgaagactctgtcaaaaggctcctggagctgataaacaactttggtaaaggttcaggatttaaaatcaatgtacaaaaatcagtagcatttctatacaccagtaatgttcaagctgagagccaaatcaagaatgcaatcccatttgtaacagtcacaaaaagagtaaaatacctaggaatgcatctaagttagtttaaaatttttacaaggagaactacaaaacactgctgaaagaaatcaaagatgacacaaacaaatggaataacattccatgctcatggactggtagaatcagtatagttaaaatggtcatactacccaaagcaatttatagattcaacactattcctatcaaactacaatgtcatttttcacagaattagcaaaaagcattctaaaattcctatggaaccaaaaaatgccccaaatagccaaagcaatcctaagcaaaaagaacaaagttggcaacatcacattaccccaaatcaaactatactacaggctatagtaaccgaaacagcatggtactggtaaaaaaaaaccacacacaatggtacagaatagagtccagaaataaagacacacacctacagccatgtaatctacacaaagttgataaaaataagccatagggaaaagactccctattccattaatggtgctgggataactggctatccatgtgcagaagaatgaaactggacccctacctactgccatataaaaattagtaaggtggattaaagatgtaaatgtaagacctcaaactatgaaaatcctagaagaaaacctaggaaataaccttctcgacattggccttgggaaagaatttatgactaatccccaaaagaaactgcaacaaaaacaaaaattgacaatgggacctaactaaagagtttctgcaaatcaagagaaactatcacaatctacagaatgggagaaaatatttgcaaactatgcatctgacaaagccctaatatccagagtttatatggaacttaaattaacaagcaaaaacaaccccattaaaaatgggcaaaggacatgaacagacacttctcaaaaaaagacatacgtgtggccaacaaacatatggaaaaatgctgattgttaatcatcagagaaatgcaagtcaaaaccacaatgacaccactgtggaaagaagtttggagattcttcaaagaattaagagtttaactaccattcaacctagcaatcctattgctgggaatatacccaaagaaaaataaatcattctatcaaaaagacacatgtacccatatgttcactgcagcatggtttgcaatagcaaagacatggaaccaacccaggtgcccatcaacagtggactggataaagaaaatgtggtatttatatgccatggaatactatgtggccacaaaaagaatgaaatcacgtcctttgcagcaacatggatgtagcaggcggccagtatcctacatgaactaatgcagaaaaacaaataccatgttctcatttataaatgggagctaaacattgagtacacatagacataaagatgggaacagacactgggaaatacaagaggggggatagaggaagggaggcacaggttaaaaagcacctgttaggtactgtgcttacttcctagatgaaaggttcaatcatactccaaacaccggcatcacacaatgtatcttagtaacaaacctgtacatgtacccctagaatctaaaataaaagttgaaaataagagagaaactactagattgggtttttgaacttaaaaaaattagtttcagtaatatttggttataaatctgacaatgccacaagactaagcttcatttgactgtttatactaaaaataaagccatactttggattgattacaatatatcttaaaatgaagtgaataaaaacatttagtttcaagagaaaaacaagcaagttttttaaaaaaaaacatttaggatcaccattaaaaatcttatctgttcttaaatgctaggccctttaagcagtgaaggccactcccttaaaataaatcttgagatttacttggtatggggcaagagtataaaaatacaccacttggagtcctaagttacatttatggagagacttgggcaaagttattctggggctatcatcgaaactgcttggcttaggggaagcactctgatgaacaagagaatatttctgaaggttgttaaaaaaaaagtgtgaaacacatggctcatctgtattgtaagtgttagggtctgccaaagattcctggcatacgtacataccaggccaaataaagattttatgtatactgaggttagttcaatacaaaaatgatagttttacagtgaaaccacacacacaaaccctaagaacttttttaagcctttctttcaattcatctacaagtagaattggatcatttatatgatatgtgccacacggtacatatcatagtaggaaataacaaatcagaattttcttccactatgtagtataaaaatggatataaagtaaatcatggccctattcaaaggtgtttttaataatcagggtccaaaaagtagaagaatgtatatcaaagactaacatgtagtagttttcaacaaatgccaatttctacactaactggatacgttatactgactataaaagcatataattggttatttttaatacaatattttgagaaactgcagcctaaattgtatgcttaaattttttttttttttttttttttttttttttttttttttttgagacggagtctcgctctgtcgcccaggctggagtgcagtggcgcgatcttggctcactgcaagctccaactcctgggctgatgccattctcctgcctcagcctcccgagtagctgggactacaggcgcccgccaccacgcctggctaattttttgtatttttagtagagacggggtttcaccgtgttagccaggatagtctcgatctcctgacctcgtgatccacctgcctaggcctcccaaagtgctgggattacaggcatgagccaccgcgcccaaccgtatgcttaaattttattcatgtaagaaaaatttctgatgtccaacaaaagattcaactggaaatggcagtgatggtataattaatagaaaaatcagatgtcagtcactgcctggggtcgtcttctagtacagtaagggcaaagggcactgcaattgctattaaactgtaagaaggaggaaaaaatggacagatttcgtagcctagtccatcaaaatcattactttgtagttgatatatcttttttcttttgatgaaagaaggccctcatagtttggatagggagaaattgcccagaaaaacattatatacttaaaactccaaagatcttaaactttatatgtattcagaaaagcacctaaaaatgttactgggtaagcaaccacaatatattagagatacgacagaattttatttgggtttgtcctttgagcttcattcaaaacctatttcgaaatataaaataggtaaaatgaaaaaatgaagattagagataattgggaccggagaaaataaaccaaagggcactaaaaactcaagtgtcttaatacatatttaaatggtcaaagtatattacatacataggagattagagagcagcaagatgaaactgggtaaaatctgggcagagatctggtatctaagaaagtggggaatactgtttttataacaaaaataaactacccttgtggaactgaaagcaaacttctgtgtgcattttttagttaatctctacagtttttataacatttacaagaaagtgggcagctatcattttatgtaaatcaatgtttaacatgctgacactctgcagttaagtttaaatagcctggtcaaacgtagatagagttgtgtgtgtggtttggggaattagactcttcatagtcatacccataaatctattttctatttaacaagatgtctacacacagtgtgtgctagatagcaccaacaattagtctctcctatcaaaagaaccacataggtcagttgcagtggctcacacctgtaataccagcactttgggaggccacgttgggaggatcacttaaggccaggagttagacaccagcctgggaacatagcaagacccctttgtctctacaaaaaattaaaacaaaaattaaaaaaaaatcagctgggcatggtagtgtacatccgtagccctactgggtgggaagatggcttgagtctaggagttcaaggctgcagtgagccatgttcatgtcactgcactccagcctgggtgacaagagttagactctgtctctaaaataataataatcatcataatcataaaaggaaccacatggtttccattctctctcagtactgccatctcttatctggaggactgccatattcacttaattggtctctccatgtaagattagtctttgtaaaatacaaatctgatcatgtctctgcccttatttttcatctatctaattcctactcagcttatagatttaaaattcaatgttacttcttccttgacttccaagacagaattaggtgaccttcctcttgttcctgtggccctatgccctctatggtgtgccatgctattttgtgactgactctgcaacctaactagcagataaactacttgaatacaggcactattttattcattttatacctagtgactgccttgttggtgcatatttgttgaataaaagtgctaatttcacaataaatactaagcatatgtgttatgagatcaccactaccttcacagaacttgcaatttcaaccacagcagaattccaaacttttttcagaggaaaattttttaatgctgagatcagtgttaattatacaacttgttatataaacagggatatgaaactctaacttataactagtttcaggtttctttttttttttttttttccaagacggagtcttgctctgtcgccaagctggagtacagtggtgtgatctcggctcactgcaacctctgcctcccgggttcaagtgattctcctgcctcagcctcctgagtagctgggactacaggtgacaccaccacgctccgctaatttttgtgtttttagcagagacagggtttcaccatgttagccaggatgatcttgatctcttgacctcgtgatccgcctgccttggtctcccaaagtgcggggagaccaagaaactttctcagaaacttctcactgttgtgtgcattcaggtcatggagttgaacgtttcttttgattgagcagtttttcaaacactcattttatagaatctgcaagtggatatttggagcgctttgaggcctacggtggaaaaggtaatatcttcacataaaaactagacagaaggattctcacaaacttcggggattacaggcgtgagccactgcacccggcccaggtttcttctttacttgaaaaccaaaacaaaacccatccagttcttccttgaggttttttttttcccaccaccccccgcttgaagatctgtaataaaacacagatctccaagtaaaaggtatgcttttaaaaggcaaacagaaaaatggacatgtaaatatgtctgatacagaaacatttccaaccctagggaatagttttgaggctgaaaaaaggagtaagaataataaagttgctgcatgttgtgtaagtttcattattacataatttcctttctttgtatatagtctggctgtactgaattcagtgtgtgtaagaagaactggtggataaacaaacaatatgacatattcatgaaaaaaatttcccatttttattgggcagtaacattatgctagtcaagcatatatatactgaactgactacattaattacatctgcttacgtgtatcttcaaaagtaaaatgataaatttttataagctacagagacaaacaattgctttcagatatttatattaccttccaggttcattccagcctgaagacattttcgatagcggcatgctgggcagttttttcttcgaattttatcgatgatgcaatcattccttccagcacataggtaattgtgctgtcctatatggaataaaaggcactattaaagtttcacaggtcttcaaacatattttataaggacagcctctgtctttgtttccggtggaatataaccaagacacccacaggtattgccttgagggaatgttcttgcctacattgccattatgaggtcgagaggtcaaaaacaacaaaaagagtctccctttttctgttcaacaaactgaaaacagtgcaataaaaaaccttattgcagtattcacatataaaaaaagtacacaaatcagtgaaccatttaataaatttttacaaaccaagaacctttatgtaatcagctctcagatcaagaaacagaacagtaccccaacaggccccctttctgcccaattccagccagtacccaccaagggtaactacttttttgataaactgtgttttacacagtttgatagattatgtttttttatttttatttttttgagatggagtctcgctctgtcgcccaggctgggagtgtagtagtgtagtggcatgacctcactgcaacctctgcctcccaggttcaagcaattctcctggctcagactcccgagtagctgggattacaggtgcacgccaccacgcctggctaatttttatatttttagtagagacagggtttcaccatgttggctaggattgtctcgatctcaggacctcgtgatccacccgcctcggcctcccgatgtgctgggattacaggcatgagccaccacgcccagccaatagattgtgttttaaacaaataatagtttggggtagatggttaactgtatcaggttcaattctttgtaaagaataggccacaaaattgaccactagactataattcacctttgttcagagctgctctccaatgccaaatatctgtaccagctgtttcaatttctttttgtactctataaatatcctagcttctttacttggacagaaaatggaagcactaacccaattctatcccctataaatcaaaagtacgatcaacagatacatctattgatgaagtggttataatacaaaaaagttataccctataaggaatctctaaatcactgtcctacagttactggaagaaaaaaagaaaaaaaatcacccactgctaaaaatgaaaaattccaaagttttgtttatatccaactgaaatgtcaggatgtgcacattacgccaatcttgatttctttatcccaggtatgtcttgtgcacagctaagactctgagctataggatcagaggcaatgtaccttcataagttaaaaatagccctttgtggttattagcatgaagttggacaagtctatctatctgttccttatctataaaatgaggagttttaactagtattcactatttcataacacatggccacgtacaactaatagtcatttcctgtcaatccattcattcattccttgactcatttatttatttatttttagacaagttcttgctacgttgcctaggctggagtacagtggtgtgtcatagctctttgcagcctgaatctcctgctttagcttcctgagtagctgagactacaggtgcgatgcctggataacgttttttttttttttttttttcctgtagagacggggtctcgttatgttgctcaggctggtctcaaactccaggcctcaagcaatcctcccatcttggcctcccaaattgctgggataataggtgtgagccacagtgcacagcccattttccttgagccacagtgcccagcccattttcctgtcaacccttctgataagacaatgagatatcttattttggagttcctgtgtcttctactacttggtaaattccctttctaactaatagaaagatgagtcttcaagtcagctgaaattttgtgactttgttttgtttatatggtattcatttttgtggttaaagtctatttttggcaaataattctggttttctatttatggtgggtgtggtagccagcctcccaagatggcccccagtgatctctgcctccttgaatgcatggtcttgtgcagtccctttccgtcctttaccaagattggtctgtgtggccaataaaatatggcagaagtgatggcatgttacatgtgaaatcagataataaaagacaatagttctgctgcattgatcacatactctcttggatcatttgttatgggggatgtaaattataatgctactcacgttactccacagagaccacaaggatgccagctttggctagtgtagtagtcccacctattgattagagtcaaaagtaaagcccacccctgcctagtgtaaagctctgaataaagtgcaacaacttgctgatacccatattatactatgccaattttgagggataatctataattctagcaggtattaagaatggagtgctaagtgtaagatattttcaattcacaatgggtttatctggaggcaaccccattgtaagtcgaggagccatactgaatgcgtatcactttcccaccatcataaaagttgaaaaatcgttaagtcagggactgtccgtattattattatcactgcatttatatcgtggaaatacttaagcagttaagaaagtgaggagtaaagtgaggacacgaagacgcttctgtcttctgcgtatgtgttaagtaacatccactttattaggagcaatgcacaaagcagggctgggctttacttttgactctaatcaataggtgggactactacactggccaaagctgccatccttgtaatctttgtggtgtaatatgagtaattttataatttgctaatgtattaaaaagtaaaacaaaagaaaatgactcatctaactctcatggatatgcaaacacaacatgagacaaataataataatcctcatacagtgaatgaataattgtttctttaaaaaattaatataatcagagctttaggccaagctactttcaaactgctttagaaataactaaattatatgacaatttttttcctagaggagtcactggtagtattaggacattttagactctcttctaataaatttgctatggaatgaatttctcattctttagggagataatgctgttgccctgtcagcagtctgaatccataacaaagtaagatttgtgttaatacaacatttatatagtgaaatcagtttctctaaaatacctttcctgacctcctcaggccgagtttctctctccctcatctatattataatctctgtaccttgtcattgttaactcatctttcacttcagtggagtgtgacttcccagagggtaaggatcaggtcttattggtatttataccacttagcacagtgccctggcttaatagaaaaaaaaaatgaataagaaatgaaatgaatatcttttttttttcctgtcacagttctcactgtgactcatttttgccaggccagtaaagttggtgactttgaaacctattagcttatggaagttaaagcccatgtttctaatacaatgaacattatgttatgcccaaacttaacaccatcatttcatatgatagcactttcttatagtgttaccttatgctccctgaccaaactcccagacatcaacttgtacttttctattttattctagatctttttgtattgttgttttaaatactttcctgcccattagaggacctaggagccaccctcctctcccctcttaactgatatttagcctttcatgggctttgcatataatggaaatttcaaaatccaccctgagaaatgaaaaccaagtagaggaaaaataaactcttcaaaacacacactaccttccactgctcttttgaagaaaactttacagcttccacaagttaagactccataatgacatcctgaagcttcatcagagcacaccaggcagagtttgggaggtggtcctgttgttgctgttgaggagctggatggaggagagcttacatctggtctcatgctggggctaaagaaggggaagaacagtgttatgatttaactgtcaaaggaatatcaaaatacagttctcttagcttctcacttcatagtcagaatgctcacagtgaactctggcttcaagtgctagcaggcactaaaatatcctagctaaatatattcaaatcatgttatattcttctttaaacaaaattaagaatgaggtcatttcttttgaagtgtctccaaaatagaatggtgtggttctggttcacttcttcttctttttttttttttttttagatgcttaggatttatttttataatcacgtttattaaggtgtcacatacagtaacatttactgttttctaagtctataatttatggtttttgttaaatgaatattcatgtaactactatcacaatcaggagagaggatatttccatcatcccaaaaagatgcctcctatgcctttaattgcttaggccataatttttttcctaattttaagatcttatacaggcatcttttaaaattcaatcaagtgtcattacaattctacccatgtttcctactagagtcaaaatttttttacaatcttaaagtttttgtcccatgtctctaattcctaatgtcatcttggctgaaaccacaatttcatatgactcagagaagactgatccagaaacattttctataaccttcctgtctggcttgcagtaagattggacaaagcactaggctttcaaaagtgagttccattctgcccactccactctatgactgtttggcttgaagaagaagacagaaatgtgaatctgcttctcttactaggtctctaacatttttcatagtctcaccacaaagagtgcaggtctagtgattattagctgtttaaaagataatttgttgttttaaaaattttcaatctcaaaaaaaattggaaagaattgtacaatggatatatacttttcaccaatattcaccaagtcttaacattttgccacatttaatgataaagatatatttttataaaccaatgaaacagtgatctttctattactggaggaaaaattaattattgcatttcatattacatgacacaatggttttcaatgttgtattttcctaaggaattttcctcttacgtgctgactttagaaccaaaactgtattatgcagctaaaatgattttgtagccttctgcttgtaattagagactgcccattccatttttggttgtgttcttaagcaaatcttcaaaaacatggatgctggcaacctgttgattctggaattctacatattaaagtccgttttgcttatcatctatacaagttcataaatatactagtacctctctctaaacttttcttaatttgccttttctctaaaaaagatggaacttagaaataaacttaaattgggtgttcgttgtctctgttattctttattatctcttgcttttatttatttcagccaataacagtagtaagtctcaattacaaatatgtttaaactaattcacagagcaaagtaacttaaaatttttttctagttatcaatctggttagaaattacatttatcaagtaatgtagtttgttgctaatgttccgtttaggaataaaagttaaaaggtaataataatggaatgacaatttcttttataaatgttaccttaagtaattaagccagtaaatccaaacgatcgccctaaattctatcttcaaatgaagcttcctgaatcttgccaactgcctgcttacctaacaggcttagtcaataggacagcattcccaccaccctaattctgggaaaaggccccagggtttcacattgttctctgaacactgttaagaagaatttgtagatgcttccgtattacaaggcattcattccctgctagatttgggcgagtggactgactacacgtcgaaagcctgtaacagaataacctgaaatgactctgctgtaggtccggcacaggccacccctgattaatggaaacttgtgactaatgtagaggagctgctttgggccagagttttccagagaagtaggaaggtcctggaacagtgaatggtgcgacaatgtgttggggaagcaaaaactcctctggcttctattctgaagatactcctattcttgctcagccagtctctgtcacctgacatctatttttagggaccaaacagttgtttgtatattagtttacagaaaacgagtgcattgtttaaaggttaggacagtattctgtaatgtttaccccattaattatatatacacacatatgcatatatagtatgtatttatattttaaataatagtttgtagtacttcgtagttttagctctcaataaccctgtgaaaatgacatcatcacccctggatgcggtcatacgggccgtggcaggtggttcatcagggagcctatctacggtgaagctgacatattttagatcccagctgtaccacttcacagcttctgttaccttgggtaggtatctactactttgacccctgagtttcctcatcagtaaactgggaaggatatcacctgtgtgtgtgttgtgaaaataaggtaacacatagaaaatctactacaagttcctgcttctagcaggcactcaatacatgttcctttttctttttcaggaacactgaagattttatgagtaagtattatataaatggaaggtagtattaagtctaaatcctaggaccgtattcccaaattcttagatattacaatgtatgcaaaacatgttcaggccactcaactgtaagctacagatgacaagggaaagtaaaaatgaacaaatggattgatagtacagtagctgaaaatttggaacctcaatcaggcttttggcatcccttcaggcagtcgttctgggctacatcagataagaactgagtacatggaaagctgccagatgtaccatagacatcggtgaaaaaagccaatttttgtcatacaaataggaggagtaagatagcctataatgaacaccattggaaaaaatggatgaatgctaaatggtattcagttgcaagtttgatattgttaaaagggctagggtacaacaaaatggttagaactcaagagaaaaccatatggaattgacatcttttattaaggatacatggcagaaggaaccaaaagtataccatagtaagagtgcatatttcaccccctttgaatgggaaagctaaaatatcctggtcttaagggcatcattatctgtaatagttattgattgctcaatgtgtgttcactcacagctgtgccaaacattctgagaatgttaagaagttccattatgaactattgctagggtgcttgcttttaagtgaggaacccttggaacaaaatgccttgttccaggtgaatacctgaatgctggtggttcccaatcagaatggcaaatgtagtagaaaccgaataattcctgaggctgagtttatgttagagttcagagagagaaaaccatgcataaagctagatatgtctacttagttttgttgcaagcaaagcaattgctacaaggaggattatgggtgaaagtcatggatggattatgagttaatcacacacctagagaagcatgtaaaatgtgcaggtaaattacacccattcattcaggcagacgtttcctggcacctgaatgaaaggcaagcactgtgaggatccagtatcatgctacaaatgataacgaaccttgaaactctggtctaggatggagtaccagaatattttgtagccgcctcttgtgtctcagtactattacgaagagaatcagctttacatacagacaaatctgggttcaaatcctagttccagtgctctaatagctgtgacagtggctagctgacttaacttctttgagtccattcccttattagtgccattttagggggtttgtgtggattatatatattagagttatataaagcattgttacatacttggtgatcatcacacaataggtctctaccctacccccaaggattaccttcttcctttctggaggatcttagggaaagagaagtgctacagtcttccccatgagcctgtagaaggttaatggtcctccagaaacttaagttcaggtaattatagattgccttttctgattactacaccaaaattggacaatttcgttttttaaaggttttagtattgcaatgtggaatccaaaactgttatcaatgaacttttgattgttacattgaaatatgtcagtctatcttgcactttgaatgtatcttttacccatgcatgattttgtattatcatgcattagtcatctggaaaatactggttcactgagttatgcagatctttcaaatgttgacatagttcattatgtaatataaaagagtcacatttgtcaagctcacagtggcagatacaagtcttcaaaaattctgatttttgcttgaaacctatattttatcaattggcaacaaatactttaagttgttttccttaaagtgctaagtttacttcagtcatttttgggaaaacatcgccaaatacccaaggctgaaaaccagagtttatctctcatggtactccatgaaaaaaagtaggttaactcacagtttaatcttatacacttttctttgagacaactatcaaatgctatatgcgatataagtggattatgcaccttctcattttgtcacactgacatgagaaagaccacatgtatttaagggttgaaatttaatgtaattaataatttttttgcttcttcaaagattttaagtgcatgacagtgaatacagtaactactgtatactaagatgccaacagttttactcatctttgcttttgtaccattattgcaaatgctgacataatgaaatggcaaataaagtacgtgttactgtgaaaatagtctgccctttaaggggagactcccagggccccatggaccacactggaagaattgttgttatggagactagtaaggtaaagattctaaaccagataggctacaattcataacctaattctacaatgtaatagcttggtgaccttttaatctttctcaatctcaattgccctattgctaataggaatggtaatgtacctgacaaaaggatacagtatcgcttactaaattagaggcttccctgacagagaaaggggcagagttggtaaactattacccaaatgacatgattggcttagtcttcaatttaagtgaattaatcagcaatttttcagtgtaatgcaagaaatctatttgggagaaaaaaaacaaagatattatcacctcagaaagcaagtgttaatatggaaaaaaattccagaaatacagctgctataactggattaattttttacaactaccaatagaatattcccattggcttgtcagtttttgtccaaacaccgtaacacagtagttctcaacagagagcaattttgctctctaggagacatttggcagtgtctgaaaacacttttggttatcacggttggggaaatgctattggcatctaagtgagaagaggcgagggatgctgctaaccagcctacaaggcacaggacagcccccaccacaaagaagtatccagcttcaaatgtcaataatgctgaggatgagaaaacctggccataaagctttaagcaacataaagtggaaaagaaaaaaaaaaagggaccagaaacattttaaaacctaaactatgcttaaaaatgcaacaactgcactactgaagcagccctaaacagtccattcaagacaagtccaaaaagagattcaaaacagaactgaagccaagccatggactatacggcttagttatcaagtacaggattggcttgagccagtaatttctttttccctctagcgctagcactaaaaggtagtttttacacattaaagtcacctgcacttttcttatctttgttcattaggaaaaatgtaaatactcagctgcacacaccaggtgattatattttctgactgcccatttatctctgcattagctaaagaattactgatttgtttgataataagctatggaatagttttcaaatcaaatagaaaaatgctttaggggaaacctttcacaatatttctgttaaatggttttagcagaacacattttatcttatttaacaagccaaagaaagactgattattctctttgctttgcatttattgagagaggtttgcattggtttcaactttaggttcttattaagatagttcatccaaactctgcatcatttatattcactcctcttggggagagggttacagcaacaaaacctatacattaatagatcaagagaatgttcagtaaaggatttttcagacctctaagacaccagtggcctactactcagtgtctctgggcttggtttccctgtctgtaaaacgaaggtcttgatttaattaactccaaataagctggccatatcttgcaagatgggtttggggatggaaaagtggagaggaaaacacttggatctgtaaagggtttcttaggtcctgtgtatttatttgtagagagaatataatcatgttatctatgctacttaaagtctaatctgtctcacagaaataatgtatttctttctcattggaagaattaatccagtttggtcactgtgtttgggtaacttacttcctaacagctgtatccttctttgctcttcaaaccaagtgtcaaagatggagaaaaacagaataagtcttgagaccccaagcactcccttctcaggctgtgtgttatcagttctgtttgctcaggcttgcattaggggatgcgagttttaagcagaagcaataatagtacattgaatggtaaacagaataccaagaaccagtatggtaagaagaaagactaaaaactttttgatcgcatagttatttctagaatgaagaccggattttgttcccaccttatggttcctcacacataagagcatacaaggataatagatggttcataattcagaattaggaacatgatgtcttcagagaaggcaagaacatgttggagacaatagtgcagttattgactttttccaacaaggtatctcgagcatctttgaaatgccatttgtgttcacctcaaatacaacagtaacttatttctaaatattttattcgattcttaaagagagatttgaatttctctcactatatttagtaacccagacttacatgcagagattttgccaattctaacccatcttccacatcctatttattactccctgtaacactatgtcaggacctattccttcccatccactctgaccgctgccattctaatgcatgccttctctcacctcttgctttaaccactgcaatggttgatactaagtagtccttctggcactggcttctctttccattctatcccccacacactgctaaaactcttttctcaacatgattaaaaatctgaagggctcctccactgtttatagtacaagctcagtatggtccataatttggtctttttatttttccagtcatatgtcttatcactcccctacataatccatgtagtttctttatcactacagggatcctggattctacaaatatttatcaagtacctatgataggagtagcttttgctaagatctgttttccctgcctgaagtgtccaccatggtattcctgatccatgacagcttctagacttcctaaaacactgccatatagcactttgcacagatgatcctatgttaccttttgatgtatatgtatcctgtttctatcaataatctcttttaggtagggcccatgtcttgggtctctccatatcgccagcatcttgtacaaagttcagtatatgttcacttatttttcttatttatactttctatctttatctgttttgcaaaagaactctgagacagctaacatggtaaatatttatgagattataatcagaatacaggtataacctcaccattacttggcactattatgcaagctctttctttgtatagattatctcatttaatcctctccacagacctaagaggtgggtactattttcagcatttacagatgaagaaacaagatttagaaaagttgagttgcctaaagtgatctaagtaactagtaaagtcagggttcaaacccaggtctttctgacaccaacatcagtgttcttaagcaatcttcttcattttccactatgataaagtgtcagaactgagaagctgaggtatatccaggccttcaacttgagaaataacactttctactttgtaggctgaagtttgatgtcttgatgacataatgcaaaaaaggtggcaattttttttctgtgcctgcctccaatcatgacctgcaaatgaagatttttgcccaaatagggattgccagactaggtcaaataggtaaaaacatttgtcttaaaactgtgtgacgatctgtgtcatttgaccaaattttcaaatgttcctcaaactaacagatatctcatattgcataattagcagttcctaaatcctaaaaagacatttataaaaacaaatggaaatgcagaacagttgtgtctatattcatatcaatataaaggaaggaaaaggaaccctcagaaccaatctcaacctgatttaaagccacattacccctttccttccctcaaaggcaaaggcttaattctttaattcttagattctcacattaacttgagaactttttggtttctctgtcatgccagtatactagacaagtttcttttgctatctggatttccctcaggttttgatgctgctgctctcacttcacactcaggtccctacatatccactgaaacaatttaaaggaataatcttaggtacaggactccccacttatctgtggtttcacttttgacagtttcaggtacctgcagtcaaccacagtttgaaaacattaagtggaaaattccagaaataattaataagttttaaattctgtgcaattctgagtaatgaaatcttatgccctggaacgtgaatcatccctttgtccagcatatccacactggagacgctccctgccggttagtcccttactagccatctgtattagttgttttcacactgctgataaagatatacctaaaactgggaagaaaaagaggtttaattggacttacagttccacatggctggggaagcctcagaatcatggcaggaggtgaaaggtacttcttacatggtggtggcaagagaaaaatgaggaagaggcaaaagttttggaaacccctgataaacccatgagatctcgtcagtcttattcactatcatgagaatagcacaggaaagaccagcccccatgattcaattactgcacccccacccccgggtccctcccacaacacatgggaattctgggacatacaattcaagttgagattagggtggggacacagccaaaccatatcattccacccctggcccctccaaatctcatgtcctcacatttcaaaaccaatcatgccttcccaatagtcccccaaagtcttagcttatttcagtattaacccagaagtccacagtccaaagtctcatctgagacaaggctagtaagtctcttctgcctatgagcctataaaatcaaaagcaagctagttacttccagatacaagggccggagggatggggggcagggggtaggggggtgtcacaggttaaatacagctgttccaaatgggagaaattggccaaaacaaaggggttacggggcccatgcaagtctgaaatccagtgagttagtcaaattttaaagccccaaaatgatctcctttgactccaggtctcatatccaggtcatgctgatgcaaaagatggattcccatggtcttgggcagctccgcccctgtgactttgcagcctacctcccggctgctttcacaggctggcattgagtgtctgtggcttttccaggtacatggtgcaagttgttggtggatctaccattctggggtctggaggatgacggctctcttcccacagctccactgggcagtgccccagtagggattctgtgtgagggctccaatcccacatttcccttctgcactgccctagcaaaggttctccatgacagccctgccctgcagtaatacttctgcctgggcatctaggtgtttccatacgtcttctaaaatctaggcagaggttcccaaacctcaattcttgacttctgtgtacccacaggctcagcaccatgtggaagctgccaaggcttggggcctccaccctctgaagtcacagcctgagctctatattggctcctttcagccacagctggagcagctgggacacagggcacaaagtccctagcctacacatagcatgaggaccgtgggcctggcccacgaaaccactttttcctcctgggtctctgggcctgtgatgggaagggctgctgtgaaggtctctgacatggccatggagacattttccccatggtcttggggattaacattaggctccttgctacttatgcaaatatctgcagccagctttaatttcttctcaaaaaatgggtttctcttttcaactgcattgtcaggctgcaaattttctgaagttttatgctgtttcccttttaaaacagaatgcttttaacagcaccgaagtcaccttttgagtgctttgctgcttagaaatttcttccaccagataccctaaatcatctctctcaagttcaaagttccacaaatctctagggcagaggcaaaatgctgccagtctttttgctaaaacataacatagtaacctttgctccagttcccaaaaagttcctaatatccatctgagaccacctcagcctggatcttattgttcatatcactatcagcatgttggtcaaagccattcaacatgtctctaggaggttcctaactttcccacattttcccgtcttcttctgagtcctccaaagttccaaagtcgcttccacatttttgggtatcttttcagcaacacccactctactggtaccaatttactgtattagtccattttcatgcttgtgataaagacacacccaaaactgggaacaaaaagaggtttaattggacttagagttccacagggctggggaggcctcagaatcatggcgggaggcaaaaggtacttcttacatggtggtggcaaaagaaaaatgaggaagaggcaaaaggggaaacccctgataaacccatcagatcatgtgagacttattaactatcacgagaatagcaagggaaagaccagaccctgtgattcaattagctccccctgggtccctcccacaacacataggaattctgggagatacaattcacgttgagattctggtgaggacacagccaaaccgcatcactatctctgttaccagttggactgccacagtatcacagtgcttgtgttcaagtaacccttattttacttaatggtggccctaaagcacaagaatagtgatgctggaatattgttacaattgttttattttattattagttactattactcttttactcttcctaattagtaggttaaacattaaccataggtatgtatgtataggaaaaacaatatacatataggatttgggattatctgtggtctgtggtttcaagcatacactaggggttttggaacctatcctccatgaataaggggtgggggctgctatatttagtaaataatgaaaacattggtaaccttacccctagaagatcaaggaggaaagaaatagtttttaaaattatataaaagttatatagcagacatctgcaatacagccagttagataaaaaatttaagactgaaaaaagttttcagtaggtgaaacaaaatatctctttcacaataataatcatactggaaactactgacttgtaattctgtgtgtcaagctgcatgcctaggtacagtacacaaataaattatctcaaataatttttactgagtccattttacagataagaatacaaaaattgggccttttatttgcccaaagtcgcattataaggcaacacctggatctgaattcagctctgcctaattccaaaatctatgcacctcataaccttgtgactgttgcctggcaggggcctgcagagtagcatccattaagcttgacagagttttttaagattatgtgggtcacttaacagacagtcttaaggtaaggttaaacatcaaagttaatttctgttttctatctatcctgccccttctatccttcatatcacaatggagcacaaattataattaagagatacaaaagcattcagtcacttccatttttttctttagatacttactatattaagtcttaaatgaacatattggcattccaaattattaagataatgtcatgctggtcattgaaatgctaaattaacatgaagactacatttcaaaaatacaaaagtataaataggagtgttttgtatattcataccacgatttttgcccttagaggaactctgaagtacattgttatatgtctgactaatgtattcaaccctggaatttttggggaagcatttgtttttttctgaaatatactgtcccactaaagtatcaaattgggcatacatgatgacatgaaaagcatttcccaaaccatagttaatttaagtaaaatgaacttaatattatacagccttaactagaaatgagatgtcttgccacactaccagttctgtcaatagaagttgagtgaatagatttatatctattaactagaaaaaagtataggcataaattaacatgtcatctgatgtgagcagattgagaaagccaacaaatttctagttattcaatttaaaggacactgaagtaccacaatgtatacattcaatttgactacataataatagctgctatttacttagcacttcttcatctacatattctgtaatcttcattactatcctgtattagtccattctgacactgctataaagatactatctgagactgggtaatttatacggaaaggaggtttaattgactcacagttctgcatggctggggaggcctcaggaaacttatgatcatggtggaaggggcaggggaagcaagacacgtctcacctggcagcaggagagagaaagagcacaagggaaactgccacatttaaaccatcaactctcctgagaactccctatcacaagaacagcatggaaaaaacccccccatgatccaactgcctcccaccaggtccctcccccaaaacatgcgggttacaattcaagattagatttgggtggggacacagagccaaaccatattattttgcacttgctccctctcaaatcccatgtctttttacattttaaaaccaattatgccttcacaacagtcccccaaagtcttattacagcattaactcaaaagtccaagaccaaagtctcatctgagacatggcaagtcccttccacgtatgagcctataaaatcaaaagcaagttagttacttccaagatacaatgagggaacaggcattgggtaaatgttcctgttccaaatgggagaaactggtcaaaccaagggccacaggccccatgaaatctgaaacccagctgggcagcccttaaatctaaaagctccaaaatctcctttgactccatgtctcacattcagggcacactgaagtaaggggtgggctttcatacccttgggcagctccgcccctgtggctcagcagggtacccctgtggctttcacaggctggcattctgtggcttttccagacgtatactgcaaactgtcggtgaatctacctttctggggcctggaggacagaggccctcttctcacagctccactaggtagtgccccagtggggactctgtatgagggatccaaccccatatttcccttccgcattgccctagcagaggttctccatgaaggctctgcctccatggcagacttctgcctggacatccaggcgtttctatacatcctcttaaatataggcacaggttcccaaacctcaactcttgtcttctgcgcacctgcaggcccaacaccacgtgaaagctgccaaagcttggggcttgcaccctctgaagcaatggtgcgagctgtaacttggccccttacagccacagctggagctggagcatcagggatgcagggcaccatgtcgtgaggctgtacagagcagcaaggccctgagcaggaaaccatttttccctcctagttctcaggcctgtgatgggaggggctgccccgaagatctctgccatgccctggagacattttctccattgtcttggttattaacatttggctccttgttacttattacttattactttttacttattattacttattactccttgttacttattcagatttctgcagctggcttgaattcctccccagaaaatggggttttcttttctactacatggtcaggctgcaaattttccaaacctttatgttctgcttcacttctaaacctaagttccaatttcagaccatatcttcgtgaatgcacatgactgaacgctttcagaatcagccaagtcaccactaggatgctttgctgcttagaaattttcttctgccaaataccctaaatcatctcaaagttcatcagttctctagggcaggggtaaaatgctgccagtctttttgctaaagcatagcaaaaataacctttgctccagttcccaataagttcctcatctctgggaccatttcagcctggacttcattgtccacgtcactatcagcattttggtcaaaagtattcaaaacaagtctctaggacgttccaaactttcctatatcttccagttttcttctgagccctccaaactgttctaaccactgcctgttacccagttccaaagtcacttccgcattttcagattatctttatagcagtacccaaccctgccagtaccaattctctgtattagtcagtttttacactactataaagaatatctgagactgggtaatttataagggaggtttaatttactcatagttctgcatagctggggaggcctcaagaaacatacaatcatggcagaaggcaaagaggaagcaaggaaagtcttacatggtggcaggagagagagaaagcacaggggaaactgccatatttaaaccatcagatgttttgcgatctcccacactatcacgagaacagcatggaggaaatcacttccatgatccaaacacctcacaccaggtccctccctcaatatatggggattacaattcaagataagatttgggtggggacacagagccaaaccatatcacatcctgaaagtaggtatctctaatcccatttgacagatgcagaaactaggactcagaaatgttagagaattggtcccagaacactatattatacatttattaagaggcaaaatctaaatttgcattcaagattccaagtctactgctgctttatttttttgcacatgccaatagtaaaagcttggttttcaaactgtatcacagattaagatagattaaattagaacaatattataataattagaggatgttagaactcctctatttcacagaaataaaggttaaatgatacccaaagtaacaggtatcataggtaagaaattaacacctttttttaaataccaatactcatgtattattcctttaccctgcattctccagatacagataaaagggctgactacattttttttaaatatgtgaattgttctaaaattcaatacttttctacattctggtgagatcctcttggtaaattatataattaaatatcagtcaaaacatactaaaaaatgtattgtggtgctgcatataatgtatatgtactctgattttcacatatttgtctacatatacatttgtcaattcacaataacagagtgatgtgccaagtaaactatcgtgtagtttcacttttgaaaatttaacaatagaatataagttttgtttttcacagtctaagtaagtataggttactgtggttcattttagaacattcattagaaaagtaacgtgtctcttctaaaatgctatttgctaacattttagaaactgtatgttaaataaagaagaaacatttaaagcaagtgatgatgtaatttttgttttaaaattttagggatattctgcacaatgtaaaaatttcaagggcacacttagcactttttttgagaaagaataaatggtagctactgttgtagtgggagatgtgcaatgtggaagctttaaaattgataaacatttataagcaaaataatagtaaataatattttccttttttctaaaataatcgtcagatttacaagtgaaatcaatactgtattctctcaaacttgttttaaaagctttgtcagagtttgtatcttcataaaagtattgcaaaaattaattttaacaaaccaaatccctcttgaaaagaatcaaaaggaataagaatgtgaatgtcagccataagaaagcatttttaaaactgtgttttcatataagcagttctgcatgcaggaaacagaaactgctgagtaccactgcagattggacactgctgttaacagctccaaagtctaagagaagtggaatctctgaaaataaaagtcattacttaaaattttaattaccaacataatttttagagttgtcactttcaacaaaatcatccctgaaaaaacttcacaagtaaaaatagttaaatacaacaacaaagaattgcaggggatagaaagaatcgatattgttaaaatcgccatactgcccaaagcaattagcgggttcagtgctattgctctcaaaataccaatgacattcatcacagaattagaaaaaaactattttaaaattcatatagaatcaaaaaagggcacaaatagccaaagcaatcctaagccaaaagaacaaagctggaggcaccgtattacccgacttcaaactactacaaggctaaagtaaccaaaacagcatggtattggtacaaaacagacacatagaccaatgcaacagaatagagcccagaaataagaccacacacttaaaaccatccaatcttcaacaaagtcaacaaaaacaagtaatggggaaaggactccctattcaataaatggtgctgggataccatctcacaccagtcagaacagctattattaaaaagtcagaaaataatagatcctggtgaggttgcagagaaagggaaatgcttatacactcctggtggaagtgtaaattaatccagccattgtggaaagcagtttgatgatttctcaaagaacttaaaacagaactaccattcgacccagcaatcccatcactgggtatatacccagaggaatataaatgattctaccataaagacgcatgcatgtgtatgttcactgcagtactactcacaatagcaaagacatagaatcaacctaaaagcccatcaacagaagactgcataaagaaaatgtggtacatatacaccatggaattctacacagcgataaaaagaatgaaatcatgtcctttgcggcaacatggatggagctggcagccattatcctaagcaaactaacacaggaatagaaaaccaaataccacatgttcttctcagttataactaggaactaaacattgagtacacagggacacaaagaagggaaggacagacactggggcctacttgagggtgggaagagaatgaagactaaaaacctatccatcaagtactgtgtttatttcctgggtgatgaaataatctgtacagcaaacccctgtggcacaaaatttgcctatataacaaacctgcacatgtacctctgaacctaaaataaaagtttaacaaaaaagaattgcagggttttttggggagtgggcaggggagaaaaggaaccaataaaacaatgattatgacaaaacctttatccatagtttaaaattagaacacaaaacatctaaccacctgccaaaacatgaatcacaaaattgatattttaaggacaagtcattaatttgtagcataaatagctgacaaccttagactaaatgtgtcattgctgataaatgattcacatcttcaatactgaaagctgacaagcattcagaacattaaaacaatatatcacaacacagactgttaaatattaggtggacagtcagtgcatgagtttagctgtaccaggattattttaagaaagttcgggcactttgagtgtttttttttttttttaatccataactttctgtaagaaccacactgtggatcataacatctgagctataaggattaagagtgtaactggggcccgttgggtgggggggcgggacagcattaggaaaaatagctaacgcatgccgggcttaatacctgatgagttgataggtacagcaaaccaccatggccacatgtttacctatgtaacctgcacatcctgcacatgtaccctggaacttaaaataaaaattataattaaaaaaagaattgagtagctgcaccactagaaagatggcagtagcaagacagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgatggcgtgagtttacgggtgcagagaaccactgcaagacttcgcctaaagaaaatttttagtggtatctttgtaaaagttaccccctagaatctaaaaatgctgcatatagtggaaccttatgtgacctggggatttccaaatctgaagtctgtccgagaactcattttgaaacgtggacaagccaaggtcaagaataagaccatccctctgacagacaacacagtgattgaggagcacctggggaagtttggcttcatttgcttggaagacctcattcatgaaattgccttcccagggaagcatttccaggagatctcatggttcttgcgccctttccacctctcagtggcccatcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaaagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcacgtgcctgtagtcccagctactcgagaggctaaggcaggaaaatcgcttgaacccaggaggcagagactgcagtgagccaagattgcgccagtgcactccagctgggcgacagagcgagactccatctcaaaaaacaaacaaacaaacaaacaaacaaacaaaaaactattgctgcagtcattcagatggaaatggggaaagaataatattaataactgatttcaaaaaggacttgaagatgtgaatcatctattttgctgaagaaatcttaactttttgaaattactttttattgctgttgtcatactcttaggtgacaaactgcggtaaattttttatcagtgaagtggaagcatgcgttttgttgttttgggaatttttatcaagtatcttcagagaagattatttcctgctttatcttcaaaaactggaaaggaagggtcaaagaaaagacagtagctggccggtcgtggtggctcatgcctgtaatcccaacactttgggaggctgaggcaggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcttatgttcatgtcaagcacctctcatcacagtctagttccaaggaaaaattccagcgttttctacattgggtgctgtgtcatctgaaatcggcacattccatggaggaaggagtcctgctttgttgcatgtatcctagggtttaatgttggtaaatgagtcactctagcatttgtagaaggctccctgagactcctacagcagtcgaccaagcccaaggacataattgaatctggagagtcctggggccttgttttgataaagacttgaaatacacataggaagaaaggcataaaaataaatgttcacttgtctctgctgtgaaaaaaaaaaaaaagaattaagagtacagagagcaatagaaagagggagatcttttaaattacattggaagcagtaagttttcttagttagcctgaggaggaactctgtccctgtccctgcctcccaaaagggagcaaaagggtataaatagtttataagaagcatccacttgaaagtttaatttttctcacagtgcgaaaaagaataaaataataccagaaaaggttattatgatttctgaaatgtagcataaagccaaaacctgaaaagaagaagaaacactgaattagacaagggtatgcaatagagaacatgaggggttcacaccttcttgacactgcagggagtagctgaaatgactggttgacgctatttgtgggtcttggtttgaataggaggcaatttgattctctccctactagcatcaagaaatcacatcatacacagtacagtggtacatgccgaggcccttccagttgtaggctggccccatttttcattcatgtgggaaaggaaaactgaataaactcaatacagctatgatccccacactgaggaaaactctctgtaaccataaagcccaactcatgtttttacatctaatccgtagtctactctaagattattgttgtaaattcatctgctctaagattactgctgtaaattcatttagaattacatagctagatagaatgaaaaggtaatttgtcaaatgaagctaaattggaagatacttttacattataaaaactataactatttagacaatttagaaaacagcaaaaagtttaaattagaaaataaagtcgccattcttttgacagaaaaccagcaaacacttccatatatagcctgcatcttttaaaaaaactgcatctatttattttggggataacaatataaatggctaatttgcaccttgctttttatgtgtggtactattcatctgtatacttcacattttgataaaactcctatgtcaatagatattttacatgattctttagtagttgtaaagtatttggctgtaacttccattctcccgttattggtcattctttggtttttcactattataaataccactgtacacacctttgcaaatgtctgattatttccctaagttaaattcctagaagggactggaaagccgatggacaactttagggtttatcacatggatccttaaactgcctctccttacctgctccaggaaaagtaggcaaaacatggacacatgtatttccccatattcgcttctaacagaaaacaaatctggtgaactggctattgataaaatttgcctatttctctgttggggtgtttgtcttctcttgattagtaagaatgttttggatgttaagtacttaaacacttagtccattgaggacatagctataaagctctcattttgaatcaaaatttcaaatatttcaagtatgatgatataatctgtgatgttcagagccctggctgttgttcacatgataattcctttagccatatctctgtttgaagtgtatgtgagcttgaaaataaaatgaccagtcaaatgtagttctggttaaagatggtatatttaacacatgcttttatttcagctccctctcaaacccagtatatgtttttaaaagcatacacctctaagaataaagagaagagacaataccagcaacagttcacaagacagaaagcagatggacaaggattgttggcttcctaagatctgttaagtcaccagtggggaaagctaagaagcaacctaattattatgaaaaaaaattctgaaaggctcaaaaactgggggtaaaggtaggggttcaaaatcaggaagactggttcaaagtctgtttaagaacatttacaggtttctttttatagaaatggtaggtcagactatgagtgccaacctgcctgccaaaaaccaaagtgctagataaaaaatatttttaaaaaatatccaggccaggcgcggtagctcatgcctgtaatcccagcactttgggaggctaaagcaggcagatcacttgacgtgaggagttcaagtgaggagttcaagtccagcctgtcaacatggcgaaaccctgtttctattaaatacaaaaattagcgggtatggtggcatacctgtaatcctagctactcgggttgctgagacagggaaaagcttgaacccaggaggtggaggctgcagtgagccaagactgtgccgctgcactccagcctgggtgacagagtgagaccctgtctcaaaaaatacatacatacatatacatatatatatatacacacacgcacatgtgtgcgcacacacacatatatatctccttaaaagcaccatcaagctgacaaaatgataaagaattaggctaaatctaaaggaaagcatcccaagttacttgtgctcagagaataacagatttaggcaaatttggatttcaactaaaaggacagaaaactagaaaaatggacaaaaaaacttatactttacaatacaggaactccaaatggccaataaacatatgaaaagttactcagcttaattagtaatcagggaaatgcaaattaaaacgacaataaaataacttacatacccatcagactgacaaaaattaaacatttgacaataagatgtgtcctgagtttaaggatgtaatcattttggaagacagtttggtattatccagtaaagtcaaagacaagaatgtcctatgatgtagcaactccatcaatagatatgtattcaaaaagaaatttatacttgtaaataaattaatgtgcatatacagtaaaatgtgtaagaatgttggcagcagcatttttttggttaaataaaaactacaaactagtcaaatgttcataatagtggaatgatttataaacatccatatatcttatctctgaggatataattctatacagcaatgaataaacgacagctgtacactacaacatgaatgaatcctacaatgttgaatgaaaaaagcaagatgcaaaatgacatatataatattctattcacataaaattcatatacatatgatattctattaacatggaattcaaaatatacaaactgagttatattgtttaaggatgtttatataggtagtaagaaaaacaagaaaacaacgatcacatttgtcagggcagtggttacctctggggaggaggaacaaaataggatttgtaaacttatatggtcatactggaggcctccaaggtattggcaatattctatttcttgccctggttggtaattacacactgctagctttattattattatttttcattaaattgtatgtatggtcatgcacgacataaatttcagtcaatgatggacagcatttatagtgatggtcccataaaattataatggagctgaaaaagtcctatcacttagctgcagctgtgcattgtaatacaacaccatgcttatgtttgtggtgatgctggtataaacaaacctaccgtgctaccagttatagaaaagtacagcaaatacaactgtgtacagtacataatactcgataatgataataaatgactatgttggtggtttatgtatttactgtattatacttttttcattattttagagtgtacttcttgtccttttttttttttgttaactgtcaaacactctcagccaggtctttcagtaggtatatcagaaaaaggcactgttatcacagaaaacgacagctctgtgtttgttattgcccctgaaggccttccagtgggataacatgtgaaggttgaacactgatgacactgactttgtataggcctaggttaatgtgtgtgtttgtgtattagtttttagtaacagttttaaaaataaaaacatcttaaaaatggaaaaaagcttacagaagaaggacataaaattttctttacagctgtacaatgtgtgtgttttaagctaagtgttactaaaaaggagtcaaaatgttaaaaaaattaaaagtttacaaagtaaaaaagttacagtaggctaaggttaatttattattgaagaaaatttttctataaatttagtgtagcctaagtctacagagtttacactacagtagacttcatataataaatgtcctaggccttcacattcactcactactcaatgactcacagcaacttccaatcctggaagccctattcacagtaagcacctatacaggtgtactatttttttcctcttttatattgtatttttattgtaccttttctatgtttagatacataaatacttaccgatgtattagaggtgcctgcagtgttcagtacagtaacatgctgtaagtttgtggcctggaagcaacagctataccatatggtccaggtgtactgtaggacataccattcagatttgtgtaagttcactctatgatgtctgcacaatgatgacatcgcctaatgatgcatttctcagaacctatctctgttgttaagcaatacatgactgcatatttgttttgttcattctcatgtacatatgcttgtttcacagtaaaaaaaaatgtaactcaaaataaaaaatagaaaaagaaacagatagcatgacctcccctactccagtctttgatgatttcttaccttttgttgtctacattttctctttctagaactcctaagctggttctctaattctcttatcttctcccctattttacattgctgtctttttgctcttatttctgggatattttcttacttttatctttcaatccttcaactgagcttttcatttatgttatcatccttttaactttcaagagtttagttttattctctgaatgttccctttttcaaaatcctttaatttgataaatgcattatttttcttatttctgaggatataagtaataggtttgagggaagtttccttatccaagatgactgctctgttgtttgttctgatctctgtcctgaagctagaagctctccccttcctttcaccctatccttctcctccttccttctaggctgagggttggtggggctccggactaaaggattccagacacagctgagagtagaaatatcttaaaaacaaaaggaagtttaagtgagccattacataccaaattattaatggcattcattcagttgaagaacacagagaaaaagaagaatgaagaaaaattaacagaacttcatggacctgagagacagtatcaaatggccttacatatgaatggagtcccagaaggggaagacaatgaaaattcaagagaaagataatgaagacataatgactagaattagttaatttagcatggtcacaggacacaatatttttaaaacattctatatatgcgacaaacaattggaaaataaaatttatattaatataatttaataactagcaaaacacatatacacaatagatatgggacaaaagatgtgcaagagctttacaggaaaaatgagaaaatattgctgaaaggaactaaagatctgaaaatattgttgaaataaactaaatatctgactaaatggagagatatacagtgttcctggattggaagactcaatatagactcaatccccaaattgaagtctcttatacccaaattgatttaatttcaatgcaataccaatcataatcccagcaggctttttttgtgtgtgtatagaaattgacaggctgactctaaaatttatagggaatacaaaggacctggaagaaccttagactttggccctgccttctggggaagggttagttatctctttaaagatgattttttttttttttttttttttttgagacagagtctcgctctgtcgcccaggctggagtccaatggcacaatcttggctcactgcaacctccgcctcctgggttgaagagattcccctgcctcagcctcccgagtagctgggattacaggtgcgcgccaccacgcccagctattttttgtatttttagtagagacagggtttcaccatgttggccaggctggtcttgaactcctgacctcgtgatccgcccggcttggcctcccaaagtgctggggttacagacatgggccaccacacccggccaaaaggcgatattttttaaaacacatcaattgatttaccaaatatatatttttaaacttttaggcttggggatacatgtgagggttcgttaaataggtaaacacatgtcacgggggcttgttgtacatattatttcatcacccagatattaggcccagtacccaatagttgtatcttttctgctcctctccctcctcccaccctcagtaccaggaattaaatatgaataatgaaggtagctcagccaataaaactgaatcagttcttcagtctgtgggcaaacacaaaattcttctttcagaggtttgataagctgttgtagtttcgaaatgatccaaataataacttacatgacttgatttattaagaagcctgaaatatattaaacaaatcacagctccaaagaatgaacaataggataatggaatgttaaaggaaaacaaaccaatttaaaggaaatttccatctgcaaaaggcttagtaggatctgctaactcagaatcaggagtgttctttaatttatgaggttctcatttcagtactttaaaaaattaacggtaaatggccccatggcttatagcaaaaggagacattctatttaagcaaagttattagaacaatggtgattgtgagaagagctgaaaacaaaagtcagtcactcagcaactagaatgccagaaagaaaaaagaaaagacaaaaatagaaatacatctaccactggtcctttcaggacatctggatacatggctcataactaccccaagtaacatccctttcaaacacaagaagagaagtcttctaactgccaaaactgttctaacagaacatgtgtatcatatcctaattagtattagcatattttttgaccaccagaaagttgaaagtgaaatgatgttatttaatataaacctgttcttaaataatacttctcctaagaatattttttagttattaaaatagaattttggggaaagaaaagacccacttcaaatactctgtggtcaaatataaaattataatttacaacagataatatattcaaatgccctcaaattttattatgaattgaactgaaatattagtactatgggcttaacatcaataattttatagcaaagaaaatacagagagggaggaggggcaaaatgaatgtctttttatcacatgtcctgactcacttctactggtgcttgtccaggatgatgcaattattgaatcataagctgttccactgatgccatgttcaaaatgacaagtctcagtctctcagactttcaacaagaatctacgacagccacagtcaaaacagtatgaataacaaaaaggtgccatgcaggtgtttcacagaaaaaaaaaaaccaagaaactattacattttaagaattaaaatttctttccttctggttacttcgtttagtctgttcattttttatgatcatactataatgacggaggctaactcttgcttagtacgtggcaggcactatgccaaatcatctacaggaattatcttggttattttaatcttggcaacatctctgagaatgggttctattaatatccccacttaagggataaggaaactgaggcttagaaggtctactgtccaaggtcaccaaggtggtggctctgtgagaactggaatctagattctcagacctccaggggaggagtttactcaatgcattctgttgttgctctccatattgatgacatatcaatgacatttattatggaaaaacatttgctgaatcaatttaagagaagttggaaatgtcagtaaaaaccttcatagcagtatgagaatatgtttccaaaaaccaggagaaggagatgccccaaaatgttttaagaaggaatcagaaagtcctgagcaaggaagcatcgaaaaatgatcgagttcctagccaggagccaggaaatgtgctttgtaattggaattataactgccctgagtaaaacagattgtgttttcatgaagcttcaacagctcattgtaggagacatacaaggaaaaggccagttaaaatacactgtgattcatgccgccatgtgagaatatcaaaggacctttagacatagagaggtgtcagagaagtcttctgatttgctacgagctggaaaggtaagtagagagggaagtcgaggaagagaagacagtcatgtgtgaagtttcctggcacccagagtatagctcttttaggggaacccaaagacaacagaagatgacaaaaaaatatactaaataacactagaaaacactgtccaaccaaggttctaagtgatctgaaagtcacaggttaaatttcataaggacaaatataagatagcatctagggaatggaaagtgacaagcacaatggtcatactgccttttcatatttagaatggcacagtattctagtgcaatgcagagcccagaactaggaaatgggcaactactgggattccagatatctttctatcaccaactcacagggtgacaatcaacagctctttcagcttccctgggtttcggctccctctttggtaactcatggataaagctaattgtctagcaggaggcaggttgcttgacctgatagtctcctcgggactttctaaaatcaatgactctctaactcagatacatgatggctaacaaccagggatgaacaacaatactatcttaatgagaaccactaatagaaattaacactatgtgtgaggtaggtactattattatccccattatatagacaaagaaaaatgcaaactcagagaagttaaattatctgcacaatttcatataactagccattagtggagtcagagttctctttcaggcatcccagctacagagtccatatccctaaccatcagaatatgccatatgcttcctctttcttacaagttgcaatattcccagtattgttactctgtgtgtatttatgatacgtaactttttaatcttcataatattcttggaaggtgttattcccattcagagatgaaatcaaaaccttgagagttcctacagggatttagttgtggcactgggcctagattttatcatgacctctatcactatgctctttcaaatacagcaaattatagagattaaataaaccagcatcatagataaatgaactgcaaatctcattcactcaattttttgtcatcaattaatttataaaaagaatattagtattaacaaaagatattttacttttataaatcagtcactgtcagctatttttttttctaaattgtagaattttactaattatgttccttttggactgtataagatgtagcacctttaagttatttaactatgacatagtgcttagaatttaaacatttttaaacattatattttgctatggctcatttggaaaatctaagctttaaaaagactaagacaaattaggtaagagagaaaaagtagactcccaacaatttttcatacccatatcgtacaaaagtttgcttttctaatattataaagccaattcttaaattttatttcagcatgtcctgatagtacacaggtgaaaccaaacaaccaccacatcaaaataatagcaaagacaacaactaatactaattagttattatggtctaagtactttattaattctaattcttacaaaaaccttatgcattattactagccccattttatgaatgaggacatttaagctcagaaagggttgctaactttcccaaagaaagtcacacaactagaaaatagccatacggcaggtctttgaataatgttttgttcaacattgttttaacgttgatgagaaaaaaaaaatgatgctgactgggcgcggtagctcacgcctgtaatcccatcactttgggaggccaaggcgggtggatcacctgaggtcaggagttccagaccagcttggccaacatggtgaaaccttgtctctactaaaaatacaaaaattagccaggtgtggtggcgggcgcctgtaatcccagctacttgggaggctgaggcaggagaaactcttgaacccgggaggtggaggttgtagtgagctgagatcacaccactgcactgcaatccagcctgggtgacagagtgagactccatgccccaccctcaccccccacaaaaaaaagaaaaaaaactgatgcctgcccagctctgtccagggccactgtctgtgtagagttggctcgttcttcccatgtctgtgtagtttttctccagatacttcgctttcctcccacatcccgaagctgtgtgtgatacggtaactggcatgtctgaagggtcccagtttgagtgtgagtgtgcatttgagtgcaccctacaatggggtggcgtcctgtctatagggtcagttgctctgagctatgagtataagctgcaggccccctggaccctgaactggaatgaacacattggaaaatgaatgaatacaaattattattattgttttttgagacagagtctagctctgtcaccaggccggagtgcaggggcacaatctcggcttactgcaacctccacctcccaggttcaagcaattctcctgcctcagcctcccaaatagctgggattacaggtgtgtaccaccacacctggctaatttttgtatttttagtagagatggggattccccatgttggtcaggctggtgttgaactcctgacctccagtgacccgcctgccttggcctcccaaagtgccgggattacagacgtgagccactgtgcctggcctacaaattaatataaaatgaaaattcataaagtctgcgataatcattcaaatgcatgacaataaacagtgcagtttaaaaatgctcagcaagcctgccctaattattatttctgagctatgtggtgacagggggtgcttcttacaattttcactttgcaaatatttattccttgatttcatccaccatcactatgatcactatcactcactggttcaccaaaaattgggtaaataattattttttgtttttattattcttaaatgtatatatatagctcacatttatttcagtggttaatattataagtgttttgggtctttatttagaagtttagtgatgtttttgtgaccagaaatatgccacaggaacttaactcttgtttatatcaattagcctgtggtaaaattggtttcattagaggttgttttgcttaaggtcacagtttccaagaacctactgatgatgttaagtgagagcttactgtatgtggatcccaaataagtagaccattccagatggcaggctcttcaccattatgctaaacatacaatgttatgactttcataaacagcagattattatgaggcatacactgcatgctgtcagactcctaaatctaggttatcaaagtaagttactgacaagttagagataatcagcaagcaattgagatgatatctacttgctcaagtgagatatctgctgtggtcaacccaggggctgtgtcagggtcattgtgcctcttcttctcctccttcgtaacaggcttagaattccatggtatctgccacttaacatacagcacaatctcctaatctgttctagcctaggtcctaggatctcaaaccttcagtccacacagagtggtctccagaagaggagatgtaacagaagaggaaaacagatttctatctagccttttaacaaagtcagtatcagtttggcctgaacatagtttatgattttttcatttttcattgatactttattttgacaaaggtataggggccttgaaaatatataggaaattagacttttgtgttactgtaaaatttataaatctaacaaatcaaaatttcccaaatttggttgacgtcgtgattacaaggagatcgccaccaaaataatgtttatatcctagttgtgactaaaatgaaatattcctaaaatatgttaacaaagtatagcagcaaaattgaaacaactgtaaacttcaaaaacttaacacaactatactttaaatgtctttttacacattagctgtcttaaaaactaaaaacgtagcatgccattgttcaatttaggatattttctttatgagcagaaaacaagagaatcacaaaatcaaataagattcttttataatttaagattgcttggcagaaatagtgaatggtataaggctaatgaaaatcgacttctgatgctaccaaagcagcaacatgtgtgctcagtgctttctgatttacaacacaggctttagtacacagcactgtaaaggaaatcccttttcagagagggtgaagctctttttaatgagcactttcctccctgcctgtctctcttttctagaatgtttatatagtacaagaaatgtatatttgacatagaaaatgtcaaatgttcaaatattcagaattcttttgcaattattgcagtttattcaaattgtcttaccaaactaaaaagtagagactaaatttcaaaatcttctcatctgttacaaaagggaagaatatagtctgtaacatttttataagttgcagtcattaatatttgtaagaactgaaattggcatttcctccttctatgtgaaacacacacagacacacacacacacgaataaaaagaaaaacttgcacttgaaaacagactttaacccagtgctgctatttctaggcctcaactctaatgttagttatttttttacagggcatcacactagtaaagaattaaaggcccccttcctctgtaaatcccacttaaagtacatgttatttctaatgtctattcaaagggatagagagtgactttctgggaaatccattttaccattatagaactggagattgccaagggctaacttaagtgttaatttttgctacacaagaatttcggcctgaaaaacctacttccttccccagtaaagactataaaatcacattctcattgtagaaatttagatcaaacaccaagggataagtatcatttgtgtgaaatgacattgatgttttcaggcaggtaacagctctaccaaaatatatgctgctaaaatgcagcttttatgcaaccttcaaaaaccaatagctttgttttgtagaggataaagtctaaatttcttcagttagcaaatatagctctccacattctgtgcccagtctgcctttccaaaacgggctctcatttttttaagtacacattccagtgtcagctttcaatctctgttccccagtgaggccatctgagtttgttcatttggtgtctttttggtttgaggactacaccctcaaaatacaggcagcttgacagagtaaacctgcctatgattcttcagtattcatctcagctctctgggcctccaaggtttcttgagcattctagcccacagttgtgatggtggattacctgttgattttgtctcacagcatcagctcgtgtttccggtagcatactttggagcttcaattacaaaatttgaaatgtgacttcagataaaactactgaaaatgcccaatgaaactataaactacaacactcagtgaatggggcaggttataaggtgttacaatagtactttaaaaaactgatttaatgatcagactaacatagttgattctaactacttgtagattccacatctgcaagtttacacatttgctacattttatttgtaacccccaaatccacacttgctttcctatcgattcgtggataagcacagaatagcaaaaaatttgagtcgactgatatgcatgttcccagctgaagtcaaacgaagtgacacgccaccttcttgttttagctctcaaactgtaaacaagtgtccttttcatggtaaatttagtggcacattttttgagttttgtgctttttgttgggaattttgctgtttaaaatggcctctatgcatagtcctgaagtactacctagagttcccatgtacgagaagactatgatgtaccttacgaagaaagtacatgtatcataagttttgatcagacatgatttatagtgctgttagccatgagttcaatgttaatgaatcaacaatatatattaagtatggtatctttaaatagaaacacacatgaaacaagggcacaacttaaaattttcccataaatatagaaagagaataggtcttactgtatttgtaaatatttttccctacaaatgctccttgtattattgacaaaggaaaacatctgaataatttttctctccatgcatgccaacctggtgaaattttacacaaattcttaattattgttgcattacatgtggtaaaactgaagtggagggaggatcagagagagaagcctcttctacagatttctctcttcttagtcctccaagttcctgagaaaggatgaggggggtcaaagatgatcctactgtctttttgtggcgattgttaaacagtggtagtatattctttcttagttgctttgctttaccaaaatgcaggtttccccaaggatatcattttccttacaacactatctgatgatggctgttccttctctaactgcttctacctgagagattcaaggttaagaagggttagcatccccttcttcactggacaattgcctactctcttcatgatgactcatcatttcatgtttgagatctatgagtggaacaggctcatatttctatcccctaatccttcttactataatctatcttcttagaagactttaccccttctgttttggaatctggctctcttcctctccaactctgccatgcatcagtatccactgttatcagatagtggactctatccacacccaggccttgggtttttgcttcagttatagtggtttaaaacacagtatttcctaaaacaaactcttcttctaggttttaacctgctgctttcctgcagctttcatagccttgtttcctagtcttgaaacttaccctcttcctgttctctttctcatttcttcatacatctaacaaatattttgagagcttatcatatactaggcactggggtataccacagtgaaaaacacaaacatgaacctttgctctcccaaaacttttagactagcaggagctgtagagacgagtacacagtagttgtaatacaatgaggcaaatgctaggataggggacacacctggtgcggtgatggtactgaagagggatatctaacccaaacgtgggagatcaagaatgggcctgcatgacaatgtgatattcagctggattttggaggaagaggagaagtgaaaaggagatgaaggttagacgtgaggtgaagtatagggaacagcattatgcaaagacacagagccaagaaagagggaagtaaaggcagtttagaaaggttatacaataaaaagctcaccaaatcataaaagaccctgtaagccatggtaaacccttagactgtactcaggacagtgagaaccctagggtgttctaaagaggggactaatctgatcacatgtttatgtttgaaagctctagctgcagtatagaatatagattgaagatgacaagggagccagtcaagatgatgatgcagtcatccagctacaaaattatggtagcctggcttaaggtaggagcagttaagaatataagtagaagggtttgcgaggtatttatttagtccaatctatgaggcctaatgactgaaattatgtgcacagagaggggaaaagggtagttagggattatgtccagatttctgctttggggttgatagcaccatatatttcctgagatagggactacaggagaaagaggaagcaggccttagaataagtcaatgaattattctggacatgttgtgtttgagagacctataactcatccaagaaaagatacccagttagatagttggaaatatgggtcaggaggcaaagagatacatctgagctggagatacagtagatatggctgtcctttgcataaggacaaatggtaactgaagcaacagaaaaggatgggatcacttagagaaggagaaaatgagaagagggcctagcacaaagctctgagaaactctgaaagaagaacttgccaagaggctagagaagtagaaggaggaaaactagaaacagaattgtgtcacagaaaccactggcagatgcctttacaaacaggatcctggtgtctagcacagggctggtgccaacagtaggttactggaaagtgcccactgaatttaaggacaagcaggtcactgataaccttggaaaggtcaatgtgaatggagtggaagcagaaaaccagtgattctgtaaggtcaatgaattgcctcatactttccaaatgactcccacatctatccttttatttccttccctactgctaccactccagttaatgcttttactacttcttgccagacctttagtaatgactcatataactgccttcgtatgtagtctctcttcgagaactgtctccccaaacaaaacaaagcaacatacagctcatcctatgtacaactgccagagtaatatttctaaggtacagcttagaacaagtcaatcctggcttaaaaacataatggttctctactgccttcagagtaaaacccaaacctcttagcatgatgttcaaagccttccattatttggtcccaatctaactgtccagccatatcgcccacattccaaacacctatctttataaaaaaatgctgactttaaaaaaattaaagccattcaaagagtcaggattatagacatacagacaagaataattttcctcttttgttgaggaaaaaaagatgtgtccagggctctcttcatttattcaccaaaatgaacaaacagcatctgacagaacagaactgtcataaaacacagacaattgtcccttttgtgttgtggcatgaaacacatggcttacagagaaaaaaaatggtgttttagcatttaataacacatttgatcaatattaatctgttacagaaaacatttctactctattattagctaacttattttatattctcagctaagtaaaatgacaaaaaatttataaagatataactttctttataaaggttctccccagcaatcctgtagaagctatccgatggttcctaattgaaagatggtagtttttacatacttcactaacctagcaagtgtgatagctttgcacctatactacaagctagttgggaaataattatataggtaaaaagccattttaggctttcagaccaattttaatccaaacagatgagagagacctataacaaatttaagagaagatgttctaaagatgacctaataatagatgaagagagttttgttatataattttaggggtagcttaatcccttcacaacattcctagtcatttaacttttctggggtggctttctaatattttatacaatcacacacatgcacaaacacacacatgcatgcacacacaatgcggtatgctgatgacaaaatatgcttagcaaaaactttgtccttctataatttggtctgcttgtcttggtactacattgtaatatggggtaagtggttgtaaagtgatcctaggattgatcataagaagattactgtgtactttataaattctatatcccaaagaaataacagctattaaaagtattcttactgagattggtataatgagttttcatattatgaactgcaagaattggctatctcagacatattttcttggtttatatccttccctaattataatttatcatgttcttcagttagagaaaaacattttcatccatattactgaactctcaacatattctacgttttttttatatgctgggttttttacttgcaaaataatattaatacaggcatacctctgagatatttcaggttcggttctagaccacaataaagtgaatattgcaacaaagcaagtcagacgaattttttggtttcccactacatataaaagttatatttatactatactgtagtctattaagtgtgcaatagcattgtgtctttaaaaatgtatttaccttaatcttaaaatattgcttaaaaatgctaacaatcatttgaactttcagtgagttgtaatctttttccttgtggagggtcttgcttcagtgttgatgcctgctgactgatcagagaggtggttgctgaaggtggggtggctgtggcaatttcttaaagtagacaacaatgaagtttcacttttcttttcataaaagatttctttgtagcacgagatgctgtttgatagcattttacccacagtagaaactctttcaaaactggaatgaatccactcaaaccatgctgctgctttaccaattaagtttatgtaatactctaaatcctttgttgttatttcaacaaggttcacagaatcttcaccaggagtagattccatctcaagaaaaaaatttatttgctcatttgtccataagaagcaactcctcatccattcacgttttctcatgagattgcagcaattccgtcacattttcgggctccacttctaattctagttctcttgctgtttctaccacatctgcagtgacttcctaaactgaagtgttgaacccctcaaattcatctataactgttggaatcaacttctttcaaactgctactaatgttgatcctttgacctcctcctgcgaatcacaaattcttaatagcatctagaatggccaatccttttcagaaggtttttgatttactttgcccaggtccaccagagcaatcactgtctatagcagctatagccttacaaaatgtactgatttgaaacttgaaatcactccctgattcatgggctacaaatggatgatgtgttggcaggcatgagaacaacatccatcttgttgtacaattccattagagctcttgggtgagcccaggtgcactgtcaatgaacagcaatattttgaaagtaatcatttttttctgagcagttgaacaggtctttacagtggccttaaaatattcagtgaagcatactataaacagatgtgctgtcatccaggctttgttgtttcatttctagagtacaagcagagtagattaagcataagtcttaagggtcttcggatttttggagtggtaaatgagacctggcttcaacttaaagtcaccaactacattagcccctaacaagaatgtcagcctgtcctctgaagccagacattgactcctttctagctatgaaagtcctagatggcatcttcttccaacaaaaggctttttcatctacatggaaaatctattatttagtaatcttagctagatcttctacataacttgctgcagtttctgtatcagcacttgctgcttcaccttacacttttatgttacagcgctggcttctttccctaaacctcatcaaccgacctctgctagcttccaatttttcttctgcagctttctcacctctcacagccttcatagaattgaagagagttaagctttggcttaaaggaatgttgtgaatggtttgatcttctgtccagaccactaaaactttcttcgtatcagcaagaaggctgtttcactttctgatcattcacatgtttgctggagtagcactagttatttccttcaagagcttttcctttgcattcacaatttagctgtttagtacaagagtccttgcttttggcctgtcttggcttttgatgtgccttcctcactaagtttagccacttctagctttttatttaaagtgagagacatgcaactctttcacttcaacacttagaggccactgtagggttattaattagcttaattttaatattattgtctctcagggatttgagagtcccaggaagagggagacagacagggaatggccagttggaagagcagtcagatcatgcgcaatatttatcaattaagtacggtgccttatacaggtgaggtttatggtgcctgaaaacaattaaaatagtaacatcaggctggcacggtaatcccagcactttgggaggccaaggtgagcggatcacctgaggtcaggagttcgagaccagcctggccaacatggggaatccccatctctactaaaaatacaaaaattagccaggcgtggtggcacacgcctgtaggcccggctactggggaggctgaggcaggaggattgcttgaacctgggaggcagaggttgctgtgagccaagattgaaccactgcactccagcctgggtgacagagcaaaagtccgtctcaaaaaaaaaaaaaaaaagaaaaaatcaaagatcactgatcactggtcgtaacagatacaaaaatgatgaaaaagtttgatatattgagagaattaccaaaatgtgacacagagacacaaaatgagcacaagctgttggaaaaatggcactgacagactcgcttaatatagggttgccacaaaccttcaatttgtaagtgaaacaaaacaaaataaacacgcaatatttgggaagtacaataaaacaaggtatgcttatatctaaatatgacagaatacccctataatggccacagctattatgttatcaattgttcttagaagcaataccagaaacatttggagggctttactaaaattcagatacccaaccccaaaattctaatttaggaaatctggtatacagccttggaatttgccaggtgattcttacttgatacttagccacttgggctgaggtgggaggacagtctgagcccaggagttcaagaatacagtgagctaggatcatgccactgtgctccagcctgggtgacagagcaagaccctgtctttaaaaaataataaataaataaataaatacatctaatgggggaaaaactccaaaactcttggtttctaaatatcatataacattttccccccaaatagtgatggtcagtaaattaaatacattgaaagtagggcagagaaactcccaaatgtgatcctaaataaatcaacataaggagcaagccaatttgagaaattccgtttaactataaaaccaccctttaaaaacttctcattatcatgttaaaggtattcagattcaatgaaacagtactaataacttccaggccattcctaaaagatcttataagccctaaaagaccttatgaaatacttaataattagtacagttgtgcctttaatgtttaaaagaggcagagacaaacaagttaaaaggcattttcctaaccctgactgtgagtcacaagcttgatgctgcctgaagccaactggcatggtgcccatttacagtaagttgtttactccctgtctaccaatcacaccacagagaaggaatgcctagagacatagagtgtcttttcaagatagatcaacagagaaagaggaatttataagtttattaaattgttacagatactgtttttaatattgctccaaaatattccaatccactttccataatctcagcatttttaaaccaaataactagccctcaatagacaaacttacagtaatagtttatcagtggaatgggtagtatcctctcatcagtttaaatatcttttaaataaaatttttaaaggacacaatatcgatcttaaaatggatttgaacttaagccaattagactgaagttgatttaaattgttttaaataaccaatttttagcataaagactgagagcttaatattaatattaatattaagaaatggagcatccagagaaatagaaaatagaaaaaatgaaccctgattatcaagagaaaaatgggtgggaagtatctgtctagtatatcaacaatttcacttaattcccaagcccaaatagcagagcaaatcactccagtaacaatatttaatactttctttggaccctcagagctagtctggactgtccctttcctccactgccctgtttttagtacattatgcccaataattttggagttttggttcctgcaatcttttgatcctatagtgatatttctgctgctgcttcttttacttttctgtttctcacaatttgtatttctcaaaaaaaaaaacacacgcaaatgttgtcacattattaaattactaaattatcctatacttctttataaacatatactttttgctgaaaaagctcagtgctaatgatcatcagatgtacgttacttttccttttaagagcccaaatgagaaagaatatacacacagaatactaggattagtttacaggtcagagtacacacgttatttctaagatcttactaggtgcaagatttaagttagacttcagtcaataggtaaataaataaaatcaaattctatctttgtcccaatagttagtacctggaaaggtgctggattcatgaccttggaaattgtatagtttataaacagaatttcgaaataatgctgaggcagcagtggtacttcctcacctcttcagtgcttgtattttaaatccaaagggctaaaaaagcatcaactgtaaataggttgaaagttacatatttataacgtattgctagtgtatttgccacaggaaagcaagtttgtcaacatggtaaatagcttgaaaaaagattatgcacaaagaaaattcaaatttagattgatactttaataattacagggaaagttacattttttagataaatttctagcttccactttctctttaaattttaaccaatgggaaaaagaagaacaaaaaacaccactttgtcaatttaacaaaactatatatggtatacaaaattgagcatagcaacatgagaaagctgaaattggagaaaatcaaaaaatacacgttttacctaataagtgaaaaataattctacaaacatttaaaaagaattctgtaatcctcagtgtgcagctgcattggcaaaaggcaatttaaacccacctcatgaactacaaacaggggaatgccatgctccctttctcttgctctccttcagtttccacacttaaaaaatttcctagagccacgtagattcctagattccacactcactttttctttttatgttgtgcaaggtagtatctccaaaatagaatttctaacactcaataaaaaagaaaattctgtgcaaacattttagttgtcttcactgaaaaatacatatcttcataactgcattgtaatttgtctattttaaggtggtatagttactagaagttcataggccattccgaaagtctcccttcatcttctcttattactcctcaccttctcttatatattttagacttccagaactaaaactagttcttttggttaataactaacgtaaaaccctgagataacaaaaaaacgtaagcacttgagtgaacgaataaatactaaatacttgatcaagccaaacgatagttctttcatctgaaaacagaaaagttaagatgccttgatcgttaagttattgtgtactactgaataggaagtttatgttctgtaaagcgggtaaggatttgggtagatttctcttcccatcctctcttgccagcagcacttcccgttcaccaccccaataaattaaacatttactatatacagaactccccacctaagatgttttttcttaatcattcagtgagacccatgttagctcagcagtggacataagaggacatgagaaaggaagaaaggctctgggacaacttctacattaaaagcaagttttccacaggagtaacgtatttaattctgaagagggatagccttataatgttcattttgatcatgaatcatgaatatgatagcatcctttgaacacttttgccattataaccatctaatatctggtaccattaaatatttgtggagagaattatattgtgtaaatattagcaaagaattccaaacataagagcctcctctttgcctttagttttaatcagtcttaatccattcttgctaaaacaagagtttccaaacccttagcaaaatattttcttttaaaaaattaaatcttggccgggcgcggtggctcacgcctgtaatcccagcactttgggaggctgaggcaggcggatcacctgaggtcaggagttcgagaccagcctgaccaacatggagaaaccccgtctctactaaaattcaaaattagccgggcatggtggcacatgcctgtaatcccagctacttgggaggctgagccaggagaatcacttaaacccgggaggcagaggttgtggtgagccgagatcacaccattgcactccagccccgtgaacaagagcaaaactccatttcaaaaaaaaaaaaaattaaatcttatgcagaacctccaatacgtaagacagataaaagttgctattttactgctaaagcttcctttgtacattcaaatttataatattaatctgcataggaagcaatcagtaagatcaatgaagatgttttgataaaaccaatacaactgaaatggaagttataaacaatagttatgtcagggttatcatcaaagtttggatttaaacagtttgaaagccactaccctaaaacctcactgtgtccccattaacagctccaagcctcatttccaaacccctgtgaaactttctccccgtataaaaataaagcccaaactttaacaaggctcaccaaaatctagactgtaacatatgtctcaccagtttcttgtaggaactatcttccagtcagtatggctttctcagtgttcctcaatataccaagttcagccattcattctaacaaatacatacttgagtgcctacaatgagtctctagatttttgcttattctgcctattattgtcttggactcttcctcaaccatcctcaacaaaagttctctcttatttcccaaagtactcagtccttctgccactcatgaatcctgaagtgtttgcttttacaagctgtttaaatgataaacagccatatggtatagcgtcaaggctgctaataaatgtactaaaatacacaattctgtcttcgatttggatttttaaaaatcaagtttttagctggatgcggtggctcacacctgtaatccccagcactttggaaggctgagacagacagatcacctgaggccaggagttcgagaccagcctgcccaacatggagaaaccccatctctactaaaaatacaaaaattagctgggcatggtggcaggcacctgtaatcccagctactcggcaggctgaggcaggagaatcacttgaacccaggaggcagaggttgcagtgagctgagatcaccctcctgcaccatagcctgggccacagaacgagactccgtctcaaaaataaaataaataaataaataaaataaatcaagtttttatttctactggaaggagaaaaaacccatttctgaatttcaaaagtgaagacttgaaacccatgtactatttataggaaatgcatgtgcaaatgtgtacagtttaagtggtatttgtggtttgtttactctgttgagtactttaaaattttaaagtcacagtttggcacacagaaaagctacttggttgtcaaaaaaagccacattttacacacacatgattaaagaataattatctaaaatgtttttcatagcacagtatttgatcaaaagtttcaaacatattaaatgcatgagttccactctactaatatttgtaaacttaataaaagtacttctagtggcttgtatacaattcagttttaaactatgtttacatttttctgtgactttctgtgctatcaagcttttctaaatttataaatgactgcctttttttagagaggacttgagacagctttaaaaaacaggtaaaattcaagatggcaatttaaaagagagtgaaaagtttatcaattacatttctacaggagtagctaattggatcactgttaaattatttagaaacacaaaatatttaggatagtatcagacttttatctttgtttgctgattaacttaagcctaatctaaaattttctattgctacatcaagggaacaatttcaacatgacaatagaagaatacaggtctttaaacacctaaccttgatgccacaaatagtactaggctttgtcttacctataacacttaataaagcattaaggacactgttccacctaatgatgtttccggggtttctggtatctcattagggactcatctaatatgactgatatatcaacagtaagcagagtgacctccaagttagatacatgtaaatacacagccaagttctaatgtaaatttcctctgctataaactgatagctacactgcagggtaccaggttttatcttgagtctatccagtgaaaaatagaaacaagcacacaaaaatcacaacatattaaatacaatttcaaacaaataagctatcctatagaagaacaggaatgagataaaatgatctactgcaggacaattctgaattaagcattctcctgtcaacaactagagagtctactgggtatttagtttgaaaacagttcaaactgtttttcttaacttaggcaacagctttcttttttgattgttagattaagctagcttattcagtataagtaggaagcatggctgaatgactaaagacaaaataggtagcagcaacactggcattaacttcattagattgaaaccttggtctggattacagcataaactgaaaattgttaaattttaataaaattaaaaaaggaaataaaaaattaattgccagaagctttaaccaacattcttaacactagtatcagtgccttaatttttctactttccattgatttctctaaaataaaattaaaatgcaatataagtggcattcaaggtaattttttaaaccttagaactccttcttcaaaggaaagcttctctagaaataagatgtgtaatgcaagccgggtggatttctctacttgcacccaactctctgagctacctctataacccctgatagttcttctgagtagttaggaaaacactaataaacaattgctcaaacactgccttatagataaagatcgctctactactgaagctgttgcctggtggacagtactaccaggcactgacttgaaatatttgtcagctgctgtaagaaattcctagatgtcccacgaataacagtttgatggagggggcatcaatgtaatttccaaacaattggaaacttgcacacaaaaagttcatttgttccaaagttgaacttatgacaattgaggaccaccagtatgctagacaatgtacaggaatcattagattctaaagtttagataaatggtaaaacagcttgaaagacctctagtattgaattttggtcaatacgaattcatttccaaaatcaaaggggagtaacagtatttttaattattggctagccttgagagagacaacatttgggttttacaaaaagtgcttttaaaacaatgtcagcaaaactggtggaaaaaagaactcaagttctacatatccataaaagcaaataaaaagggcaaaaactgtcaaactgaactttttcggaacctgaaaattaatcaacggcttgaagcagcccagggaatttttactgaaaaacaaaaacaaccctcttccccagcttattcttggtaagaacagcaaactctgtggtgttttacccagtccccatctatcccttgattcctagcttagcagtagccatgaaaataacagtccacattccacattcctggtatgaaagacagcagaatggacctctttcatgaagacttgtttttttttttttttgttgagacggagtcttgctctgtcacccaggctggagtgcagtagtgtgatctcggctcacggcaagctccacctcctgggttcattccattctcctgcctcagcctcccgagtagctgggactacaggcgcccgccaccacagccacctattttttcgtattttttagtagagacagggtttcaccgtgttagccaggatggtctcaatctcctgaccttgtgatccacctgcctcagcctcccaaagtgccgggattacaggtgtgagccactgtatccagccaaagacttgtaattaattatttggtttacctgtctggtgactccatggaagaccacctcaaaaggattgtctttattttgcctaacttagaactggcttagtgcttccctggggcacatgacgggtggaggagttgaaaacatttatgctaatctcttaatttgctgctgcctgacagataactgttgaagaaaacaacacactagtctaaagattgagaggaaaagctggggagtctgtaagggctttgaaagggtccaacatactcctggaaatctagagggccacatgcatgagtagggctgtgtatatgctcaggaaagatggagtaggctccaaactctcaccacctgttgaccttaatgctctgcagaagctggtagtaaaggctaaggcagggttgtaaactccctgggtaagagttcaaggcctgccctaatgcatacacagaggccatgggcaaagactggaagatattttgcttctaggcatttaatgaaatctctgttaattattaggtgaccactaaactaacaaacagagacttcagggtgcccacaatcttcaaagaatataaaatttacagaattagccatgaaaagtcactaaacaaacatctacaatactcaccaacaacaaatactggggaggggagacagtctgactgccagagttgttacactataatattcaaaatgtccagttaacaacaacaattacaaggtatacaaagaaacgaagtacacaggaaaagaaagaaagaaaacagaaactatgcctgaggaagcccagatactagacttcatagacaaagacttaaaatcattgcgtgaacccaggaggtggagcttgcagtgagctgagatcgtgccactgcactccagcctgggtgacagagcgagactccatctccaaaaaaataaaaaaaaaaagacttaaaatcagctattttaaatatattcagtgacataaactatgtctaaagaactaaaggaaagtataaaacagtatctcattaaactgagaataatataaagatagcaatgataaaactgaaccaaagagaaattttgaagtagaataactgaaatgaaaaattctctagaaaaaaattcatctcacagatgtcacttggagaagagaaaatccatgaactcgaagataggtcaaattgagatcatccagtctgaggaagtgaaagaaaaaagaatggggaggaaaaaactggacagagtctcagagacttctgggacaccaccaaacaaagcaacacacaaataatcagagtgacagaaggagcggaaaggggcaaaaagattatttaaaaaaaaaatagtggcaaaagaacttgacacatctgatgaaatacatctacaaagctcaacaaactccaagtagaacagactaataaagtacacacctaaatgcatcacaatcaaactaccaaaagctaaaggcaaagaatgaatcttgaaagcagcacgacaagcaagtcattacaaacaagtgatcctcaataagattaacagttgattccttatcagaaaccatggaggtcagaagacagtacgatgacatattcataatgctgaaagaattacatgtcaaccaagaattctgtatcctgccaacactatccttcaaaaatgaaggataaattaacacattcccagataacaaaaactgtgagagtccatcattagcatatctccaacacatgctaaaaggagtctttcaggttgaaacaaaaggacactcacaataaccctactttgcctttagaaatacaacatcaggaaagggaattacataagtaaacatacaagacagtaaaaatgcatcttttgtttatatctccttttctccgtatcggattctaaagacaactactaagcaatatttttaaatctacattgataaacacacagtgtagaaagatgaaaatctatgacaataacagcacagagtggaagcagaagaggtatacagaggcaaagtttttatacactgttgaagttgagttgatattaatctaaattagattttttttttccttcatttctttgggctagttttgccctggtacccaggctggagtgcagtggtgtgatcaaagttcactgcagcctcaacctcctgggctcaagctatcctcccaactcagcctctcaagcatctgggactacaggcacacaccaccatgcctggctaatttttgtatttttttgtagagacagtatctcagtaagttgcccaggctggtcttgaactcctggactcaagctatcctcctgcctcagtctcccaaagtgctgggattacaggcatgagccactgtgcccaacctaggctgttaaaatgacaataaaatctccgtggcaaccactaagaaaataactaaaaacatacaacaaaagaaatgacaaagaaattaaaatcgttacactagaaaatatgtaatacaaaagaaagaaggtagtaatggaagaatttaagaacaagagacacaaaataaaggaaacaaatggcaaaatatcagaagtaatcttcctcatcaataattacattaaatgtcaatggtttaaactccccaaataaaaagcaaagattggcagatccaattgctatctacagagattcaccttagactcaagaacacaaatagaaagtaaaagaagaaaatattccatgcaaacagtaaacaaaagaaagctgaagtggctatactaatatagacaaatagacttaagataaaaattgttcttatagggcactgtataatgataaaagaatcaatctatcaagaagatataataatcataaacttacttgtacctaacaatagaatttcaaaatatataaagcaaaaagtgacagaactgaagaaaacaataaacaattcagcaatattagttggagatttcaatatcctacttccaatagacagaacaactagatagaaatctgcaaggaaacagatttgaacagaactatgtaccaacacacctgtcaaacactctacccaacaaaagcagaatacacattcttctcaagtgtacatgaaacatcctccaggatagacaatgtattaggtcataagacaagccaaataaattttaaaagatagaaatcatacaaagtatgttctcggaccagaatggaatgacactgagaattaacaaagaaggaaatctggaaagttcacaggtatgtggaaatcaacaagttcctaaataataaacgggttagagggggaagaaatcacaatggaaatcagaagactataccttgagacaaatgaaaacaaaaatacaacataccaaatcttaagggatgcagtgaaagcatatacatttctgagaaggaaattcatagcagtacatgaccaccttacaaagaagtaagaattcaaatcaggaacttaattatccaccttaagagactagaaaaagaagaactaagtccaaagcaagcataaggaagaaaataataaagaccagtgtagaaataagtgaaatagagaagagaaaaacaatagagtaggtcaacaaaaataaccaaagctgggttgggcacggtagctcacacctgtaatcccagcactttgggaggccaaggcaggcagatcacctgaggtcaggagttcgagaccagcctgcccaacatggtgaaaccccgtctctactaaaaatataaaaaattagccaggcgtggtggtgggcgcttgtaatcccagctacttggcaagctgaggcaggagaatctcttgaacccgggaagcggaggctgcaatgagccgagattgcaccactgcactctagactgggtgacaagatggaaattctgcctcaaaaaaaaaaaaaaagctgttcccctgaaaacggacaaaactttactttagctagactgaccaagaaaaaaaaggagagaagactcttaaattaccagaatccgaaatgaaagagtgaacattatgactgaccttacagcaaaaaaataagattataaaggaatactatgaataattatacactaaccaattagataactacatgaaatgaacaaattcctcaaccaactgtcaaaaatgactcaaggagaaaaaaatctgaatggacttataacaaacaagtaaagacattaagttagtaatcaaaaaacttccaaagaagaccccagatggcttcactagtgaattttaccaaatgtttaaagaacaattaccaacaatccttcttctcaaagtctcccccaaaacagagggaacacttagtaaactatacagcttactatacttactggtcagctacaacagaccaatatcccttataaatataaatgcaagcatcctcaacaaaatactggcaaactgaatctacaagtatataaaaaggattataaaccataaccaagtgagatgaaacccaagaacacagggtttgtttgacatatgaaaatcaattaatgtgataaaccataaaagaccagaaaaacacacaaaaatctcaatagctgcagaaaaagcatttgacaaaatctaatgccctttcctgattaaaacaatcaaaaagaaaacactcaacaaactaggaacagaaaggaacattctcaatctgataaaggacaactatgaaaaccccacaacaacacacttaaactgaaaggtttccccacaagatgaagaccaacacaaagatgctcattctcaccactgctattcaacactgcactggaggttctagctagggcaactaggcaagaaaaagaagtaaaaaatgtccagattgaaagggaagaagtaaaattatctctaattgcagatgacatgatcttatatatagaaatcctaaatctattaaatactctattatgctaatcaatgatttcagctaggttgcaggatacaaaaatcaacacacaaaaatcagttgcattactaatcagtagcaatgaacaatcttaaagtgaaattaagaaaacaaattcataaaagcatcaaaacccaaaatattcaagaataaatttaatcgaagtacaagacttttatattgaaaactacaaaatattaatgaaagaaactaaatatctacagaaatggaaagaagtcttgtattcatgggttggaagacctactaattgttatgatggcaatattccccaaactgatctacaggttcaatgcaatccctatctgaacttcaattgcctctttttttcttccagaaatggagagttgatttaaaattcatatgagtttgcaacgaacacggaatataggcaaagtaatcttaaaaaagaacaaagttggaagactcacatttcccaatttcaaaactttgtacaaagatgtaataatcaaaacagtgtggtactggcataagattagacatacagactcatagaattgtgagtccaggaataagcctatatatttatggtcagttgatttcaacaaggtatcaagaccattcaatggggaaagaataatcttttcaacaaatggtgctgggacaactaggtatcattacacaaaagaataagttagagccctacttcacaccatatacacaaattaattcaaaatggatcaaaggcctaaatgtaagagctaaaactataattcttagatgaaaacataggtgaaaatcagtttgaccttagatcaggcaactttttaaagatacagtgccaaaaacaaagaattaaaaaataaattggacttcataaaaattaaaaacttgtgagtcaaatgacactatcaagaagtgaaaagatggccttttaaatgggagaaattgtcctcaaattatatatttcataagggtctagtgtttagaatatatctgcatatatacatacacatatattctagatacacacacacacacacacacacacacacacacaccgacaactcaacaataaaaagacaacctaattttaaaatgggcaaagaatgttaaagacatttcttcaaagaaaatacacaaatgtccaaaaagcagatgaaaagatgttcaacatcgttagtcatttgggagacacaaataaaaaacacaatgagatacccatacccaataggatggtgtcttagtctgtgttctgttggtataactgaatacgtgagactgtgtaatttattaaaaaaaagaaatggatttcttacatttctggaggctgggaagtccaaggtcaaggggccacagctgatgaagaacttcttgctgctggaggactctctgcagagtcccaaggtgacacagggcagcaatcacatagtgagaaggctgagcttactagattagttctcttcctcttcttataaagccactagtcccaatccagtgataacccattagtacattaactcatgaatggattagcctattcatgagggcagacctctgatgacccaagcacttcttaaaggcctcacatctcaatactgccacattggggattatgttccaacatgagttttggaggggacaaacattcgaaccacagcagttggctaataagaaaagacagttaataaatataggcaaggacagagaaattggaattcttatacattgctgatgggagtgtaaaatgatacagccactgtagaaaaatgtttggcagttcctcaaaaggtaacacatagagttatcatatgatccagtaattctactcctaggtatccacacaagagaaataaagatatatgtctacacagaaacttgtatatgaatgttcttaacagcattatttataatagccaaagaatggacacaacctaaaagaccatcagctaaggagtggatagacaaaatatggtagtatatccacataacagaatattactcagccataaaaagaaaatgaagtgctgttacatgctacaatatggatgaaccttgaaaacatgttaagtgaaataagccaggtacaagaagccacatatatatgattctatttatacgaaatgtccagaataggcaaatccatagagacagaaagtaacatttgtgattgtcagggatgttgctaactatcctgcaacacacagaacagccctgacagcaaagaattatccaatcaaaaatgtcaatagtccagaggttgagaaactgttctacggtgaagtttaatctattaaaaagcaaaaaagaatcaatcatgagaaaataaattaatatcattctgttccaaacttactagagcactaagtcctcattcattttgacaatatcagatcaaaaggtgaaggagtattcagttatcagtctcaagtttaaagtgcaccttggagttcacctattttaagatgtcttcaaaatcttgcaatcttcaagttttttctttttaaatgaacccagctaagaattcatagaagagcagattaaattggaatctggctctttccagtcctttagtttaagatattatgatactgaagcagttcagtggatctttataataatagtccctccaatccctttgcccatgctgccctgcaaagatggtttcctgctacctattcaaaaataagattctcaagtagctcagaaacacattgagggatgctatcaatgtattatgattgctctctttagctgactttatagcaccttggaatagcagccaggaaccaaggacaagatggtaccccttgcatacactccagacagaagtaacctactttttgtttatttaggacctgaaaaatgttaacttcaaagaataatgcatatcgtcagcattcttctcaaattcattaattataaatatgtccttattgtttagccaactttacttagaggggatacatcaattttgcaaatgtatcttctacagcagaataacttgtattttttaaactgcatatttacagaagagagtcatgagacatgaagccaacatattaagggcaccggctacagacttgtacattgtagaataccacaccggtcctcccagactttagcaaggtcggcatttagctgaagctgtattggtctggcttcagcctattactgtttctactcctattcaaacacctacttatttgagcagcttcatgatagatgaagaaacacaaaaattcccacttggaaatttttaatgactcaatatttcaatcaaatagcaactgaggaaaagaaagtttaaaggaagagaaattaggtctgtataaaagcaagatatcaggaacctataagtggttggaagcttcgcatctgagagtgatggcaatctgatcctagagatctatcaatttagcataaagttgttaaaatctgtcctttaaattttcatggattatctagaccatagccaagtcaagtatctgtgtaaggtatggaggacattaataaaagtatagaaatatactaaatgttttctatgtgtctttctttgatatttaaataagtccttaattaaccaaagaccagaaaagggggaaattttgttttagattagattgtggtccttaaaaataaaatgtttgcttttgtcattatatgtacatcttctataatattaggtggctccctgaaggttatcaaattagtaataccataattaccaaaataaaacatgtttatcttgaaaaaaattcacaactttgaaaattcctttaattccaacatttctattccattctgaaaagactgctcttgcttttgacttacagctaaagcagatttttactacatagtctagcaccttattataaatcattttggtctcttcatatttcatatcattcttttctgttgctccagcagactgtaaactcctggctttttctttccagtccttgctaagacgtaagagtgctgaaggcaggggatcaatgcttgctgacagacattgtccacagtagaaactgcagccatggtgatcaggaggcaaaaaagtataaagcaaaaaaaccgtgggcttggcgagaagagccttggggtcccaccccatccctgtctcttaccagatgggtatcattggccaatatgtttcatctctcttaccttttatatctttatcaataaagcagtggtagatgatacctttctttcagagttattgttaaatgggatcacaaatgtgaacgttctgtaaatactaagagttctgtgtgactataatttatcattatctatgccactattgctaaggtaaaatactaatcacatttttcttctttctcaaacaactgtttacctatactcaaactgctgaactaatcttctccaacctcttccccatctctgttccttagtgttcatttaacactaaaagagtagtctccccttatactcaggagacccccaatggatgcctgaaatcacaggtagtaccaaacactatatatacttaccttaaatgcctttttccttttaactaagcacttatcatacacattggctgcaaacttttgcagtctgagatatgacagcaaaaccagcacgcatttctttttcattcttcacaatttcatgtataaaagattcattcttatcatagatcttagcagtctcagcatatgatttcttttctttatatataagtctagaattttcatctttcacttaagggaagcaatttacagcttctctttgacatatctgaattgccaggatcaccactcctgcactttggggccactatgaagtaaaataaggattacttgaagccaagtgttgtaatactagaagagtcaatctgataacctggatggctaccaagtgactaaggggcaggcagcacctacagcatggagatgctgaacaaaggaatgattcacatcccaggtgggatgggtgggaagcataaaatttaaaactcttcgattctttatttctgtaatttttcacttaatattttcagaacacagttgactgcgggtaactgaaaccttggaaagcaaaactgcagataaggcggactactgcataaattttgaaatcctttgcaagggttccctgtgttttatcacagctggtcaccatctggcctatcaaacataagcccttaaaccttgttgcaacttttaacataaaagttggggaggctaaaactgacccacaacaagtgtcccttgtacagtacaatcgtttagaaactttttactgccattctgttcaacaatcacaattattgctctgacttctaaactacacatgcataatttaacatacttattttattcagtaccagaaaagctccagaataccaaaaaaagttttccttttaggaactttgcaaccaatgtttattccaagtcgtaatctcaatgtctgcattaaaacaaaacaagcaaaaaataaaaacaaaaacaaaaaactgccttgacttctaaatattttttataaaaattattaaatggcaccaagaaaaactaaacataaatatttcacacccaccatactgccacaaatgtaaaagactagcactagtaaaagttgatgagaacacttctaacgctccttggaaacaatttggcattacctagcagaagttgtagatgtgtatgccttgtgatctagttattcaatttctaggtataattcccttggggaaaaaaaaactcttataaatgtgtttcaggagacattttcacagcagcgttgttcaaaacagcaaaactctggaaacaatccaagtgtccactaacaggggaacagagaaatgtatgtactgtattcattaaaaggcttaacaaagatctctataaaaaagcttcagcttacatggatgaatcttacaaacaatgttgagttaaaaaaacaagttataaagactacatttatcggggggtggggggctaggggagggatagcattaggagaaatacccagtgtaaatgacgagttgatgggtgcagcaaaccaacatggcgcatgtatacctacgtaacaaacctgcacgttgtgcacatgtaccctagaacttaaagtataatataaaaaaaaaagactacatttaatgtgattccacaacataaagttaaaacatatgaaactaaataatgtattatttagggatatgtagataggtagtaaaatcataaaacaaagcaaaataatgcaaaaaatacaaaatttactagtatagtcctgcagatgggaagggagggggatgtgactgggaaagggcatccagcgagcaccaaagggaatagcaatgagctgttccttaagttgggtggtaggtacaaagaggtgtttattatttcttacacacatatattttcctatgtgtatgaaataaaaaaaatttaaaaaatatgatgcctatggtatgacacaaaaaatgtgttaagataagctcctaacttcagttactctttctgtccttcaacaactgtcttattttgccattttattgatatataaagtattatgctactaccttcattgttttttcaggatgatcattatccaatatttatattccccagattttaaattgttaaaaatttgcctcagctccagattggcttggggaatgttttacagtggagcaaatgaaaacaagggcttaaaaacatagtgagtaaagggccgggtgtggtggctcacgcctgtaatcccagcactttgggaggccgaggcgggtggatcacgaggtcaggagatcgggaccatcctggctaacacagtgaaaccccgactctactaaaaatacaaaaaattagccgggcgcggtggcaggccctgtagtcccagctacatgggaggctgaggcaggagaatggcgtgaaccagggaggcggagcttgcagtgagccaagatcatgccactgcactccagcctgggcgacagagcgagactctgtctcaaaaaaaaaaaaaacatagtgagtaaaaaagacatgatcaggtgggtgatcatccaaattttctagagagtttttagtaactctgattcttgggttctgccactatacttttaaatgggggcgagggcagggaggagagacagtatacagaaatctattttatgagcccaaatgacaagggcttcaaagcacagtgagtcaaaaaaaacagtgagtcaaaaagacactagattcaacacttcaccttgccaggctccaggctgacatacgctcagcagctgtacttgaacacagcttccacaaaatccttcggaggtcctcattctttaaatgcccaggatacgtttttaagagaagtaatttgtatgcacacatacatgcactcacatgtattttacttgggccttcatactctactgattttctagagactccatcttataacttgggatgattaccatgaagtgatgaaaaccacaaatctcatcagtaaagggatgctggcatgcaggcagacactagattcaacacatcaccttgccagactctaggcagacatcaggtcagcagctatatttgaacacagcttctccaaaatccttcctgggacctcactctttcggctgagaaagtctagtcatgccacctatttttaaatggaagttttcgggaattttatgcagaacaaattactgaaagctactcatagagatgacataaaacttctaaaagaaaaatgtaaaaaaaccatgatttaatgcttctgaaaatacttaagacaatttcaaaacctttcctaagatttaaacctaaaaaaaaatctgaaatagccaaggggaaaatatatgtacactcgtacaaagatacacacacaaagatacatacacagatacacactgcaacactatagtagctacaaaagagtcaaaattcttttaataggggcctagttaaatatattatggtatacccatatggctattagaaagaatgaggtagatttgtttggacacggaaagatgtctgtgatacatttttaagagacataattcgtatgtacgcatatcacacacattcatgctgctcacatctattttacaaattagattgttactaaaaatttttaatacaaattatgcacttttatttacaagtaagttgtccacttccagaaagtataaaaaatatgaaaagtaaccaaaagattagtaaccatgctaacagcagagagccacttgacaatttctgtaagaaatctacttccctgaagactgtttacactactggaaaaattgatcaaagaggaacataagggttaatgtataaagtaacttttttaaaaactaggggaaaatctttatttcaaaataatcatgttacattctgaacagtatctggatgagtatttgggagaatacaaaacacaggacagggtctggcatttcaaaaattttcatgaaccacttctatttaaactaatatgctaacaggcataatgctctacattatattttcatgaattctcaatgttatttagctttcaagggaggctccctgaaattagatctatgccaatgagaatttttctaaagcaaaataaggaaaatttttacccatcagaaagctgaaagatgtggagaaaaaaaaaaagttggcatacaccttgcataatcacaataagccaaaaaagtttgtatttcacacaagggtagtgggagaaatacattgatgagatgatacaatggaaggagactggaccatagctttttgctgtctcacaaatgcagttggaaccaaagattgttacagcgggaaagaactgtggataaattctcatgtgaggacacagacacctaagcagggctaggacattcagagcacctctttacttcttgcacatgattctttccatgacacctagtgcccttctccatctagagctacctctatatgtccacgttccttctctctaagctcatgatagacctcaggagaaagtcaggtaggcctgctgcttttggctttattataatgtaactagtacatggactatttggctattgtgggattctcctcatgttatcagggttccagcttgcataatcacctccttggcaacagaatttattggcatatttgttgtccttcttagtgcagtggttctaaatgtaggtgatcatccaaaatttttagggactttcaaaaactcagactcttgggttctgaccctgtaactcttaaatgggggtaagagcagggagggaagatgatgtacagaaatccgtatttttcttactgcattccaggtgtagctgtgtaccactagtttttaatactacttttgactgattcaccatctgtgacttaagggtatcagggtttggataaggtgcggtggaggactggagatttagaatgaatgatggaggagggaggaaaaacaaggcagctactgctctatgggagagacagataggactggtttcctgtgtatgtgaagtaggtgctgtgatctcggttacactgggaaggctcttttgtctcaaagtatctctcatcagctttttattaatgcctgaaattccatccttatgatttcattccttcaagttatgtcatttgttaaatagaaataccccttactcctcagtattccactgtaacctttccctaatgaagcataaattcattcacttctttttaacaatccactaaaacaaagcaggtttaggagggcactgtattccttgatttggcagacaggaaggggatgccattcccctccccccacacaaaaaaaggccatgactcaatatgatggcttttgcaacttgcctcaggctagccttagggcattacctatggagctgctgcatgccaggatgatacttgacccagaggagatgtgaatttgcataaggaagaatcatctgatgatgctctgggctataccttcgcccacactagctctaccattctctgacctcctggtatattcttcagcacctgctacagttaattgtttcttaattatttcatgtgtctgcatcatgtctctctagccagatacaggctcctttgaggtcagaaaaaacacatgatttatctttcctccctatgagcacgcagtgcagcgctgaaaaggtacaaggtccttagtaagaccttcactgatacaccctatcagcaggcaatatagggagaaacatttttatggctatctctttatgatcctctcatttctgaacactgaactcgacctgcctcttaagtttctcttctctccaagtaactgtctttcccaaattaagagtctttctttactagtccatttttgtaggttttgcaaaaatgtattgatatgaaattagcattaatcatttgggaaaatatccttggatcccaaatatgtctgagggagctgaagtttccgttgatttatggttgaaagtagtctttgtaaaggatgaaattgggggccaggtgcagtggctcacacttgtaatcccagcattttggaaggctgagaccagagcatcaactgaggccaggaatgtgagaccagcctgggcaacagagcactaccctgtctctacaaaagatttaaaaaattagccaaggatggtggtgcacacctatagtccaagctacttgggaggctgaggtgggaggattgcttgagcccaggagttcaaggctgcagtgatccaagtttgccccattgcactccagcctgggtaacagagtgagaccctgtctcttaaaaaaataaataatacaaaatgaattgggaaatgtcaatcaaaacagcgaagactgcaatccataaaggctggcagttcaacttaaaaacaaaaaaaactaagggcttctatgccaaatgcctttactctctacactaaatttcacccttaataaaaaattacacccaaatgttaccttcttttcttctaagaaaagaagcttacatgaaaggtagctatggtgcggaaaaattcagacttgcttgtgttcacaaatagataatgccagaggtggtggtctcagtttccagttctttgagaacacttacctggtacctctcctaaaagaggcattaactctagtcaacatctctgactgtctgaattctgagatatctggccctttgtataaattaaattaatctagttttactgtgtgtgtgtttcatcttttctattactactagttggatgaatttaggtgtttagtcctcatccaatatgacaactatgtttaacacaagaaatttatgtgattttatttctatatggcccttttaattttttaaaagcagtcatctttcaattgttaatgtggaatgatactgttctttttcctatcttatgtaaaacctgatttataggagtgataattgccacatatagtattaaggcacccagtgtgtataggatggactacaattctttaaaaaaaaaatctagactgggactgtgtctaatgttacacctctcaacccatgaatcacagggaatcctaccccaaggagacttttggatttgtatctcttaactctgagcctcaaccattcttttcttacaggaaaatacccccagtgagtggtcactttattggggccacaattagtcaaatatttctcttcctttccctaacacactttctcttcctttttaattcaaggaagacactgagtcttacaccttgaatggagtgtgggagccaggtttgcaataataaaagcagttacataagtgctttgcatttacctagccctttctttaaaatacataaagaatctgaggttcaggtgaatcaatcattactgaatgcctatcaggaagattaacttctgcaggattgcagaaataagtgatggagctggaatctgaacctttgttagtctctaaattccaagattttatccttctgtcacaatgattctgcctttccaccagaggcaaggttcatgaacaattcggatatcacagaaggatcagaattttaaatacacctgattcctacaactactgtgacaaatcgcaaaaaaataaaaataaaaaaacacctctccctacagtcacactcctttgcagtgtaattgcagctcctccacccacttgaatctagactagccccgtgatttgctttgaccaatagaatgtggtagaaatatagttgttccaagcctaggtcttaaagagttttgcatggttctgctggttcttttgtaactctaatgctactgtgtgaaaaagttaagggcagcctactttcaccattcattgctacagccaaccagccaactgacagcagatacgctgaatgtgcccagctgagataagttcagcttggccagatcagcagaactgcccacctcatttgtagactcatgaagaataataaatggttgttattttaaagccactaaattttaaaagcagtcagctctaaactgttaatatggaaggatactattcttcttggaaagatactgttctttttcctatcttatgtaatatctcatttacaggagtgataattgccaaatctaagtgggaaggcacccagtatgtttgttatagagcaaatactaacagatacaacaaacatagctactttgagcaagcagagaaaacaaaagattgcttataaagcttataaaagagggccccgatatgcaaaagcttgatattaagacaaatatttaacaaatccttaattatttgacttaaatttgcaaagtaagactgaaaaataagacctgatccattcaagaatttgctaggtgctttggtgtaataaatctacttataaacatcagtaattgtgtatttgaaaatctacattaagaaagtaaagtcctttacactgtgggatttaattcacactgaatcatacaaaaaccatttttttttaaagtctttatttgaagaggcagaaccttagtattatgacgttcaaagtgttagtattctctttaagaagaagccaaagtaactggagaaaaaaagcaatgaagttatttctaaaaccccaagaatttctcaagacatgaaaggcttgctcttcttcagacagttttattctaatttaccttaaccccaagttcctcagaggttcaagtagttgatgagtgactgagagaggaacttgtgtggattatagggcaggggggtgggagaagagagccaaataggaagcatatgcatcacatatgcatttttcagctcctcttcaagcttatggccgaaatataaatctgataatggtaccacaagttaaagtatccacttcctaactataatcaattagtttgaaagttatgccatctgcaacaaactgacagctagtatcatactgaatggggaaaaactgaaagcctttcttctaagatctacaacaagacaagagtgcccactgttattcaactggaagtactggaagacctacctagagtaatcagacaagagaaagatataaagggaatccaaaatggaatggaagaagtcaaattattcttgtttgcagactgtatgatcttattggaaaagcctaaagactccaccaaaaaaatattagaacagataaattcagtacagttacaggatacaaaatcaacatacaaaaatctgtggcatttctagatgccaacagaggacaatctaaaaaagaaatcagaaagtaatctcatttacaatagctacagataaaataaaacacctaggaataaactcaacgaaagaagtgaaagagctctacaatgaaaacaataaaacactgaggaaaaatattgaagaggacacacaaaaaaagaaagatagtccatgctcatggattggaagaatcaatattgttaaaatgtccatactacccaaagcaatctacagattcaatgcaatctttattaataaatatcaatgacattcttcacagaaatagaaaaaaaaaatcataggatttatatggaaccacaaaagccccggaatagccaaagccatcctgaacaaaaaaaataaaactggaggaattacattatctgacttcaaattatgctacaaaactataataacccaaacaacatagttctagcataaaaacagatacacagacctagagaacccagaaacaaattcatacacctacagtgaactcattttcagcaaaggtgccaagaacatacactagggaaaggacagtctcttcaataaatggtgctgggaaaactggatatccataggcagaatgaaactagacccctatctctcaccacatataaaaatcaaataaaaatggactaaagccctaaatctaagacctgaaactaggatactaaaagaaaacatttgggaagctctccaggacactggtatgggcaaagatttctttagtaatacctcaaatgcacaggcaaccaatgcaaaaatggacaaatgggatcacatcaagctaaaaaacttctgcacagcaacggaaacaacaaagaagcaacccacaaaatggaagaaaatatttgcaagctacccatctgagaagggattaataactagaatatataaagagttcagacaacaggaaaaaatcaaacaatccaacttaaaaaatggacaaaagatctgaatagacatttctcaaaagacatacaaatggccaacaggtgtatgaagaaatgttcaacatccttaatcatcagagaaatgcaaatcaaaactacaatgagatatctcaccccagtcaattatatatcacccccacaattgcatgcttgcattaaaacatgacctgtaccccataaatatatatgcctactatatacccataaaaattaaaaataaattttaaaaataaaactgaaataaagttaagatcataatgaagccagtttgagatcaattaatgaaaaaggcttatcttatgaacagcgtgtagtatggcacaacagacagagttctcaagtaaaaacctttggcattaaggagttgtctaatcttaaaacacatcactaaaaataacttcaggagtgctttttaagtgccagacactgtgctatgcagtttacatgcatcactttgttgtgcccattttaaaagtgaggaaacagagtttacagggttatgaatttggtcaagttcacacagttgttagtcagattcatacccagggaatctgaagagtcctaattcttactcacaatactggacctagtttcctcatatgaagtgagatctggatatcaaaactagctccatttggaattctatgattctttgacaatgacgggagcatacttcttcgtggtttgtgtactgggtacagggatgaagactggcacctttcactaaaaacaaatgtccctggggtgtatgctgacatgaatccctatatctaatcctttcctcgtatatgcaaatacagaaatggtgaggctagtttgggaaacaagtctactgcccacagtcatcctggtcagttcactacctctcaggtaaggtctgcctgtctttgggctttctcttcaattcctggcagagcaggcactaagtaaatgctgaatgaacggaaaaatattccacagtttctgctggaaagagcctgaaattggatggcattttagaatgtgtcctacaaatgtcttgaatgtaacacccataaaccataagcttcagaaaggcagaaacaactaaagctttgtccactgttgtatcctctgcagtttgaactgtgcctcacatatagtaactgctcaataaaagtgctgttcttattattgttactagattcttacagttccagttttccctaagagaaagtaaaatatatgtattaaaggcaaggccatgctatttgcttcctctgtggttctttgttcaaacagccctacctaaattgagtaccttaagtgctaggtgttatagtgaaaacgttccttgtccttaaggagactggatttacttggagataaattagaaatatataaacagtattaattcaacaaacatttactgggtacctactatgtgctaatgactaatttaggtagaaagaactgtgtggtctgtggctgccagaggataccatcagatgaggtggggggctatggcctggactacataaaggaaagcatacaaaataagtggcactaaattggtcttgaacattacacatattgttaaaagcagagagaaggagcctgaattctagactgcaacagtcctcagctatgttatatggcacactggtatgttgttatcaatttaggactcatggcaaggaatttgttagtaataatgatttatgtatttttattataaagaaaagtataaacactgccagggggaactgtgacttgccataatcctcgaaaaaagtaatttggaaatatctgttaaaattttaaatacacatacccctgactcaggaacccaactttggggaaatctattgtattattccgttttcacactgcaataaagaactacctgtgtctggataatttatgaagaacagagacttaattgacttacagttccacaggcttcaaaggaagcatgactgagaggcctcaggaaacttagaatcctggtggaagttgaaggagaagcaagcacatgttcacatggcagaggaggagacagagagagaagggggaagtgccacacactttcaaacaaccaggtctcatgagaactcacgatcatgagaacaacaagagggaagtccacccttgtgattcagtcacctcccactaggcccctcccctgacatgtggggattacaagtgattgagatttgggtggggacacacagccaagccatattattctgcccccggcccctcctaaatctcatgttcttacatttcaaaacacaatcttgcattctcaatagtccccggaagtcttaactccttccagcattaactcaaaagtccaagtacaaagtcttcttgggtcaaggcaagtccactctgcttatgagactgtaaaatcaaaaactagttacttccaagaaaaaattgggatacaggcattgggtaaattcccccattccaaactagagaaattggttaagacaaagaggctacaggccccatgcatgtccaaaaacctgcaggacagtcattaaatcttaaaaatccaaaatgatctcctttgactccacgtctcatgtccaagccacgctgacacaaggggtgagctcccaaggccttggacagctctgccctggtggctctgctgggtacagaccctgcagctgctttcacaggctagcattgagtgcctacagcttttccaggcacatggtgaaagctgtcagtggatctaccactctggagtctggaggatggtatccctcttctcacggctccactaggcagtgccccagtggggtctctgtgtgggggctctaaccccatgtatctcctctgcactgccctagcagaggatctccatgagggctctgcccctgcagaatgcatggacatccaggcatttccatacatcctgaaatcaaggcagaggctttcaagcctcaactcttgccttctgcacacccataggcccaacaccacatgaaggctgccaaggtttgaggcttaccccctctgaagcaacagcccaagattatctcctggccccttttagccacagctggagctagagcagctgggatgcagggcaccatgtcctgaggctgcagagagcagcgcaaccctgggcctggcccacgaaaccattttttcctcctagacctccaggcctgtgataggaagggctgccatgaaggtctctgacatgccctggaaacattttccctattctactggctattaacattaggctactcttcatctatgcatatttctgcagctcacttgaattgctccccagaaaataggtttttcttttctaccacaaggtcaggctgcaaattttccaaacttttatgctctgcttctcttttaaacctaagttccaacttcagaccatctctttgtgaacacatatgactgtatgttgttaggagcagccaggccacatattgaatgctttgctacttagaaatttcttctgccacgaactctaaatcatctctctcaagttcaaagatccacagatctctagggcaggggcaaaatgctgtcagtctatttgctaaagcaaagcaaaagtgaactttgctccagttcccaataagtgcctcatctccacctgagaccacctcagcctggactttattgtccatataactatcagcattttggtcaaaaccattcaacatgtctctaggaagttccaaacattccctcatcttcctgtcttcttctgagtcctccaaactgttgcaacctctgcccattatccagttacaaagttgcttccgcattttcatgtatctttatagcaatgccccactgtcctggtaccaagtttctgtactagtccattttcacagtgctataaagaactaactgagactgggtaacttacaaagaaaagaggttcaactgactcatagttccacaggcttaacaggaagcattactgggaggcctcaggaaacttacactcacagtggaaggcaaagaaaccatgttttcacatggcagagcaggagagacagtgagtgaagagggaagtgccatacattttcaagcaaccagatctcatgagaactcactatcatgagaacagcagaggagaagtctgcctccaggattcaatcacctttcaccaggcccctcccctgatatgtgaggattataattcaagatgagatttgggtggggatacagagccaaaccatagcatttatatttagaaaaaaagttgctatttgtaaagggtacatagaaaagggtgtttattagaaacttgcttgtagtggcaaaaatcacgaaaccacatgaatagaatattgtctatttaaaagaatgggatccgcatctgttaacctggaaggatgttcagggtgtacttgttaggtgagaaaagcaagctgcagacaaaggggtataagataatcccattcttttatttaaaggcaagcaacccagaaaatctcatatgtgtctgtttatgcttatgtaattacagagaaatgtggaggataaggggagatgtgcaggaagaaagaggaaagaaagaaataggaaaggagacgtgatggaaataagcttattaacattttggggtataattttactgatggaatgaacacactatttctgtaaattctgaaggggcatttgcaaaaagaagaacaaattttaaaaggagtcaattataagactatccctataatgctcacttacactcagatatgctttcttggataacagactgtgtataacccaaatcctccaaaggttatggagagttcatgtggctacccaccatctatcatcgtgcatatgggctgtggtacaaagaaggagaaccactatgctatgagcaacaaaaccacagacattttttgatcaggggaataatactgaaagtggtgttctaggaagattaatctggcagtagactgcagaatgaattaagaagggagaggagaaaactagagaaacaattaggagactattgataagagtaataagagtttgaactagggtgtggccagttttttcctgttgtgttggcttctcagggaacagaaacttaattcccttctggcttccagcctttctaccttactcttaactgaatctcagggtctttgtggtctcagaagtatgtttcttattatctgctttaattacatctaaatttcaaatttaagtctcctttttaaaaaaattataaacgaaatcactagttatattgtgccatttaagatttccctaatttatctggctttgatttttgggaatgttcccatgttttaaagactggtttcaagaacaataatcactcatatatttatgttattctattctgtctcttctatgctagttaatgtgacaactaccctctccctgccacattttaagattgttgtctcctaattcttcagctattcatttattttgtggctgctctctttggttgccttctagagccctgtccttgtccctcccctcttttttcctgaacattagagcagttcattcttaaatgacctcatctgattttcttgctatggctaacacctacttaacttgcattttctcttttctgcgactgtcattgccatattaggttgaactctcctataactcttagtagaagagatgaacttatcctaccaacctcctgactgttatatactatagacagaataagtcaaatctaaaatataaataagctgaagaaagatattttgaaaattcaggcaaaaataaaacacccctcctctcttaaggtactcagtgattacacacacacttatctgaaaaatgaggaaaccgatttcttgcctgaccttctaggtaagtcagtacaaacatatacattagactcatctgcttaaataatctcaattcttataaaagtgaaaagcataaagcttctgctacaaaagttcctatattgacaatttactatgttactgccttgagcaagcttttaacaaaccaccaaaggaaaaaaccctctaacccttcatttacaaacattggctactctaatttttcaatggtaaacagaccagagttattctaagaaattatgaaaagcaatccatttcgaagtcttaaagcaaatttagagactgtcaattgaaaatacatcttctttatgtatactctctgtattcatatacacctgtcagtcttaaggcttatttctatctggggaagataacctgggctatcatctctctctcagtgatattcactatctgctgacattttcctcactcgagaaagattagaaatataatccattcctatatatctttttggtttatatgttaaattttgtttatttaggtattcaacatgtatttgtagaggtcttactatgtgctagacactattctagacgctggcatacaggagtaagcaaggcagacagtatcactgctctcatggagcttacattgtagcaggtgagcagataagacacaaatagatgatgtcaagaagaaggaaagactgtgaaagattctactatttcagatagagcagtcagagatctcttttacagagctgacatttaaatgagagagtaaaccatgtgggtatctggggaaagaacatttcaggtaaattttcctcagatttgggcttatacactggggagcccagaaagaggattatttctcctagacaataaggatattcttaagtgactagaagaaaaaaatatcttgcaactagggtacacaaactgaggttatggtgaaagtcatgttttctccttgtcttgtatcatgtgatatttgatgacaacatgcatgcacataatactttcatccattagttgctgaagtctcctgttggctcattcctatgtactcagtcctcatctagtcaactaattctttccatcttttctttcatttgtttcagactccttgttgccccttttcttattccaaatagttgaatcaaatcttgtttcccattcattcatgcactttcctccatgaagtttcagttatgtcttcccaggaaggagtttgagatctttcaagctcacatttcaaaaagcaaactgagggagggggaggcagggatgactatcatcagagtgctctccatgctgctggggatattcatcttcttcatctccatatgcccagtgtctagcttgataaatgcttgctgctgccaagtgcaattagaaggaccttggagatcatctagttaacctcccactctacctaccaccagaattcttggcctagaacatgtctttgtagttctttagttcttccacttacgaacataataacgtagctaggttgcttattgatttcccagtgtccatagagaaacactgaggcatacaaaaatcaaatttagccaggcaccagaattgaagtttagaattttcattttctttcttaatagttttataacttttccttctggcttccttatttactgttttcttgtttaaacatgtctgtgggacccccaaagcactgtacagctctgttaaatatcattatcaattaaaaggtcactcatccctaaaatactgaattagaaattacttcaccaatttgtctttcctttaaaaacatttcttgattaaaaatgtagtgcccatccacagactgcactaacaccagcccatgatatgtgtttagtgatgagaagcatttgctacctaatagaaaatctaccagcctcccagctgacagaacaaagtaagaggttcaaggcaaataaagcagtgcagagaaaacctgttagcagtaaaacattacctgccatgctaggatggctcttccttcccatttcttagctctgaaaacttataaatcatcttttggggagaaagaacaaatatccaagaaaacagtttgcttttagtacaattctaaaaaatctaaagttcttaagcaggctgttgtcacaaagaaattctaagaacttcggcactaacagaatagttacaaaatgaatatcctatttttgacaccactacacatgtcttcatcatttcaaagattaggatccattttaacctagcattttttgaacagtaaacatgactaaatttagcaaatagtagtaacaaaattcatttagtttttaaaagtactatcagtaatcgcagaggtttttttcaggttgtgaggaataaaagtcaaaaatatattaattttatattgtagctataactcaaactattttatgagtataaataacttcagtatacttgagttgttcttgctatactgataatcagatacttaattccctgatacactaagggaaatgtgtatgaatgagaaattaaactgtttgggagactgttgtaggaattcacattatgtttactttatatctgctattgccaaattcaagtccaagccaaaagcagacctaccttacttaaacataaaataaacacttatttaaaaaatcaggcttagaggtgaatagtctctattacttcattactatgccaagaagagggaatatataaactgttatcataaagttccttaataacttcaagaaaacacaaatcagaacttaaccactaagcatcacccatttcagaatagtcaccctgggaagctattcacttattccaggcatattcaaaacagaattaaacattttctgtagaaatatctatgtgggctcttttaaaaaccctcaaagaaaataaatgttatcattcgagagaggattaaatttctaaatatctggcaatactcatatgatttggagtcacacaaataaagctaagggataaatacattttctttgagcaagaacagttaggtgttactatagtgcaatgagtccgattttcttttatggcttacaaggtggttctgaaggcagtttcaaagaggagcaatatacatagcctcctaaggtggaaacttagaacatttattttgggttttctgttttaaaaaaaaaactcaatctattttatagccatacactttgtccttaataaacccagctgaattccagatgacaaatttcacataatgttctgattaaaatttttttaagtttccatctaagaaagctgcctacaaacttaggttctacatcggtatgtttaccaatttaaactgccgtttaataattctatgctttcctctgcttttataactttggtttaatagatcaaatttgtttaactgaagtttttttcaaccatttgatcaataaagaaaacaagtcagtgcagtcaagtttcacaatcctcccaactttatgcagttaggataaattttggtattcaatatactcaagagctttttcagacagcttcaataaatgtaataaatgtaaaaaaattttaaacctgaaaatttcattcccattttcaggcaaattaaggtttccaatgacaaagaatctttgcatacttgattatataaaaatatcagaataggaaataccagaaagagaatactctagcatttattaataaaaatataacaatgtggttggagttatcactatggctattatgtagatggcatacttaatatccctcaacaaaatccactgaaaactttgtcgaaggcgctttcaaaaaataataaaactgaaaaaaaaaatcattgtgaagatactacgttggcatttgaaggctttaaaatacagcagtctttatgaaactgcgatccatgacccttcagggattgcacatagcagaccctaaaagattcttgattataggcaatacctacaccacagtcacagatgtcataacgtacttagccaatgagagtcatgctggtttaagctaagtggacttggcagagctttaaaaattccaccttgcatttttataatgctttttaattttcttttcttttttttttcttttttttgagacggagactcgctctgtcgcccaggctggagtgcagtggtgcaacctcggctcactgcaagctccgcctcccaggttcacaccattctcctgcctcaggctcccgagtagctgggactacaggcaccagccaccatgcccggctaattttctgtatttttagtagagacagggtttcaccgtgttagccaggatggtctcaatctcctgacctcatgatctgcccgcctcggcctcccaaagtgctgggattacaggcgtgagccaccgcgcctggcctaatgctttttaattttcaaagtaaacgtacatgcacaaatcctgtcaggtaaaaaccctctcactattttacagaaattgaaactgtgacaaaaagcagtaagtgactttacaaatatatgcaggagagcagaggcctgatcctttatattttatttaaagattcgctgttgacaaaaattattaaagatacatgaggaactaacatacccaatattaaatatttcccttcagataagtgttaaggtttcctggttttttttttctttttctctttaaatgcctttagttttcacatctgtaaaattaaggtaaataacagctgccttctgtgcttcatggatattgacagaattgagacttaatacagtaactagaataaaaactttcacagagttgagatttaaatgagatgaatgcatgcaaagtgcttagcatagtgctgtcacataattggtgcttaatcattattaggtaaaaaaaaattaacaaaatgaatagagaagaatacagacactgtatattttaaaaatctaaatgagtcaaaagtaactcttataaaatatgtggctagtctgtattatgtcaatcaactatttgttccagatgtctagaagagacccagataattaaagaagcctaccagggaacttagataactaagaattgagatattcaaactggcaacaccgctcattaagtgttttgtgatctttacctcaacactttctatggatctcaatttctcattcgaaaaaattagggggtagaattagggaaactctcaagttcttttaagttctaatctaaaataactgtaacgaacatagaaaacaagctctgagaacccaagagccccacctctcgggtgctaacagcagcaatagtttatttttatatatcaccaactacattattttaaatccttatcttataaaaacaccaaatctgcattcacatctatttgtcttacattcgataatctataaagaaaatgtcaaagaaccaactttgttataccattccctaccctaattacttccctcatcaaattgacgggttaaaaggattgtggaattttagaaacacacacacaggtgttttgaaaacaattcaaacacagttgtaaagaaagtatttttgactccaaagtacctagttggaggccatggactgtctcccttagcattagaaactaggtctttggacttttagttgagtatttttcttctgtttctactactgaatatctaaatcaaattctttggaagggatggttaaaaaaataaaaaagcaaaatctgcaatttaaatagtcttaaaattaaggaagctcttatcctcaataattataaaagaaaacattaaaacgataacataaagtaaaacagtgtccataacaaactggtagagctttagtgttcagcatgtgacaatcataaggtcataagtcacagcactgccccaaccagcatgaaataataaatcatgtagtgaattgtatcatttcataatagctttcaaaatttggctatcaaatatactttcataatagccacagctaaatattatggacagttatgaaatcaactagaataaaggctaattttattgtaaaaagaaatagtaagttaacactttttgcaacaaactatgtcttaaacactgcatacttattgaactctcaaattattagttacaaaaataaaaattcaaggtaagataatgcgtaaacatttacaactaatcatatcattaaaacttttttccccttatatatatttttggtgccctacagtgagaatgaaaaaaaaattataaaacaacaggtactttcactgaacttgctgcattatagacaggattaatgttgttgaaacttgctaaaaagaaaaaatatttaaaagcactcgaaattaatacttgggttactctgaaaaagcatgtttaagcatgcagctctattgggatgtaattaatatttaaattggacaagtgataaaattcggggataacacactttcattcaaaatactgaatttaaggaatgtattgcaatataaatggtttaagtgactgtctagcacttgcagaaccccataatttattctgcatattatgaaaaattaattttctcaatattccagcagaaaaatacataacccatagaaatatattaccaaagaaaagggttgctctccagtcagttgacaatggctgtaaaagggcactatgatatatgaaatgattatatcaacattaagacattaggtcgactacattcaagtcattagattttcatttattaaacagcagcttaaataaaaatgagaaaaatatgaacttaatcttagctaaaataatcttcaagtaaaatgtgcattttatccttttttgataataaagcatagtaagaaacaacataactcaaaaattagtattatatagccatggtcagttttagatttctacctgaaataaaagaaattaaattgtaattctgattgatgcattcccttgtacctatagtcctaaatttttcttttcttaaacctctaattcatgacagttgatccaaactgttagttttcagaactgatctggatattcctaaacttatctatagcatcccacatctctgttgctcctccctcttcaccctccacccccaattaattcatgaactccactggaaattctgtatttagagacatttacaacagtattgagcactaaggaaagcaacctgtcacaattaggtgtctgggggttaaaaccactgtctacaaataattttgaactgcaataaaattctatttctttcttaatatgtaaaatgaacaaaaatcaccatcacaagtcacaccctaatctagtttagcatagaaatgatcacacataattcaacagggaaaggaacacttagtagaccttttcttttttaaaattgaaattctcaataggaatattttatttacttgaaaaatacaaaacccaagtattaatagaatatgccagaagaaaataagagcagtcggctctctgaagctgcagaaataaggacagcatgggcttttaaaaatcctttctaaaggtcaatatgtaatggatttttttttgtagttatagcttaattcaacaaaattttcttgaaaactctttatgcaacaggaatcatcaatgtatattttccatgactcagaaatatgaaaacaagtgcccattaatctggcaaatacctgtaaatattgcattacacaattactcttgatgaaaatattaccaggatgtcctcagaagggtaaatgctattcagcacaaacctattttgcttatttaatttgcccacctaagtactagtacacaatgagaacccactgctcattaaaattaggaataatcattaaagtaaaaaagaatgtgctttaagaactaagcctaagcctcagaccttgtctaagcttaatgtaaattaagatttcctgggctgtttcagtcacctgcaggccagagtagactaagatttatgtaactaaccaattaatgcagatgttccgactttcacattaggcagtcacattaaagtaaacccttttgatccaatctttccttcactaaatctcaaaaggcccctaaagtgatctctacccacatatccatttcactattaatacaatttgcatttaacctacatttatgcaaggtatatttcagaataagtctttcataaaatgtataaacattaaataagtagcaaaagtggtcagactaaaatacatgtaacacaaatagacaagaccaaaataacatatgaattatgttaccaattataaaaatacaaggggactagccatagaaacatcgtaagtaatttcaataaaatctgaccacatgctagtcacatatttctgcattagtcatttcacactaaaatgacacacctgaatacacagtgtgttttaaaaactttttttactaatcatgtagccataacaagttacagatttaaaaaataagattctcatcataaagctaaaaataagtgaaaatatatttaaaaagaaatctcctttaacattcagaaatcactttacataaatgagtaccagaaatattaagcttaaaaaacactgaaacacccattgccagaatctttagaaggaaaagaaaaagaaaaaaggtaggaagtaaagaaagtatccatgggggtgagggtaaatcacagtcaaaacaaatctcttctcttcgtatttcctctttttctgagaaaacattcaacatgatgttagcagaatttgcttcattcattctgtatttgtacaggtcttcaatttcattacttttataaaaccagatacagatgcgattactaatgagacattaaaatctacataaattttagtagcttcattaagtgccaatcatcacttaattttagactctgccgaaaactgaatttacaagttcatcctacatcattcattctctccaataatccctcccttcaggatacgaacaattttttaacactaaaatttcaacataatcccaataaaagctctaataccacctaaaaccatttctgttctctacctctgtcattaatgcttaaatgaaacaaggctgaaaatcaaataatgcagaaatgtgccttcgtcaataagtttatgctaaatgtactgaacttcagtatttttaaaagcatattaagttagaatgactagtttgttttacttaaagaatagattttgagaataaggtttctcttgttttactataaatgaacttagaaaatgctttactaagctcaatcataatattcataattttacaattttatgtgataattcaatgttgtggtggaaggaaggaattgcctcttcccacccccagagaataaagtgaggatttttttttaagtattctgataaaaacaattttaggtggcattttaaaaagtcaaattgcaatttataactttttttaatttaaaaggaattcaagttattagtggcatttaatatttttcttcgtaaagtcagaaggtcagtattcaagttgtggtctcaatgtgttgattatttgctgatcactcagggtcactggtcatagcaaatgtttggctacagtcatgtaacatatagagaagagaaagcaactaattttagctatatcagggctgttgtttggaaacaatagactaattcaatgatggtttaaaagaaacactgtttcaatttatttggatgaagctttgttttgggtaatcatagttcccagtgctaagttaatgccataaggtataaaatcttcaaatattaacaaaataccctgtataaagtattataccttcttgttaggacacagactactgattatatttcccaatcacagattggcataaaaataataatttcatttgatattaaagaacttctaaagagccgcatcatcattgccttgcctactacctccataaggttatgggacccaaattaaaaatacgtaaagatactttatgtcatgaagtactataaaagttaaagcattaaaatcacctttagtgatttaagagtaactatgttcatctacttatactctatatcccagattttatagggtttaaaagttcatagcaaatggaaaataagttttgtcccttgccttttctttatagtaaggaaaatgaaaaccatgccatgatgattatcagggcaaaatccattaataatccccaagagtttcctaagatgttttatttttctttgtataattacatgttttataaatcaatttaagagtttcctacagatagcttagtcaaatcaaccgtacttaactcttttaagaaaaccaagtatgcgaattctattgccaaaaatttgcaattgaaaattttaaaacacagcatgtcttttagcatttaaaacacaacagcttatgcaataataaagatctcaaatctccttactgaaaagattttaaaccttcaactcaggttgaagtagtgttcttctaaataaaggataattatttaaacaatagattaggaggtagttcacattaagacatgtaagaaccaaggttttttggtttttttttttttttttttgacaactaagccttttagaagaacagaacatagcctaaatctaattctaaattatttccctaacaagaaaagcttcttaagtacagaggaaagaaaagagacatcctccaggttaggatagctttcacagaaaaaggattttcaaaaatctgaataactagttaatgggaacgatgaatatcactaacatttaagaaaaaacttcaatagttacatacaaataaatcactgtctaccatgtcttcttttaaaaaaacccgctgattaatcaatcttgtgtcactacaatccacatttttatattttccttcacaactaaaatggatataaaacctagcatttatctgaattggggatgaggttacggggtagagaaattcacccctaccaacacgtatatctacatttagaacttttttctgataattccattttctgacctttttgggtcagacaaaaatatcagtatgcttataaacgactgagtaaaaaaaagagaaaaatcaaacgaaagctgaaaattgaagcttaacaattttggccatcagttatctacttgagaacttgcaggaacatttgaacgtaaaattttgttttgcaccatgttgacaccaattcctctcttaaagagattgatcagcagacataacttgtctactttatggcaagaaccctgtgagcaagacctgtgtctaatactatggtctggtacactgttcactgcattgctttagcaacttcaaaactcaaattctttaacagaagattcagtttgaagaatagggctctttgttagtacttctgcttttaactctttaatctcaagctaacacttaacgaatttacaaataaggcagcacaacttttgactatgtaagtaagggtatcatttattgtaatataagaacatattctaaaacagctgaatgaccatgcacaacacaatatgatattatgagacattatactctcctgaatttatataatttttcgttaagatatctgttaatgagcaacattattttaaaaatgttaaataaaatcctcaccgttggccaatgggatactgaaaaccactatttaaggaaaaaacctgaaatggttacgtacagatgtcacttaggttgtctacctttcctactttcaaaaggccacttaaacttattcatataaaaaagcacatgaatctttagagaacacatataaatcaatgaagatttacatctattaatctaccttaaatgtaccattcttaagaaacagaaaaacactgatcttaccttgaatagccattagaaaaaactgttcgaccagggaagttcagagtccccagagaagtcaagttgtcatctccagatccttggcacctattccaattttcggaaccaacgggaattggtggaatgacattaaaaataggcttctgatcctgctgttgagaaagggatgctgtattcatgtcatagtggtacatctgtcctccagaggtactcacaccatgaacagaaatggcagacattttattaccaattatatttgctccaggaaagcttgcctgacagtaaactgtgcccagtttctcttgcttaattaccccaggggtgcagagttcgatgaaatcttctttttctgttttcacttggggcagtgttacattactggggcttgacaaaaccagatctccattatccttaattttgggtttagtgtccggtaaaatgagaggcttgcagtcctcattcgagtttccttccaaaaggaatgaatcgtcttctcccgccagaggagaaagcaaacagttttcatctatcaacaggtctgatctccaaggactctcattcgtctctttacctggggacccagaagaaaactccaaatcctgcaaaatgtcaaaggtgctttggtctgtggtatacaatttcacattgccaccgttggtgccagtctggcccttcaaatgttgctgttctgaagatacatcagagtgagtttttggaaactccttctctgtgggggcagcagacacagcagtggatgctgaactcttggggttctctggaacactggtcgacctattgaggtttgcaatgctttcttccaaaagctttaagtctgtttcccccgaggaaaggctgatttggccctgctgtgggaatcccaggtcatttcccatcacttttgtttctgtctctcccatatacagtcccattgagagtgaaactgctttggacagatctggctgctgcgcattgcttactgagccttttggaaaatcaaccaaaagtcttcgctgcttggagtctgattgagaagcgacagccagtgagggtgaagacgcagaaaccttcacagtagctcctcctcttagggttttatagaagtccatcacatctcccctctcctgagcaagcacactgctggggttttcttctctaccaggagttaatgattctttggagtccatcagtgaatatcaactacaaaacaaaaaacaaaaacggggggaaaacatcataagctctaaagtcacattatcttcctgatccgattagtaagaggcagcttgttaaatgaaccttttagttaactccgaatcaaattctttgttaccagaagagtagtttctatcttccagaataaaaagccatgtcccctgctcccattcagcatgccacatttaaaagtacaatgcaatccatttgcacagctgagggcaaaagtgtatcgaactaagcttggctattcatcctgccgctcactgaacgtgtagctttgttaatcacagacattataattcattacatctgattattctgaaggttcaagttgatgtcaaagtatttaatttcaaaaaaaggaagtgtgatcattaaaattcctacctcttttcaatcacggctgtttgcttttctgagaaccaatacatataacatttgataaatactatgctagaattctcaatccctaattacttccaaatttccctcctaccagctagtcacacatccaaacctttgagtacaaccaactggtgaaccatgcacgttttctttgaaaaataaacaatgctgatctgcttatcttccgacaggctgggaaaaggctttttaacccatacttctgactggatgtgcctacctccaaattttggatatatgaaatgagatacactttatataggccaactaaaatttagattttaaagagcagaagagaaggtgtagtagtttctcactacgttgttagcttacataacttaaatatagctgacccttatcataactcacaaaaacatctagattaagctacatttgtttacattgcttgagatcctcaatatgaaatgctattacatctctaagttctttcctttccaaacaaatatcgaagtactgaaaaatggaaaaacacagaaccgtaaaatcacattcatataaattcaggtacaactgtatccagtaaaatgttcaaaataattttctctgccttcacctatccaaaccttcacctatcccaattctcagcctattctcaagagagtaagactgttagtatatcgttaatcagggtgttttaagagatgggctaagacggagaagcgcatttgggacactatagtcaaatcccgtccaataaaaggtaacttttcctatgcgatgacgttaggcagcataaatgtcactggccctcactgaaaagtgaatatgaaggtagagagaggggtgtggacttgccactacaaatcttgagggtaaactgcttatctccccacctctctgccccgtttatctgaggcgataacgatctctaaacacgaggtatcgaatggagcccaatgaatttccatgccgcttttttgacagctgccttcaaacccgaaaccaaaacaatatttcctaaaacgaaaacgctccctcaagcgacattatcccccagtttaagttgcaaataacccagccacattaattggccctaatgaaccatgccagagggtcttaagtggtattacaaggttgcaattatcaagtctgcaaccccaaacgtcaaactagcacttgtaaaaatcgcagcacaaaaccattacggttacagggggtctttttctaaaaggggccacttagaaacctcaggcgcgaattaacaacaaacgctaaagagcaagcccttgcggggcgggggtggagaagagaaaaaagtgcgaggttaaaagagaagtacgtccagacctgttgagttctctctccgacacgcccacttctaacagataacgccggccccggccgcagtctccaagttgcgggctgtcagccccccgcgtgtgcaccctcacgcgccccgcacgccctcctcaagccaggcgccgccggggcctccccggagcccgggctcgcgctcgggcgcgccggggtggcgtgcaaatattcgggcgagtaaaattcagacgcggcttagcgttcaccacgaaaacgggtgtcgggcgacccccttggagggaaaggggacactagggggagaaaagaggccaggattcccgcgaggaatgagaggctcgaagcccccggcagttcgacagggctccgctcgccgtccgaggtcaggttcctccccctcggcccggccaggggacgcctgcggagggagaggaagaggccagcgctgtcacccgcgcgctgccctttcgtcaccgtcgcccggcccttgccagccccccacccccactccccgaggctaataaaagtttgtaggctcccgcggcggcccccgagttgtctccggtcccagcggcacctcgggggagcgagcgcgccccggccccctcccgcctcgcttcttacctctggcagaggagccgctcgcccgccaccgtccgcagttcccgccgcagccgagataaacaacttagcttgtgaacgcagaaggagcaggagggaaatatattttttttttctaaaaaaaggaagtaaacagccgcccctttctccatgggtggggggagagcccctatttaagaaagtctcccattgcccagctgacaagccagccctccgccccgcgccgggctccgcgggtcgaggttccgggcgcgcgtgccccgtcccggtcccagctgcttcggccgctccggctgcggcgtctccttccacccacagaatccgtccccgacgggcaggcggtgactcgggctcccgtcacagacacgagctcgcaaaatggaggaggcggcggcggagggaagagagcgcggacacgcgaaagggcagcccggcctgggcgagcgagcgggaccgagcggggagcgggtggaggcggcgccacggcgcgcacacactcgcacacacgcgctcccactccacccccggccgctccccgcccgaggggccgcgcggcggccgcggggaacgatgcaacctgttggtgacgcttggcaactgcaggggcgcccgcggtccctgcccccacgccctccgcgcgggccccgccaccccggccccgacggcgcctgcacgcccgcgtcccctggcgtggccgccccgcccggtgcgccgcgcttcgccccccgcccccaactccccaggaaaaagggtggcggcggcagcggcgggggccgacctggtctctctggggcggcgttaagagggccaccgagtttctccagtttcttttctcgctacctccttcccgcccccgcccagctccgcggctccagacccactcgggagctcgctctgccccttggcggcaagcgccgccagtgcccctgcgggtgacagcgggcgggccacaagagccggggcgcctcccgcggctgagctgcgtgagtggcccgcgccgccgccgccgggccgagttgcgtgaagtgtgtcacttcgaaaggggctacggggttgcacggaaacggtgccgcagcgtctcggccgcgctcggggccgggcggcctgacacgccctctggggaggcttcagggaagggacgggatagcgggggtcggcgcatacgtactttgggcccggggggagtcgcgtgccggcaggtcccccaccaccgcatcatctgggcggccgggtcttcagctgccgccgccgcgctctcgcactgggagagaagttgcaaagcagaacccaccctcccccgcgccccgaccgtcccccaccctcttccccgagtctgcgaggcggcggcggcggcagaaggaggcgccgcctgccaagttcaacccccacccctcccgcccaatgtgctcacactcgaaggaagttgcacgccaaatgcaaaacctccagcgagctggatttctttgcactttttttttattattatgattaaggaaagcagggggcggcaggcttaaaagcaagttgcaggcgaaatagtaagttgctggcgaaatatagccccccttccgaaactcctgacctcttcttccaccccggccagggcccgcgtccaagttcccggtgcaggccccacccccgaatcttgacatttgctgccctcgactctgtgcgttgctcaccctatcacgttcataggacccctgcccctacaaataaaacaaaatacaggcagctttaaaatgccagcgttcaactccctacagatgttcctgttaggagcttccccctcagtccaaggggaagggaactcgtggtccgtcctgagaaaggagagggccgtggggcgaggggtgcccgtgcgggaagcccccgccccagctcccttccccagctcgccgcgtcgggaaggcttggacgatgccgggaccgagcctcctaccttgtgcggcacagattatgatttttgtgactctgggaaaggttgtgctgtgtgggtttagggtttggggaggtaacttttgcgcccccacaggtgacatcgcttgccagctcctgacacgggcgggggctgccgcagctccacctaatcctgctcgggcgctcggccacagccactctctcacctcccgccgcgctcagactgacggcggctccccctgctctgacatcttgaagacgattggggaagcgcgtcccggaagccgcccgccgccatcttggtagggtacagtgtcgccagcccgtccccgcggccaccatcttggcaaaggttcgcgatcgcgggtagcctaagccgtccttccttggttctcaagggtaaacggttccctgtgcattgtctgatgtgaaaggaaagaagtaggctttcagcaagcctcttgtccggagacgatctacgggggccgcctccagaggattctggagccgccatcttggcaaaggaagagatactcgccacctcggaaaagaagagggaaccaaccgtatgccaacgtagaaccctcagccagaagaatttttatgaagggcgctgagcaactccatgttaacaaaacccccttctggacccagaaggcagactccgcttctcctgtcccttggcacaagtcaactagaaggaggcccttgctttggatgctcatctgtgaggctatgagaacactgcttgacctagttgcccgtttttccaatttctgagcctcaagcactagaatgagatgtctttcgttaatttggcccctaaactaccaacagtttcatgggaaacaaatcaagacccaaccctacaataatgttttacacgttttaaaagtgagttaaatagcccatgctaataattatccttgtacactgcttaaaatgattaagaattctatttatatatacatgtatgtatacatatgtatacacatatatattatatacatatatatgtatataattaaggggacaatacagttgtctaatagaacacatctccccatgccattagcctgtctcactgctgaatctctgctctaagaatccacctcatcgctcatacatgctcaaatccttagtggtaggtactctgcttaaataatttatgatttcacaagagttcccaattattctcccttcatttttttttctctgcagatcttaatggggaagaatacgtagttttaaatatgccattgaaaacgtttttaattgagcaaaaaaaaaaaaaaacttatcctaatttctctcttcagcaatctaaatgtgcctgttaattttttaatttgatagcaaaaaaattctcattctttagtctttcacattcatttggaagcatgcatgaactataagttaacccctctttttcagagtaatacaaatagttatgatttgtggctaacatttattgatccccactcttctgctgcccacttttgctgacaacaattaaatgagataggtattgttattcgatttttcaatatgaggacaacaggcttacagaggttgatgcttgtctaagttcacatggctcctatgcattaagagaggaattagacaatattaaagtggttttcctcactgatctcaatcattaacatgaagtagtatatcaattctgatagactacttacaatatgtgcttacggaatttaattgaagagatgaactccagtgtgccagaaaggacgtgagatttagcattataataataacacaattctaacgaaagtcaacatttattgcgcatctgctgtctgacagacactattgaaagtgttttatgcacagtatcctaagtctttaggtatggcatttactaatctgtaaccctgggaacttataattactacaagaaataggatgaatccctatctgagtgggaaggtatttgattgtcttagaagcagaggtggaaatgaaggtgatgtattcagactcagtcaaggcaaggacctgatctatcttgtcatagctttatgtcccactcctggaacacagcccactacatagcaggcacccaacaaatacattacagggttataataacattgagtcaactagttaactagatgtaaaatcacttttactgggttattgttgtggccaaatgggttaataaaaagtgtacagataaccctcaagatcctcatttttattgttttgtgtttaaacatctgagtgctccccccacttttttttaaaataaactagattagattcttgattgtatgttcttatagtattctgcatactttgttagcacattacaatgatagttcattatttgtgccctcatttgttatttctctgtatcacccaccagaacataagttctgcaaaggcagggactgtgtctgtttgttcacccctgtatcactagtgcatagttggtgctcagtgggtgttggttaaatgaatgaatgaagataatatatggtcttagagactatgtcctaaggccaataaaaccttaagcctgactaataaccaaaccacttgatacattgatttcagaaactgatatattacccaagtgagttctcccattctcttcatgttttgtcatctccattcccactaaaataatccaagctgtactgccagattacccctccaaaacatcaactaaatcaggctgtgctccttctcaagtatatacaataactcttgattctagtgctacacagatcccaactcccagtatggtatttaagatcatcacctttacctacccctttgtagaaagtgaagccttctagtggatgtgattgaactggagtttaatttaaaaattagttaaaagaaggaaataattttaagaaagataacttgcaaactttaaacttttgaaacttttgaaacctaaaacctgtgattgaacatttattttctaatcttttgatgaaggtctaaagcttttatgagcccactgactggagttccatgtcttctttagtgtgtgtataaactatacctgtaatgcattgatatagtgtagcagttaaaagccagactataaaggccaaatacagtctccaccactaaaaggaatgtaaccttgggcaggctaactctctgtgcctttttccatcatctgtaaaatggggataataatagtactgatttataaagattaaaccagtttgatatatgtgaagtgcttagacgaattcctgggtcataggaagtatttgctcatcattagcaattattattcatctgtagaattactattttcccccttttttttaaacaaagtagaacaagaaattaaagatacacattcagtatccatgacctgaaatgcttaatactgaaagtgttttagattttggatttttttttttctgattttggaatatttgcattataatgagatatctcggccatgggacccaagtctaaataggaaattcattttttgtttcatatacaccttatagcctgaagataattttatacaatatttaaaataatttggggcatgaagcaaagtttgtggtaagtacttccatgtaggatttttcatttgtggtatcataacaatgctcaaaaagttttggattttggagcacttcaaaattcagattttcaagttagggatgttcaatgtgtacttttagaataattttcgtgcagatttctaaatttttatgattcctcactcctgcccccacaccagtcttttaaaattgtcttacatccaccttacttgacgcaactgtaagtcaaggaaggctatagggcatctttccatttagattttatagaacaattttttacactcatttcatcattttacttaatatttaatcaaattaagtaagtacagtaataagcaacaaatggcataaacatgtttgggaagcaaaagcaccaggaactgttggtagctcaactggtgggagcagaatcgtgtgaagtgcagaagtgaccatggttccagtgttcagcgcaccctgggcatcaatccattgttttccagggagactggagaactggatcagttgagatcgatattgagtagtgtctgttacacgattctgttaaagaaaggacataagacaccacattcattcccatgtctcctgttgtttatcacatatatttcctcttacataagcatacttctttgtgacttattttcctatagtccgtgattctttgtcatggcttcagtttccatttattctttttttctgtactctctcactttaaatgtgtgatgttaaatataaatgggaaccatgtatacgtgtattgtgtacatgtgtattgtgtattttgaacatgttaagcccacacaaacagcttttattggtggttagaacttactttaaaaaattattcctgcagctatcatagctattatttgtctctttaaaataatatcttgactttggaaaatacttctattcctatttaactttataaggtaagaggttcaagggaacccagctgagctttgaatgagccatctctgtctgcttcaatatttgtattttatgccagacatgcctattataaacaattcacactagtacagcaagttcttaatcataatgaactccactttggtattcctcgttgtaattagaattaacattcccgcctggactgggaaatgctaaattattactagctttcctgctgttttgctgtctttcatgatgctttcaatgatttcatcataagcaacctaaaatatcacaatttgtgctcatatgcgtgaaatgcccaatgggtgtcctggttgactttattctttatgctggcagaacttagtttaagcaatacctgattcaaggatgaggcagctatcagcagataaatgagataaatgttgccataagcaggaactcaatgtttttaatgtttggaggcattagagcaagcacactgaataattgcaacaagtattacgtactttgttttttcatttgtggcatttgtggctcctcatatgtcattagctttcttcctttcttgatttaatctccttttctctcccatgttcctttggtaaagagtgtttcaatctgccccgctgctatgtggaatctttcagctcatttgagaacctgcatttccattttggttcttatatcttcttattagagcacacagggttttgttttgtttttaagctaacttagaaatagtggggttgagatgaaaacattcttggtatagggatcccttaacaagataagaagatacttcatatcaaactccaaagtgctacaaaggacatttgtcaccattgaaaaaaaaattgttttgagatcagtatttgtcaattaaattttctctatcctcttgttgaattttcaatacaagacctggtttttagaccctattctgccatttacttacttgaatgagcctggggtaggcatttgatttttctcagccttgtttttcaatctgtaaaggaaggataatgatatctaccccacctatcacacaggaagtaatgtaggccttacatgggatcatgtgttcaaacgtttttaaacactaagctttatttggaaaacttagaggagcttatggaatttttgcactatcacttcaccacaacaaaaatgaaaattatcattgtctcttttcacttatttcccagggaatcagtgcaatgggcagtctggaattttaggcaggggagtgataattcagtagtgcaccggaaacaattgtaccagcttgcaagcactgactgttaaattttcagagattttgtaagttggttgttaatcacagtcattattaaaaaccaaattatttataaactcacaatcaaatattttaacaacaaaaataaatgctgaagactttactgcctaattattttactccattttactattatctatgttcttaaagttatttctgtctgttctgtataagaacataccatacgatggtatgatgcagcgtatcccttcctaacgctgcattcagaaatgttattttggtagtttgaaatcaaccatggtggagtacctatactatagaaattgggaaacatgacaaaccagagcttgatttgttttgttgattgtctagactgacagagtagaagaaattttaataatgaagattgaacttaaaagtgccttagtttgtgaacacaaaaacttgaggaaatatttttctagtacttgaaagctattatcagcaaaagaagtcacttctgtcattaatgaacgagtttagttccaacatccatttttgttgcttcacttttatctcgctcattaatgtaaaaatatcaaccaacattcatgttgggacttcagtaccatgaatgacttctttgctgattggatattaatcagatatttatttgtggtctgattttgccaaacgtgtttgaattttagctgtaggttggctatggacacaaatattctgcaaaaatcactgaaatggttctgtgaaaatcacatggccatatagaatttactattaagagtgttatattttttcttgctttttgtaaattatgtgatacatatatgtaaaaattataaaacacatagatactctgttcccctcaggagctgttaaacatttactaacacactaatggacataatctaatttactatttgaaaagctcgttctgcttgcgatgtggagtatgagttgtaggggctaagggagaaagcagggagagcagtgaggagacaggcacattggcccaaggaaagatgacgaagtttgtattggttgcaatggcaggggagctggggagctatggttggacaggagaggtattttgaaggccaaaggtaagcaaagcagtcatccagcagctctatgaaagagatggacttccaggaactttttatgctaagagaagaccttctggtgaagagtaagcaggcttagttgaatggggtgagtgcatagaaagctgtgccagagaaaaggagtcagggagggttgtagtaggaagtaggagatgttggcagttctaggatttcaaggtaaatatctttatatcagatggagaaagttaggctggattgttagtcaaatgtcgaattgcctcaaagtgcagggggggaggggggaggggaagccccaaataccagtaacatgttgcaactggaactcacatactaagctactcatctagtaatttcattgatttttgcccacatggaggggttatttgttcatctccatgccttgagcctatcccaatttatagtagatttttttttctcacatttggcaattttaattataaaactctcacactgaatcaccctgtgttacacatatattgctgtcccctttcatgcttctcacttcttcattcctatttttctttgctatgccataaagaaggaccctaccaaaagccaccctattgtcttgcctattagttatcagaaaacttctggcaaccacagttttccccactttccctgcttcctccattataacctacaatctatattccacattacaggtttttttgtttgggttttaacatttttcaagagaagttattacattttatggagtttaaaaaatagtaaatgttttgcaaaagaaagaatcatgtctccacattcacccaccctttcaaccctaatgaccagaagaaggaaagattctcagctatacagctaccaatgactaacactttgaggattcagtttggatatgttgtttactttggtcttctgatgattagctattttaggcatggtttcaatcaatcagggaatgtttattaatagaagagactttcttaattaatattctctccattcattccttcaacaaaagagaattccttcaacaaaatacaattccttcaacaaaatagcaactattatatgttaggccccagtataaggctgcagggatatcaaaatgataacaatctcttctctggaggaaatggagacagatacggttacaagtcattatagaacaatgcagacttacagaaatgtgttagatgcatagggcacttcataagcttcaagaagtcatctggtgtttaaggttaggaaaatgggtgtggatatggagatggtggtcacggagggtttcctagaggttagcaggactgacttgaattatgaagggttttcttcaagttatttgttttttttttctcttgaagataatacttctaatggaagcttgtagacaacattcattaggtcattttttggtgcatttataagaaaccccactgttaaaaacagagttttttgattcactgaaaagtccaggggaagtttaatttcaggaggcatgactggattcaggggctcaaatgaagtccaaagggcttaaattttatcccttagcttcattttcctgttttgttttgttttgttttctggaaagattatctccacctctccacctggtggcctgtggcacctggatttaacacatcctgccaggttagtaacttcagtggaaagagttcttttcccataattttagtagttgttcctgggaggggtttcactggtctagttggttcaaatgcttatccctggaccaataactatgaccaagggatgtcaggaatgtgtactatgatgggcaaagcctagctcaagtgcccaccactgacacctaagaatggggtacaaatgaaagagagagaagaggaggtgcttctccaaataattggagattttaaatttaaataggagaaaagggatttctgggcatgcagaaaaaaacccagatgtccatgacaatagctttttatcaaaatattaacagtgacataaacatcatattttacattttaagagaatagacatgacttaaaatgtttgtcagcaatggaaagaaccctgaaaattaagtatagttgttacaagttttattggtttcacttcctgcctttaatagaatgtgggtttgtactttgaaatttcaaatgttacacaaatgaattgatgattgctttgcagaaatagtatctccacttaattgggccttttttgggtgatgaagtgatgtttacaacttttaagctagttttatcgtcttccactgaaggagtttgtctcacttgaatatgattccaacaatatgatgggtataggcggctgcagtgagcctctgtctgcttattttgctccttctgtcttgacaagctgaatgtcacgcaaatgtctcaagcctctgcactgggcaggcaggaagccagaaccagtaatagaagcagtaggcactctgtgaatacttgctgattaattttagctccataggcctgatgggttttccatccctataattaccatcagcaaatagttattgaatgatgtccagcatatttttatttcccttttcttgatcctgattttcattttctattttacctctctgtgattttatcacgtgtgtttctgttcatcagactaacagagcctcctgtgattagtttataatcactcagttttatttctacctatgagatatctttatctgtctgtctaaatttgtctttgttatgacccagttcaagttctttctggaattagggaaaggatgaagtgtgaaaaaaaaggaattaaatagttcggttattgaatggctattttgtgcttgatgctatattagtacatttccacatttgctttacaagttagtctttcttattagaagtaatgcttaacaagcctacaagtactgactgggctcactttatagagaaaatggagagcagtgaagggtgaggaggttatgagttatggatatgacaaatggggaaagatcttacagaagagagattggggccatccaagaaaaatcgttatctttgtgtagacggcattagaaggatgaaaaataactttagatattacttatgcctttaagaaaaaaacttcaaaagatgctagaaaataacacatacttattgtaaaaatccaaacatacagaaggtagaaatgtataaaggtaaaaacttcctcacacaatcccattttgcagatgtaactatttttttctttttatattttgatggcaacaaatttgtaattatttttgagtttttatgtatattccagatcccccaccccattattcccctctttaaaaacttttattatgtgaaatagaaagtagaattgtgactatcagaggctgggaagggcagggggaaggggaggatggggagagattagttaacgattacaaaattacagctagataagaggaatgagttctgatgttctgcagtaccataaggtaaatgtgattaactataatttattgtatattttcaaatcctttttgtctatacatggatgcatgcatgcatatatgttttttaaaaacaaaaatgagattttactacatgtatttttcaacctttattcatcaaatgttattggacatcttttcatcttttcaatattttcaggtaatagtagcatagtataccattgttttaacctttccttattgaagtatatgtaaattgttttcaatttttcactattgcaagccatgctgcaatgaatatttttgtatctagatctttctgctattgtacaattattatagaattgaaatttctcaggcaaatgtgatttgcaacaattatcaagcacccaaaagtgctacattattgggctcattttaaaaatgcttgtccactacagctcattttctactttcatcttcctttagacattctagaaaaaatcaattagagcagtagtcatggatggctatgcaggacaggctactagctggagacccctcatgttttgctattgatacagttttgctgaatccatccttatgttaaatgcattaacaatttaagaggattggtttacatatgaactgggaagggattattcagggataccataatgcttgatggctgcctccatcctaccagggaccctgatctgccctgttgtggccacatggtagataggtactgttttacttgccaagtatcccctctccacatatgatactaggacctaacatttcctttggaaaactatcctttccctaactttggtccatgcgcttatggtggtattaacccatctgtaactctgcatgggccaggtctggtaatatcagagataggcacatgacagggacagatacaccttaattcttggctttctgggactacttggaaacttgtcttgtttctcaacaggaatagctaagctgatacgatgcaagcttggagcagctgtggtctaccacttagagactccattggattgaggtttgcaaaaaaaaaaagcaaagagatctggaaatagattcccaattatataatatgaatgtctagatcctaaggtgagggctgctcctagacttgactattacacacttcaatacattattccccctccttctcttcctcctccttcctcttcagccagctggagttagctaacacttgcatcagaaagggtcctgacatcagaagtaaaggtctaaaacatgggggtgttgctccttctggaagagacagggaggttaaggttaccagacatggaggatgaccccaaaagaaaaggggagcccaaaagagaagccagttgaatgtctaaaaataaactttacctgcttcacaagtttggctcgagtttccttttaatgattaactagatgagatggtcaaactccttctttatttaaaatacacaaacataaataagaatatcagtcttcagttaattcacctattctggttacatctgcctcaggtttctattttttttattaatacataaattgcttttctattttaggctgtgtttaaaaagagagagagagagaaacctggtaatcctctaagaaatgtcttacgtagtttttctttagggcctaaattattactctactttccatattgatccagccttttgttttattgttttgtttatagtagatttggtaatatattaacagtacctataaatatgatctagtggaattatgtattaaaatattttaatatcttcttagcatttgcgatcttgaaactgaaacttgatagctgaagaaaaagttccattaagatgaaaaatcaatcccttagtggaattaaatccacaatgcttatataaaacattgcttctgtcttatttacataaactttatacttctctctctcatcagtggcaggggaatatggagtgggatgtcattagttggattcaatagacatttatttacttattaggagcttgaaatagacttgagactctacctcctagtagacacatgtctttagcaagttacttaacttttctgaatgttagtttccttatctgaaaagtaaggttaataatattatctgcctcaggaggttcttatacagattaaaaaagatattctctgtaaagcatttagcatggtctctgacatttaattaatgcatggtaaagtaacttattattacgctttcagaaagtgagatagccctgtaggcacaccccaagcagaaagtacacgcccatacacaatacactaacttccttcaaacgaagccccttttctccttacatcatggattgtgaagggagcacctgtccaataaaagaaagattctgtaaaagaaatccaggcactggctggaaattttcactatatgatttatcaggcctctcccagctttgaggtcctataattctataaaccacacaagtttacatatcactgtgggatttgatccttatgaaacccaagagaaccataggttttccacatccagctgagcatgctcaaataaagacagacatttaaaagcatagacattgatcacgtgctctttaaccagcaaaatactacagccaaaagaaacagaagcacagagaaataaaatgatttgtttgaagtctcattgatttgccaagaaaccagactgaatgtgcaagctttcctaattcctagttgggttctccacacactaaacatagtgatatataatcttcagttgtcaatatttaccttttatgagtttattgcttgtcatgtgttaactcataaagccatttatttacttatatcagtgccatcaaaaaccctttaatttcacaatcacagtttgtgtaacgtagcagacaaagcactgggctgggacaagggactgggttttggttttggctttgtccccctttcttcctgccctcaactgcatgatttgggcaagttacttttccccttttggactgtttgcctttttctgcttaagtatctggactttcccttcccttctttctcaacccacacagaagtaattatgtttctttcattatctctaactgcaaagtttttactagacagcccatatttactggtcatctgctgaatgcctctgtgcagtgagctggagatagaggtaaataaggtatggcccctgccctcagggctttcccagttaagagggcacagggtgtgaaggggcacaggtcagaaggtgaaggcaggggtcagggaaggctcctggaggaggcagaatgagacttaaagggtaaacagttggtgctgggtggcaggcaggtagacataagctccagtgatgacacagattatgctgaaaggaagaatagtgttaacagaactggcttggacgagggcagaactagaaagaatccagactctgacactccaagttgtgtgaccttgacctagttacctctgtttcctcatctactaagtaggcataatgatcgggtttcctcttaaggctgttgtcacaattcaatgagattacatttgctaattttagtgcagtatttggcattactataggtcaaatatccctaatcccaaattctgaaatcggaaatgctccaaaatccaaagctttttgagtgctatcatgatgctcaaaggaaatgctcattggaacatttcagattttggatttttggattagggatgctctacctgtatgtattctgcaaatatttcaaaatctgaaaatatctgaaatccaaaacccttcctgtcggaagcattttggataagggatattcaatctatattactaccaatttattttcaccaacaacatgctgttatacctgttctcttgtcccctctttctcttccaaggacacgggcatattcataccctgctatcaaatatattttgtttataaatattttcagtaacacactgaaatacttatttgaagcactatgataaaagaaatgtggcattccatgcaatactttggggagtatcggggaacctgccccgatagtcacataggttcttttctattttccctaagcgtcagccagtttgagaaataaagggacagagttcaaaagagagaaattttaaagctgggcgtctgggggagacatcacatgttggtaggttccgtgatgccccacaagccgcaaaaccagcaagtttttattagggactttcaaaaggggagggaatgtacgaataggtgtgggtcacagagatcacgcgcttcacaaggtaatagaatatcacaaggcaaatggaggcagggcgaaatcacaggaccacaggacgggggcgaaattaaaattgctaacaaagttttgggcaccattgtctttgataacatcttatcaggagacagggtttgagagcaactggtctgaccaaaatatattaggcaggaatttcctcttcctaataagcctgggagcgctatgggagactggggtttatttcatccctacagtttcaaccatagaagacagccacacccaagggggccatttcagagacccaccctcaggggcatattctctttctcagggatgttccttgctgagaaaaagaattcagcaatatttctcccatttgcttttgaaagaagagaaatatggctctgttccccctggctcaccggcggtcagagtttaaggttatctctcttattacctgaacaattgctgttatcctgttcttttttcaaggtgcccagatttcatattgttcaaacacacatgctctacaatttgtgcagttaacacaattatcacagggtcctgaggcaacatacatcctcctcagtttaggagatgacaggattaagagattaaagtaaagacaggtataggaaatcacaagggtattgattggggaagtgataagtgtccatgaaatcttcacaatttgtgtttagagattgcagtgaagacaggcataggaaattatagaagtattaatttggggaactaataaatgtccatgaaatcttcacaatccacgttcttctgccatggcttcagctggtccctccgtttggggtccctgacttcccgcaacaggggagatcatagacatgctattaattataatggttttccctagaacactagttttcaactgggtgattttggccctaggggatatttggaaattcctggagacatttttggttgtcacagatggaaagggagaatcttattggcatctagtgggtagaagccagggatcctgctaaacatcctgcaatgcatagcacagccccccacaacaaagaattacccggcccaaaatgtcaatagtgccgaggctgagaaaccctgccctagatgtaacccagtcactgcttcttttcaacaatcattgggaaacacggtaaaaccatgtttcttaagatcctaaattcagctgcaaaagtgtatcctttggatattttacacattttaacatctcctttgaaaacaaagtccttcagagaacctggtggaatcattccaactttttttgctacaaagataatggaaattattttattttatcatttttctcctatatgtataattcaggacaaattcttctttttttatgtggtaattttaatgaaattcaccaaaaaagatacttgattaaccctagtttgggagtcttttccagagcagagaaaattctggaaacttgcaacagtgtgggcttttctccaccatcacgggggatacaaatggctagctaccaatgatggctcctgtagcctctggaggagagtgctaagtgtcacctttgagttcccatagtcttcctaacactcctgccaaagtggggccaacaacagggggctcagaagggcttgcatgtttttactatccttcatcccttattttctttcttctagaagcaacatagtgattaagagtgtgggctccgggtttgaatctggttctgctgcttgttagctacagtgaccttgataaactccttaacctctgtgtgcttcagagtccttccctgtaaaatggggggaaacaatagtacctacctcacaggattgttatgaggactaagtgagttctcatgggtagagcacttaaaacatagcctggcacatgggtgtggaggctcacacctgtaatcccagcactttgtgaggctgaggtgggcacatcacttgaggtctggaattgaagatcagcctggccaacatagcaaaaccccatctctactaaacgtgcctgtaatttcagccacttgggaggctgaggcaggagaatcacttgaccccaggaggcagaagttgcagtgagccaagctcacaccactgcactccagcctgggtgacagagtgagactctatctcaaaaaaaaaaggacatagcctggcacataataagcagcaaataaatgtgagttgtttctcttactttttattcttacttgcttttgtggacacactgaagtaggctttaggtatgatatggacgtggtggaagttacatgtcattgcagagtatggaacacagtcacagccagggccagctggggccaaggtagggagtggctgaagtggtgttcactgcttcatcaggtctgcctcttttttagcctagcaatatcttgtgttttcccttctccatgatctttactaatacccagttttctcttactttccctggcttttcctcccaagtatgacatctcaccaagctctccccatctttaccttccatagagttttatttggctatttcttgaagcattgattttcatctgagttgcccatcagatcatttgggaatttgtttaaagtatagatatctgggctctgcctcccaacgatcatcccaagtatcttgattttagtgtttatttgagagacagtatggcatagtatttaagaacatgaccaaagagccaggctgcctaggctacgggttcgttgtatgaccttgagaaaattatttaactctctgtttctcactgttcttatctgtaaaatgggggtgctatgttctgaatgtctgtgtcctttccaaattcctgttgaaatcctaaccccatggtgatggcattaggaggtggaacctttgggaggtgatttggtcatgagggcagagccctcatgaatgggattagtgcccatataaaagaggcctcagggagcttctttaccccttcccaccatgtgaggacaaagcaagaagagaagatggctgtccatttgtaaaccaggaagcaggtcctcaccagataacagttctgtcagtgccttgatcatggacttcccagtcactagaactaagagaaataaatttctattgtttataacccacgcagtctatgggattctgttatagcatcctgaacaaactgaaagtaagagtgcttatctcataaggttgtaagaataaatgagatgccccttaaaacagtgcctggaatgacttttgtctttcttgttcattttcccttctctcttactttctcacctggcctttctttcttcattactttcttctctccctccaacacatatatattgttttattctagtggtttcatacttgcaggccttcgatttaggtttttaatccaatttgatttgatttttgtatatggcaagagatgacattggtctggccaaatattttttgaataagacatcaaaagcacagtcaaccagtgcaaaagtggacaaatgagatcacctcaagctaaaaggcttctgcacagcaaaggaaaccatcaacaaagtgaagagacaactcacagaatggaataaaatatctggaagctacctatctgataagggattaataaacagaatatataagttgtgtaaacaactcaataggaaaaaataatttgatttaaaaatggtcaaaagatctgaatagatgacatacgaatggccaaaaatactcaacatccttaatcatcagagaaatataagtctaaactacaatgagatatcatctcatcccagtgaaaattgcttctatcaaaaagacagggaattacggatgctctcaaaagtgtggagaaaggggaaccctcatacactgttggtgggaacgtaaattagtacagccactatggagaacagtatgaaggttcctaaaaacaacaacaacaacaaaatagagctaccatattacccagcaatcccactgctggacatatacccaaaagaaagaaaatcagtatatcgaagagatatctgcactcccatgtttaccgcagcactattcacaatagccaaggtatggaatcaacctaagtgtccaccaacagatgaataaagaaaatgttgtacatatacacaatgaaatgttattcagccataaaaaagaatgaaattatgtctctttcatcaacatggatggaactggaggacattatgcaagagaaataagccaggcacagaaagacaaatatcacatttcttgctcatatgtgggaactcagagagagaaagaatagaatgatggttactagggtctgggaagggtagtggggaggggggataaagagggggtgtttaaccgcatattctcactcgtaggtgggaattgaacaatgagaacacatggacacaggaaggggaacatcacactctggggactgttgtggggtgtggggaggggggagggatagcattgggagatatacctaatgctagatgacgagttaatgggtgcagcgcaccaccatggcacatgtatacatatgtaactaacctgcacattgtgcacatgtaccctaaaacttatagtataataataataaataaaataaaaaataaaaaagaggggtgtttaatggatacgaaaatgcagtcagatatgaggaataagatctagtgttcagtagacaacagggtgactacagttaacaaaaatttattgtatatttcaaaataactaagagtggaattgcaatgcttctaacacaaatacattacaaatgcttgaggtgacggatatcccagttaccctgatttgatcattatatggtgtatgcttgtatcaaaatgtcacatgtaccctttacatatctgtaactcttatgtatccataataattaaaaataaaaactttttaaaagaaaaaaaacccctatatacttatggtcttaagcatggctttgggacccagcaatgaattagatgtaattctagccttatatggcattatagtctaattagtggaaaatagacacataaacaaataaagatatgtatgtgtacaatgtatgaatgagagagttactgattttcttagaaaagagaagggagagatgaaaggctccaaaggggaaatgaacatggcattgagtgttagaatagagatgaaatcaatccattccatgcaacaaacattttcaaaagcacctactacataccaagcacaggtctcagtgcctttctgaaattgtcctcctttagagagtggcagcttcatttttaacttgatgttttaaaaaaatacttaactcaaaatagcaaaacaatctataaaaaaaggcaaagttcgaggactcacaaaacgtactactacttacatactacaaagctgcagtaatcaagacagtgtagtactggcatgaggataggcattcagatcagtcgggtagaattgagagtccagaaacccatatgcctacagtcaactgattttttacaagaataccaagaccattcaatgaggaaagaatcacctattcaacaaatagcattgggacaactggatagctacatgcaaaagaatatttaaaaaattaactcaaaatggattaaaaacttaaatgtaaaagctaaaattataaaacttagaagaaagcatgtatgtacatcagaatctcggattagtcaatggtttgttagttacaataccaaaagcacaagaaaaaaatagtcaaactggacttcatcacaatgaaaaactattctgcttcaaaagacgttgtgaagaaaataaaaagacaacccacagaatggttgaaattgtagacaacgtacagaaatggtagaatttgcaagtcatatatccagtaaaggtctagatctagaatatataaagaacttttatatttcaacaataaaaagacaaccaacatttcaaaaaaaggcaaatgacctgatagttctctaaagaagatgtgcaactagccaataagcacataaaagatgcacaatatcattattcattacagaaatgcaaattgaaaatacaggagatatcacttcatacccactaggacagcaataattgttttttaaaaaaaggaaaataaatgttggtgaagatgtggagaaagtggaactctcatacattgccagcgaaattataaaatggttcagacactgtggaaaacatattggcagttttctcaaaaaggtaaacatagagttactatatgacccagcaattcaactcctaggaatttacccaggagaaataacatgtctgcccaaaaacttgtacatgaacgttcataacaacattattcataatagctaataagtggcaacagcctaagtgatcagctcatgagtggataaacaaatatggtagattcagaggacaaaatgttattcagccataacaggaaatgaagtgtggatcgatgcatgctataacatggagaaacctttaatacagtatgttgagtggaaggtgccagacacaaaagactacatattgtgtgattccatttatatgcaatgttcatggtaggcaaatccatagagacagagaaataattaattagtggtcgccagggggctagggaaaagggaattgggagtgactactaatagaaccagagtttattgttggtgtgatggatatgctttgaaatttgatagcggggatggttgtacaaaattaagaacatactcaaactcactgaattgtactttttaaaatggtaaagtttatgtcatgtgaattacatgtcaatagtcataacaaaaattattaaccaacatatgctccctattttctttggaatgttgatacattgatacaaatcagctaaaataataaagcacgagttatgccattaatattcgttttacaaaaacacgtgttttgcattctagtcgaaaagttaaagtttattcagattatgatcaggagtaggcagaggccaagggaaggccaagcttaaaggacttagttgtcaagactcctttgactaatttttaaactcccacatgataattcatctgctcagcaaagcttcgctttgaaaaaacaatttttattaaaacgttacggtacaaaaattagtgggtcaaatcctgtctcataggtacaaattagtcattttgaaatatgtacgaattcttgtgatgcacagaacagctgtttggctgatgctgacctgtgaggctctgatgtgctactgcagcctttcagtgtgtctcctggtgaagagggcaccaacagtatctgctccctttttcttaaatgtgcttttacgaagtttatcccttgggaggaccacccatgtgagtggatgtcagatttgctcataagtccataaatcatacagacttaaccttgtttattaaagcaggtctttttcttcatttctgttccttttgaagagttcaaaagctaaaacactagccccaatgaactccccatcacatcttagcaagcctaatatttctaattctagaggaagaaccccagtctgcactataagtaagaaatagcattttcattattttgtgtgacaaactgtgttcttactgaccatttcactccagatatagcttagtatttttttttcatagagatttcaggaaacgatagcatagttttttaatagtgaaaatataaatacagattctgaagcagtctgtggtcttagtatgtgggaatgattagtcatattggggactgccctgatagtagggtgggctgggggaattaccctgagaggttaattatgaaattcatataaaatggatgaaaagtcaccttaatggatagaatgacaaataaggcaagaagaagaggggaaagatagttggcaaaacaaacctcagcagtgcctcttccagcaccatctaggaaattataggatttgggaattcccatcctagtgggaaggccgtagccagtgttgtaaacaaacatggaggacctgctagcaataccgttcttctgcaagatggctgcatcaggccccattaacctgataacattaaaatcagatttttctgccttcttttcccccatggattcaatgtccactagcaaccttctgaacatgtctcctatgagacactatgttgtagtggctaggtatccacactctggtttacactgtgtgggttcaaatctcatctctaccactcactagcattgtgatcttataagtttagaacctctgactttatctataagagggttttaaccacaattcctaccgatagacttgtgaggtcatcatggaaaatgcttgacactgtgcctggcacaatgttattgttaataaatgctaaccattatggtcattgttattctaatataagtatgtctatgaaaatagaatgggcttctcacatgtggcaattatgtttttcattaaaaattactaaaatgggctttttgacttaatatgttaatcacctgaacttagtgtaagtcttataggacttacaagaaaagaggacttacaggcgaatagattcaggtttctgatcctgccaagccaaggtcatggcaaatccaccaaggccacaaaaatgccatcttgtgaagccccttggggtctgcctcctggtctttccctgaaaatgccatctcattcaggagcttgctttcaatttccttaagaggagattctacagaggaagtaacaaaatgggatcaatggttcacatggtgagtgaatgttgaaatactgatctgctgaggactgagcttctgtaattcaggtcatacccttttctaaaacccttcaaaggcttcccttctgcttttaggataaaatccaaactttgtgctagagttccacaaggtctttcctccctgactccttctgcctttccaaccacgttctacaattctctcttgccttaccatgctctagttcaggggctggcaaactataggaaagtttggtaacattttattggaacacagcacatccctttgtttaagtattgcctatggctgctttcacactgcaatggcaggcttgggtggttgagacagacacatatggctccactgtaattgtatggtaacatttaactgtacaggacttgggaagttaggtctagctgtgagtccaagaaaaggaaatgattttgttcatcagccaacaatttttgctataaaagcaaagcaatgtgagtgggggccctaaaaatccccactgttttcgccattctgactaccacccactccccaccaaaggtccctggggcacaccctgcagaccttattactttagggcacacattttgaaaagggctgactttgctaatttgacttggcattttgattaaagttactttcatattttgattaaagttataactgcatgatacaggcatactcttatcaccagtgctttaagaacatgaaacgggaagctgatgacttctaaaccatttcacattgagtctaaattcactgcttaataataaataacaatgataataatagtaacagatgtgtaccactcacatataccaccatcttatctcatcctcacttatggtaagtgcttctgttattcattttatagatgaggaaactaaggagaagagaagttaagtaacttgcccaggttacacaataggaagtaatgaataatggatccaggatttaaagccagtagtctgaccactgagcacaattaattaattttaactacaaaatctcaccatatggttaaatgaatacctcattcttgtgtagtagtttacagttacaaattggtgagtatcttcattttccatattagaaacaaaggcatgaaaatgttaagagatttggcaaggttatgtagccatttttcaggcaaaagaatattaggaacttggtctttggattctcccgctcacaaacaaaatctaaacttgaactgtatgcaactatctctgctatggcagtcatgcacctagaacctggtgggcactaaatcagaataaactatctggatggcattttagctacaacatatccaaaataaaaagagccaaatatttataaagaaaatgagaggcaatgtaacaacaataaaagttggaaatgaccttaatattaactagtagaagaatggttaaattaattatattgcatccataagatgatgccatcaaaaatcatggtttttggtctggtgcggtggcttatgcctgtaattccagcactttgggaggccgaggtgggcagatcacctgaggtcaggagttcaagaccagcctggccaacatggtgaaaccccatctctactaaaaatacaaaaaaattagatgggcatggtggcaggggcctgtaatccctgttactcgggaggctgaggcaggagaattgcttgagcctgggaggtggaggttgcagtaagccaagattgcaccactgcactccagcctgggtgagagagtgagactccatctccaaaaaaaaaaaagaaaagaaaagaaaaagaaaaagaacaaaaaatcatggttttctaataatatgggggaatgctcacaataaaaataataagcatatatgtttgtgtatatataaaaatacatatacacacatacatattaactttattttaaaatatctttatgaatttcatgcttttatattagattatgttttcaaactctattaatgtgtactgaataacttcacaggaattgtattaaaatatttaccatggatatctctggatgtgagatgatggtagattttcttctacatatttttctgtacttttttactttctccagtgaagatatattacttttatgagtaggaaagtttcacggtacgtgttgttatatagactgaatgtttgtgtctccccaaaattcatacgttgaaatcctaacccccaatatgatggtattaggaggtagggcctttgtaagtaattaggtcatgaaggtggagccctatgaatgggattagtgcccttatgaaagagtctcggaagagctctctcaccctttcagcctcttgaggacagtgagaagacagcgggctatgaactaggatgcaggcctttaccagacactggatctgtcagtgccttgatcttggacttcacagcctccagactgtgagaaataaatgtttgttgtttaagccaccaaatctatggtatttttactgtagcatcctgagcacactaagacacatgttattttaaggaaagatgctaataccctgcccttcacagcctgcctcctcagcaagttcccaccgtgtttaggggtgttgagccttcactgcaaccactaaaaacacagtcccacattataagtaattctgcttaggaacttccagttgaccatcagtaccaaataaacgtatcttgaattcagtcatctatataaatgttgtttatgtagagatgtgggaggagagaggagaaggttatgatctctttgtggtttcatgggatgtactgtttggtccctttctggggccacaggggtacaggttcagacatggtttaggataccagggttccgggactgggtaagaaatgtggctcaggagcttctggggagagagatgggccacacccttccccagtgcattcatttttcaatagggcttaggaactttcagagaaaggactgaaatcctgcccaccaatgcactgcaaacctatgtctgagaaagtagggtgttcccagatggagaacagattatagagaagaacaagtgcttccactgaagaactaaactggcactacaattccaataagaaaaattggtgttatgcatgttctcactcataagtgggagttgaacaatgagaacatgtggacacagggaggggaacatcacatacccgggcctgtcagggggtggggggtaaggggagggagagcatcaggacaaatacctaatgcatgcgaggcttaaaacctaggtggtgggttgataggtgcagcaagccaccatggcacatgcatacctgtgtaacaaaccggcacgttctgcacatgtatcccagaacttaaagtaaaataaaataaaataaaatagaaaaagaaaagttggtgttagcagagagtgggggttataggtagtttcccagctgacatcaaaacttgcctgtacacagccaccctaggggcacttttgtagccttggagaaaggtgcagtgggttgatttggaagaataataactctgtaaaaggtagtaacactatggtttaatcagctttgcagtggggcccctggatgagtggactataacaattactacagcaattacatcctctggctttgaatgacatttatatgggtttgggaacagagatgactctccctgagggggtggtggtagctgcaaagctgacaggagcggagtttcaaccttggtgggggtggaggagcagaatatgtgtacgactatcagggttggtggtaaaaactgccttgcttggctcagcatgtctccagtgaggaagccctgtcatgagccactagaatacctgggactgggtgcatctacagtgccagcctagctgaatgtagcaccaagtgtgttcatctcactttgctgagtgggaggtgacactggaccagtgatctggatcgctgaattatacatttaaaatatgtaatgcgctaggttaaaagtgctataaagaaataaggtcataacaaggtagtaaggcatctagcatatattccaaattcacaaacattggtcctgcaggatttccaggtgatggtgactgtggtggcaacggggatggggacagatttctagtcctgaggggcatctttgtggaaacatcagagccttggtccatggattcctgccatagtggggacagaagtgaactatttctggctgcacgtcagcacccttaggcatttccagaaatatttaggggaaagacactctttaaaaggctgaggtaaagcagggacactcaaaattggtgaagtgtgagatgctcgggatgagtttgtttaaacaaagtaagccaaaggggctattaaagcgtacggttccccatgaattcaatgtttttctttaagcaactcaacttctgtggctacttgttacagctatttcaaggagctgcccttggaagccttcatttttatgaggtgtaagaaaaaccatgactcaggtaaatctgtcaacattttcccatagaaagtttatctttagaggctcctcccaccgggatcctctccatctgtccacagcctactgagtaacccaccgactattgcgttctctgccccacgttcattcgttccttttccctattcaaacttcaactagctctaatggcagaaaagtgatctgatatataacgtcacctaaaaggacaaatgactgacagtagctcgatttagtttccattttaaaggaggatgtttggagtccacaatgccttaatggaaaggaattgggctaattgtgtaattctttcaacaaggcaggccattggtgggaggcttttgggcaggggagcttcctggaatctgttaatgatataccccaaaggcaactcaactgactcatgaagttaactctgatggtgctgatgatgttactaagaagccctaagcctgtgctgcctaaagttcacagagttttatttaacatattcttttgagctaggcagagaagaaatgaccatctctcattaacagcaaggatactgaggactggagatcaccctcatttgcccaagtgtctcagctagtagctgatggaaacagcactaaatatatatatatataatttatttatttaaattatatatatatataatttatttatttaaattatatatatatatatatatttaatttcatcttgtgtgggcaaataaaggcagaatgtccaagacaaggttgtttaccttggctgttattggcaccttggaataatattaagctgtaaggggcttaagatcagctaaattacctgatctgtaagcctctctctttttctcatcccccatgtccaatcctccagcaactcctgcaggcttaacattcaaaataaacactttccaccattccactgctcccctccatctgaggccttacctctctcatgtagatggttatggcagcttcctgactgctctccttccttccacacttgcccatctacagttaattcttcacacaccagccagagggatcctgttcaaacctaaggcaggtcagggcggtcctttgcttggaaccttcagcagttcctccctgcaggcagagtcaaagcccagtctgcacctggctcctggctgccttgatggcctcagctccagttctctttgctccagtcagactgtctttccttttcctcaaacttgccacacaccttcctacctcagggcctttctactggctatttccgccctgccccttgagtcttccagatattcacataactggcctctttactttattcagacccctgatcaaatgtcatctcctcagagaagcccctccgccactatcactcttctagcctctcattgtgttttagctctccttatagcactttttacctaacacattatatatattttaaaacgcgttgtctcgttctcctttctagttggaagctccatgtcagttttgttttgttccctgctgtatcttcattgcctacaatagcacttggcacatacttgctgaataaatgaaactgagaaactcagagcaaactatttctttttagataaagcccacaaaaatgttttcttcctgttcagtttaaactatccagcacacaacatcagccttgtgattgtctttttttctgatgctctgacctctgagtgacctttaacaagtaactttgttagaactcactttacccagctatagaatgggaataaaaatataacctaccttccttctcagacactttaatgaagcaaagtcttctttgttctttgaggaaaggagccaggcagatgaaaattcctgttattaaggtacaactaaagcccgaggagggtaggagctgcattttgttcctccccattctcgcacagagaaggcactcattaagtgcttatcaaagttaatatctgtggcacacaaactgcacctgcctctgcagcagtcgtcacagaagctggcccctttcctgggctaactgctctgagagcaccagaatgaaatctgacttagatatgacgcagattccttttttcagaagaagccagctacacaactcttgatgaacaaatagctaccaacgatgagcacaaaccagagaatttcagaagtgaagaaaatttcagatcagaagatcctgtctctcgggtataacttttttttttttggagagaaatacagtgactctcctaattatggtgaatttcctagttcagctcagagccactgattcagcagatattcccccaggcagatcctaatggaaaccaacatgtgaggtctgatgctgggaattttatcatgctcaacaaggatttgaaaactaaatgaatgcgtgcatattcacactaagcaattttcctccctgccttcaccactttcccttttttcttctcttaccctctttctgtttctattccttccccactcatgccccagtgcttccgttggacacatgcgcattttacggtcctgcagggcttgaaagatttctgaccttctaaggtccagtgatttggtatcagaagatctaagttttctccttctctctgccatttaaagaagcgtgttgcaatttccccagcagaagtgaaagtgattcgcctctactcaaatgtctgcataggcacaagaatgagggcgagagggagcaagagaagaggaagaggtaccttttgaatggggtgaaagcaaacccttacataacctgaccacacaataggaggaaatgaaaacttgggttcaagggcaattttgtcattggttattagtctgtgtcatcaagcaggtgccagaaaaacaaattttattttgattttaggcattcattttaacaactggattttcctaatttctcattcccaaggaggatctatgcaagaatgcacaatttatagttaatttggagatgaataaaatattaacataccttttgttccccctaaaacataatacctaaattagtgtgatgccttggttaccatcctacatatgtatttggattgtaaatgagctcagttttaagcacatttgtaacagtggaacaagtgaggcttgtattacatggccaaattgatattaatgatggtggcctcgagaacggattccatcccaagacatctgatctgcagacagttgagcattcacagcagttttgactttattgacttcattggccccagtcagaaggttttcatctagtgcattcagttaccctgatttctaattacaatagaatctttcaaatagatttgtttccagagagcttgcttgagatagattaaatggcagaagttgcaaaggatgtcattgttttacataaaagatctgtggaaattacgcctagaaacttgttgcctttttattttaaaagctgctatatacaaaataacagtcagggtcaaatagttaccactgtgacaacaatcatttatggtacgtttgcaattgttctaaaaagttaatatggaaaagttaccagaattaagtggtgatgttttacttaagaagtagaaaagatttacaattcattatggatgtaaaaagaaatggactctaagaaacttgttactgtagttgttgaaagaatattgtcaaagtgtttatccatattaagtggctccatagaacgtagttcctttagattttagtgttagcttctataaaactgctggtttgttttaatcttttggaaaccataggtgtttttttttaataccagtgatcatattttcctttgtgcttttgttggtaggaagctcagagcccaatttacaatctctaatgactcctattgaactttatatttgcacttcttttagtttcttttttttagggtgggaatagggttttattaatttttccctggatttatttgcttcacaatatttctcttcactttgattcaactgtttcttttctctttttctatgatatatgttcttaaaagctggcatgaagtgaaatggagcatatctggtctcaaagtgacaaatttaacacatccaaaatcatcaccctagtgtgactatttatcccatcttactatcgttttagaacaatgcatttagaatgctgtcctccttcttgaagttttaaaaatcatttaattcttctctgaattagtgtacactaacgtttacatcttaatcttttatattttgtttgtttttatcctttgcttcaaaagaaattaatgtgcactgtgaccttagtttccattagtcatcaacttggggactaacatgactgcctcactgtcagtgagtatctttttctgatagttccaggaggggtgattaatctcacctgattcatcatgttcttttactctgtctgcccagtgactatggccttgcatttccttgcatttatttctttaccatctaattcaacttaattatttattgtttgaccattttgcattctctttcttcctgtctcttgcacagaactcgccattccttctctgtttccattcagcctcctttgctggttcctcatctcccctacatcataatgctggagtgccttagggctaagtccttgggtctcttctcttacctgcaaatactcttaccttggttggtttgtttaacccaatggctttaaatcaaatttctacactgaagaccgaaatttatgtcagcaacttggatgtctcttccgaactccagactcacatacgcaacagcctactcatcatgtcc

SEQ ID NO: 140 - DNA, 67667 bp, Homo sapiens
acaggagcaggcctcaccggctgtcctgtggccagggtggtctctgcggccattcctgaagaagttggaagcaaggagatgaaggtgctgggtgtctctgttcctgttcctcctgggcaacagcaggaggtctccatcctctcccccaccccaccccacctccatgcatagccctagaaaccgggcactggactccttccacacatctcagagttatattattgtaacaaatcagtcaaaattccattttacagttaaatagtacagaagacagtttactgtacaagcaagttgtgcgttaaaaacaaacaccaagcaaacgatagtgcaaagcagtttccacccagctccatcctctcgccagctctgggatggttttacatcagatgagtgcagcaggtgtcacacctcagcatgacaatatgtcacaaaagattggtacccactactgacaggctcacagtaacactatatcaaaacgtcttcctttcctcgtgcttcctacatcagtgtgtttgcctagtacaactttaacgcagccttgtaaataaggacctacttttaccagcccaggctgtctgtacccactttgggccttacagactcagtacggctgccgtcactttttgtcaggggatgggggatggggtaggaagagcaatttatttactatccctgcctctccaggatcaggaagggttagtaatctgggatgagactacaaagtgctgggcactgggaacccaaaggtgcctcccacgctgacctgggaccagctataaccagagaacaggagggaagaaactacaaggacaatggattcatagctgcttcctaagaaggcatggagaggccccttgggtgcagggagtcagcaactattttgaggagatggagactgtttttccagtgaggacaggccaagagaaaccgcagcaggagggaatggaataggatcaccagaaggactgcctaacctgccagtgtgtctctggtgtatggttctggccgttgtgacaggttgggtggggacagtgctctcacagagacaaccaatgaagagcattttgtagggcagatttctgcatccacagaggccgaggcagaaagttaaaataccgcatgctgctagcctttatgagttcccttacgccttttctaagcctttctagggccagagaactctgatgtgagaatccatgcagcctggcccttgggcaagcgcccactttcccattttgcaaaattcaggggcaagacttcacctcggaacgcagtgcagctgagctgcggctggagagccctttacagtgcttctgtcctgccacgcacagccagtactccccacctctcacatcctgcccacctccgcccagcctcctggacagatgtcctagagccacagaggagagatgcccagcgtctcatcagcgtttccctcgtcctcccaggggagcctgtggtgcaggctggtgggatgctgcctgatggggagtgtagccccttgagaaagtattgagaccctaataaccccacaccctcaggaggcagctgggggtccgcgggggggagagggggcggggatgttgcttataatcacagagctatcataatcacggaactatacctgtaagagaccttgtgtttgaaaacgttagattaagcttctttttctaaaatcagttttaaaaactgttttgttttttttttgtttttttgttttttttttttttttgctcaggactatttgctttcagagcacaaaacaggttacagacaggtgtgtgccaggagtcgcaagatttggctggatcctcccaggaggcttgggggatggggcacagcttggctggacccaggggggacagggacattgatgtctgacccaaaatgatccctcacctcaatgccttctgctaggacctatctatctggccctcctgttctctccacaaatggaattatgagaccacctaggggaaaggggacctcctatcccccctcccccgccctgccaagagaacagagagtggatgcgttgagctggtaaagtgcatggaggagccggtctgtaggtgctttcctgggtttaagaacctgatgccatagactcatcttctctggggcctgggacccgtgcggctgggggaaagccaacagttaggaacggaggggaagctgggctggggggactggcttggatgtgttctcaaaccatctctgccagcagcgtgctgggtcctgccccatctgtacaatgaggggaaccccgctcgagggtggtgggggtgggggacactttccagttctgactcaaatctgtgtaaatgcagagggggctggacccaggggatgcaggggctccaacgaaggtgcaggggtcgggaggtttcccagggcctgaggcttatcctgtgggccaatgctgcctctctctggaagagagatggcctctgtcccaggagacatgggtcccatgcagcactgggcatagctggagacagtgaggtccttccgggggggtggcaggaggctgattccccacagaagtatgggatgagacggccaggatctgggccgggggcagtatcccgggccggggtgggggtggtaacctatgcctctgtacaaggatgtggctgcacagatgcagccagaggctcccaccagctgggaccaccctgggaccgagaccaccctggagcgcaggtcccattcccgcccggagcctcggagccggcccatcactggtcttgaaggttgttagggtccccgcctccagcgggaggagtccaccagggcggtcagtagggccgccacacggcctcatccatgcggcctggcgtgctcagggccgtgggtgagttgctgtggctgccgtcggcctccacgccatcactctggccgcccaggctggggttcatgaggttgccggcggcgacagaggcagcgctgctggtgcaagaggccagcatgcgggtaggtgagcggtcgcccccactgctgctgccggccaccatggagaactggtaggagccagaggatgtcccgtagtagaggtggtagggggacgggttggcctggaagggcccgctctggttctgcggggcccccgggtagggtggcgggaggtaggtatggtggaagcggctggtggccggcatgcccgccacgctgaggctgctgatgctcgtgcccgagggcgtggcgctgtaggggaaggcagctgacatggccccgggataatgcatcctggggtctgggaagcggctctccgtgagggttggcagcgtggggaaggagcggtcaaactggcgggggtcggagaatgggttcagttccgaggtgcctggaggacagcagggaagaggtcagttccagctcgagacaaccccaggagggcttcctgaagaatgaccttgggctctggttcccaaggcccatctgggggacccctagttctagacctggctctcctcttcctgccctaggctgcccggggcctcccccgccaggactccgaacacagacctgccgggaagctggttggagcgtgccccgggccaagaggggccatgggagcccccccacagcagcaacagaacagaggagggggtctattcttctttttaaatcctccttcccagcctcgcagaggagaggcctaggatgcggtggtggggctgagggcagagtcagctcaggcctcccagcagccctgcccaggcaggttcctctccccaccggcccatgttaacagctgggaaggccgtggatgtgtaaagggctccaatgaccgtgtgagactgggagttggaacccgcttttgaagacaagaaaatggaggcagagagagagcaagactgagtctctgtggcagagaaaggactggttctcatcacaaggcctctgctggggacacacgtgcctctcctgcccaggtgcagcacgcggaggttctgtgcgctcacacctgggttgtgggcactgagttcacaggagctctggcctccacctcaccctgggcctgtgtctctggagccgactcgtggccacacagtgactggatgccaccctaacctgccttggcagcaaagtgagacagcagtcagacaaacttggggacccagaccccaacctggtcacagtgtccagcccagactctgcccctgctcccccaggaatgtggcttctcaatgggctccaaggcaagggtgttccatcctctgtccccaacttttgtcatcacagacccccaaaacctcagcattcaaaggggctcagggattgagtctaacacccttgatggggaaactgaggcccagacagggtgaggcacttccctcagggtcacacagcacattggacctggcacacaatcctagggcctctggtcctgagccccaacacgtacttgagagggagctgtcccgtctttgaggcagcacaggatcaaggcttactgtgtggcttctggagccggacagttatcctggtttggacacttactagctttgtgtccttgggcaagtcacttaacctctctgcgcatcagtttccccatataaaacatgagacgataacagttcatcaggattcagttaattcacatcgagtacttagaatggcactgggcacagagcaggggtccatgaggctttgcaaggccactgtggctgtggtgtctcttactctgggtacccaggagaactggctcattcagggccctgccaagttgaggccctggtgcagggcctcccttctactctggcagccgggggaggtggatgagcccccagcagtggtccagaggtgcagtctgtccagcccagcaacccctctgtgtcacccaccaaaggataagggccggtgctagccggagtgggctctgcctgccacgccgaggcttggctgaggacggagagctatgagcctgaggtgtgtgtgacttcggctgggacttggaacttctcggggctttggggtcttcccaagtcagctggggtatgtttccctcagcagcgtactctggccctgggcgtggatccgaacggagtgatgctcctggcttaaggtaagaagatgtggggacagcagtctgggtggcgggggccttctgggacatctgggatgttccctagtaggtcacttggctgtcccggccccttgaggccgagagcctccgaggcacctggctgccagttttcatctggggagcccctcggggggagaggtcctgttgcaggtgctgggcacgtcagcacagctgagatgggtggggtggaagtgggtgctggccgcctgatgggaaccccattctcaagacgaaggaaacaaatggggaccgcaggatacaacggcaggactgtgcccctcagagctcacgcgggctgcagggcgctgggctgggcctccctggacctgccaccatcccctccagcctctttcctcagggccaccacccctcctccggggtggtgggggaagtacctgccctcagcactccctcagaccccccagcagcttccttggagctcctgtacccccaccctgcggcctcgcagccccaggaaacccgagctgcccggggcactgtcgagtggccaatcccaacagtggaaagaaatgtttattttcttctccagattgtccgggctgctgcatggtggctgaatgagccctttcagctgtgagaagcccccattgtgggcggctgcggctgggggctggggctggggtatgggaggtgctggggtctctgcactgcttgccagtgaccaatattggagggtcaaagcacttaacaggcaccgagggaagtggtggtggggtgtcccaagggggatccccaggagggagtccgagggcagagggaggagggcctgtgagagtgacttcccaagcctaggtctgccagcaacccctctttgtcagggacctccttctccccacttcacagatgagaaaactgaggctgagtttaagtgacttgtctaagatcatacagccaatgcctggcagagcctgaattcctagcctggtccagctgactgcagagttcatgctcgccctgtcctggtcatccgaggccctttctctcacccaaaggggatgggcctgaggatggagatgcctggctgcctgtggcccagtgctgtggggggctagcgagggactgggccaggcctcaggagggagcaggcagagaagcagaagtcagccactgccccacacaggctgggctcctttcctcccagcccaggatggaagcagcagctgtgcctgccgtggggccaggcattgattcccaagctgtgcccacccagcagtggatgggcagatgtgggctctccttccatgggggctggtggacaggaagccactgttcaccccacctcctggattctggctcccccgctgagccccgatcccctggcctggctctgtccatggcagagaaaggctggctctcaggctactgcacctcgacagatgctggcccatgggtagcagaagcagaggcagctacgcggcaggggtgggcgtgagcacagcgtgcagggctccttccgctacctcttgagagcagacctccaactcctgggctcgagagctgagagtctcaaatgcactagctcctgggctcagagaggctgggcctggggcttctcccaaccttggcgtctcagcaggaccaaggccaaaagtcctgagcccaggccagaaggggaggggtcctctcttcacactgaaggcctgcatccagcccctggctgcagcactatgcctggaacaatgtcagtagagagacccagtcggcccccacctcagcgtggcaccggaaaagggggtggggcaggcagaccggttggcagccctgttccaggcccctttatctgtcccctcagaagtacagaaagttcttgggagcaggtactgtggagactgtggacctggtcacagatgggctgtgtgacccgagggtggctctgaacctcttaggcctctcaattcattcatctgccaaggggttctaaccaggctctggggaattgagaaagaatgggcacagtccgtgacggcagccagctgcctgcctctgtccacccggccaccaagcacccttggcaccccacttagcccaagggccggctgtgcacacagcctcccatgtccccagctcactgactgagagaacagaggagagatgcagccggcagccgtttagtgagcggctactatgcgccaggcacctcgatactccagaagacctgcctgaggcctggctgcaactgtgcttgctgtatccgtctaggcagtggagatggagaccccagctcggtcttcccttccacctcagctcctcctgtttgggaggatgctctgggcagggtgggagacctttcccaggaatgctatgtgcctctctagggttggaatgtcacttaacagtgtgcaaagtttgtgtgagtacagtaatgtcatttgaatgtcatcccagccctgggtggaggcatccgccccaatccactttcagatgaaaaatcgcaggctgtggggcaggggtggggaaactgtacatggcaggggcgagtctgtcacggctccttggacaagtcatgccccaattttaataggggcactatggggttaaccccatttccccaggcacagtgaactcctggtatgcagatccctggggccaggcaccaggcatgtgtcagtaatgtcagtgtttgctgagtgaacgaatgatggctagcacacagaaagcccacaggaaccgtctgcaggtgccaatgagcaccagcagctcctctacaaaacaagggggtgcagtgactgatcttcggacaggcttttggtctggggcagattggaccacatcgaggccctccacccccacctcaccccgctgcagcccctccctccgtgccgtaccttggattggggtctggggctggctgctgaagtggcttgtggtgctgagtgagcctcgggggctgggtgtgctcggtgtcacccgcatgcgcagccgttccaggtccccaaagcggtcagggaacggcttggtctggtcctccagcttctgccggtgccctgcagagcacaggaagcccatcagccgttgcttccccagagtctcagtggagacagaaatgcctcactctgctgggaagttcttcctgaggtctgaccttaggcctctgctgggagaaccctgaggtcaccgccagcctcttcacagaggttttcaaaagactttctgaacagagaatggtcgttatgtgccaccccacatatctaaacctctacaacacacggtgatccaaacctctacaacacgcggtgatctaaacctctacaacacgcggtgatctaaacctctacaacacgcggtgatctaaacctctacaacacactgtgatgtaaacctctacaacacgcggtgatctaaacctctacaacacacggtgatccaaacctctacaacacacggtgatctaaacctctacaacacacggtgatctaaacctctacaacacactgtgatgtaaacctctacaacacgcggtgatctaaacctctacaacacactgtgatgtaaacctctacaacacgcggtgatctaaacctcaaccacacgcggtgatctaaacctctacaacacgcggtgatctaaacctctacaacacgcggtgatccgaacctcaaccacacgcggtgatccgaacctctacgacacacggtgatccgaacctctacgacacgcggtgatccgaacctctacgacacgcggtgatccaaacctctatgacacgcggtgatccgaacctctacgacacgcggtgatccgaagctctacgacacgcggtgatccgaacctctacgacacgcggtgatctgaacctctatgacacgcggtgatctgaacctctacgacacgcggtgatccaaacctctacgacatgtggtgatccaaacctctacgacacacggtgatccaaacctctacaacacactgtttggcagaagaggaaactgagggccaggtgcagtggcttacgcctataatctcagcactttgggagactgagatgggaggatcagttgaacccaggagtttgagatcagcctgggcaactatcgagacccctgtctgtacaaaaattaaaaaaaaaaaagaaaaaagaaaaacttagccaggtggggtggcacaagcctgtagtcccagctactgggatgactgaggcaggaggatcacttgagcccaggaggtggaggctgcagtgagctgattgtaccactgcatcccagtctgggcaacggaacaaggaccctagatctaaaaaaaggaaactgaggcaacagacatgagaaagtggctcatgcccccaagggaggcagggagataacccaggagcactgccaccctctgcctcccagcatcccagcctgccttgcacactgtctcccatgtctacaagaacaatgggaggtggccccaggaggggactgcaggcttttccagccctaagtcactctgggatccccagaacatgccttcttctctctgggcctcaggcagaaaaataactccaccaggatgctgggcagaggtgtagggggcttgcatgagggactagacagccatctctgcctggaagctggggtcaggggacgagatgtcacacctggagaaaactgccagcattttccactccctatctgccagagcccacacaggaagaatcccagcctcacatccgaggactcagaggtgctgggagggtcaaggtggccaggctcccaccctcctgcggcctgctgaggccgagggacacttctggagtgatatcaagcttgcagggacctcccccgccacacacacttttttaattactaattttacatttcacaagcaacacgtgaatatttacaaaaataaaagcattacagataaggctctgtccaccgctctaagctcctctccagagtccccaccgtgaccagtttctttccagacatttttcatcttccatgaatggaaaacgcaaagtaggcttctcatggaactctcttgaacagcctcagtccgggtgtgtcattctgtaacttgctttcttagtagcacaccttggagctcaaactcagtttccctatctgcaaaatggggacagtaatccagccccacagaaatgacggagttcccataaaaccctggggatcctccctgctacggaagggattcaacaagcatggcgagaatgacgctgctctccctctttcctgctggccactggaggcacagttcactccgcagtcctctccacccacatttcagtccttctcaagcttcccctttagttcccttacatgcaacactcccgggaacgtccctgttcgcaccccctagtggctgcagcttctccagggctgacccgaggaaaggacggctcccttggaggactgtgcactccagggttcggctgatcaaccctaacacggtcacggccattctacctcacgtgacttggtgggaggctgccagtcaggcagggtggccaggccctcttttacaagtaagagaactgcaactgcggagaggcgaggaagcttgttggaggccacacgccgaacaaggggtgggatttcctggacctgggaccctttagaaaagatggaggctaggcatggtggctacgcctgtaatcccagcgctttgggaagccgaggcgggcggatcacctgagtgaggtcaggagtttgaaaccagcctgaccaatatggtgaaaccccgtctctactaaaagtacaaaaattagccgggcgtggtggcgggcgcctatgatcccaactacttgggaggctgaggcaggagaatcgcttgaacccgggaggcggaggttgcagtgagccaagatcacaccactgcactccagcctaggtgacagagcaagattccatctcaaaaaaaaaaaaaaaaaaaaatgtgggagggggtaagggggaggagaaggtttgcctaaggccttgggtctagaatgacatgtgcgttttctagtttggcagagggagaagaggcaagatgtaggtgggaggtaaaacagaactcactgcgcttcttggggcctgaacaagtgattgctggggactcgaaaagtgggaaaagcctgtcgaccactgtagggcatgaggggacagagcccgaggcctcgcatgggcctgatttctgattttcagaatgggaacgcaatggattctggtacttgtaggcccccaagctccctacgcatccctgttggaagctcaaacaggtatctgggagcctcagaaagaaagcagggggcctgggagccacaggggctcagccagtcaccaagaaccagggagccccaccttctcctccaatgaggccccagaccaggaatccatgggacacttggtggcaggaataagaccatttggtctctggccaggcccccactgctgcctcccagggcccttggcaacaaaggggaaaacatgggctgggggcgagtttagctggagctggggctgcaaactcagatgcccatggggatggggcaagtcacgtgaacgaggcaagtgggatgggtggggcctggagcggatggggaggagatgccttgtggaaagcacctgactgctaccctgaggagggcaggcccagtacggccagagcttccaattccagaccgagtcctcagccctaacaggccttggaggaaatgttgtccttgctcctgaggccactggaaatggcagggagatgtggatgagctgggggacaagtgagcagaagaatcttaacaggcatgaagcctgccgggtggacgtggggaccacagactgatccgacaacagcctgagtgcaaaggatctgggtgttttagtcagccacaagcttgaagggagccaatagggctggtgcaaaacctcaggccttgttactttcgtcacaggagaataaagtcccctgtttctgagtcacaccatgtacaaagagtgtttacagttactcctgcggcctggcggaagagggcggggttgacagccagcctgggttcgaggacgggtcctgtcacttgcagtctggtggcctcactcaagtcacactcctttcccccaccccgagctgcggtgtccccatcacactgtctttgtgggttgaggtgctggcctaaggtgtggacactttccagtcacgtgggtcaccaccatcatgaccatcgcttttatctctgctcatgcccaaaggaagcagaactatcatccccatgctggagaccggggtgtggaggccaggatgctgaagtcgtgtgaggaacacagagcctgagcagcaaggcaggattcacacccggatcccccgactccaagcccagggctcttttcctgacactttcccttttgttcccattgtttagacggggccaccgaggcttcaccatgagaccgacgctgagcgcctgttccgggacccaggctgtgggtcaggtaatctgaccccggaacccacgctcccaccacatgctcccttgccctccgtagggcagacttcccggaggaggggagtccaacagcacttcggaaatagcttccttgttactgtggaacgctggagccactgccagggaggggagaggggagccaaggcggccccacgtggccagggcgccagagagtctcagagccacagggccagggctctcacactgggaataggacagaagttccagtgcctgaggaaagaagatggtcttcagaaaaagcctctttcattcggttacccagagcaagagctgcgtggggagctctggctctaacccactccgtcaccttgggcccagtcctgctacgcctcagtttcccctctgcacagtctgctcactgaggccccttccttttgaaagtccctgatttaaggtagcaaagatcagccgctggtcagaggggccccagaaagaaaagaaggcagggctgctggccccagggcccacccactaccacttcttcctgctgctgctgttcccagtatttcttgaatattctctgccccccactcttcagagcctcagctcaggacagcctctgccagcaatgctttctgtcctgtgaagcccagtccaggagcccctcctccaggaagccccccttctcccacagtagatccccatcacacctctgcaggctagggctgtcctttaaagcagtcgccagcaggagtggaaatcatcaaaacggcagcagatgcttgctgggtgcttcctccacggcagcgtctaagcagctgacaagcaccatcttgtttcgcctggcagcatccccttgagtaatgtctgccaccatcctatcatatgggtgaaaaaactgaggctctggacagccagtgagctcaaggtcaagcagaagacacacagccacctgctctccctagagcctgtgaaaacacatctattgtggcggaagagggcggggttcacagccagcctgggttcgatacatcaatagatgtatcgggactccacaatagatgttagggccccgtccagccccaggcccagagctgctatctgcaggcccaggaggataggacttgggagaggaagatgagaaggtctcagtggactccaccaggggcccttccctgctctgaagctcagggttgagagtgcaatttccaatcataccctgctctagaccaccaagtcactctctgcctctgggccacagtttccacatctgtaaagtggttatcatactgtctaacccctgagggtgccgatgagctggaggacaggccacatgcttttaaaagcagaggactgagatggctggggaaagccccgcgttggccctcagggcctgtcctggctgctgtcagcctccagctgctgggctcagatcagacagctcctccagcatggcctggattagtgtctatgaccctcacttatgggagggcagatcccagcctgcccctcccaagggcccagtggccccaagctcataccaggcagctctcacccaccagtggtcactgtcttgggcaagccactcttgccttctgggcctcagctgtcttatctgcaaaatggggatcacacctctaacccccgagggtcaggaaaggtttcaagaattacacagcccaccaggccttggcctttgaggaaggtgttctgggttcccattctgacttggccatctgctcctaggcaaacagctcctctctgatgcgtctgtgcagtgggggtgacccacctcacaggcatatgataaaggccaaagtgggagcaggaatgctgggccccagccagtctggggactcaccagggtcacgcagtgtgggagctagaggaccagggctggattctgggttggcagctcctttaccactgtccccagggaatccttccccaccaccagcctggccagcctggggtcctacccccgccaggtacctgatgcttctgggggaaccaagagaccatcagggttacccccttgcctccatgcaggcccaacacaagcccctgtcataggagtggcaaccattttagcaggcatccatgatgtgccgggcactgtgcaaggggggccatgcatgtcgtctccaagggtcatatccctctgacaggctgtgactatcacccccgttttacagatggaaaagtggaggcacacggtcaaggtcacacggtgtgtggcacccctgagattcaaacctggaaaggtcacacatggagctcagctgctaaggtcatcgcttcccaagacctccatgagagaagagctgggtcacctggccgtaaggtccagctggcaagaggccagctcagtgttcagcctcttgggaaaagcagagtcgggcagggccacaggaacagcatcgtctgctggggacagtgtgggctccaatgaccaggcccgtcacccatctgaagccactcggcagccttcttggccgcctggtgcggctgtgacccagacacagcagccactgtctacccagcagcagggtggggcgccgggcccgaggccggctctgcggcctgtcaggagatttacacccgactcttaacagcctcgcggaatcgcaggcgggtgccgggcctggggtggtctgctgtgaatcggccccctgtgagcagatgaaagccgggtcggtggctgggcagggaaacgggctggccgggggccagcgggcagggaggcgagcggttccctcccagggctgcaagtggggcttccagaggcctggggttgattaggagaacccaggaggtctgtggttaaccccttccctcctgctgggcagactccgctagccctgcccctagcgcaggagacactcctgggggttgtggggatcttgggagccagggacctggagcagctgcctctcctcagcccaggaagaaactacagaaactctaaggccttcaaaggcccaactgcgggctcagggtcacttctcctgcccacgccaaaccctcggcagccacactctgctggctgctcacttcaggcccctgctcaaaggtcacctcttcaggaggcctccccgccccatcccttgttccatcccttgcacgctccactccttctcccagctttgtttttcttcataggacttcctactacccgaaatgacattaatgaatcatttgcttattcatcaacgatttatggagcagctgtgaagggctcctgcccacattctcagggtctagctataccagggcctggcaaaccagagcaaagaactctgcccttgtagagcataaacaacagggggccgggtgcggtggctcacgcctgtagtcccagcactttgggaggctgaggtgggcggatcacttgaggtcgggagttcaagactagcctggccaacatggtgaaaccctgtctctattaaaaatacaaaaattagctgggtgtggtggcgtgtgcctgtaatcccagctcctagggaggctgaggcaagagaatctcctgaacctgggaggcggaggttgctgtgagccgagatcttgccactgcactccagcctgggcaacagagcaagactccatctcaaaaaacaaaacaaaacaaaatgggagaaatgaataacaaatgaaacaaactatcggactagatagcaccttagaaggtggtagtggtaagtgctcggggtaaccttaaagccaggaaggaaaagggggagaggtgaggaaggctgtgtgtgtgccacttgaaacaggcgggctgctgagaagtgcagaggctttagggtgtgaaggagtgtgccatgcatctgggggtgtccggggaggagtgttccagatagaaaaaagagcagtgcaaaggcccccgaggcaggagtgtccctggcaagttcaaagaccagccaggataccagggtggccagagcaggatgtgggagggagggcagggggtaacgggcacaggctaggggggcgtgagggcctttcccccaccgtggtccatgccagacttgccaggtgtcaccgcccctcctgctgggatcctggacctggctcagcaacctgcttcttaaccagcccccagtgactctgagggacaccagcactgagaacctcagaaaccgaggccacacaggcaggaagccaccaagccagccttcaaacccagctggccacctggctgcaggccgggcacgctctgcagggcaccagaggggaacgacccggccacagaacccacagccggcctcagggatctacagattcccagtccttggctcccaggaccagcccctactcccacttcaccccacagcgggctcagatttcagagggtcggaggtggcaaaacaggaaaaaagccgggaaaggaagtccaggagcacaaaaggcctgtaacaacctgtgaaggttgtgggggcacttcctggggccaggccccggtaaactcagtcaaccttcacagcgactcccctaggcagacaccaataccatccatttgacagctgagcacactgaggtgaaaaggcccttccaagtggccctcacttcccgcagcccccgggtcggagcccccagggtgtgctgacagtcaccttgggcaaaaggttttgcgccctggcctctatcctctcctggggttgcccaagagatcagttactggggactttgcacagggcctgacgcaagggagggggttgctcagtgaccaggagccgctgagctggtcccttcactcttacagatggggacgctgaggacccgaaaggccaaggatttgtccagggccaaagacaaaggagtggggctgcaacccagggtatggggggggacctgatctcagggccaggatatgccagggacaggaacaggcaggtcctaaggatgggggacctagtagactgccccccgactccatctctgctctgttctgtaaataaaaccactgatccagccgctgccggggcccagagagggaggtcacctgtctcaggtggtgcagcaagcctggcttctgacgccgtgggtctccaggcccagcctctgtccctccctcttgttgcctcgtcctgagccacgcatttaccttccagctcaccccagaaggggccatctcaggtctgggagacccaggcagggaagagcaggcaggggattctgctggaatctcccacaggcagggctgagtctccatgctcatccaggggtcccagcagggcagagtgggcggctctggggtgggctgggctgagcatggagggctctcagaggggccaaccttgcccggtcccttggatcttcccaccaagcgtcaagaccccgtcccgtgcctccctctttctggagtggctcccctctttctggagtggcttctgagtgccgcatccccacccagagcccaactgaggctcctgtccatgctgaccctgcccctggagacatagggcagggctgccacctccttcaatggagacttgatacctgcacctctattaccaaggcagccacccagctgctgcccatgagagagctcaccgttgactaatggtggtggtgggagtgcaggaagggggctgggtactgaggacgacaaaacgctgcggacccagtgactcatgggacccctctgtgctacggccacgtgctgtccacatgtcgcccctgatctccaggtccgcagggtgggtggcatcatcacacttcatggaggagggagctgaggcccagagaggtcagtgacttgccctaggtcacactgcagataacagccctggctaaagtgacggatcccttgctaacccccaccgctaagtgctttctatagattaagccactgtttcctcgcaatagcatcatgaggtagctgcttgtgcgaatatcatttttcagttcaggaaactgaggcacggagatgactagcccaaggacccacagccaggaaggctggcttggaaactgctctctacaccatggtggtctatggctcatgagggcttcccagccatcaccaccttgagactcctggagtcactgatccagttctcagatgacaaaactgaggccacaaagaagacatgacttgcctagggtcatgaagcccaaggccaagggcatgggctggtctatgtctgatctcagcaggagggaaccagcaggagtgtggccagggcaagtgctggctgggagctgacggtgcaggcctgaggatgcgtgccggggctcagggctggcagaggtgaccctgagagccctggagggaaactcttccagggctgctggactcagctccaagcctttcccaagtggccagatgctgggatgggcccaggaattggatgatggggtgtcaggcccagctgactcccaagaagggaggggccagcccagggctaggcctcctgccccaggcctcctgccccaggcctgctcagcctagaatcttgcctctgggaagactgaagcctggggcgccttcctgctccttgcacagcattaggtcctattcaggtacccaactccctcaggcctggattctctcctcactggaacttgggtgacccctctggctctgctgtcatcaagatcccattcaatagtgactgctaaaaggtcttctaaactacaaagggtcacatttctgagaaagagaggggtgggccaaccttcagtgcaccaagctgaaaatgccttggggaggtgggatggagctcaggaagctggctggctctatttcattcattcattcattcattcagtcagtcagtcagtcagtcattcattcattctgtggacacagagcctcagcctaccctcccacttccccagccttaatctgaccttcagcaagcagagagaattaaacacaaactcgctttgatggaccagaactccctgctcatagggtctgggtgcccggactctgggtgacctgagcaagtcacatgctaagattcaaagactcagtttccaaggaagaggcctggcctcacagccagaccagcccctgacttttgatcactcctgccctccatgcatccctcagccacccgcagagaagctgggggcagagtaaagcaagcctggctcaacctccacccagaaacacacaagcacccgacaaatgccatatctgaaagctttctccatccttttcctttccttgactccctcagtagtctccatggacagtcatctccactcccagcctcctcgctggcctcccacggtctcaggctaagcccagagggtttaggggtttgccagcaggcacgcagtgtgtgggggcacagagccaaggactgcaaccccccgaggagggctccatctgtctgacctagctgctgtccttcccgcactggaccctcctcccccgcgcaggggctcagggggctcggtggcacttacgtctgggctcccggggtccgtccacggtcaccttgatggctcggtggtaggtcgccacttgggtggggttggtgaacacagtgatggtcagggtgaaactcttccctggggagagtggggaatagaggcaggtggttggcacctggagcttccacaataccctgctctcccacctgtatctacccctggaagcccctaactgtcaagaaggggcactctgtcctctttgaacatgggcagaagatagggctctgggtgaagttcaagctcttgggcttggcattcaaggcccctgggggtctgacgccaactttgtcaaccccccgccccatgccgtgaccaccctggctcatgttcccctcttcttggcctttctgctgtctcttctattcagagacccacacgattttgtggtggggagcaggatgggtatattctattttctgaaagtaattggtgatctttgtagaaaaattcaagaacatacaaaatataaataaagaagaaaagacaccccccccccacggttccactagctggagatagacaccgttaccatttggtgttttccctttcagctctttttgtatgggtttgtatatttacacagtcgcagtggtactaaaatacagattttcatactgttttttttttcatttaacctcacatcagaagcactttcccacgtcattaaaactccataaacttcgtttttaatggctgcaaaatatttcaactcaaggaagcctcctcatcttttatttatctacctccttactctcgggtatttacatcgttgctaatttcttattgatgtgtgcagctggagctgaaaaaggactgatttgggagctgcagacatttcttctgtagacacaactgttatttccagaatgttctatttttagatagacatttggctccaaagtctccattcaaaattcctgagaggggaaaaaacttttaaaatactacttttttttttttttaccatttaaaataaaatgaaagtgaccttctgtttataaaaatctttgtctgcatctctgcttatttccttagaagagattccaagaagcggtgagtgatttcacggcagcagagggttgggacatattacgggcgcggatccctcttggagtgagatgactctccggagagatttagtcgtcaccctcgcgtgtgaggctgcgtcacaccccagggatgtgtctatcaagatggaagatcttttacacgctcttgattttgtttgcctttttttctattactagtgagaatgaaactttttatatgattattatccatcataatccaacacaaattactgcttcatgttcttttactttcctgtgaaggttttagtgccttttaaaaattgctatatattaagcttgttaatactttccatgctgtatttgtggccatcagtttccccgggcacaggcctgcacattttgccttcacacgctgggtggtttttcattttcacttctatttctcgttcttctatcgttttatgttcagacgggtttctccgtgtagaaagcagtttatgaagatttactttcgacagtcttctctctactttctacagtgaattctctgatgtgtctgggagtttgggggtctgggtaagagtcctcctctcaccctattctctattacgatccacagcctcatgctttatgagattggtggccgggagcgggggagatttgcggatcccccaagccagactttatccccctatccctgcctctggatcccacgtacaggcctgggaactccctgtgggtaggggccaatggtctcgcactctcacctgtaccccagggctggcacaggatggtcaaggagagaggctgcccaagcgcatccctctggtgtccccctgacacgcctccaaagtgagcaggtaggtttcaacagccccacgttgcaggtgggagatgaagctcagggtggagaccagtatctcacagttctctttgcatggccgggtacttgttagtcaactgatcaagtgaaaattctagccccagaggcaggagaatccggaacaaaattaaaccagccaggctgccaggagccatgccacaggacccaaggccctctgagacaccagggggaatttaaagctcaagacccactgagtgtcactccagctgggaaatgaggggcttctctggaagccttttcctaagccagtcggctgaggcagggatagaaattctgactgcacttgcccccggagccccaggtcagaacagacctggtctcccactctcaggtcacaggggccactttgtatgatttctggaagcagaagtgcagatggtctagggaagtgccaggcagatgcctcgggctccctgcccgacccctcctactgcctttcctcactctgaggtcatttctctgctggacctctttctcctccaaccagcccagcactctcctggggtccctgagcctctgaccctgccagcattgtccagcaccttcttggttatgacggggagtttaggcagacagcccagagccctaggggccagactggagacacggaggactaatgggtcccagtgccctgccacagggccccgggcccacagcagcatttgaaagcttactaaaaccctccttcaggtcgcccaccttctcagtcaggccttccctggtcactttatctgaagtaggcatttttaattttaattaatttttttgagacaaggtcttgctctgtcacccaggttggagtgcagtggcatgatcatagctcactgcagcctggacctcccgggctcaagtgatcctcctgtctcagcctcctgagtagctgggacaacaggtgagcgccaccatgcccggctatttctttttttcccttccttcttttccttccctcccttccttccttcctttcctttcttttctttctttcctttctttcttttttttttttttcaagcttttactatgtgcccaggctggtcttgaactcctgggctcaagtgatcctcctgccttggcctcccaaagtgttgggattacagtcgtaaaccactacacctggaaggcatttttaacttggctccgtagagttgaatgagcctgagaactagggtaggaaaaaattacaattgtattgtccctaacctctaactgaaatttagcatcactctcaagtacgagcgtaggcaacaaaccacagaggtattatcagccgtacctgtgaccttgtcaccaacagacgtcacagatacttacatatcacattacagttgctgcagattgctctaaatatcttttatgctcatcacaacttcaaaaccatggttgtcattaggcccaatgctagatcttatttaatacattgaataaagcagcacatttaccacaatttttaaagtattttgctatgttttaatagaaatggtttctattgtaatactttgtatttgattttataccttaaaaatatcattgttctgagaaaggtgtgcgggcttcaccagctatcagaggggcccacagggcaaaaaaaaaaaaaaaaaaaaaaaaagcgctaagcagctcaacctgaagtatcacaggccctaccactccctttctctattccctgcacctgctggaattttctcacaatgcatatgcttttaataatccatctactcattttgtctccttctactagattataacctccccaggggcccaagtttttgtcttgttcatgcagtgtctccagcccctaggacggcatccggcacagagtaggtgctcaacaacatttgttaaataaattaagggcagagataatggctcccattttgcacacaggtactaacgtcccgctcctgagaagtgagaagcccccacccataccaggtagcaaaccacatgccacccctgaggtcaccagcactcctcggccgcttccaccagcttccacgcctgtcaccacccctcccaggtacaaaggagaggagtgtggggcctaagaggaggagtgagagggaggggcaggagtcctggacctcgggagacagggagcctggggagcaggggtgggagaaagctgtctccctgagtgcccctcagctaccccggccctgcccagctctctctctgcctggcagtggcaaacccatccatccctctctctcagcctctagatataactctgtgcaggagtcccaggcaaacctgcaatccatcaggagcccaggaagtgtaaacccaggctctctgagggctggccctggttgcaggggagaagtcttggtctgggaaatgggtttcctttagggctccagaaactcctccaggacccatcatcaaccagccggggtggcagcagggcctcaggcaagtccttgagcattctctgcctgggttcctatgtgtataaggtccccgccccacccacaggagctgcatgggtggggggaggggacgtgtctcagtctcaggggacctcggggttttctcagcttcagccaagaagccattcatctctcccccaaccagcggttcccctcagcctgcaccggcacactgcaccccgaatctctgtcgacacacagttgctttttaaccagttgatcacagctcgagagctcatgtgcttttcattttcacttaggccagtggccgcctgctagaggggcatttttgggatttgtggtggcgtgtggtcaacatagtgttggggtggcactgccagcgttaggggtggggtgcgtgtatgtggtgggggatgccagcacccaacgctgcccagggtggtgaagattcaattcttcctgggagggaaaaacttgcttataaaagttctctggctggtcgcagtggctcatgcctgtaatcccaacactttgagaggctgaggcaggaggatcgcttgagtccaggagttcaagaccagcctgagcaacacagtgaacaacacccccatctctacaacaaataattttaaaaaatcagctgagcatggtggcgcatgcctatagtcccagctattgaggtgggaggactgcttgagaccaggaggttgagactgcagtgatcgcaccactgcaccctggcctgggcgacagagcgagaccttgtcccaaaaaaaagtaaaagaaaaaaaaattatctgagtcatgaacctaactcagttttacataaaacaagggttttttttgtacttttaatatctactgaattttccagaaggaaagacagttctttttttttttttaattttgttcagcgctttgccaacaggtgttgacaacttcagaaagtcatggtattggcagcaaggccaggttcagattgagccctgccaccctgcctgttccctctgctgtgggcttctgcatggagggcattcgtccacctcatggagtcctgtggccccaacgtttacatattcaaatcagtgttttattataaattactttccctttttttctccatcatagctatggaataacatagtttgcaactgcatgtaaataggtaggtttcattatttatacatttcaacgtagaatagtaaggcttgatataaaatatgtattgtaagaaaggctcctcgtgtctggcagggcagggacctcagccctaatcactgcaggagacagcaatgacctggttttcctcccttccttttcttggttcacaccttcagccctgttgttaagagctctgtggtgttactgggtgcgtgtctttcatggaaagccatcttcctggaattcagacagaatgtagaactaaaaattgaggcaacaagcagaggtttccatcagacttcttagttctggcagaagtcaagagacccaggcaagggttctgggtcccaacccccagtcttaactcccaaagtgtcccatctcctaaagtggcccagattgtcactgtcaaccactgactgttctctcaggtgggaatttcccagtcagcaggatgggcactgcagatgtgtgtctgcatgccagcggacccggcaccctccttcctccctgccaaccgcctccacctctcccactcagcagttcacaccttctgggtttcccccacccccgcccaaaccacacagtaatcagagaatcagtggctgtcaccgctcaaagggacctcaaagtcctcctccagtcccaggcatttgaagtaacaaaatctctaacatgtatccagctctcaatatgcgccagctgatacacttgtgtcaatttccctaaccttcccaaaatctcatgaggtaggtaccattatcatccccatctcacagatgaggaaactgaggcacagagtggttaagtcatttgcccaatgtcatccagcaagtcattagcagagctgggactcaaacgcagggtggctgatactagaatgcaggctctcaaagacctcgagcctctgaaggctgaacgccttagccacagttcctcagacatcggaactcctcctcagatcacttcctgcctcccaggaccactgagactggttatggacctctgagaggagatggatgagagaatggtttataaactcagcctcttgcatctcccagagccacagtcccagcctcggccattcctgctacaaggacaagctcccaaccaacgccttggaaacccatttccctccctgcaggcctggggaggggggctcaaggtctgtgggcatgaaaacccctaaaaaaatcattctcagtgtgcagaatggccagacaaggtctcggtaactcagaaaatcgtcgtctcttctctttctctcgcttcccaggagagagagtgggaagggagaatcaagttcctgatgccttgctgggctcccagatcgacagcaccttctgcccgcctcgcaacaggcagcagctatagtgctcctgacacatacctgggctagcagacctggccactgccccgcagtcagcagagctcatcagccttgtctgccaccgaccaaggaccagtgactgtcctctcagggttgggattaagtcgcaaagggtttgagagattggggatgacaaaagggacttggagactaattaggagcagcaatgaaagcttaattcataaaagcaaacattttccatccatcaacctgcaaccagttaagggcaccgtttgaaagaaatctgtgtgtggggaagggagccaacaggaacaggaaatgtttgaaagaatgtaaactatttcagtttcataaaaagtaacaagtaaacagttattacatgcaaataatgtcctggttttaattaatgctgaaaagtcaaaatatggctgacatttgtatgtatacatcgaacggctggaaaggaaaaaatggtgcccagatgcctgtttcagagcggggctggcagctcagagggaactagaaccttgagaaggtcctgtttattggtgatgaaaagcacggttctgcttcagccacttcagcctgctgtggagttggggagcagagggaacccagcttacttcttaacaaagctagaggcgggcctggtgcttgggaagggcgactcccacttcagccacttctcgtaggcaggctggtcttaaagggccagtggaccctcaggcctccgttccacaggggcagggtttccaggactttcccatccaggagttaagtgatgatgggtttcaggtcccagaagcctcccattcaacagccccccacccccgtcccgccttccttctgctgctcaaggtcggtcagacaggcagggtggcacacccgccttgactctggggcaggagatggcagccttcgagctgtgctttccaacattcagctgcgttagcttccgttctagaccacctagggctcaaaggcgctgggaaactgggtctgggagaccacagctggagagacagcctcagagtgtgggggatattctgccccctatggagagagtggctggggtgcttgggccccacagatcagggacttgtcctgcaaccgccttgctgaaagacctataagctccctttttgagcttgttaatccaccatctcctgccagcattttttgtgagaccaggtgtgcttaaccgggaaagagggggtggcatgaacggtttcaggagttggtaaaccctagaaactgggagaaaattgtctttttctggcaagagaccataactttcctcacctcctcaaagcgatctgtaatatcctacaggattacaaattgctgtttttagacagagctgcatctggagacctgtttttcgggattctaaggcccctctttcaacctccttccctgctgcccctgccattgccaatgctgaaatggcgaggcctcccttccacttacctcgcccactgcggcccacgaagcgaaggtcgttgaacctggccacctggttcttcatgacggccgaggcattgcgcagctcagcggagtagttctcgtcattgcctgccatcacagtcaccaccgtaccatccggcacgtcccccaatgccaccacctgaagacacggggcggggggatgcagggggacagcttagaaaggaagagggtgaccagggaaaggaggggaggggctgggctgggcagctcccccaggtcccaggcacactgagtatttctccaatgcagggtggagaagaggcttaaaaacaataaagaccttcccccaaatatcacgaaaacaagaagatggaatctcgagcttccacaccaaaatcctagatcaactgcttacataaactgtgtcccaagaaatcatcctttcaatgaaatctaagccagagctgtgaatcagctcagtcactatgatgtggggtgcagttcccctgttgtcttcggctgcagcgaaagaggaatcaacatgctcctagcaacgaagtctccaaatgagaaagagtaacaacaataataacaacagggctgctacccccactcaatttatgcaagagctgtttagggcatgaaatttggccctgaaatgtggaccaggcccagtttattggcctctgcagagcctaaattcgttatgcagagaaaatgcagaatgcaaaactcactggtgttttgaaaaaggccaccagaaaacccctttaaagtgagagtggggcttttgataatggaaggatgcacctgccgggaattgcaggatgggggtggcgatgtccccctaaacaccatctcccccaaatcccccacccccaggagcacggagaggcggatgccttttgaaaaagaatcagactttaaacagagtcacaactatttaaacgtggccgccgcgtgcagggactggggatccatatggtaaaaatttcaaggagaaaatgtttgggatctgattaagaagaccagatttcctgtcaacatcctgtcttcttttaatttcaaagactccttttaagctccaagtgacagtaaaacctccgatctgacgattaaagtcacacgggcctcccgcccctcccggcgagatttcccccactggtattttaagatgtcacccgggagacctcaaagagccactcttcctttttttcccatttagagtcgtcttaatgggagcagggacggcctcagcttccagccacctcgggcagcaccacccccagccgccggcccttcctgccctgcccttttctcacggcagctgtgagaggtttaggggaaaaccgaggcgttttcgtttcatctcgctgcccccttaaaaaaatgaaaatgaaacagtcgcctactccctggcataaagaaaaaggtcctctaaatggctgggggctgccagggttaggggtcccccaatctcaactcgccattcgggacgcataatatccccgagcaaacgtctggagagcagtgccccgatcccggcctagcgccgtccggtaaaatttcggaagcccgagggtgtgagcaggaagcttttgcgaagcggcgcgggaggaggggtgctggaggcggagggtaggccctttcaccgttcgcaccccacccgcggtgtccttgcccctgtcccgggatcctcttctccgttacccgcagggctgtatctgagcgatccgggttaggggggcgcaaaaccccatccgcccatttccgcaccaacgtctctacgcaaggcgccccaaaacccaggtggagcggggcaaccccgttaaaagtcattcctgcagggcgcatccaaaacggaacgccgaggtcccggagccgagcgcgcagccagactgaaccgggtgcccgggtgtcgccgcggcgtctcgggcacctcccatccccactgctcccgaggctctggctcccgcagctcagacgcccggagccccagggccggcgccctcccgccccgggtcccgcactcaccttgaaggcgacgggcagcgtcttgttgcagcgccagtgcgagggcagcacggagcagaggaagttggggctgtcggtgcgcacgagctcgcctgcgtggtccgccagcacgtccaccatcgagcgcacctcgggccgggcgcgccctccgggccccacggccgcctgcgcgctcagcgcgccgctgttctcgcccatcttgccgccgccgccgccgcaggggaaggccggggagggaggtgtgaagcggcggctggtgcttgggtctacgggaatacgcataacagcggccgtcagggcgccgggcaggcggagacggcgcggcttcccccgggggcggccggcgcgggcgcctcctcggccgccgctgccgcgagaagcgggaaagcagaagcggcggggcccgggcctcagggcgcagggggcggcgcccggccactactcgccagggcccgcccgctgcgaggcctcgctggcccgacggccgcccgcagcctgcccggctagtcccgcatcctcggcgcgcggccccgcgtgcggccgcccctcgtggctgtcccggctgcctgggccgcggcggggcccgcgcggggctgtgccgctgccgccgcctcccgccccgaagctcgcccgcggccgccccgactccgcggccgcagccccagaacaaatcctccagaatcaagtggcggggccgcggccgcccgcgcggggttagtacccccggggcccgcggggcggggctggcggagcgacgcgtcgcacagccaatcggcggagcccccatcgcgggcacctcggtggcgttcgcggggaggaacggggcctgccggaggccgcccaacggggaggggcggaaggcgccaccccgcggaggaggccccagtgccacagcccagggcccccgagagctctgggagcccggggcaaatgctagaaatttgcttagaacgtccgggtcccacggaaggcgcccttgccgccctctctcgggtcgtagctccctgacgctggggcgcaaccccttcgctcctcctccccgctggccgcggccgggcttccccagctcttgctgcttcgggcctgtgacttctgcaaccccgggctgggggccgcggggtctcagggccggtgacgccgcactgggagccgccccaaagaggttactcacctccctcgtcccgcacattattctgacccaagagcctccaccccacacgggattttgcgcgtcgtccacgcccggccggcggcctttgctgctcccagccctgcgcggctttggtcccagcctcggtggcccctgtgccaaaccggggacaggcggaagggagtctcctagggaccctaagtagcctggggccaacaacccctttcctctctgctctcccctcaaaacaagtttcaggatcttgcaggcctcgcggcgtcgttcttcgttgtggcggcctgtggctctttgaaaaacacgacgaggcctgcaaaatgcgtttttctttttttcctttacgcatgtaaccacggtcctgcatcgtgaaacggtacgcgcgtcggtggcaaaagaaaaacagcagtggctgcaaagctaagggccctcgctttcagaggagagaattttctttctccatgcgggtggaaagtggcctctgcgggtccaaccccacttcttcttgggcccgtgcgctccggctgcgccgcagggaccgcggacagcttcgccaaggcactgcctgcccgcccggctccgggtccccgctcccactcccagccgcgtggcccaacctctcctgggcttcactgcaaatcaccccttcctctcccgcctcctaagtctgtcgagcagacctaggggccggctacagttgggagggcaacgggaaagatcaagccacaatcattccgaattatcgccccagacacctccctagactctggggaacgaacgcgtgctgagcctccccgccgctttggagacggggctagattttcgttgcctccggctctcgacaggtgcaaaacaatgaattccaagcctcggaagcaaagaagcttaggatccgacggtggccgcaagatctcatcatggatctgacccctgctcagcgcgcgccatttcgtcgttgccaaacgaaatcaagccccgcgtgcgctccaggggcgaaggactctggactcaccccgaccaccgggagagctggcccctacccacctcgggacctcacagcacgccctcaggccgtgtcgaaaggaaggacggcaaaggtcccttactgaaccttttaagagagcctgcgcctggcagttgtcgattgcggacccaggcccgcgcgccctcggacgcgctggcacgagcagcagaactagaggaaagcgagtgatccagcctgggcgctcccacctccgggaacgtctccgagaaggcgcagcgcgtcgtggccaggtagggccctggccgggggcgggcaacacgtgctgccctcgagcaggttgcgggaccatgacccgctgtttcaggtggtggtaaattccatttgtcgaatggtttcggtttgcaccgtgccctttgcttgttcctccgcctgatttctccctctccgcttacgatgggttcacagacaagtttccagagaatgagggactcttgtgggccctggcacctggcgcagggcccggcacggctccggctctccgtagggcgctggctccccgtgggcaccagatccaagggaccagggcggcggggggagggggggcgggtgcaggcccttgggtccccagaccaaggtcgcggggccgcctggcaggcacagtggcgggagccgccgctagttggcgcccgcgccctgccagccgcggaggtgcgggcccggccgggctacagatgcgcgccagctgcggccccgggtgcaggcgcggcgaccgcccccgaggagctgccctttccttgccatccatgcggccaggtctcagacaaaccgatggctttgtgtcaaaccaaggccgccttcctcacctctgataagatggacgccttctgtcttcgcgttttcaggcacccggggaagacccacagaacaggctagcttgttcccaatttccacctgcttcctccccatcccggaccgacaaaaattgtcgtctgtttgatgggagggagaactccgactcccccacctggggcatgcagacaccctcgcccttccccagttggcatggaccgtcgtcttttctccctcttccatcagatcgatggacaaacaggccagtttctccccagtggcccccacctaagagcaccctaagttgtccacagcagggctaggaagcagaaggtcaggacactcccctaccctaccttgacttagagctgggtaaacccagaacccatccccgggcaaatagagccagctcctttgccccaggaaggggattcgtctccctctggcatttaggagtgctctctaagtgcgttcttggcagtgagggtgccgccttcccagggcaggtgtgattcatgtggactctgtggcgcctgggcagggatccccaggtataccagacaaggggcaggtgtgccctgggaaaccgcctaagaggtccatgggctatggaaggagctggggtccacagtccctctgcctgagcgtgtctttttccctcacccacagcgctctagggaaagttgcctaaacctctctgagcctcatttctttcatttgtaaagtggggcactcatagtggcccttcatagaattgtgtgtaaagtgcttagcacaggcctggcacatggagggtgctccagcctccgggagccatcactgtcatgaaaaaataagacctctcaatccttgctgggggcctttgacccacccctcctctctctgggcctcacacttccatctgtgaaatgtccagttctcatattcaaagcttactaggactccaagccagtccatgctgtcctgatccctcaattcgcccacaggctgcctgggggaggtaaggactggctgtgacctacctccacgtggagtcagctcatagcggggtttccagcaaccatcacagggcggccagagctgggtctcgatgattgcctgtctgaccattcctctcagaacctcactttcgcccccagccggccgccctcctgtgggcagaccctttcctgagtagcaactgggcctcagcggacactgccagggaccccgtttccttcccaggaggcctctgttccccatatcccgaatcacacaggagcctagtccagcgaagagagcagaggactctcttctagaactgaaaatttctcccagcctggccctaaatcccctgtccagagggacccgtggtgaaacctatctcctgcccagtgccctagaactcaaaggggacattcatgcccctcactgagcctcaatttcctcttctgtcaatggaggtcattctaaccactccatttcacgggagggggattaaggattccctctaggaggggaggggcatcattgtgattgatgatcgattgtttgaagaaacagaaagaaaatgctgctgagtaaactaggactcatctgcatcctgatttcagataatgatctctgaatatataagcgagaaatgttaatgaaaaatggcaatatatctgggttgaggggttgtctcctgtaggccgggggtccagctccagagagtccagctctggggtcatctatcctgggcagcctctctggaaggattcagaatgtgtgggagcacaaatgtgcttctcaaattacagagatctttcttcctttttggaaagttccagacttggaggggagggagaaggagcaagggagagcagggtggtgagggtgttaggacccagatgctgcctgtgcggtctgagacttttgcctggtgtccacgctcccctgagccttggtccccgagggtaaaatgggaagaacagtaacagctgggggtgctgaggctttaccttgtgccaggcgccgcacatgggcattgctcatggtattcaatccccacggcgtcatatgtggtaggtgttatgcccatgtaagcaaagaggaacgttgtccgaggtcagccaggctagagagggccagacccgggttaaaagtctgctctggttcaaaatgtggggcatgaacgcatcacctggccaagcatgtcagcactctcctcctagtggctgagtaatgggaagagctagcatctagatacagaggaaagagctattgtgatggggagagggagctgggtttggtaaatcctgctaagcagccctgggcttggaaatcagtaaactcttcaaatctgcagggagtcaggaaggacttgccagggtcattcgggagggtcctgtgatagtcaaggtgcacccaccacctgctctcctttggcctcagaaccagtctgcgaggaggcaggactggcagtagtccccagtttacagatgggaacactgaggcccagaaaggggaaagggcgtgatcaggatctggaatgagctccagcaaggccaggagcaagcacctcgaggcaaaacgcagttggacaggacctttgccttgcaggagactgcagcccagtcctgggcctcatacactagcaccctgatgccacattcagtgcctctcgcccaggggaagtgctaatcagacgtgtttccctctgggcctcagtgtttgcatctgaatgcgggggtgcactttcaaggcccctctacatgccatgcgggttccataggaccccagggtttggttgtgacccgaggcccctcctccccacccacctcctctccacctcccgcggggcgccagctcccttgcgtccacatgacctcggatccttccacgcccatccccaccctgttctgcaggtgggtggtcagagggtgctctgctttgaggatgggagagagaaagggaggcaaggacggagaaaagagacttcttttgcgggagcgcagagcagaaaaaccgtctccatcggttaccagggaaggggtttctggtttcagatcccatcacttggtggggccttcctaccaccctccctgctactcgctcttgtcatctgtaaatcagggaaatacttctggaagacagttatctggtctgtgactttgatcattggtctatgactaataattgccctaattttttgaacacctgccgcatgctgggagttttccgccaattgtcgctcaccctcaggtgcctctgaagggcagagattttattctttccatttcacagatggggaaacccaagctccgaaagtaaagagcttttcctctgtgggcctcagaatctgagaagttcaaacaggttctcaggagcccttccagcaccccactcctcgatcagggaggggctgtctgcactctgaccgctgctctcagcgcagagctctccatccaaagcagcaggtgcgtgcagagctacctgccagcagagccatcaaacacggactcttctactgggagccatggagtggtgagagagacctgggcagcttggagccaagggggcttctgggaaacatgtgcccttcccccagggtggggttcagctctggcgggcagggagagaaagggctcttctgagtggctgttgctttacacacatttttgcttcacagtattcttagggagtagcgacagttatcactcccattttacaggaaagaaaactgaggcttagagagctcaagtaacttgtccaagttggcaccactgggaaaccacaggggtaggattccaacgaggcagcctggccccagagcccatgttgctgcccactacactctactcttgtggactaaaaccagatgctcagagttacagtcatggaatagaattagaatcctggcagaagaactgtgggcaggattcggaattttacaatgtcagactcgaaagggctctgagatatcaaatccaaatccccatttctcaaatgacagaactgaggcctaggaaggaagagtctcactcaaggtcacagccagtgccagggacagagtctgcaccccctgcctctccagctacctcccgctgactccgcaccttcctctctcgcaggccctcctctccccactgcccacccagcagcttctgggcccagccaggcccattagggattttccacctccccaaaaaggtcctgatgactgtcagtccttgtgaagccttaattaatctcagaggccgatggctcggaggagactgggggctttggccttacgcagatgaagattgcggctctatttcatgtggtggtgaaagaacgcctcagacattcctgccagcaataaaagccacatggctttccagcatcgcccttggaaaagaaaaaaaagtgcagccctttgcggaaataaatcaactatgtgctgtacgcatggcatgagatacaaatgggcatacggaggtgggcaacagtcggtcttttatgccgcctctgatgtccactgacagtggcagggccagcggtcatggtcccagctgcaatcctggggagagggagtgacccccagtgtggtgggggaagcctcagcttctccacctgaactggatttgagccaccctagatatcccagaggcagggccggctttctggcctgtgacccatgcagtcgcacagggccctggtctcagaagggtcctgagcttgttttaatgccctgccaccactgccttgaacttctgaatacttgctcaacaaaggtcctgcgttttcattttgtactgggccccccaaattatatagccagtcctgaccacaaatccacccctcatcaccaattgtcacgtctctcctggcccctgccatgtacccaatcccggggagtagggtttcttgagtgcctactagccagtttgcttatatcacctgagatgaacttcagaatgactttgtgaattgggcagatgtggaaaattgaggctcagagaggcttccatatggcaaggaagcctagacttgaactcaggtctccctgactccaaagtgagtgctcttagcagctctacattctgcattatttcatcttcaccatgcccagggggatggggatacacacagttaggctgctctattcccagataacagaaggcataactgaggccagagaagtgaaggttctcaagtcagtgtcaaaccgagggcctgggcaacagtggacctgggcctggatccatagggctggggatggagtctcagttttatagttgtttgtgccacttgtaaatttattagctctttccatgcaggtcactgccttgagtctggtctggaatgtggctggagccctaccctgtccccctcccccacagctctccattctaaacatctggaagtccttccttgtgtcttcttccactctttcacgctgcagttttcctctgccaccctcactggttgggaagcagttggatctggcaccttgataaactcaaaagagtccaaattcttgatgaaagttggggctgaacagagcccatagattgccatgtcctataaccaggcctgggcctaaggctcatagagccaactgctagatccagggcagccatttccttgttccttgctgggtaaccttgagcaagtcccttccctctctggccctcagactccccttcagggagataaatgcattggaccacacctgagccccaggaggcctctctgtcttcaacattctagaattccatattaatctacaacaggtctgttcatttccgcatctaatagctggggaaaccgaggcccaggaaggatcagagatttgcccaccgtcacagaaggtgcttattgacaagtggacttgactctgaggctcctgtcagctggcccggttgcctctgcacaaactttcggaggatctggcctcagcatcagctcagcttgcccttgtcccgccgcctttagcccaggtggtctgtcaggcaccctcagtgtccaggcctggaaatcacagctaagagtccttggcaggcaataaagttcctcttctatggcttgaatgtctcccaaaagtcatacattaaaacttcacccccattgtgatggtattaagaggcagtggggggcctttcgggaagtgattaagtggtgaaggctctgccctcatgaatggattaggccctctttgcccttctgacttcaggacacaatgttctgtgtcctccggaggacacagccagaagacactgccttggaaacagggagtccaggacctcaccagatgcggaacctgccagagccttgatcttggacttcccagtctccagaaccatgtgtagtaagtttctatttctctatttataaattatcccgtctcaggtattttgttacagcgacacagagtgaactaagacactctctttagacaaaagtgggccaggggatggcagcaacccttttctccccaatcgcatttgggctgtgtcagtgtttccgtaataaaggccccttttccaggggttataatttggctggaaaatgaggaggaaagaccagactccaggactggaggggcacatgaagtaggaggctaggatgggaaaagtctccactggaccctgggcacgcagagtgcacacacacacgcacacacatctataccctacatgtgtgcactcacacacagcacccacgctcatgggcacagtctctcacacattcactggcagctcacacccacatggacaagccctcatggaggacagcattgttacagtgcagccacaggtgcaaacagttaagtgcaggtgtgtgcaaagatgctcctaggagatgcctctgtctgcatcatcatgcatggacctattggtatagatgcgcagatagatgcacagataggccccattatatgagtggtgtggacacacacatgggcagaaacccacatcacagctgtgtaaacagcagaccattgtgtggacaaatctttacacacagaggcaggcatggaatcagggctcagagctttggatttgttctacagagcagctctgggaggagtcgaaccctggctctggaagtttctgcttctcctcaattcagaggcatggactttctgggtggtttgcccccctggggcttccaaaccattccccagcatctgagtttaacccgctccctcattgttcgatggggacaaggagagcctgtcttcctggtccagagaaaggcagtgggaggggagaagtgggagggttgcagctagggtgccccacggcagcatgggtggaagggcagggcactagcctaggggcccagagacctgagtttgggtttaggttgagatgccctaggccaacacatggcctctctgggcttcatcctgagccccctctgttagggccatgtgacacccccaggggcctcagcatggggaagagcactgaaaccatgtcacatgatgaactattaaagcaactggagactttgccctggaggagagcaggcttggggggtaagagctcctctggcagatctatgaagagctcccaggtggcagggaccatatggatgctgggggctccataccaggaatagaaatattgagagctggcttggaatagggacacgtcccctcagaggtagagatcaagttgagaccaggatattgtgcagggagttcgagtgttagatggggcaggggccggaccagatactagtgtctcaaacgctcagctcatagcaaacacgtattgaacaaatgagagagcgactgcagagctccatttctgagccaatcatccgtgattcagagcataccagctctgggttcccaccttgccatctgcatgaccttggccctctccaaacctcagtttcctcatctatgaaatggggagaacaaattatttccaagagctccagcaagtcacatcccctattgttggtctttcaggtcatcccagaatttctgctcttataaatagaaaatgacattgaaggtgaaaagcagacagacaagcaagagaatagttaatacaaaaatcatagctaggcgtggtaacttgtgtctgtaatctcagctacttggaagggtgaggtggggggatctacttgaggcctagagttcaagactagcctgggcaacaaagtgagactctgtatctaccaaaaaaaaaaaaaaaaatcaggagagtggtccccaccacttgccacctgtgatgagtagggagagggatgcagtcagggaagggacactggtgggagccctaaggtcccattagtgctttgttttttaaagccaggtggtaggtagatagatgtctgctttattcttcttctttaaacaatacttatattttatacattcttctgtacatgtattttacatgtttaaaaatattttaaaggaaagcaaaagataaaatatagaaaaagttcccctgccccaaacctctgaaaaaatggacaatatgctcaaatgtgcataatatcgtacaattattcatgatgcagcaaagctgcactgtttcatccggatggtcctgtgtaccatcacactctcagttgaatctctgcaggcccttgcagctgtcctcatcatggcaacccccacctaggtaagcacttctaggtaacagcccctgctgagcacgctccccaagcactcctcatggccgaccagtagcccttcaggtatgtgtcagtgggcccactttacaggcaaggaagtcccttgcacctacataggaaggggcagagctgggatttgaaccagctctgtcaatgccaaagttgtgcagcaacctcacccgaggagccaggccccttgattatagtaactagcgttatgtacactcacacatgctgttgaatccccggagccacttttgtattaggtacatttatcatcatccccattgtaacagtaggacaacggaggcatagcaaggtcaggaacgtgttcaagttcacaccctaggtgagtatcagagctgagccttgaacctcagcagcctgatcccagattgtgtttcctggcctggctgtgtggggagctcagacttcatggaaacaaaagacagaacggtggctccagggtccacagcggatcccaagggaccagaggccagcaggggggttggctggggttggaggatgctgcctaggagatctgctcccagagtgatgctagccctgtgtgatgacctgagtccccgcctccttacagggtcatggctgctggggaggtgctgaggctgtgggtacagccaaacggagctagagcaggctttggactccctgcctggcaagtccaggtgacaggctcagacactgggcactctgtcatttgctgttggcataagtttccactggcaggaatgtgacatttatcacctgagtgggcttccagaagcccactgaatgtcctcagacctggggtggggggccctctcactgcctcacctctgagccttaatcaaatccagggtggctggatgatctgaaggcccttttagctcacggaggcctgggcttgcccctgcccccatccgtgtcctcaggggaaaaggttcccagtcctgcccttagcagctctgagcttagatgagggggggagatgagatggaaaggaaaaggagaagtaagaaacagacagaggaaaaggagttggcactagattgaagcagtcaacacacacttattaggcacctagggctattttaggtgctggggatacaagcaatggaccagaaagccatggagctccttgggggctttgattccagcagggcagacagaagacagacaaggaggcaaataaataagcacgccaatatttgatagtgtcttgggacactcaagaaaacagatgggggtaaagtcagagagagtgactgggtggatggggagagaggggctcttggcaatactttagacagggtggtcagggaaggtctgtcggagcaggtgacatgcgagctgagaccagagggttgagagggacccaggaagggagaagggggctggtaggagggcccactgcacagtggaactggctttacccacctgccttctccccactcctctgcactgctagtatccccagttcctaaaactcttactgccctttctctctgttgcttctcccacaacagccctgagagccagatggggtgagcctaagtagcctgacctgcagtgcaggaaactgaggctagagtggggagggtcagcatcagcggtgccctaatgccaggacctgacccgggctcccgcctcccagcctggtgctcctcggagcctgcccattgcctggcatgttattcaaccaccccagtccaggcaggctgcagccactgtggagccagcccgtgggcaccgctcctgagaggtcacaggctggaaatgtgggcagctgggtagggtctaggagggggcagcggctcaggactgggcgggggtccggagcggaaggcgcccagccctgattggaacaaggtggcagcaccgggagccgagccgggtgtcattgatcttgcccggtgttccagccaccaggcgggaccagcgccgggcagactgccggttttcccaggtgtggggacaccctgagggaatgacttttcatgtggttgtggggcaggcatgccacccagcacgtgggggaggccagggctttgggagcatgctggcagcagggtggaggggggtgtctggagactcagaatcccacagccagcaaatgtgaggctcctggagacagggtcatggacttgaggctctgagaccctgaggatgttagaatcttcatcgcagtagctcccactgatggtgtgctcacggtgccaggcacggttctgagaactcacacagcttaactcttcatccttgctccatcctaagagggggttctgtgatcatccccacttacagttggggaaactgaggctcggcaaggttaagtagcctgccaaacacacagctaccaggtttttgtcttaggaaataagagccctggaacagttggccagtgcggagaggacccccgaagatctctgaggctagtccccttgtgtcggaaaaacaggtctggagaggggatgtgacgtgctggggcccaggggagtccaaagtcaggactcattcttcccccaggtcatcgtgggacctccgctggtccctgaatgtcaggccccctgagggcagggtcctcagccaggacctaggctcccagatgttaccaaccttaactgacagttttctgctagcacacaggaagttcttttgaacatctaacctgaatccctcgtttgcagggaaagcctcttccttctcatcttgcagtactctaagaagagtttggcctttgatgttagggaagatcaccagttccctggtgttgtgggaggtgagactgtgcccctctctgccataaaatatctctttactgtccatcgctgggcctaaacattagcgacttagcccttggggccttacagagtttcttattaaaatgtgagtactcctggaatgggtgtcagcttagcaggacagggtggtacttcaggggcagggcttgggggccgttgaggggcaggagagagctgattctccccttctagccaggcttgatggggtctacatgacctgccaccctccacctctctgacctcatctgcttccactctgcccctccctcaccctgctccagccaccctgccttcaaatatgcccatcatactcccaccacagggcctttgtctgtgctgccctttacctggaaaacccttcccattctgtctgcctggctcagctacccacttcattcaggtccctgctgcctcctccaagaggccttctctggtctcctgtggtaggcagaataatggccacagagatgtccacatcctaatccccaaacctgtggctatgttaccttatatggcaaaagggacttcgcagatgtgatgaaggataaagactttcagatgggagattatcctggattccccaggtgggccccatatgatcacaaggatcctcacacatggaatagggaggcagaaaaggacagtcggagggagatggggtgtggaaactgattagggaacctgagagatggcagcgtgggaaaaacatggctcaaagctgtgggctttgaaggtggaggaaggggctatgagccatggaaagcagacagcctttaggagctggacaagacaaggaaacaaattctccaccagagcctccagcaaggaacacagccctgccctgaccttgatcttggccaagggagactcatagagaatttctgatccctggaactgtaagattataaatgcatgttttttttaaggcactaaaagtgggttaatttatgatggcaggcataggaaacgaatatgtctcccttccttgattgacagttcctcagcacatttattagtgcctgatacacaatagcttgacttatgaattgtctcttttctctcacagaaggtcagctgcaggagggcagggattttttgcttgcttggtgttacattcgcagatagagttgtcacatttaacaaatggaaatataaaacacccagttaaattgaatttcagataaataatgaactcctttttagtataaagttgccccaaatattgcaattatttatcgtttatctgaaattaaaataatttaggagtcttgtattttatctggcgaattcatccccaacacataaaaccattcctgggtatgtattaggatctcaataaatgtctgttgaatgagtgaaatagataagcaaatgaattcacattaacttctagcttaaaaaccctctttggctcccagaatgcctacagggtaaagtgtaaatcatagcaaatgataaaagcagacagtttcatagccgcttcaatatgccagacccgggctgagtgctttacacttattaactcactcggttcttgcaataacccaatgaggtggttagcccattttccagatgaggaaactgaggcccaggaggcttagtaacttgttcaaagtcacataaccattgagcagcagagccaggcaattccaggcctttgaaaacttggctcatggaatgttctaatgttatctccctacccattcccctgaacactgtggatcctctctctctaacagcccccggttccttttcagggtatgtgcttccgcattctctgactgctgaactcctcctcatacatcaaagccctgtcctacttttctctctttgtgagaccatctctaaaactcccaggaggacttggccccctctctttcccctccccaccatggccccttgtctgaatgcgttgtaaggacttgctattgtgtcctttacgttccctgactgtgacctccctgagaacggagatgggcccctttcagctctttggcatggggcttcaaactgagtctggctttaggggggttcccagaagcatttgagaatgaatgaatgaatgaatgaatgagtgagtgaatgaatggctgagtgaatgaacgaatgctgtttgtttccactctgggcctcagtttcagagtctataaaaggggaagaacaatcctgaaccgccccccattccttaaaacaaaacacatttttttctgattataaaaataatacacattcattaaagaaaaattggaaaataataaaattatgaagaagaaaattaaaaccatccataatcctgccacccagaacaatggttcccactgggtgttcagccttctgctcttcttactgtatgtatagatttattatcttcttctcttccccgccctccctcccttctctccttccttttttttttgagtgttgggaacatacagtatggggtcctttaaacctgcttttgaaatcccccaacatgtgtgtatgtgtgttctcctgttttcttaaagcctccctgatggcaggggacaagtggctgctagacaagcctggtaggggccagggtgtggaaagcccattccccccctactcatggaccaccatagttcccttgtgatgggctgtttagggggtttccagatttctgtcagggaacaccctgcgtggatgtcttagctgcatccctggttccttccttaggacagattctgggactggggttgctgagaccagtatagacactgagaggctccggacaccgccccacatcctccccacagctgctctccagccccactcccactggcagcctggacttctcagcttggcagaaagccgggggcagtattccacctcctccagagaaaagccttgtctacacccaaggcctcactgattccatccaacgctgaaaatacccatttactcagctatttctccacgttatggtctaaggcccagatgcttagttccaaccaaaatagccacagaggtcactgtggtctgagggtcctctggacctcaggcctgtgtagacatcatacttggtaataattaacccacggagctcaccacgtgccagaccctctgcgtctctgtgtgtcctcacggtaaccctgaagctagggatggctgtctcccatcttacaggtgagaacactgagggtgctccagagagctgtgggccctaggccttgtcacctgggggtgcaaaggcgctgccccagtagtccggctgcctgctacctggctgcctgctacccaatggggcaaagtcccagcactaccccgaaacaaggacaagctttggcctagaagctgggcagccaggtcctgtgcctgttttttctccatatgtgccctgggcagctcaccctctccgtctgtgaaatgggagagcagggagtcagagacagcctcctaggcctgtggcggctctgagcacagtgggtgcagatactcagtgctgagtcaaagagagagagaaccctgccagatgggccagctcaccacaagcagccaagcccggtctttgaggggttggagtgggcaggcctttgaccaaggctgagctaggagggacctgacggccccagatggaggctggcccaccctgccccagcagatgggaggctattttttaaccccacaggaagaagaggacagaaatgattgcagggggttaacctaggcccctggggacgctccctgtttgcatcctcctttccccacaacccagagagctatgtgggcttcacctggagttccctgaatccttctggagctccccgcagatcacagccggagctggcagggcctgagtggcccctgtctgccaggcgagggacccagagcccagagaagtttgaccaggactggcttcctctgccctctctgctgtgtgcttccaccaggtgaggctgcctcctccgcttctacctttcttcctggggtgacctggggaggccccaccttctcccgggccagtttccccatctgtcagacaatgggaccctccagacatcactgaggcttctcccagctgggaaacctccttctgagctggggccctgactctgtcacatcagtcctggattcctggaggcctcagccctccagaagcatccacccagtggacaggagctcgtggcaggtgtctggggacccccaggaagaggaaggatttcctggccagagataagaagagcagcgtgggtaggggttaagcatcctccccctgcagcctccctcagaccacgccaccaggtggcccttggtccccccaaaaggagttcctgaaaagtctgtgtctgttgcagcaggtgcggcctgtgaagtgtgtgtatgcttgtgtgagggtggtgtgtgttcacatgcacatggtgggggtgggcacacaaggcgggaggcctaacatggtggcagggacagactttggttgctgagctgggacagcctgtgacagaggccccagcacacccgcaggtcttaccagaaaccctcagatggtgctggtctgacctgaaggtgggcacatgcagggaaggggtacatgcaggacaggggtgcatgtgggggagggccatgtacagggcaggggtgcatgtggaggaggggtacatgcaggatgggtgcatgtcggggagggtcatgtgcaggacggggtgcatgtggggggtgcgtgcaagacagaggtgcatgggagagaagggtttgtacatggcaggggtgcattgggggtgcatgcagggcaggtgtgcatgtgggggaggggcatatccaggacaagggtacatgtggggaggccacagggctcaaatgctgtcagggcctctgggaagctgggaccccagtgaatgcttgaggggagccaactctgcctgacctcctcttatgattgtctatttaaacaatactgtaaattaatcacattaatcgaacccacctccctgcctcctgctgcttgcccctgtgatacaaataatatgagcacaatgaaaaatcttggaaaatacagaaaacacataaaaaatgttaaagcctgaagtcttataaccacagtgaacactgcgagtgtctttgaggggatgggggtctgcaggtcttcttgatacaatcacattcattcccacatactggagcatttcccacgggcggctgtggagctgagcacttcaggtttgtcttagtgaattctctaacagcctgagagggaggtactgttattctccccattgtatggctgaagaaacagcaaaaaggaggttaaatatccccctcagggtgtaagaagcagagccaagatttgaatccaagtctggctaaatggaaagtgcaaatcgtccagcgtccagggctgcactccagccatgccccgccccccgtgagcagaccactcatttattcattcctccaggagcatttactgagcacctcctgtgactcagaccctgcccagcacccacaccaaggacttggcggatgtgaacgagacagagagaggccccaacctgactccccaagcggccacaaactgagtcccaaccttgaccacagcttgatttctagtccaagttgtcactgacccccactggccttcatcactgactgaactgtgacctggcctcctgcactctgcagtggcctctgtgagcttttcattccccgtgatgtgtgtgaaagccaaggccagcagcccacctcacccagcctatcatccacgcggcctgggccagggaggccgtcaggagcccacccaccacctctggcctgccactctgggccaggcctctctggagcgggggtttggccttggcccttggcaccctgcttggcagaagggtgggccttggctcagagcatggggccaccccaggaggggtcagcatagctgagctcagggtacctgtgggcggggcttccatgtcccagggtcctcacactgcagcctcctctttttgcctgggccctggaaccccaggagaccccaggagccgttgctccctcctctcacttgcagaaactcaacagggcagctcatctgagctcccccgatgcctgcactgtatttctgggggtcctgcatgtctctccaatcctcaggcagggccagttacctactttataggacccagtgcaaaaagaaaatacaggaccccttttcaaaatgcaggaacaaaagtttttcctttcttctgtggactctcaacccacggtggtgttttttatttgctgttcaatgtcacacgtacttggacctggggagacttgtgcagaaagtgcagaccctcacagatgctcaggggccaccccaaaacttggtgtgcagattccaacccctttctcctccccatgcctgcctcagtggagggcggcagtgcaggtagtgggctgctgagaacccatccctggaggcagcaggaggcagactggacccgggccccaagtccccaggcatgctgcactagcccatcaggcttcatttacaacacactaattcagagcgaaaatgatccagcatttcaatatggcaactgctgagcgttaaattcaagcacaggaggtgggggggccaggtagccctggaacatagcagtctcacaggtggctgggcgtggggtggatctctgttcttggagtagagggatgtggagtacctccctctgcttggagtatctggggtacctggacaagcacagggggccatgaacagggccatgcctgtgtgcctgcccctcgctcagaagagggcacctgacgggaataccagggcatatctgcaccatgcccgggcagtaggcctgggcatgaccctggatcaggcagacctgtagtaggtggaagggccccaggagagctgaggagcctaggggagaggaacccagaggtccctgccaaagtgcttgatgtgctgccgtaagaagggcagcataggccgggcgtggtggctcacgcctgtaatcctagcaccttgggaggctgaggtgggtggatcacgaggtcaggagattgagaccctcctggataacatggggaaaccctgtctctactaaaaatacaaaaattagccggttgtggtggtgcgtgcctgtaatcccagctactcggaaggctgaggtagaagaattgcttgaaccagggagttggaggttgcagtgagccaagatcatgccactgcactccagtctggcaacagagagagactccatctcaaaaaaaaaaaaaaaaaaataaggcagcatgggtgcctgctgagagagagagaaagaagctctttccctgcatgtgttgccatgggattctggcccagctccctggggtgctctctgagctcagctttggccctgtccctctctctctgtgcctcaatttctctaactatgcactgagcaaggagaagaccaccacacctcaagtaccttctgcatgggccatacactgagttttatgaatctcccctctcttgttccacaaatgattactggcccatttctcagacgaggaaactgaagcccagaggaggcaatgactcacccagtaagaaggtggtggagctggttctgcctggcttcccttcaccccttgagtcgctccagcctctctaggtttgggtggaggacgtgggaaccaagctcgtgggggcaccaccagctcttgccagaaatggggccaagagaagaccaaggatgctccttgacctgaggaaacgtccattaattcatagctactgtgctttggcgagccacgcaggctctggatgcaggctgcctgggtgggtgacctgagcagatgccttaatctctctggggttcagttttctcatctgtaaaataggcctcataagagcttttgtcttatagggttgtgaggattaaatgagctaaggtatatcacttgagcctgggaggcagagactttagtgagcaagattatgccactgcactccagcctggaagacagagccagaacctgtctcaaatacatatataaacaaaatgagcaaaggtatggaaaacacttagacagtggctgacatagagttaagagctatgtaaatgtttactgctaatggaactatttaaaagttgagtcataatttatattttctagactgtcaattacgaattgattcatttcaatgttgtgcttttcccttttgtatttaggatccagcaaattttcctttgaaatctcaatacaatttcctaggtccttgagaagataatttccccgcccccacagtgcttatagcccatggtggatccaatagctctctctagagcagcttttccaaaagtggactttgcacacaccagccccttccagatgcatcatctcaccccaagagataactcaataaacagttgagcatacactattttagatctccatggcccaacaaggtagccattagcatatcaaagactctgacaagtcctgcagcaaaacaccattgaacattgtttgaaacaaccaatcccaatcttgtttgaccacagagttccattatttctgctcaacagctgataacatctgaacacacgttgggagatgccaccctcatttcctgctttctaggaaatggcaaggggagtcagagctgtgaggaacaccctctcgcagggatgagtggctccacctctacagaaatcatctccagtcatgtgcaccatcgctaggccattcctcctgttctcaccttccttgtctgattcagcccccacagcggcctggagaggtcactagcatcaatgtctccatcatacagatgaggaaattgaggttcacaaaggttaagtgggcacatagccagtaagtggcagatccggtagacaaacccacagcttctgattctaaaccccacattcgttcttctgtatgttgactggaaaagtaaaaatagatcctattctaacaggatcaatcttcccccatcataggcttttaaaaaactcaggtattttttttttccggtagcattgaatgctttaaaaacttaaaatttttactatctttcttttgattactaaagcagtacgtgcttgttatgtataaaacttttcaaacattttgagttgaaaaatgaaaaaaaggcagggcgcggtggctcaagcctgcaatcccatcactttgggaggctgaggcgggcggatcacgaggtcaggagatcgagaccatcctggctaacacagtgaaaccccgtctctactaaaaatacaaaaattagccaggcgtagtggcgggcacctgtagtcccagctactcgagaggctgaggcaggagaatggcgtgaacccaggaggcggagcttgcagtgagtgcgattgcgccactgcacgccagcctgggcgacagagccagactccgtctgaaaaaaaaaaaaaaaagaaaagaaaagaaaagaaaaatgaaaaaaaaaaaaaaacagatctgcatagccctacaaagtagccattagcttttaaatgaaaatacttaaatgctatctaaatgaaaatagttaaaatgaaataagataaaaaattcagttcctcagttacagtagccacgtttcaagcgctcgggattcacgtgcccctggtggctactgtgttgggcagcacagacatgggacattactatcatcacagagaatcctacgggacggtgccgttctagattcttcttagacatatcctaacacctatacaggttgattatccctaattcaaaaatctaaaatctgaaatgctccaaaatccaaaacttttttagggccaacatggtactcaaaggaaatgctcattggagaattttggattttggactgaagtataatccaactattccgaaatctgacaaaatcagaagtcctaaatttgaatgcttctggtcccagccatcttgggtaagggatgttcaacctgtaatgactgttaatgtgtggtttttttttttggagaccaggtcttgctctgtcgcccaagctagagtgcagtggcacgatcatagttcactgcagccttcacctcttgagctcaagttatcctcctgcctcagcctcccaaagtgttgggattacaggcgggagccgccatgccccagcctattgatattcttgttgaggttctcagacatatctgcatggcctcacacatggaggaaagagacccacagaggcaaaaacaagacatggggtaaaaatagactggaaggaaacacaccgaatgatagtggttttttctgggtgttgagattaccgagcttatttttaaatttcttagatccttcaggtgttctacaacgtaaaatgcagacagggtggggacgttggttggagtcatgttttccctaatgttcttactggttctaaaatcttcaagctatgctctcacccaaggcttcacttattattattttaacactgtggattcataaagaatggaagcccacacaagtccagggaaggaaggaaaggcagacagaggcttattttcaggcctgggcagttgcacagggtcccttgcttagaagggcctcatgcttggtttcgtgttctgtggtcgctgtcctgaaattcttactgatttttgaacaagggatcctgtattttcattttgcactgtgccctgaaaatcatgccgccgtcactagccctgggattctccccaggacaggtttcccttcagctgctctaagccttcgcccttgtccttgtccaaccacggacgtggccatccacggagccctctacgtgcctcagagcaagtgtgcttcggctgctcaggtgtgtgtctagagactgataaaaacagggctcgtgagtgggtgcgggaggcccctgtggtctctgttcacacacgtacctaccctcaaggccatgtctacactggcctatttcagagaaccgccctgtgcatcatgggatgctttgccccacatcacggcccagcttggttcagtcctggagccctgtgtcctgaagccatgaccaaccccaggcctggcccaccttcttcctcagtctcctctccctcaagccctccacaggacccataaaccttccatctccatgtaatccttttgtgtgatccttcttccatacctttgcccatgctgttcactctgcttgtaccagcaaggttccttcctccccagatctgccctttctagacccatctcagattccaccctttctagaaagacttcaggaagtatttgagaagggcctgaagatgctgtggttgcatagaggaggatatgaatcacctcgcttagaggtatcggggagggctccatggaggtggtgccctcaggccaaggaagagaagatatcttccgggcagaagggagagtttgacgggctggtttgatgtcagacagaccacaggatgactcaaggtcctctttcctcttcttaaacattagttgcagcaagtcccaccatctgcctgagtctgttttcatctccacaatggaggtggtgatgcccagcacacggagctgtgatgaggatttaatggggaatccagagcatttatggaagtgccaggaggccaagattctgcataggtaggaaggacctaagccagaggggtgtgggtggccagaggagagagcctaccttagtagggcttggtaggctaaggtctgggctgaatctcgaggctctggagcttagaacagcatctgcaactccctggctgtcggggttcaggcaaggactgcctcctctctgagtgtcagtttccccatctataaatggaaagctgggacactgaaaaacactgggggggagggtggttcctgaggcagtctctctccacacatcacaggaatgtggcgccccagggagaaggcatctttgtccattgtgttcacttctgcatctccagtgcccagaacagtgcttgcatgcagtagatgctcaataaatgttcattgaatgaatcagcagcaaccaattcgcccacctcacatcctaagtccgctggggacgtaggcccacctctccagggaaactgtctgcagattgggaccacacctcaggtcacaagcatttcctgagcacctactgtatgcatggctctgcgcagcccggggcagacccttgctccacagcccgacagggcagagccaaggaggcaggtgacagacacagtgatttgggaagaagaacagagagcagggtggccagcagggccttgcctgggtgggagcaggccgttcccaggctggagctcaggctgatgggagccccagcttgcctgttcctgggagggtgggactgcctcttcctctttctttctctgaaaacaaaaattgttttcccttaaatttacaagtattaaaagtttggaaaatacacaataatcaaaagaatataaaataaaggttacctgccatcatggcggaccacacagtattaactactatggacttttcagtgtttccctctagtcttttttctgaggtggctttgctctcagaggtggctttctctccccctgggaagggatatagctgctctgtaggagatgtgggggcaccaggctctctccatgggctctttatcacttctgacttggaggtcctttctccaccccccctggacctagcacctcttcccgagacacaggggtgcgaagagctgggggaggtacgtcagcaggcctcccctcctgcccctgcttaccccacggaggtggggtgggacagaactcaggcttgaggaaggagcactggaggccaagccacaggtgctggtcctcagccctggtgcccaggcaagttgggtttgggaataggggcatgaccaaaatggacccctcctttcctccccacccctttccactccatccgcctttccctttgcgttctccaagcgttccgtcccccagatgccctctgtttcctctgctccagccttttaactcctctcaacaaaggccaaggaatcaggcagactgtggacactcaggtgtgcatgatgggaagggacctgcatttacaaaagctcccccccacagggactgcatgtgctggtggaatctcagtcaccatgtcccacgttgaaggatgtttggagggggctgactttggtcacccttcaaatcataagttatatgcgtctgccctttccgcccacacgtaagtctgaaccttttgccaaaaacacttttcccagactcgaaagaaaaccccaaagaggaacctaaaccttcacgctgcctgcaccgattggaccggagtgctcaggctcgcgccaacaagtgtttcaaagaagaagccagacagtgaagggggaagtgagggagaagctggaaaactctcaggctgaccaatcgtcagcccattcattcgttcatccatccatccatccatccatccatccatccatccatccatccattctttctttctttcctctatccattcagtgagaagggctgaatatcacctgtgagcctgcccctgctcccaagaacaccctttggacacctgtggggtgagtagtgaggggcagcaatggcagagcacccccaccgcctggaggggagaaagggaagggctgggaaggctccccaagggggcggccatgaagctgggccttgagaagacaggccagggtttctcaccttccacatcctgcttagagtcagacagaaggcttttgcagaggaggaggaacattaaatagtagtaatttctggcattccatgagggcttgtctgtgccgggccctgtgctgtgcacgtgatacacactacctcattaaacctacccaacatgccttgagggggtgctattcattttctccattttacaggtaagaaaatgaaacacagagaggtgaggcacctctcccaacgccacacagcgaggaagtggcagagcctggctgcagctgaggcttatagccgcattttacattgctttctctccgaagagtgccttcctttatccctgggagccattgacaaggggtctgacagtccctctagtcttgtgcctgctcagccctctctagccctgaaaaaaccagggcttggcgctggagaaagagcaggagggtgagatgtggaaacatctgttgagtggcaggggatcacgctggcgcagaggggcccgagccgatcaggaggccggcctgtgccaggccagtgctccctgtgtaccaggtgccacatgcggggctcagggtagggccacagttgctcctcccaaccaccctttgaggtcagtgttactagcccattttacagaggaggaaactgagaccttaagaggtgaattaacatgtcaggtcacccagctaccatgcagtttaagcctagattgttctgactcctaaactgtgtgcaaggcggatgattggaccccagggaggcaaggaaagtcagttttcctgctgctgaattcaatgttttacaagaccacacacctctttagacctcagtttcgtcatgtatgaaatgaggaggggaactctctgcctccgggctctgatatgctcctggactgattcactgttccttgttcttgtgacttctcaaagcaagaccagagtcccactcccagccctaggcccgagattcccatccccactgtgtccaggggcttcaggaggtgctattttagggcagatggcaaaggcctgggctgtagatccactgagggctaaaggcaatctttcttccctccacccctcccttccttccttccttctctttacttccactaagcaaggtagggaactactcgctgagtctcagggcaggcccacggactgaagctcaggaggacagggctccccagtggctgcaggtgtcccagcactgactcctagcagagggggtgtttgggttcagtctggaagattgggtgagattccccaactacggggggtgggggcacactctgggtggcagatttgaggaagagtctgcagataaggcatccccaggagatggcaataagagctggtgttggggctgccccactgaacccagagcccaggcctgtttccccacccatggaggagtccggactggctcagtggcaaggccggggtcagaggctgccactctcctcctgcctctcacagcccgctggaaggtcaggttttcaggctctgcttatccgtctcccggcctcctccctccaggtaaccgagggagcctccgctttgatgcggccacctccaggcccaggcgtcaatgagccctctatatgaccagtggggctgctgggggcctccagcccgccagagtgggtgcggtgaggcctggacacacagtcccgctgtgtggggtcggctcatgcctgcctagaccctgtgggcagtggggggctcctaggaatgcttttccagcctggggggcactttggacaggcagggtggtctggggagacgggtgtgtgcagggcagcctcagaagccgccatcaaagggacctagcagacgtggcgccaggcaagcgccatagtgggcacggaagggctggcggtcagtctgttcctctcccagggatggcggggagggggaggccccatggacacatgtgctcagggtgaccagccatcaggggttgcctgggatgaaggggtttcctgggacgtggagctttcagtgctaaaacagagagtcccctgttattggaacttcctggaccttcggaaaggatacagtgactgacctctctggtctgggcagcctcctccctgtccggtgacctctgagtcagaccatctcggccagacctgcccagggccattttgtccaccccctgcctccacacaggcctgcctcatacccaagagtccactttccatttctcccaggcatcttcaggggaggagctgccggccaactccaaccactgctagggggacctcggccagacccacaccacgctcccagccctccctgtggctcccgagccagctcatactttcctgcttccacacctttgcccaggacgttccttctgcctggaacatcctttccctgtctttgttacctctttacccttagggacccagtttccaagtcactcctccagaggacttgttctctctttcccaaggctgggctagtacccctctttgaactcacagccctggttcttctcccaaaaaacctttgtcacgccccagggcaattttctgttgacccatctttttctacaccagatggtgagctcttaggatggagatcctgacccagtttcccccgggctcccagtacaaggccatgctcatggtgttcatcaaatggaaaatgcttattgagcaactactctgtgccaggcatcatgctcctttaattctctccatagctctgcaaggttggtgtaacccctacagatgaggaaaccagagacagagaagtgaagtaactcatgcaggtgacggcagagggcagagtcaggacttgaacctggagagcctggctctaaagcccaagctggaatctcgatactctacacctcgataagtttttgggaaatgactgactaaacagatgaacgcgtttgcccccccgccgccccagagcccccttaaagcctacatgtggcagtttgggcccatttccttggcttccctccctggaggggcacccactgccagtgtccctggtgagtgtttgcctgtgggggtacaagtgagggttcagcaaaggtgacctggtgtgaggggggggtgccccagggggtgcagaggagggcctcatgaggcagattcagaatgaaggttctggcccccagtggaaccgtgcatgggcaaggggtcctcagggccattggcccataattgtcagacggggaaactgaggcccagagagaggaagggacttgtccttagttacacagagtgtctggatcacagctcttaggtctcagcttccccatttgtcacacagggagaataaatcccccttgtcctgcctgggggtagaccccagggggcccctgtgccctctcacaccttccattccagcttctagaattccaccatccatgcaccagccctgagggtaggcgttgccctcttctcacctcctgctcacgcctctactgcaggatgggaaccaaatgcctctccacccttttcccacaccccttctctccacagtgaactgaggggagtttctgatcccttagctcaaagtcagagaaactgagaggggagggctgggtgggagccgtgggaatgtcatgcacaagcagtcggactctccaggggtctggatctctcccttgctgccttgaaggcccctgcacaggctgtggcactggctgagtacaggtgcctgaaggcagaggcatggatgggatgcttcattctcagcctgtttttgccagtgaagacaaaagggaagtcatcttccgttggtctatggggaccctgaggtagtaggagctcggtgataattctagggaccaccctgggttgtcaggtgggggagacagagaagcccacataggaggcaccaaatgcaactcactcgtgcccttttactcatgagagaacacggatccagagatgtcaagtgactcagacacagtctcacagcacacaggcggcagaggcaggtaggggactgggcttccctggcagcagtccccaagcctgcctgagaggcacatcagaatcgctttaggggatttgcaaaaccacacctgcccaggcccaaaccctagagattctgattccgcagtctgaggtaggaatggagaatcctccacagcctgaggtaggaactgggaatccagtgtttaaaactctctaggggcggtgatttcagaaaacctgctggctccatcacactttgctcagggactgagatgggatggcatttggaagacacaggtaggaggaagaggaggcagtggggggcacagggagacccttccccttctggtaaaagcctgtggacgagagaacagcccgagtaagattctgagaacccgagacccggatggacctggagtttttgtcttgcgtataatttagggggtctgtgacactgggctggagataaccgtgtctttcctttccctggcctctagctgaaatttagcatcatattccatggcgattttccaccagtggaaatcacaggtgttctctggtatcacagcggggtcagggatgacctgaaatattgttcatgctcatcacaactgcatggcccaccgcggggtcttgtcactcagtgagttcttgaagaggcacagacaaatggagttcaacaaatggaaaacgtgagtcaatatgtcaccagcttgctttctgagtttgacaatggtatttccatcgatttcttttcctttgtaatcctttggattttgtcttacgcgtttaaaaacgcaactccgaggaggaacctgaaggttccctgagactgccaagggtcggtgggttagggaccctgtagggggcagcgtggggttggcaccctgcaaatgggaccctggggctgcgtctctttgaggaaggaattggcagctggagccctgtaagcctccagggatgggatttgggagacaggcccccatggcgagcacgtcgtgagcagaaatgaacaggagagagaaggctgaagaggggagacaggtctccacaaaagtggagggaaggccctcgggccacagaccccagatccaaacatctccacagaccctagcctatgaggcgccttctgtgccactgctggccaggatcagcccgctctgcccagcggcctcctgtctctgggcgcatacatgacatgttgggccaaagccacctctccctttgtgccctttgtgctactgccagccacctcccaggctccgaggatcaggacccagcccaggccgaccggggctctagccctgtctcccaaggttcctttgttttaaaccctacatttctccatcttgcgcacggaaggagaaatacagattacaaagacccggcaaatggattttataaactcttattttcttgccacagaactgcctttaattagctccgaggactacaaagggaacaacgttataatagcagcaactccaaggaagcagccacagctctcagctctcagacctggggctgccgctcatcatcagctacagctaggtttgatgggagtgcccccatttcaggggacagcaggcccccttcactccccgactcagtccccatctgcagcagcacagccttccttggcctcaccagggaagaagaacaggccccgctctcagacaagccttcccagaagcctgaggactcaaacacccaaatgtgtctgggtccctgccccgagccggccacccaggcagcagccctgaatcactcggtcagccagcggcagggcaggccaatgggctggagggtaggcaggcaggcagacccacctctgcatctctgctgactgcctcggctgaggaaaggcagcaccagcccccaaccctgaagttctagatctcatgcagcctctctgttctggaaccatccagaggcactgcccttatacatggtccacccccaggctcagacaatgagaattccacaagcagaggggactctatttggggcacagagaggttaagtaactcccctcctaaggtctctcagcaaggaagccactgagccgtgggacttgagctcagggactcttgatccccagtctcaggtgtcacagccccatctgggctcctgctagggaggaggaaggcagcagggggtgtctgaggccagggtgcatcagccctaaatgccagacagaggcaggagaagtctccccatgagtcccagccccattagaggctccaggtcggggatcccagaccccctatccttgctgggagacacaacccagaactctgcatccctgcagccaccaaaaaaggcaaaagctgcccagaaacactttctcctcttccgtggccaaatccacgaactttctcgaggtctgtccccctgccccgtgcaggtccagcttcagtgcagcccagctctgtgcagttttccacaaaagcctgtggcttccttctcctccctctgcttctgataccccaggagttacacacaaaatgttggcggtggtctccaggaagacccctgcatcccacagctctccccagaagttgccagcagtgacctcctgagcccaggtggggagtcccaggcaggacaggggctggggctgcaggccctggggccctgttagtgaagcagcaagccgagggtccctgagagtttcccttggcccctctgagggctgccctttgaggtcttgaggtcttggagtatccatcgcccccacggcttactgtccccaccagcggaggatgaaagtgccacagcgatgttccacgccaagagaccacagagaccaccaacccctcttcccacctcaggctttcagaggccagcggatttaggcggacaggctgtgcgcttgagggcagccagggcggtcagtggagggacgtggtccggggcctggccacagctccccacccagggccctgggctattgttactcaccgcggatgaaggtcggcgagtaggtcgggaaggagtcgaagatgctgttcgatgccatgccccgctctgaagaaggcgagaattttcagcccttcagggggttgggttgggattcacttggttggctgttgttttatttttttttcctctagctacttttgaaaataaaaggggggggtgttgctttttgttgttttttgttttgtttttgtctcttttttcccccctgctgctacgaaaaagaaaaaaggaaagaacgcgagagtgtgtgtgagtgagagagagaaaaaaatccccaaggaaagtaagtttctgtttgtacccaagaatttggattcccggtcccacaggaatgtctagccacaaattctcaacagaagcgtatgcagagtgtatcattagatggcgggaaggggctttcggcagccagggtggaggagctccgaagctgacagagcagagtgggccgcctccagtgccacggggaatgaatgaatgaggcttacccttgacagagcccaggctctggtgggtacgagggcggccgggggtggggagcaccaggagccaaccagctcccgcgcagggccctggaggcggcaagggcctggccttgtggttctgtggttgagggaccaggccttcccagtgtcaacccaacctcagctcacaggatgcgagaagcctgctcgcggccttggctcattggctgggccgcggtcacctgggccgtgatgtcacggccttttagaagatcttgtggctgcctctctttttggaaaagaaaaaaaaaaaaaagaaagagagagagagagagaaatagaaaagtgatggcttttatttgtgaggctggcctcagcacgcggcccaagaaacagaactgaaagcggttgcagtgggcgtggccaggagggtggtttggctcctgggtgggagactccttcttaattaaggccagcattggcctgggcgggctaggagccccgcgggcccctcaccgagtgcccagagcccggatccaccagcggccggagagctccctgccatgccacctcgcccctgggctgcggctgactccctgccattgtccaccaccattgttgccagggagaggtgtccacatgtgtggctgggtggcacctctggggcttttatgggagttgggactaagtacaacgggaaacacatgaagtggcattgccagcactcacgcctggcctcggcctgcccaccgagaagggccttcctgtggaaacctggtggcctgcccgcactggggggccctctgcagggctgggggctgagtccccagcatgtcattcagggccctttactcctcttgttgccacctgcgcatccccttgggggtctctgccccagcatgatgctcgggagcttccctgcctccgggccttcgctcatgctgttcccctcaccagaagcgccctttgtgtcttcatgtccttgaggagtcaaggcccagagaggctcaaaagtagaaaagtcatgaagacgattgaaccctatacttgcatgttccccaaagtcatgtcaggatgggagagagggtggagagtgggggaaaggtggcggcttttaccatttcccttgcaagctctactctcccatttcacaggccaggctgcgaggcccagggtggtgacgccagcttgtctaaggtcatgtggtattctggaatgggattggaacttcagcctctgactcaccagccccgaccttgggcatgacaccagagtgcccttccatgccctttaaatgaagacttcagaaagtccctctgcagcctggccaccaacccctggcctctcccagggaccccaggcttggggctagaacctagcaccagcctctgactcacagtagcctctgtaggccaacaaggatggggtggggacatccctggaagaggatgggctggtccaaggtcccaaagagacttgtttctgcccaaggcacatgtgcagaagatggccttggaaacgctcactcagcctcatctcaagcctcatgaagattcagtcttctgtccctgaatggtgggtcaattggtgctgagggtgggggtggtggggacaagagttctaatttggccagagaggaagcaggtttatggtgacagccacagagctctagagtcagatttggcttccagccccagctctgctgaatctgagcagccagaccctggggaaagtcacttcctttctctgggcctcagttttcttccctgtaaaatggggataacaccttcttcaaagggacaggcacggggtgagggcatcataaacattggtttccttggctgagcctccatgacgcaatttgggctccgttatgagtcagctcaagtaaggagctatgacagtcatgcagggggagaggctgccccgcccccaccctgtgttgtaaactcatcagctggccagcctgcatgggaccctcaggggtca

SEQ ID NO: 141 - DNA, 3966 bp, Homo sapiens
acacacgccaaaactagaccaaccgtttctctccctggagagttgtgggtggaaccgtgagggatgcccagccacagggcaggccccgtacaccacctgcagcccagcaggtcagccttaggaccctctcccctggacctgttcagaaccaagttaaacttttggccaaagcacactcgctagaaaacttatttttttttaaaaaaaaaactttcataataaagtttattacctaaactgactttaaaaaatataaaataggattctgcacagcagaaaaataaagccagagaccctcccccaacccctggtttgtgcaaagatactgggtatatgtaaacatgaagaggtaggaggtgcgagttcaggtcctggctccagatacagttaagctgctacaacaaccagggggacccagagggagcaccaggagggggaggaccccctcaagaggtgagaaggggtctgcggcctcgtctccagccgagggcgggaggcgcctcgcccctacacccatccgctccctccaacccaggccggggagggtacccacatggttccaggcaagtaataacaaaataacacggcatcccagttaatgctgcgtgcacggcgggcgctgccggtcaaatctggaaggggaaggagctcaggtagtcgcggaggacggggttgagggggatgcgagccaggttctcgcggcccacggtggccacgatgcgctggcggcacagctcctgcagcggccgcacgcggcgctggcgcagcggggcccccagcatgcggcgcggcgccgccacgtagtgctccagcagctcgaagaggcagtcgaagctctcgcggctgccatccaggtgaaagcggccggcctgaaagtgcacgcggatgctcgtgggtcccgaggccatcttcacgctaagggcgaaaaagcagttccgctggcggctgtcgcgcaccaggaaggtgcccacgggctcggcgcgcagccgctcgtgcgccccgtgcacgctcaggggcccccagtagaatccgcaggcgtccaggagcgcgctggcgcgcgtgatgcgccggtaatcggcgtgcgaacggaatgtgcggaagtgcgtgtcgccgggggccggggccgggaccgcggggcacggccgcgggcgcgcgggggccgcgggcgaggaggaggaagaggaggaaggttctggccgccgtcggggctctgctgctgtggagactgcattgtcggctgccacctggttgtgtgctaccatcctacagaaggggccagccggaggggtgggccatagcgtccgggggtgcgctgcgggagagacaaagaggtgagctggggcgctgcggggccgggcaggtgtgcgccggccggacaactccggagggcggcgctcccggcggacccggccctagggggcgagcacggagcaccaagtccgcgcggatccgttcagcctcagtggacacagctagaaaatgggctctgtactccgcggagctcttcccggcgggtgggggctcggtggaggcggagtccggcctccgggcagcaccgagaggggggcgtggagagcagccggttctggctccagccgtccggccccggctcgccgccccgcgcccgccgcctgctggccaggctgggatccgcgcctggtctgggcgatttgggctagggccggagaaaggctgtgctgcgggagccccgcgcgcggggggcggcctgggtggggccggcgagggtcaggggcatcgcggccgcgaccccattctgcagcccccgaggctcgcccgactcctggctgccctggactcccctccctcctccctcccgcctcctcgcccagggcccggctcacctggcggcggggcgcgggacgccgcgggcgggacggcggggggctccggggcgctccggggcggctctcgcgcatgctccggggccaggagccgtgcagctgccacggccgcagctcgctctgttcggcgcccgcccctgcgccagtcttttaaaccggctcggaggcggggctggcgacggcgggaggccccgccccctgccggccccgcccccagctccacttttggtttctctttccgcggtggcgtccggcgaggaccgcttcggccctgtttccctctcttctggaccctcccgcggggccctctgcccgcctgttcgcacctgccccagcacccgcctctcgaggggctctggccccgaccctgcgccttccggccacttctcggacccctccttcggacttggcgaccccgattttgccccgctacctcgggttccactttctgccgccaggccctcttgggacgcgccctgacacaccctcctccgccccagctgtctccacacccgccgggggcagagccctgtcctctcctcccctgcagccagatccccctaggaggccacagaaggtgtccccaaccctgagcctgaccccacccgtagaccccctcctagcccctgctccacccgccgtcgacgccctcagtcgcccgccctgctgtcccgaagccccggccggccgcggtctctggtcttggctcgggcttcccgggaagcggcggcctgaccacaggcttcagaggaacccctggcggcgcgggcgcctccaccccggcccagttcctcggaaactgggcggggccgggcaaggtccctggtggcctcgactgccctccctgcgctcccactacccggctgcggaagaaactgaggctggggaggggctgggatttgcaatggcttgcagattgggagctctggacctggatctcgccttccccgtcttcattttggggagaggtgcagctggacgacatcaaattggagcccagtgaaaaaatggtgcattctcagacgtgatgaatccccaaacctggtttcctagccctcctctcccccgaccccttcctcatagatttccccctcctactgctccgtcaggcatctgcccttcaaagactgccttcccaccacacacacggccggggcttgggatggtgggcggtcggtggtcggggctgtaatttgcacacgtgtttgtgatttagtgattccgattgtcgtgcgaggccatggagtaggtgcctggctgctccgtgtatttttgaatgaaggcatgtgaggagccccagcatcacaaggggccacataaaaacctggctaggctgggcacttggttactggcctcacactgggacacactgccctctacagacagctctcagacggcttctctcctggaagccctggtgcccagtcccttcccgcctccctggccccacgatacctctttccccaggcagagcctaggtccttattaacctcctgaacacagggagtggcccagaatcagcccagcttagcaccccatcagtgccctgaatctgcatgtggccagggctggtggtggtcattggtgtagcctcctaggttgtgcgtgtgtgtgcgtgcgcgtgcgtgagggggtgagagaagatgcagaaccttgcctgcaccagaggtcaggtgtgtgatcattcgagagatgtccactgaacatctgctggaggccacactctgtggagggtgatggaatacaaggagacccagttccaaatctgcacctttctattcttgtgaccttgagcatgtaattaacctctctgccatggtttctttatctgtgaaatggggataataatagtacctctagcagggcgcagtagctcatgcctataatcccagcacttggaaggccaagacaggaggattgcttgagcccaggagtttgagaacagcctgggcaacaaagtgagaccccctctctacaaaaaaaaaaaaaaaaaaaaaaaaatagtacaaaaatcagccagtcgtagtggattgcacctgcagtcccagctacttgggaggctgaagcaggaggattgcctgagcccaggaggtcaaggctgcag

SEQ ID NO: 142 - DNA, 1101 bp, Artificial Sequence
  Chemically-Treated DNA
taattttttagtattatagaggaagtagattgatattaataatatttattaataataacgtgttttatgaaataaagattcgaaaggaattggaataaaaattttttgtattttatgttaagggggaaatattagaattaagtgtttcgcgtgattgaagatattttttcgtttaagaatgtaaagtatatttaataaaatagttggattataattttttttttttttttgggggtcgtggggtgggagttggggcgagaggtgtcgttggttttcgttgttttttttttgggaaggatggcgtacgttgggagaatagggtacgataatcgggagatagtgatgaagtatatttattataagttgtcgtagaggggttacgagtgggatgcgggagatgtgggcgtcgcgttttcgggggtcgttttcgtatcgggtattttttttttttagttcgggtatacgttttatttagtcgtatttcgggattcggtcgttaggatttcgtcgttgtagatttcggttgttttcggcgtcgtcgcggggtttgcgtttagttcggtgttatttgtggtttatttgatttttcgttaggtcggcgacgatttttttcgtcgttatcgtcgcgatttcgtcgagatgtttagttagttgtatttgacgttttttatcgcgcggggacgttttgttacggtggtggaggagttttttagggacggggtgaattgggggaggattgtggttttttttgagttcggtggggttatgtgtgtggagagcgttaatcgggagatgtcgtttttggtggataatatcgttttgtggatgattgagtatttgaatcggtatttgtatatttggatttaggataacggaggttgggtaggtgtatttggtgatgtgagtttgggttgaggttataggttcgagatgcgggggttggagtgcgggtgggtttttggggtaatgggaggttgtggagtcggcgaaataaaattagagttgttgtttttcggcgtttttatttttttttttggataaagcgtttatttttaatttgatcgataacgtttgttatttaaaagtttttaatttgtttgt

SEQ ID NO: 143 - DNA, 1101 bp, Artificial Sequence
  Chemically-Treated DNA
gtaagtaagttaaagatttttagatggtaggcgttatcggttaggttgggagtgaacgttttgtttagaggaggaggtagggacgtcgggaagtaataattttgattttatttcgtcggttttatagttttttattgttttaggagtttattcgtattttaattttcgtatttcggatttgtggttttagtttagatttatattattaagtgtatttatttagttttcgttattttggatttaggtgtgtaggtgtcggtttaggtatttagttatttatagggcgatgttgtttattaggggcgatatttttcggttgacgttttttatatatatgattttatcgaatttaaagaaggttataatttttttttagtttatttcgtttttgaagagtttttttattatcgtggtaaagcgttttcgcgcggtgaagggcgttaggtgtagttggttggatatttcggcgaagtcgcggcggtagcggcgggagaagtcgtcgtcggtttggcggagggttaggtggattataggtggtatcgggttgagcgtaggtttcgcggcggcgtcgggggtagtcggggtttgtagcggcgaggttttggcgatcgggtttcgggatgcggttggatggggcgtgtgttcgggttgggaggagaagatgttcggtgcgggggcggttttcgggggcgcggcgtttatatttttcgtattttattcgtagtttttttgcgatagtttataatggatgtattttattattatttttcggttatcgtattttgtttttttagcgtgcgttattttttttagaggaaaagtaacgggggttaacggtatttttcgttttagtttttattttacggtttttagagaaagaagaggagttataatttagttattttattggatgtgttttgtatttttggacgagggggtgtttttaattacgcggaatatttgattttggtgttttttttttggtatgagatgtaggaaatttttattttaatttttttcggatttttattttatgaggtacgttattattagtaagtattgttaatattagtttattttttttgtgatgttgaaaggtta

SEQ ID NO: 144 - DNA, 1401 bp, Artificial Sequence
  Chemically-Treated DNA
ttttattacgtagttttgggttttttttaggtttttttttttttatttcgtgattttttcgggtttttttttttttggtggtgtcggttgattttttgggttgtgggatgggggagaaaattttttaagagtaattttaaatcgttttttttatcggaggggaggaaagaaggagattggtttcgttttataattttggggtgggggattttttagttaattttttttcgcggacgggtagtttttgtattaagttttatttttagcgtttgtttatttcggggtttatataaattttacgggttttcggcggcggagttatatcgtggtttcgattttggttttagcgtttagtttcggttttcgtcgcggtgttgtttttcgtcggttttatagtagcggtgggtgttttattaaagtttttcgagtaggaggtggaggggcgtatcgggttggtttttttgttcggttcgggagttcgaggcgttacggggtgcgcgggatagcgagcgggcgggtgcgttcgggcgcggcggcggtagcggcggggattcggagttttaggttgcgttttgcgttcgggttagatattatttagtttttcggttgagtttcgattggttaaacggcgtcgtttttttttttcgtttttcgtttttcgtttttcgttcgttcgcgttatcgatattcgttcgaggcggtcgtttaaagggaacgtcgcgtttttttttcgcgcggggaatcgaggggcgttcggaatttttcgttttttcggggtttgtttttatttttttttttagggtttcgcgatatcgttttgcgagttttgcgtttttttggggcgttttggataggacgttcgcggtttcgaggggtgttttagttttagttttagtttcggggaatttcgcgtttcgcgttttttgtagaaatttcggttgtgggcgttggggcgggagggagcgagtgagaatcgtacgtttcgaggtttcgtttttttagtttttaatttttttttttttttttattttagtatttaagttttttgggagagggcgtgcgtttttcgggttatagatatattttttcgtatttttttgtattacggagtttgcgaacgcgagtatataatgaaatcgtatagagtatgggggttattggtttattttgttgttttaaatacgtcggtttaaatagagttcgcgtattgatttttttagagtttgtttaataggaatttaattaagataataatagtattttttattgatgaacgtttttagataacgttatattaagttatttgttttagttaggaagtttaggtaatgatagatttcgttaaagttatacgttttttagtcgattaaatagaaaaacggaaagagaaagaaagaaaat

SEQ ID NO: 145 - DNA, 1401 bp, Artificial Sequence
  Chemically-Treated DNA
gtttttttttttttttttttcgtttttttgtttggtcggttagaaagcgtgtggttttagcgaggtttgttattgtttgggttttttggttggaataagtaatttggtgtaacgttatttgggggcgtttattaataaaaaatgttgttattattttgattgaatttttattaggtaaattttagagaggttagtgcgcgaattttgtttaagtcggcgtgtttaaggtagtagagtaaattaatagtttttatgttttgtgcgattttattgtgtgttcgcgttcgtaagtttcgtagtgtaggaaggtgcgggaaggtgtgtttgtggttcgggaaacgtacgtttttttttagagaatttgggtgttgggatggggaggaaggggagagttgaaagttaggggagcgagatttcggggcgtgcgatttttattcgttttttttcgttttagcgtttatagtcggggtttttgtagagggcgcgggacgcggggtttttcggggttgaggttggggttggaatatttttcgaagtcgcgggcgttttgtttaaggcgttttaggagggcgtaggattcgtagggcgatgtcgcggggttttaggggaggaggtgaggataggtttcgggggagcggggagtttcgggcgtttttcggtttttcgcgcgaggaaaagacgcggcgttttttttaagcggtcgtttcgaacgggtatcggtagcgcgggcgagcggggagcggggggcggggggcggggggggggggcggcgtcgtttgattaatcgaagtttaatcgaagagttaaataatgtttgattcgggcgtaaggcgtagtttggagtttcgggttttcgtcgttgtcgtcgtcgcgttcgggcgtattcgttcgttcgttgtttcgcgtatttcgtagcgtttcgggttttcgggtcggatagaggagttagttcggtgcgtttttttattttttgttcggggggttttaatgagatatttatcgttgttgtggggtcggcggggagtagtatcgcgacggggatcggggttgggcgttggagttagaatcggaattacgatgtgatttcgtcgtcggggattcgtgaggtttgtgtggatttcgaggtaggtaagcgttgggaatggggtttggtgtaggagttgttcgttcgcgggagagagttgattgggggattttttattttaaagttgtgggacgaggttagttttttttttttttttttttcggtagaagggacgatttggagttatttttggggagtttttttttttattttataatttagaaggttagtcggtattattagggaaaaagggattcggggaagttacgaagtagaggagggaaggtttggaggagatttagagttgcgtgatggga

SEQ ID NO: 146 - DNA, 1968 bp, Artificial Sequence
  Chemically-Treated DNA
aggagattgcggttttttttttttcgttttcgtagttttttttttatcgtttttatttattttttattaaattcggaaattaaatttagttcgttaatcggcgcgggtagagtatagtttttaggttttcgaagttttttatatttggaggatgacgatttttttttgattatatttggagggcgtttagttgcgagttagcggggtatagttttttttttttggtttggatttttatttttttaatttaggaagattgaggtgtgtgtacgtaggtggggtaagttcgggttatcgacgagatttgttcgcgttttcgtttttattttggtgtttttttttttttttggtagttttttttttattcgtttatttttcgggtttatttcgatttatttggcggtgggtttttttttttttcgattttcggcggtgcggttcgttttttttttgatttcgcgtttggtcgtcgtgtttcgaaggatatgggttatagatcgtgcggagatattagtttcgcgggcggttgttttggtttaagtagaagaaaattatcggggttagcgtcgggtacggtagttttttcgtttcggagttcgcgttgttcgggtttttttttgttgatttcggtttcggtcggttttcggttttcgataggtcgttgagtcgtatgaagtttcggggttgtttcgatttttcggcgttcgttttattttttttttcgtttattttttggttagtcggggtttcgggcgattcggagaggggtaagcggcgttttttagaggaggtgtttttacgtaattcgggggtttcggcgggggtatatttggtgggttttagggcgtaagttgagttttcgggagggttagtttagtttagttttttttgttcgtaggggtatgttgttcgcggggcgtcggggcgtagggaaatttcgttcggcgcgagtttcgttttttttgcgtttttggggtttttcgggttagtcggtcggtttttttttattttgtttcggttttttcgtttcgcgtttaggtttcggttgtcggattcggcgttattttcggcgaagtcgtttcgagagggcgaacgaaaaggggggtagcggcggagggcgggggttcggggaggggcgtttttttttttcgcggcgtagttggagtcggatttaaggggttagtatcgtttcggtttcgcgttaggcggcgggggaggggaggagggatttttttaggggtgggtttggagggggtgggggcggttttttttttcgtttcgtcgcgggtttattgttcgggaggggcgggagatagtggggggtagtttcgggcgggagtggaggcggagatgtcgtcgtcgtagtcgtcgcggtggttgtcgttgtcgtagttgtcgtcggcgttatagttttttttttcggtcgagacgcggagcgagcgagcgaaagcggcggcgaggagtttcgcgtatattatagttggattttttattttaattttaagtttcggtttcgtttttagatagtttcgtagttaatcgtcggacgtcgtcggtttcgagtcgcgcgtttattggtcgttcgtcgtggtagtgcgggcgggagcgtagggagagaattatagttggaattcgatttttattttaaaatttaggatcgttttttttttttttttttgtttttgggttcgttttcgaaggttggagttaattagattgttgtttagatcgaatttatttttttattggttattggggtttttgggatttttttggagggagttcgaagaattagagtattcggcgcggggttttggcgtagggtcgtaggttttaggtattttttgtttacgatttttgatttgggtagtagtcggaggacggagtttagttttgggcgggtttggggaagaaaggagataggcggtacgggggtgagggttgttattagggggttttagagcgaaa

SEQ ID NO: 147 - DNA, 1968 bp, Artificial Sequence
  Chemically-Treated DNA
tttcgttttgggattttttggtgataatttttattttcgtgtcgtttgtttttttttttttttaggttcgtttagagttgagtttcgtttttcggttgttgtttaaattaggggtcgtggataaaggatgtttggggtttgcggttttacgttaggatttcgcgtcgaatattttgatttttcgggttttttttaagggagttttaaagattttaatggttaataggaaagtgggttcggtttgggtagtagtttgattggttttagttttcgggagcggatttaggggtaaggggaggggagaggggcggttttgggttttggggtgggaatcggattttagttgtggttttttttttgcgttttcgttcgtattgttacggcggacggttaatgggcgcgcggttcggggtcggcggcgttcggcgattggttgcggggttgtttgggggcggggtcgaggtttgaagttgaagtgagggatttagttgtggtgtgcgcggggtttttcgtcgtcgttttcgttcgttcgtttcgcgtttcggtcggaggaggaggttgtggcgtcggcgatagttacggtagcggtagttatcgcggcggttgcggcggcggtattttcgtttttattttcgttcgggattgttttttattgtttttcgtttttttcggatagtgagttcgcggcggggcgggggaaggagtcgtttttattttttttaagtttatttttaaagagatttttttttttttttttcgtcgtttggcgcggagtcgggacgatgttgattttttagattcggttttagttgcgtcgcgggaagagggggcgttttttttcggattttcgtttttcgtcgttgttttttttttcgttcgttttttcggggcggtttcgtcgaaggtagcgtcgaattcggtaatcggagtttgggcgcgaagcgaagaagtcggaataaagtgagggggagtcggtcggttggttcgggaagttttaggggcgtaggggaagcgggattcgcgtcgggcggggtttttttgcgtttcggcgtttcgcgggtagtatgtttttgcgggtagggggagttgggttgaattggttttttcgggggtttagtttgcgttttagagtttattagatgtgttttcgtcggggttttcgggttgcgtgaggatattttttttgaggggcgtcgtttgttttttttcggatcgttcggggtttcggttggttagaggatggacgaggaggaggatggagcgggcgtcgaggagtcgggatagtttcggagttttatgcggtttaacgatttgtcgggggtcgggggtcggtcggggtcggggttagtagaaaaggattcgggtagcgcggatttcgaggcggaggggttgtcgtattcggcgttggtttcggtggtttttttttatttgagttaggatagtcgttcgcggagttggtgttttcgtacggtttgtaatttatatttttcggggtacgacggttaggcgcggggttagaagggggacgggtcgtatcgtcgggggtcgggggggaagaagatttatcgttaggtgagtcgaagtgagttcggagggtaggcggatggggggggggttgttagggaggggagggggtattagagtgggagcggagacgcgagtaggtttcgtcggtaattcgggtttattttatttgcgtatatatattttagtttttttgggttgggggggtggggatttaggttaggagaagagagttgtgtttcgttggttcgtagttggacgttttttagatgtggttaggggagggtcgttattttttagatgtgggaagtttcgggagtttgggagttgtattttgttcgcgtcggttagcgagttgggtttggttttcgagtttggtggggggtgggtgggggcggtggggaggaagttgcggggacggaggaggggggatcgtaatttttt

SEQ ID NO: 148 - DNA, 746 bp, Artificial Sequence
  Chemically-Treated DNA
gcgttatttgttggtgtttttattattttttattatttttattaatgattttaatgtaaatataagtgggacggttttgttggattttttaggttttggaagtatgagggtgacgtaatttaggggtaaaggattttttcgtttattggttgttgtgtattggcggaattttttcgatttatagcggcgggaataagagtagtcgttggcgttgggaggtattagagatattgtttagtttaagtgtcgtcgtcgtttttatagggttttggttggacgtcgtcgtcgtcgttgttatcgtttttgatttaagttatttttcgttaggtgagtttcgagattttggtttaggtatatgtttttttttttttttttttttattcgttatttttttatttttttttttttttttttttttttttcgttagtttttttattagatagtttttgttagttcgcgatttatattagttcgtgttttaggttggatcggatagttttaatttttcggttcgttttttttgttcggttgcggattttagttttattttttcgtattgtatataggtttaggttagtttcgggatatttaggttttttagggatcgcgtatagagtttgaggtaagagaaatttttcgtagacggtgcgattagggacggcgtttggagtttagtagttttagggaaattggtttagaatttggaatagagcggatgggtggtaaataggtacgacgattgagg

SEQ ID NO: 149 - DNA, 746 bp, Artificial Sequence
  Chemically-Treated DNA
ttttagtcgtcgtgtttatttgttatttattcgttttgttttaggttttgaattaatttttttgggattgttgggttttagacgtcgtttttgatcgtatcgtttgcggaaagttttttttgttttaggttttgtgcgcggtttttggggagtttgagtgtttcgagattggtttaagtttgtgtgtagtgcgagagagtaagattggagttcgtagtcgagtaggaagagcgagtcgggggattgagattgttcgatttaatttagggtacgagttggtataaatcgcggattaatagagattatttgatgaagagattaacggagagagagggagaggaggaaagggagtgagaaaatgacgaatggagggagagggagggagagatatatatttgagttagaatttcggggtttatttggcgggaggtggtttggattagaggcggtggtagcggcggcggcggcgtttagttagagttttgtggaagcggcggcgatatttgggttgggtagtgtttttgatgttttttagcgttagcgattgtttttattttcgtcgttgtgggtcgggaaagtttcgttagtgtatagtaattaatgggcggaggggttttttgtttttgggttgcgttatttttatgtttttagaatttggaggatttagtaggatcgttttatttgtatttgtattgaggttattgatggaaatggtgggggatggtgggggtattaataagtaacgt

SEQ ID NO: 150 - DNA, 2098 bp, Artificial Sequence
  Chemically-Treated DNA
ttggagaaggggagggagatattttgttattttttaaataagtggtagtatcggtgattatttttttatttggttaattaaatgtaatttttgtttatgtaaaaaacgaatgtataattttttgttttaatttatcggtttatttttgggtcgatgtatggagaaataaaaaaaaatttttgtttttgaggattaagagagggtaattagtttatttttttagttagaatttgttttgtttttggaaagatttcgtcgtttttttaaggaattaggtcgaaggcgggaagggagaggtgacggggttatcgggattgttaaaattgtatttagagcgtatttaggcggtttagggattcgggcgggcgcgggggatacggcgggaaaggaatgtaagagttgcggttttatttgcgatagagaatttggcggtttttgtaatttttttttttttttgcgtcgtttgcgtttggcgttgtaaatcgttgtaaaagttattgttgggaacgcggcgtaatttagagttcgttttttaagcgcggttgttagtatttcgggaggtagcgtagggatggggttgagatggaatgaaggtaatattttgttttgagttaggggtaattaggatgtataaattttttttgtaaatagttagtgtatatattttgtaaggaaggcgcgttataggttgtaaagggagatataggtttttttagtagtagtgggttatgggtatcgagcggggatacggggacgttgtagtggttttggggttttattttgtatttgcgttcgtttacggttttttttttaaagtttttttcgattttgaagttgattttagtggtgcgtatcgtggtggatgttttgatgtagaattgattttcgttttggcggatttttacgtgcggtttggacgtagtcgttacggttattttttttagtatggcgtttatatttgcgtagggtgtattataggtttgggttacggggtttcgtcgttagtttcgggatcggtcgggtattggttatattttaattttagaaaggggttttaaaattgatttattcgtttttttgttttcgtttttgttttcgagatgagagattgaggtatagagagggtaagtgatttttttcgagttgtatagtgaattcgtggtagagtttggttttaaatttgagtttttaaatttaagtttttgattttttttgttttttagtaattttttttcgttatgatttagtacgagataaagttcgtattatcgaggagggcgttaaatatttagtaaacgttcgttgaacgcgtgggtttcgggatttttattagttttttcgagattcggtgcgtttgggagataaggcgatttattgtttcggggatttttttttgtttgggttttttaatttttattttttttaggatcggggtattttcgggattagggtattttcgggtcgtattttttcgtcggggcgcgttttttgtattagtttatttagtgttttgagtagttcgtcgaaattttcgttgttgcgtattttttaggtgtcggcgaagttgggtatggtggcggtggcggcggcggtaggtacggatagcggcggcgtagcgggtatattttgagttcgtaaggcggagattggcgttttgcgtttagcgttgcgcgttttgagttattaggagagcgtttttaatttcgtcgggtttttggtttcgtttcgtcggttttgttttcgttttttcgtagtttttattcggtatgcgtttaatttttagtttagttgtgttttagtttttagaggtgcgggtattcgttttttaattggggagtttttattttttttaggatatttatatttcgttttaaaatgggtggtgggagagggttagttgaaataagatgggtttggaggggataattgttgaagttgggcggtgtggatttgggttatgattttatttttttttttatttttgaatatgtttgaaaatatttataatataaatttaaagtggatagcgagcggggttattaggggatgggatttattttttttttattttcggtcgtatttattgggtgtgtttaga

SEQ ID NO: 151 - DNA, 2098 bp, Artificial Sequence
  Chemically-Treated DNA
tttgggtatatttagtaggtacgatcggaggtgaaaaaagagtgggttttattttttgatggtttcgttcgttatttattttaagtttatgttatggatatttttaaatatatttaaaagtagagagaaaagtagaattataatttaagtttatatcgtttagttttaatagttattttttttaagtttattttgttttagttaatttttttttattatttattttaaagcgggatgtgggtgttttgagggaggtggaggttttttagttggagagcgggtgttcgtatttttggaggttgaggtataattgggttgggagttgagcgtatatcgagtaggggttgcgggggagcgggggtagggtcggcggggcggggttagaagttcggcggggttgggggcgtttttttagtgatttaaggcgcgtagcgttgggcgtaaagcgttagttttcgttttgcgagtttagagtgtgttcgttgcgtcgtcgttgttcgtatttgtcgtcgtcgttatcgttattatgtttaatttcgtcggtatttggaagatgcgtagtagcgagaatttcgacgagttgtttaaggtattgggtaagttggtgtagagggcgcgtttcgacggggagatgcggttcggaggtgttttggtttcggaagtgtttcggttttggagggggtggaagttggggagtttaggtaggagggagttttcggggtaatagatcgttttgttttttaggcgtatcgggtttcggagaagttggtagagatttcggaatttacgcgtttagcgaacgtttgttgaatgtttggcgtttttttcgatggtgcggattttatttcgtgttagattatagcgaggagagattattggagagtaaggaggattagggatttaaatttggagatttaaatttgggattaggttttgttacgaatttattgtgtaattcgaggaaagttatttattttttttgtgttttagttttttatttcgaaaataagggcgagggtagggaaacgagtggattaattttaaggtttttttttaaagttagggtatgattagtgttcgatcggtttcgagattggcggcgaggtttcgtgatttaagtttgtggtgtattttgcgtaggtgtgaacgttatgttgaggaaagtggtcgtagcggttgcgtttaagtcgtacgtggagattcgttaggacggggattagttttatattaagatatttattacggtgcgtattattgagattaattttaaggtcggagaaggttttgaggaggagatcgtggacggacgtaagtgtagggtgaggttttagagttattatagcgttttcgtgttttcgttcggtgtttatggtttattgttgttggaggaatttgtgtttttttttgtagtttgtggcgcgttttttttgtagggtgtgtatattggttgtttgtagagggggtttgtgtattttagttgtttttggtttaagataaagtattatttttattttattttaattttatttttacgttgtttttcggggtgttaatagtcgcgtttaaagagcgggttttgggttgcgtcgcgtttttagtagtggtttttgtagcggtttgtagcgttaagcgtaggcggcgtaggaggaggaggaggttgtaggagtcgttaggttttttgtcgtaggtgaagtcgtagtttttgtatttttttttcgtcgtatttttcgcgttcgttcgggtttttgggtcgtttgggtacgttttggatatagttttagtagtttcgatggtttcgttattttttttttttcgttttcggtttggttttttaaaggaacggcggagtttttttaaaagtaaggtaggttttggttgggaaaatggattagttgtttttttttagtttttaagggtaagagtttttttttatttttttatgtatcggtttagggatgaatcggtggattgaagtaaggggttgtatattcgttttttgtatgggtaaaaattgtatttggttaattagatggaaaaataattatcggtgttattatttatttaaaaagtgatagaatgtttttttttttttttttaa

SEQ ID NO: 152 - DNA, 1105 bp, Artificial Sequence
  Chemically-Treated DNA
taataaatatgatgagtgaatgaatagttgtttaataaattaaagaatggatgaaggtaggtagttaggtataaggttttgtagataggtttggttgtgttaattaaatttttttttatgggtttttatatttagtaagtttatttttaaaaggataatgttgaagatataaatgtttataatgattatagcgatgacgggattcgagagaaaggtaaggcggaaggggtgaggtcggaagtcgaagtgtcgtagggagttagcggcgtttcggttgttatggagattaggagttttaaaacgcggaggtttttagcgtttcggattaacgagtgttaggggataatgtgggcgttaatttcgttattagtcgggtttagtagttttagttagtttatttggaagttttttttgtatttttttttcgtttattttgaggttttttattatagtttcgtagttcggtttcgtcgttttacgtagtttgcgttggcgtagcgtttcgagttttagttgtttcgtttgcgttttttttcgttgcgtatttaagatatttcgtatttgtttatcggcgtttttcgtaatttgtatttagtcgaggttatcggcgacgaagtgagcgtaagtttgattaaggttcgcggtagcgagaatgagcgttacgaggagttcgtggattagttgtagtaggtaacgtggcggtggcgtcgcgtttgcggacggtgtcggggttttagcgttcggtacgcgttagtatttgttaggtgttaggcgttgttttaggatttggggttgtagttgagaaatagtttattatgtcgaagtgggttcgatattttagtggaaggacgttttatttatatatatatatgcgtaaatattatatatattatataacgtgcggtatatatttgtagtatttgtttatatttttttagatatatacgttatatattgtatatattaatgaacgattgcggtagatcgttgaatagttgttttatggagaggataaagttaaaagttattcggttttggggtgtttttgtattataaattataattttgattgggttatttatgcgtagattttaggaagcgtgtt

SEQ ID NO: 153 - DNA, 1105 bp, Artificial Sequence
  Chemically-Treated DNA
gatacgttttttaaaatttgcgtatgaatggtttagttaagattgtggtttgtgatataaaggtattttaaagtcgggtgatttttggttttattttttttatggaataattatttagcggtttgtcgtagtcgtttattgatatatgtaatatataacgtatgtgtttagagaaatatagataggtgttatagatatatgtcgtacgttgtgtggtatgtgtggtatttgcgtatgtgtgtgtatggatagagcgtttttttattagaatgtcgggtttatttcggtatgatgggttgttttttaattgtagttttagattttggaatagcgtttggtatttggtaggtgttgacgcgtgtcgagcgttgagatttcggtatcgttcgtagacgcgacgttatcgttacgttatttgttgtagttggtttacgaatttttcgtggcgtttattttcgttgtcgcgggttttgattaagtttgcgtttatttcgtcgtcgatgatttcggttgagtataagttgcggaagacgtcggtgagtaagtgcgagatattttgggtgcgtagcgaggaggggcgtagacgaagtagttgaggttcgggacgttgcgttagcgtaagttgcgtgaggcggcggggtcgggttgcgaagttgtagtggaaggttttagagtaggcgagggaggaatataaggaggatttttaggtgggttggttggggttgttggattcggttggtggcgaagttggcgtttatattgttttttggtattcgttggttcgggacgttaaagattttcgcgttttggagtttttggtttttatggtaatcgagacgtcgttaattttttgcggtatttcggttttcggttttatttttttcgttttgtttttttttcggatttcgttatcgttgtggttattgtaaatatttgtgtttttagtattgtttttttaaaagtgagtttattaagtgtgaggatttatgaagaaaggtttaattgatatagttaggtttatttgtaaaattttgtatttaattatttatttttatttattttttaatttgttaagtaattgtttatttatttattatatttattg

SEQ ID NO: 154 - DNA, 3476 bp, Artificial Sequence
  Chemically-Treated DNA
atattttattaatttttttatagggatagtgttttaaaatacgacgatttttatatattaaggtgaagttgaatattgttgttgtttttttatcgtatgaaaggaattttttagaatttatttttagggacggttttttttatttcgaatttttgtatttgtagggaattttatggggtagaggagcgaagagggaataatgtttttaatttaaataaaattttaaattaagtttttagttttatcggtgggatagtttgcgggggaatttatttttttttttggtagtattgttttgggggcgagtagagagtggatttggagtttttttttttcgtttgatttttgttcgttcgagtagtattttcgggttagcggttgtagttattcgggcgtcgttaggggatgtagtggtttaaaggatcgagcgggcggtgtaggttggaattcgcggggcggattaatcgcggttcggttatagtttcgttcgttgattggtttttttaggtttcgttttcgttcgtttcgtttttttcgttggggcgtttcggagtcgcgtgtttttcgtttcggggtgtttattgcgtagagcgtggtttggagattcgcgagtcggggaaggtcgtcgtggagtttcgattagaggtcggggttggggtcggtgtagatcgagggttggtttttttgattgtgggagaaacgtcgggagtcggagtaagtagggtttcgggcggggcgaaaggaaaagttgggtttttagagtgaagatcgagttttttttgttcgtttatattgagcgtattcggggaatgagttagagttagtttttttttttttttttttttttttattttttattgttgttatttaagttaaaagtatatattgattataaatattaggtttggaaagggtagttgtaatagttgaagcgtgtttattttgggggtttgagagcgtagaaggttcgggaaagaggtgataatgataataaaattgacgcggacgttttagttaaaggtattttttttttattcgatgatttatttttttaggaagtcggttcgagaggtaaattttaaaatattttgatatgaaatattttgtttttttgattaatttaacgcgtacgtttttttatatcgatgcgtttttttaaatattttgtattagattttaataatgatttatgcgtgtttattttttaaaagtttgaaaaagaaaattttgtttatcgaaatgaattttatgaatggggtaggttggttgtatcgggacggaatcgtttattcgattcgaatgaattggtaggagtcgcggttatatttaaagggttagagcgcgcgttttttttcgttcgtttttaagtttcgcgggtttcgtttattttgttcgtcgttttttcgtcggcggtcgttttttgcggcgttttttttcggttagtggaggggcgggaggaggggcgggggtgcgcggggcggggggagaagttttggagcgggtttgggttgtagtttttttgtgtcggggattttgttttttattcgttagcgttaggtttttttttttcggcgcggatgatattagaatttttttaagttgcgtcgcgttatagttgtttgcgaatattgagttgtttggcgtcgttttgatatttttagaaagaatgtattttttgtaaaaaaaaaaaaaaaatattgagagagggagagagagagagaagaagagagagagacggagggagagcgagatagagcgagtaacgtaatttgatcgagtaggtcgtacgtcgtcgttttttttttttttttgtttttcgttatttaggttggtattggtgattttttttttttttaagtttgattttttgtttttaattatttgggaggatttaaattaattttaaaaatttaattttttttttttggaggttttttaggggttgagaggacggtttcgggatcggtgttttcgagggagggatttgttttttaagtcgtaatagttagttttgggatttgttttttaagttgtttagttagtttcggttttcgcgagtcgggttgtagggacgttttcgagagttttgcgggtttcgcggtcgtgttttcgcgttttcgtgcgggtttcgggtgcgttgggcgggcgggcggcgcgaggggaggttgtgttattttagtaatttaggggtttatttaggttttttatttttttttttgtaggtgattcgaggagggatttcgttttcgagcggttgaggatttcggtgtagaggagtttggttcgtagaattgtagagtcgtcgtttttttttataatttggtttcgttttattttgtcgtatttagtttttggatttttgtttttttttttttttttttgttaaacgatttttttaagataatttttaaaaaatttttttttttgtttatttttgttttttagtttttttatttttttatcgaaagtaaattatttaacgattttcgatttttcgacggtaggagtttttcgattttttaggcggatcgtttttttttttcgcgcgcgggtttcgggttcggcgagagggcgcgagtatagtcgaggttatggaggtgacggcggattagtcgcgttgggtgagttattattatttcgtcgtgtttaacgggtagtattcggatacgtattattcgggttttagttatttttatatggacgcggcgtagtattcgttgtcggaggaggtggatgtgttttttaatatcgacggttaaggtaattacgtttcgttttattacggaaattcggttagggttacggtgtagaggtatttttcgatttattacggtgagtgcgttcggggtgtcggggttttcgtcggtcgttttagtcgtttcggttcggggaggtcgggagggatttgagggcggggagaggttaagcgaaagtttttatttgtcgtttttggtttatttataaaaaaattggggttcggaaatgggcgaggaaggtttttggttcgtcgcgagagtgtgttttgaaagagtcgtagtaggcgtttttttcggttggtggttttggggtttggcgtttatttggcgggcgttaggtcgtagtttttcgtttttgcgcggttgtaggttttggggtggggggtttcgggatgtttttaagcgcggggtgttttggttttgttttcgcgggttcgggttttttgggttcggtagtcggcgtcggataagtacggttggaattcggtttttttaaaaaatttggcgttttttgttattcgttagttttttttaggcgggtgggcggggtggagggggttttttgttagcgttttttaattcgtatatttttagaaaggttttagagatttatttatttatatttttttttttgatttttttttagagttagtgtttttggtttttagataggtttttattttttggttttaggaatggaattttgatgttgaaggggtt

SEQ ID NO: 155 - DNA, 3476 bp, Artificial Sequence
  Chemically-Treated DNA
aatttttttagtattagaattttatttttgaagttaggaggtaagagtttgtttaaaaattaaaggtattagttttgggaaaaggttaaggagaagggtgtgaataaataggtttttggggtttttttgaaaatgtgcgaattgagggacgttggtagagggttttttttatttcgtttattcgtttagaaagagttagcgggtaatagggaacgttaggttttttggaagagtcgggttttagtcgtgtttgttcggcgtcggttatcgggtttagagagttcggattcgcggaggtagagttagggtatttcgcgtttggggatatttcgagattttttattttaaaatttgtagtcgcgtagagacggagggttgcggtttggcgttcgttaggtgagcgttaggttttagggttattagtcgggagaggcgtttgttgcgatttttttaaaatatattttcgcgacgagttagaggtttttttcgtttattttcgggttttaatttttttgtaaatgaattaggaacggtagatgggggttttcgtttgattttttttcgtttttaggtttttttcgattttttcgagtcgggacggttgaagcggtcggcgggagtttcggtatttcgggcgtatttatcgtggtgggtcggagggtatttttgtatcgtggttttgatcgagttttcgtagtagggcgggacgtggttgttttgatcgtcgatgttaaaaagtatatttatttttttcggtagcgggtattgcgtcgcgtttatgtaggagtggttgaggttcgggtggtgcgtgttcgggtgttgttcgttgagtacggcggggtggtggtggtttatttagcgcggttggttcgtcgttatttttatggtttcggttgtgttcgcgttttttcgtcgggttcggaattcgcgcgcggggagggagggcggttcgtttgggaggtcggggggtttttgtcgtcggagggtcgggggtcgttgaatgatttgttttcggtggggggatgggaaggttgggaagtaaaggtgagtaaaggagaaggttttttaaaaattattttggaggggtcgtttagtaaagagaagaaggggaagataaaaatttaaaaattgggtacggtagaataaaacgggattaggttgtaaaaaggggcgacgattttgtaattttgcgagttaggtttttttgtatcggggtttttagtcgttcggaggcggagttttttttcgggttatttgtaagggagagaatgggagatttggatgagtttttgagttgttggagtggtataattttttttcgcgtcgttcgttcgtttagcgtattcgagattcgtacgggagcgcggggatacggtcgcggagttcgtagggttttcggggacgtttttgtagttcggttcgcgggagtcggggttggttgagtaatttggagggtaagttttagggttgattgttacgatttggagggtaagtttttttttcggggatatcggtttcgggatcgtttttttagtttttagaaaatttttaaaagaggagagttgagtttttaaaattgatttaggtttttttaagtggttgggggtaaaaaattaaatttaaaaaaaaaaaaagttattagtattaatttgggtagcgaagagtagagaggaggaggaggcggcggcgtacgatttgttcggttagattgcgttgttcgttttgtttcgtttttttttcgttttttttttttttttttttttttttttttttttttagtattttttttttttttttatagggaatgtattttttttgaaagtattaagacggcgttaggtagtttagtgttcgtagatagttgtggcgcgacgtaatttaaggaggttttagtgttattcgcgtcgggggggaggagtttggcgttggcgagtaggggataggattttcggtataaggaaattgtaatttaaattcgttttaggattttttttttcgtttcgcgtattttcgttttttttttcgtttttttattgatcggaaaggggcgtcgtagagggcggtcgtcggcggaggggcggcgggtagggtgggcgaggttcgcggggtttgggggcggacgggagggaacgcgcgttttggttttttaaatgtggtcgcggtttttgttaatttattcgggtcgggtggacgatttcgtttcggtgtagttagtttgttttatttatgaagtttatttcgatgggtagaatttttttttttagatttttaaaaaataggtacgtatggattattattaggatttaatgtagggtgtttgggagagcgtatcgatgtggggaaacgtgcgcgttaaattgattagaaaaataaaatgttttatgttaaggtattttgagatttgtttttcgggtcgattttttaagagggtgagttatcggataaaggggagatgtttttgattggagcgttcgcgttaattttgttgttattgttatttttttttcgagttttttgcgtttttaagtttttagagtgaatacgttttagttgttgtagttgttttttttagatttaatatttgtaattaatgtgtgtttttgatttgagtggtaatagtgagggatgagaaggggggaggggaggaagagattggttttaatttatttttcgagtacgtttagtgtagacggatagaaagaattcggtttttattttagggatttaattttttttttcgtttcgttcggagttttatttatttcggttttcggcgttttttttatagttaaggaaattagttttcggtttgtatcgattttaatttcggtttttggtcgggattttacggcgatttttttcggttcgcgggtttttaggttacgttttgcgtaatgggtatttcggggcggagggtacgcggtttcgaggcgttttagcgagaggggcggggcgagcgggggcggggtttggagggattaattagcgggcgaggttgtggtcgagtcgcgattggttcgtttcgcgggttttaatttgtatcgttcgttcggttttttgagttattgtattttttagcggcgttcgggtggttgtagtcgttggttcgaaaatgttgttcgggcgagtaggggttaggcgggaaaagaagattttaaatttattttttgttcgtttttagggtaatgttgttaggagagggagtgggttttttcgtaggttattttatcgatggggttgagagtttaatttggggttttatttgaattggagatattgtttttttttcgtttttttattttataaaattttttataaatgtaaaaattcgagatagaagaagtcgtttttgaaagtaagttttgaaggattttttttatgcggtgaaggaataataataatatttaattttattttggtgtgtgagggtcgtcgtgttttaaaatattatttttgtagaaagattagtgaaatgt

SEQ ID NO: 156 - DNA, 2101 bp, Artificial Sequence
  Chemically-Treated DNA
aaaagtttgcgttggagaagatgttttcgatgcgggggagcgataggttttttggtggttggcgtggagaggggataaggagttattatacgtagttagggttaggttttggtgtttttgtttatatgagtggtgaatgtattgaggcgagtttatcgcgtttttagtataattttggtggtggtggtgatgttggattatgggagatgagagatttttagagtaaatagcgggagcgtattgggggtatttattatttacgtttgttttttgatttaacgcgtaggggttgtaaggcgtattgaagttttgtgagttatagtttggattataatttgagtgggagtaggatatttttaggttttcggaagtttggtaggtagtcggttgggggtggcgatggtggtggtggtggtggtggtggggcgaatcgatttgtatttttttgtttattaggaagcggtcgtcgtcgtcgtaattgttggcgttgatcgcgtacgattggaaagttgtaattttatggttcgaggggtaggttcgggttgagtaggttttcgagtcgttattgttaagtatggggtattttaggaaggagtttatttttgtattgtttatttgttattgagtgatttggttttgcgaagttcggcgtgattgtgttaatttttttattttttttatggggtcggagaagaaaaatgatatgaatgtatagtgcgtaagagggggggcgggagggcggaggacgttggaggaggggtacgtgacggtgttagttaatggttgagttttttgtaaaagtttgtcggttttcgtagtgatggattatcgttttagtggtatttaaattttcggcgtttcgtcgtttaggtgacgcgtagtcgtttttttaggtagtttaggcggcggtagttgttgcggcgattgtaaaggtcgatttggagtgttggagcgaagaagagtaaaagttgcgttttgcgcgcgttcgatttcgttgttcgtttcgttaggttttcgggaggtgggggttgggaggcgtttttcgttttcgttttttttttatcgtttaatgaaagatgaattggcgagaggtgagaagggaagagggttttcggttttttcggggcgggaattagtgggttagagttcgtcgggtggtcgtaagtacgtcggtttagttcgtagcgcgtttagtcggaaggcggggaattcggttgatatcgcgtttcgggtttttaggttattttttttgttttgaggttgggttgggagatcgtggggttgtgaggagcgtatagaatcgtggtggagggcgaggttgggttatcggttttttaagttcggaatggagggggaagagcgtagagggttggttgggaggaattcgggtgggcgtgaaggagacgagggtaagaaaagaaatttttttttttttaggagggttttcgaaattttttttttatagtttttttcgttattagtatggtaatgaggagtttttgtaattcgatttggaggggcggatgagttttggaaatttagagttcgtcggaaaaggtcgggggcggtcgggttttttttttttattttttttttttcgtcgtttttcgttttttttttttttttatttagttttgtatcgggagtttttcgggatgcggagttattcgatcgtcggatttttaggggtaggaggcgggggagagagatgacgttggcggacgtggttagcgcgggggtcgggcggtgcgttgtaggttatttgtcggcgttttgagatttaggagttttcgcgttttcgcgtgggttttatagggtcggtttatagttttaatatagtagttgaatttttttcgttgcgtttttttttttttggaggggaatgttagaagagagagagagtttttttttataattttttttattttgttgtacgtttagagtgggtgtgggggttggtaggtgggaggggcggtggataaatggttgatggtggacgggatattttattttaacgatatttttttttttttttaattggttgtgtagttgtttatgagaatttttaagtttttttttagagagatatatgtaaatttga

SEQ ID NO: 157 - DNA, 2101 bp, Artificial Sequence
  Chemically-Treated DNA
ttagatttgtatgtgtttttttagggaaggatttgaaggtttttataagtaattatatagttagttggaaaggggaggaggtgtcgttggggtaaagtgtttcgtttattattagttatttgtttatcgttttttttatttgttagtttttatatttattttagacgtgtagtagaatgaggaaggttataaaaggaagtttttttttttttttaatatttttttttagaaaaagaggaacgtaacgaagggagtttagttattatgttggagttgtggatcggttttgtgaggtttacgcgggagcgcggaggtttttgggttttagggcgtcggtagatggtttgtagcgtatcgttcggttttcgcgttggttacgttcgttagcgttatttttttttttcgttttttatttttaaaaattcggcggtcgagtagtttcgtatttcggagggttttcggtgtaaaattgagtgggaaagagaaaggggcggagagcgacgagagagggaaggtggggaagaagagttcggtcgttttcggtttttttcggcgagttttgagtttttagggtttattcgtttttttaagtcgaattatagaaattttttattgttatgttaatgacgagaggggttgtggggagagggtttcgaagatttttttggaagaagggaagtttttttttttgttttcgttttttttacgtttattcgagttttttttagttagttttttgcgtttttttttttttatttcgagtttgaagagtcggtggtttagtttcgttttttattacggttttatgcgttttttatagttttacggttttttagtttagttttagaatagaggaggtggtttgggaattcggggcgcggtgttagtcggatttttcgtttttcggttgggcgcgttgcgggttgggtcggcgtatttgcggttattcggcgagttttggtttattgattttcgtttcgagagagtcgggagtttttttttttttttatttttcgttagtttattttttattgaacggtggggagggggcgggagcgggggacgttttttagtttttatttttcggaggtttggcggggcgggtagcggagtcgggcgcgcgtagaacgtagtttttgttttttttcgttttagtattttaaatcggtttttgtagtcgtcgtagtagttgtcgtcgtttaggttgtttgggggggcgattgcgcgttatttagacggcggagcgtcggggatttaaatgttattaaaacggtgatttattattgcggaagtcggtaaatttttgtaggaggtttagttattggttgatatcgttacgtgttttttttttagcgtttttcgttttttcgtttttttttttgcgtattgtatatttatattatttttttttttcggttttatggaggaagtgagaaagttggtatagttacgtcgggtttcgtaggattaggttatttagtgatagatggataatgtaagaatgaatttttttttggaatattttatatttagtagtggcgattcggggatttgtttagttcgagtttatttttcggattataggattataattttttagtcgtgcgcggttagcgttaatagttgcggcggcgacgatcgttttttagtgggtaggggggtgtagatcggttcgttttattattattattattattattatcgttatttttagtcggttatttattagattttcgggaatttgggggtgttttatttttatttaagttgtggtttaagttatggtttatagaattttagtgcgttttatagtttttacgcgttaaattaggaagtagacgtaagtggtgggtatttttagtgcgttttcgttgtttattttggaaattttttattttttatggtttagtattattattattattagggttatgttgggggcgcggtgggttcgttttaatatatttattatttatatggataggagtattagagtttggttttggttacgtataataattttttgttttttttttacgttagttattaagaagtttgtcgttttttcgtatcggagatattttttttagcgtagattttt

SEQ ID NO: 158 - DNA, 4005 bp, Artificial Sequence
  Chemically-Treated DNA
aaatttttaattttatatggagaattttttttaattatttttttttataaattggttttttaagttagttggtttttatttgagatttttttttttatgtttttaattgtatggagtaattttttttattttttaaatttgtaatttatttttttggagtttcgagtttagttattaattacggtttttatattaacggagttttcggggtttttttttttaggatatttattcgttaagttcgtaaggtagaaagaattttgttttgcgttttttaaaatttgggtattgttttcggttcgtcggttatttattgtagtttttttaatttcgcgtatagcgggtattggtttcgggtttttttgttttttacgaagtttttagagtaattcggatttgggaaatttttttttagcgttgtttaaatatatttgggtcggtcgcgcgtttttaggacgtggatagggagggttttttcgtgtttaggaaagcgatcgggtattgtttttagttttttttaaatttgggtattgttttcgggttttttaacggattgggcgttgttttcggatattgaggattggtttcggggtttcgtttatttttagtagcgtttatcgtttgttatagagcgttcgatcgttcgttgtttgagtttttggtgcgttcgcggacgtagtttttagtttcgcggtgagtttttcgtcgcgtcgatttttttcgtttttgcgtttttgatcggttttcggttcgtatttgttgttgtttcgtcggtgttggcgttcgttttcggttgtcgtcggggaggtcggcgtggggcgcgggatacggttgcggatttgcggttggcggttgcgttcgtttttgttgggcgtttcgaaattcgcgttattttcgtttgtttattgtaaagattttatttgtggggaaagcggttggagggttttaaagtggggcgggtagggggttggggcgagggacgcggaggagaggcgttttcgtcgggcggtaaagtgtttttagttcgcgggtttaggatttcgtcgggaggcgcgcgcggagcgcgggcgaagtgattgatggcggagcgaggggggcgaggggggttaggggggcgcgagatttcgtcggcggttttttttttttggttaggtttaggcggcggggggttggcggggtgcgggattttgtgcgtggtttttgatttggtaaaaattatagtgtttttttatatcgtttaaattttttaggagatggtttttttagatttttaaattatcgtggtggttttcgagatcgaattcgcgtttatgtaagtttaacgtattgaggacggggtaattattatttagatattttgggtgggtcgtaaaggcgagttatttagacgtatttcggtgagttcggttatgtaggtaggatttgagttgtgtttttcgttttgatttttttttttttggcggtcggagttttcgtaggttttaagtttggtttagattcggttcggcgtagtcggtttttcgcgcgtttcgtatttggcgggggtttcggggtttcggcgcggtatcggggggcgttcgggatttggttgaggttttaagcgtcgcgtggtcggttttttttgttggggtaggtggcggttgcgcgtttcgttcgagtttaggggtttttttagtcgtaataattagtaaggatttttcgatttagttttaagttatttgtatttgtatttagacggggcgtattcgtagtgtagttttttggtggggcgttgggagttcgtttgtttttgtttgttcggagattttagtttacgagtataggtcgttcgggtattttagaaattcgggatggggtttttgaattttttagaacgggtatttagtatggttttggcgttttgcggttttttgttttttatttagtttcgttttcgcgtattttttagtttttgcgatcgtcgtttttttttcggggttttagggtttttagttcgtatttttcgtttcgtttttggttcgggttgcgggggcgggtcgggggcggggcgagggtttcgcgggcgtttattggcgcgggcgcgaggttagcgaggttcgcgcgggttttgggtcgcgggttggcgcgattataagagtcgggcgtgggcgttcgtagttcgtttgtttttcggcggagttgcgtgaggttcggtcggtttcggtttttttttttcggtcgttttcgttttttggtttacgtttgttcgcgttttgtttattagcgtttttatcgggtaaggcggtttcgcgtcgacgtcgttcgttgtttcgttgttgattttcgtttcgggcgtcgttcgcggggtcgcgtttcgtcgggtttgcggatttttcgtcgttttttttttatttattttaattttttttattttcgtttcgttcgaggaggcggtttttttcgtaggtagttcggttcgtaggtcgtcggcgttgttattttttttcgcgttttttttttagtttttttttcggcgcgtagtttcgggtcgttttttttttcgcgttgcgtttcggagcggtttcggtgtcgttatcgtttgtttttttttcgaggttcgggttcgcgacggtagagggtttcgtcggtttaaatcgagttgggcgttcgcggttcgggtgtagtttttatttcgttttttagttatcgtttttttcggtttttcgacgtggcgttttttttttcgtttttttgtgtttttcgcgttttttttggcgtttggtttcggttttcgttttttttttcgtaatttttttttcgttttttttcgttttttttagtttttagttttcgatttttttttttttttacgttcgttttttcgttttcgtcgaattaaagtggattaattatacgttttttgttttttttcgtgttgttttttttcgttgtgcgtttgttcgtttttcgttgttttttttttttttcgtttttttttcggttttttttttttacgtttattttgttttttttattatttttgtttttttttatttttgatataatagttgattttatttttcgatattttttttttttcgaaaagtataatatttggttcgttttagttcgaagatagttcgttttttttggataattagacgaattttttttttttttttaaaaaaaagttattttttcgttttgtttcgtcgtatattcggttttcgcgattcggttagagcggcgttggtagaggagtgttcggtaggagggttaacgttcgttgttcggtttgcgatacgtagtagggaggtgggcggtagcgtcgtcggtttttaggtaagcggcgtgtgcgggtcgggtcggggtcggggttggggcggcgcgggtttgcgtcggacgttcggtttttttttcgttcgttttcggttcggggtttgcggggttcggcggggcggttgagttcgggggggaggaggaggaggaggaggaggacggacggttgcgggtttcgttttttgcgcggagtttcgcgtttattttggcggcggagttgggggtggggtgggggcgtcgggaagggtcgagggaggtgtgaggtgtttgtaggggcgatttttcggtcggtttgtgggtgtagggggtgtcgttttatatgtgtgattcgtgttttgcgggttttggttttcggggtgttgggtaacgaggaggggcgcggagtcgtagaagtttattttggtatgttgacgcggtgttagcgagatcgcgagaggaagacgggggtgggcggggttaggatggagaggggtcgagttggtaggagttatggtagacgttatattcgcgatattttttttatattttttttggttttgttcgtaatatttttaaataggagtttcgggagagggggagaggggttgttggtttgaggttaagaagggtagagttttcgattcggagagaggtcgcggtttttgtttagtgggtagcgtggaagtttttatataaggaggtgggaag

SEQ ID NO: 159 - DNA, 4005 bp, Artificial Sequence
  Chemically-Treated DNA
ttttttatttttttgtatggaaatttttacgttgtttattgggtaggggtcgcggttttttttcgggtcgaaggttttgttttttttagttttagattagtagtttttttttttttttttcgggatttttgtttggaaatgttgcggatagagttagagggggtgtgggggagatgtcgcgaatgtggcgtttgttatgatttttgttaattcggtttttttttattttggtttcgtttattttcgtttttttttcgcggtttcgttggtatcgcgttaatatattagggtgggtttttgcggtttcgcgttttttttcgttatttagtatttcggaggttagggttcgtaaggtacgaattatatatgtgaggcggtattttttgtatttatagatcgatcgggaagtcgtttttgtagatattttatatttttttcggtttttttcgacgtttttattttatttttagtttcgtcgttagggtgagcgcggggtttcgcgtagggaacgggattcgtagtcgttcgttttttttttttttttttttttttttttcgggtttagtcgtttcgtcgagtttcgtaggtttcgggtcgggagcgggcggaggaagggtcgggcgttcggcgtaagttcgcgtcgttttagtttcggtttcggttcggttcgtatacgtcgtttatttggaagtcggcgacgttgtcgtttatttttttgttgcgtgtcgtaaatcgaatagcgggcgttggtttttttgtcggatatttttttgttagcgtcgttttggtcgagtcgcgggggtcgaatgtgcgacggggtagagcggggggatggtttttttttggggggggggggagaattcgtttgattgtttagggaggacgggttgttttcgggttggggcgggttagatgttgtatttttcgggggggaaaaggtatcgggaaatgaggttagttgttgtattaaggatagaggggggtagagatagtgggagagatagagtgaacgtgaaaggggggggtcgaagagagggcgagggggagagaggatagcgagaggcgggtaggcgtatagcgggagagaatagtacggagagaaatagaaagcgtgtaattaatttattttggttcggcgaaggcgagagggcgggcgtgagggggggagggagtcggaggttaggagttgggggggacgggagggagcgaagggaaggttgcgggagaaagagcgggggtcggggttagacgttaagaggggcgcggggagtatagagaagcggagggaagggcgttacgtcgaggggtcgggggaggcggtgattggggggcggagtggaggttgtattcggatcgcgggcgtttagttcggtttgggtcgacggagttttttgtcgtcgcgagttcgggtttcgggagggggataggcggtggcggtatcggggtcgtttcgggacgtagcgcggaaaggggagcggttcgaggttgcgcgtcggggggagggttggagggggagcgcgggggggggtgataacgtcggcggtttgcgagtcggattgtttgcggggggaatcgttttttcgggcgaagcggggatggggggagttgaggtagatgaagaggaggcggcggggaattcgtaggttcggcggagcgcgatttcgcggacggcgttcgggacgggagttagtagcgaggtagcgggcggcgtcgacgcggggtcgttttgttcgatggaggcgttggtgggtagagcgcgggtaggcgtgggttaggaggcgggggcggtcggaaggggggggtcggggtcggtcgggttttacgtagtttcgtcggagagtaggcgaattgcgggcgtttacgttcggtttttatagtcgcgttagttcgcggtttagggttcgcgcgggtttcgttggtttcgcgttcgcgttaatgggcgttcgcggagttttcgtttcgttttcggttcgttttcgtaattcgagttaagagcggggcggggggtgcgggttgggggttttggggtttcggggggggggcggcggtcgtaggggttggggggtgcgcgggggcgaggttgggtggggggtagggagtcgtagagcgttaaggttatgttgaatgttcgttttagagaatttaggggttttatttcgggtttttggggtgttcgggcggtttgtgttcgtgagttggggttttcgggtaggtaggggtaggcgggtttttagcgttttattaggaggttgtattgcgggtgcgtttcgtttgagtgtagatgtaggtggtttggggttgagtcggggggtttttgttggttgttgcggttgagggggtttttgggttcgggcggggcgcgtagtcgttatttgttttagtaggaggagtcggttacgcggcgtttggagttttagttagatttcgagcgtttttcggtgtcgcgtcggagtttcggagttttcgttaggtgcgggacgcgcggaaggtcggttgcgtcgggtcgaatttgggttaggtttggagtttacggaggtttcggtcgttagaggagagaggattagggcgggaaatatagtttaaattttatttgtatggtcgagtttatcggggtgcgtttaagtagttcgtttttgcggtttatttaaaatatttggataatggttatttcgtttttagtgcgttggatttgtatagacgcgagttcggtttcgggggttattacgataatttgggggtttggggaaattattttttggagagtttgaacgatgtaagaaagtattgtgatttttattaagttaaaaattacgtataaaatttcgtatttcgttagtttttcgtcgtttaagtttagttaaggggaaggggtcgtcggcggaatttcgcgtttttttggtttttttcgtttttttcgtttcgttattaattatttcgttcgcgtttcgcgcgcgtttttcggcggagttttaggttcgcgggttagaggtattttatcgttcggcgggagcgtttttttttcgcgtttttcgttttagttttttgttcgttttattttgggattttttagtcgttttttttataaatgagatttttgtaatgagtaaacgaaagtggcgcggatttcggggcgtttagtaggagcgagcgtagtcgttagtcgtaagttcgtagtcgtgtttcgcgttttacgtcggttttttcggcggtagtcggagacgagcgttagtatcggcgggatagtagtagatgcgggtcgagagtcggttaggggcgtagaggcggaggggatcggcgcggcggggagtttatcgcgaagttggaggttgcgttcgcgggcgtattaggagtttaggtagcgagcgatcgaacgttttgtggtaggcggtggacgttgttgaaggtgagcgagatttcggggttagtttttagtgttcgggagtaacgtttagttcgttggaagattcggggataatgtttaaatttgggggagattgggggtaatgttcggtcgtttttttggatacggggaagttttttttgtttacgttttgagggcgcgcggtcgatttaagtgtgtttgggtaacgttagagagaaattttttaaattcgagttgttttggggatttcgtaggagatagagaggttcgaaattagtgttcgttgtgcgcggggttggggaagttgtagtgggtggtcggcgagtcgggaataatgtttaaattttggggaacgtaaggtagagttttttttgttttgcgggtttagcgaatgggtgttttggaggaggggatttcggggatttcgttaatgtgggaatcgtgattaatgattaaattcgagattttagaaaaatagattataggtttgggggatgagagaagttgttttatgtaattgggaatatagagaaagaggttttaaataggggttagttagtttgggggattaatttgtgaggaggggtagttaaagaaaattttttatatgaaattgggaattt

SEQ ID NO: 160 - DNA, 1955 bp, Artificial Sequence
  Chemically-Treated DNA
aatgagatttatttaaaattggaaatttggtgtttggttttttaggagaataattaacgattgtgatttgaagtttattagggtattttgagagatttaattaaagatagagtgttggtttgaaattattaaaaggtaatagtaaaagggagagtaaaattttagttttaacgtaatttataaatttattttgtttttttcgaaagaggggcgcgggtgggcgcgttttttcgcgagtattttatttaagggggaattttttttagcgtacggcgaagttttttttcggttgttttatttggtagtttttttaggatttcggttagtttttaattggttttagtaatgtttagtcggagtttttttgggttttcgagtgggagaaaagtgagagtaggtgtttttttagcggcgcgtttcgttagggttcggtaggatttcgtttttaagtcgggaaaagttggtcggcgtttttttttttcgacgaagtcgttttagggttgtttttagaggacgcgcggtaggtaaagagaatgaatttgagcgtttacgaaacgttttgtacggttttcgggagttgggagaaataggtgttttttttcgacgttcgcgggcgacgtttgtcgtattttgttcgttgtcgcgtttttttcgggtatttttcgttttcggcgtttttgtttttatttttagtgttagggcggaggtagtttcggttcgtaggtaattattgttagcggagttcgtcggggagcgggggtgggcgcgtcggcggtgggcgggcgggcgcggcggggcgcgggtataaaggggcgcggcgcggggtttcggagtttggttttcgcgtagtatgttcgttagcgtttcgtcgcgtcgttcgcggtcgtcgtcgtagtcgttgtcgttgttgttggtgttgttgggtttgggcggtcgtcgtttgcgtgcggagtcgggcgacggcgcgtagatttgggttcgtttttcgcggttttttgttttcgaggtcgcgggttttttttagggtatttttttcgacggttttttttgggtcgtgggtagcgtcgtttattagatcgagggcggttggtagtagtacggtaagggtgcgtttatttgggatacgtttatttattattttttggtattttcgggagattttcggaacgttagtttgtcgttgggcgtttcgtcgtcgttgtagttcgttatcggggacgtagttagcgatagttataataacgtttttcgcgatacggaggcgttgcgcgagttcggggttatttattatcgtttttttatttcgtgggcgcgagtgttttttaatggtagcgcgggcgtttttaatcgcgaggggttgcgttattatcggcgtttgttggagcggttgcgggagttgggcgtgtagttcgtggttattttgtattattgggatttgttttagcgtttgtaggacgtttacggcggttgggttaatcgcgttttggtcgattattttagggattacgcggagttttgttttcgttatttcggcggttaggttaagtattggattattatcgataatttttacgtggtggtttggtacggttacgttatcgggcgtttggttttcggtattcggggtagttcgcggttcgggtatttggtggcgtataatttttttttggtgagtgcgaggggttaggcggagggttacgtaggggagatagagggtttttataggggttagggggaagtgtgggaattgagttttttttagacgaggttttatttggatacgtgtatgtggttatcgggggaaattgagtagttttgattttttttggaaggcgtggaattaggagagaaattttttagtgggtatacgagtgagtgttttttggagtttatttgtggaaaggaagcggtgataggttttcgtagtgaggaaagaaatttttttttttgggtgt

SEQ ID NO: 161 - DNA, 1955 bp, Artificial Sequence
  Chemically-Treated DNA
atatttagagaaaggagtttttttttttattgcggaaatttattatcgttttttttttatagatggattttaaggggtatttattcgtgtgtttattaagggattttttttttaattttacgttttttaagggaagttagaattgtttagtttttttcggtgattatatatacgtgtttaagtgaagtttcgtttgggggagatttagtttttatatttttttttggtttttgtggaggttttttgttttttttgcgtggtttttcgtttggtttttcgtatttattaggaggaggttgtgcgttattaggtattcgagtcgcgggttgtttcggatgtcgggggttaggcgttcggtggcgtagtcgtgttaggttattacgtaggggttgtcgatggtgatttagtatttgatttgatcgtcgaagtggcggaagtagagtttcgcgtaatttttgaagtggtcggttagggcgcggttggtttagtcgtcgtaggcgttttgtaggcgttggggtaggttttagtggtatagggtgattacgggttgtacgtttagttttcgtagtcgttttagtaggcgtcggtagtagcgtagtttttcgcggttggggacgttcgcgttgttattggggagtattcgcgtttacgagatggagaagcggtagtgagtgatttcgagttcgcgtagcgttttcgtgtcgcggaagacgttgttgtagttgtcgttggttacgttttcggtggcgggttgtagcggcgacggggcgtttaacggtagattggcgtttcgggagtttttcgggggtgttagggggtggtgggtgaacgtgttttagatggacgtatttttgtcgtgttgttgttagtcgttttcggtttggtaggcggcgttgtttacggtttagaggaagtcgtcggggaaggtgttttggaagaggttcgcggtttcgggggtaggaggtcgcgagaaacgggtttaggtttgcgcgtcgtcgttcggtttcgtacgtaggcggcggtcgtttaggtttagtagtattagtagtagcgatagcgattgcggcggcggtcgcgggcggcgcggcggggcgttggcgggtatgttgcgcgggagttaggtttcggggtttcgcgtcgcgtttttttatgttcgcgtttcgtcgcgttcgttcgtttatcgtcggcgcgtttattttcgtttttcggcgggtttcgttggtaataattatttgcgagtcgggattgttttcgttttggtattgggggtgggggtaggggcgtcgagggcgaggggtgttcgggaggggcgcggtagcgggtaaggtgcggtaggcgtcgttcgcggacgtcggagaaaggtatttgttttttttagttttcgggagtcgtgtaggacgtttcgtggacgtttaggtttattttttttgtttgtcgcgcgttttttgagagtagttttggagcggtttcgtcggggagaaaaggcgtcgattaatttttttcgatttgggggcgggattttgtcgggttttagcggagcgcgtcgttggggaagtatttgtttttattttttttttattcggaggtttaaagaagtttcggttggatattgttggagttaattagggattggtcgaaattttagagggattgttaggtgggatagtcgagggggaatttcgtcgtgcgttgaaagggatttttttttaggtgagatgttcgcggggagacgcgtttattcgcgtttttttttcgaggaagataaagtagatttatgggttgcgttgggattggggttttgtttttttttttattgttattttttaataattttaaattagtattttatttttgattagattttttagaatattttggtgaattttaaattatagtcgttgattgtttttttgaaaaattaaatattaagtttttaattttgagtaaattttatt

SEQ ID NO: 162 - DNA, 2091 bp, Artificial Sequence
  Chemically-Treated DNA
gggttagttttgagttagttataaaggaggttttgtggagtttagaaagtgtaaaaggaaaggtcgtttaggggcgggtaggaggggcgttgggttgagggtcggagaaatagattaagagatattcgtcgcgagggtgcggcgatttaataagcggtttaggtattttcgattgttttaaagttttcgtttttttttttcgtttggagagggggtttcgaggcggtagttggggttttatttattgtttgttgattaggggagggggaaagtaatagtgtttataaagggtttagtggtaaggaatgaaatagggcgttgtgtggagtaagtttttgggtaggtttgggaaggagaaaatagggtcgtcggggcggtaggtgaagttttcggaggcggttgggttattggggttagagagcggggaggcggcggcggtatttgagttttaggatttcgcgtcgttggcggggtttgggggatcgggtaggtaggggacgtattgcggcggtaggaggcgttttcgggtatcgttttcgggtagtttttgattcgttaggcgtagtgtttcggttagagtttagatgtagttgtaggcgaagcgtagcgtttcgattttggtgagtttggtgtcgtcggggaacgagggtagtacgttgcgtagtgcgtttagggtcgcgtttaagttgtgtatgcggttgcgttcgcgatcgttggttttgacgcgtcggtttttgcgtagcgagtgtagtagcgtttcggagcggattcgcgttcggtcgcggcgtcgtcgttttttttgttcgtcgttttgtgtttttggaattttagacgttcgggagatattgggcgcgtttttgcgggtcggcgcgggcggtttcgaagcggaggttgtttgttggagtttggtatagtttttttcgtcggtgaggaagtcggataggttattgtcgttgttgttggcgtagtcgaggtcggagatgtaggttttaaggcgggttggtatcgttgcgttgtgtaggatcgacggatagatagaaaggcgtttagagcgttgtagttcggattgagggtagagtcgttagggcgtatttacgtttttaatagtttggggttgttattttgtgttagttgcgggtgcgagagtttggaagggtgtaggggcgtacggagaatttggtttggttttttcgtttcgtttgtaggggttacgcgttcggtcggttttttgagtgatgtcgtcggcgattagattagttcgtgtgagtatcgagtgtggtatacgattggttttaggattttttaagtattcggcgtaataatgggcgttttttttttttgttattttcgttttcgcggtagttcgggtgaatggagcgaggcggtaggttattttcgtgtagcgttcgggtatttgtataatttatgttcgcgggaggtcgttatcgttttttttttaattcggagtgtgttcgtaattatcgtcggttaatcggcggcgtcgcgcggtttcgggagtcggttcgggttaagttggttagggcgtttttaggtagtgaaatagaggcggggtcggcgggcgattagcggtcgaggtacgttttttttggggcgggttgggcgtttttcgttggggtgggacggggaggcggggcgcgagcgcgaaagtgtgagtcgtttagtgagttgcggaaatttggagggtatttggagtttgggttcgtattttttttttagttgtttagtggtcgcgtgattttggacgagtaatttaatttttttgagtattgttttttttatttgtaagatgagataaaagtttattttgtggaggatgattagatataatgtttgtggaatattaaatgtgtagtattcgttgaatagggtgaaaattatttttaaatagattggagagtggttatgttagaggtatagggcgtagggtaaggataagtgtcgttgtttcgtttaggttgatgaagaaacgggaaagaatttgatttttatttggggagtgcgaagaggagagtggaaaagaggatcgggtgattttttaggttgttttgagttttggttttattttttttt

SEQ ID NO: 163 - DNA, 2091 bp, Artificial Sequence
  Chemically-Treated DNA
agggaagggtgagattaagatttaaggtaatttgggaaattattcgatttttttttttattttttttttcgtattttttagatgaaggttagattttttttcgtttttttattagtttgaacggagtagcgatatttatttttgttttgcgttttgtgtttttggtatggttattttttagtttatttgaaaatgatttttattttgtttagcggatgttgtatatttagtgttttataaatattatatttgattattttttatagggtaaatttttgttttattttataggtggggaaagtaatgtttagggaagttaaattattcgtttaaagttacgcgattattaagtagttggagaggggatgcgaatttaaattttaagtattttttaggttttcgtaatttattgggcggtttatattttcgcgttcgcgtttcgttttttcgttttattttagcgaggggcgtttagttcgttttaagaggagcgtgtttcggtcgttaatcgttcgtcgatttcgtttttgttttattgtttggagacgttttggttagtttagttcgagtcgattttcggggtcgcgcgacgtcgtcgattggtcggcggtaattacgggtatatttcgggttgggggaggggcgatggcggtttttcgcgagtataaattatgtaaatattcgggcgttgtacggggatgatttgtcgtttcgttttatttattcgggttgtcgcgggggcggaggtggtaagggaggggggcgtttattgttgcgtcgggtatttaaggggttttgaggttagtcgtgtgttatattcggtgtttatacgagttgatttgatcgtcggcgatattatttaggagatcggtcgggcgcgtggtttttgtaggcgaggcgaggaggttaggttaagtttttcgtgcgtttttgtatttttttaggttttcgtattcgtaattggtatagagtaataattttaggttgttgggaacgtaagtgcgttttggcggttttgtttttagttcgggttgtagcgttttgagcgtttttttatttgttcgtcggttttgtatagcgtaacgatgttagttcgttttgagatttgtattttcgatttcgattgcgttagtagtagcggtagtgatttattcggtttttttatcgacgaggaagattgtgttagattttaataggtagttttcgtttcggggtcgttcgcgtcggttcgtaggggcgcgtttaatatttttcgggcgtttgaggttttaggggtataggacgacgagtaggagaggcggcggcgtcgcggtcggacgcgggttcgtttcgaggcgttgttgtattcgttgcgtaggagtcggcgcgttaaggttaacgatcgcgagcgtaatcgtatgtataatttgaacgcggttttggacgtattgcgtagcgtgttgttttcgtttttcgacgatattaagtttattaaaatcgagacgttgcgtttcgtttataattatatttgggttttggtcgagatattgcgtttggcggattaagggttgttcggaggcggtgttcgggagcgttttttgtcgtcgtagtgcgttttttgtttgttcggttttttaagtttcgttagcgacgcggagttttggggtttaggtgtcgtcgtcgttttttcgttttttgattttagtagtttagtcgttttcgaagattttatttatcgtttcggcgattttgtttttttttttttaagtttgtttaaagatttgttttatataacgttttgttttattttttattattaggttttttgtagatattgttatttttttttttttttagttagtaggtaatagatggggttttagttgtcgtttcgggattttttttttaggcggagggaggaagcgggagttttaaagtagtcggggatatttgagtcgtttgttaggtcgtcgtattttcgcggcggatgttttttggtttgttttttcggtttttagtttagcgttttttttgttcgtttttagacggtttttttttttgtattttttgaattttataaaattttttttgtgattggtttagaattgattt

SEQ ID NO: 164 - DNA, 3003 bp, Artificial Sequence
  Chemically-Treated DNA
cgttcgtgttaggagttggtaagcgatgttatttgtgggggcgtaaaagttatttttttaaattttaaatttatatagtataattttttttagagttataaaaattataatttgtgtcgtataaggtaggaggttcggtttcggtatcgtttaagttttttcgacgcggcgagttggggaagggagttggggcgggggtttttcgtacgggtatttttcgttttacggttttttttttttttaggacggattacgagtttttttttttttggattgagggggaagtttttaataggaatatttgtagggagttgaacgttggtattttaaagttgtttgtattttgttttatttgtaggggtaggggttttatgaacgtgatagggtgagtaacgtatagagtcgagggtagtaaatgttaagattcgggggtggggtttgtatcgggaatttggacgcgggttttggtcggggtggaagaagaggttaggagtttcggaaggggggttatatttcgttagtaatttattatttcgtttgtaatttgtttttaagtttgtcgttttttgttttttttaattataataataaaaaaaaagtgtaaagaaatttagttcgttggaggttttgtatttggcgtgtaatttttttcgagtgtgagtatattgggcgggaggggtgggggttgaatttggtaggcggcgtttttttttgtcgtcgtcgtcgtttcgtagattcggggaagagggtgggggacggtcggggcgcgggggagggtgggttttgttttgtaattttttttttagtgcgagagcgcggcggcggtagttgaagattcggtcgtttagatgatgcggtggtgggggatttgtcggtacgcgattttttttcgggtttaaagtacgtatgcgtcgattttcgttatttcgttttttttttgaagtttttttagagggcgtgttaggtcgttcggtttcgagcgcggtcgagacgttgcggtatcgttttcgtgtaatttcgtagtttttttcgaagtgatatattttacgtaattcggttcggcggcggcggcgcgggttatttacgtagtttagtcgcgggaggcgtttcggtttttgtggttcgttcgttgttattcgtaggggtattggcggcgtttgtcgttaaggggtagagcgagttttcgagtgggtttggagtcgcggagttgggcgggggcgggaaggaggtagcgagaaaagaaattggagaaattcggtggtttttttaacgtcgttttagagagattaggtcggttttcgtcgttgtcgtcgttatttttttttttggggagttgggggcggggggcgaagcgcggcgtatcgggcggggcggttacgttaggggacgcgggcgtgtaggcgtcgtcggggtcggggtggcggggttcgcgcggagggcgtgggggtagggatcgcgggcgtttttgtagttgttaagcgttattaataggttgtatcgtttttcgcggtcgtcgcgcggtttttcgggcggggagcggtcgggggtggagtgggagcgcgtgtgtgcgagtgtgtgcgcgtcgtggcgtcgtttttattcgtttttcgttcggtttcgttcgttcgtttaggtcgggttgttttttcgcgtgttcgcgttttttttttttcgtcgtcgttttttttattttgcgagttcgtgtttgtgacgggagttcgagttatcgtttgttcgtcggggacggattttgtgggtggaaggagacgtcgtagtcggagcggtcgaagtagttgggatcgggacggggtacgcgcgttcggaagtttcgattcgcggagttcggcgcggggcggagggttggtttgttagttgggtaatgggagatttttttaaataggggttttttttttatttatggagaaaggggcggttgtttattttttttttttagaaaaaaaaaatatattttttttttgttttttttgcgtttataagttaagttgtttatttcggttgcggcgggaattgcggacggtggcgggcgagcggtttttttgttagaggtaagaagcgaggcgggagggggtcggggcgcgttcgttttttcgaggtgtcgttgggatcggagataattcgggggtcgtcgcgggagtttataaatttttattagtttcggggagtgggggtggggggttggtaagggtcgggcgacggtgacgaaagggtagcgcgcgggtgatagcgttggttttttttttttttttcgtcggcgttttttggtcgggtcgagggggaggaatttgatttcggacggcgagcggagttttgtcgaattgtcgggggtttcgagttttttatttttcgcgggaattttggttttttttttttttttagtgttttttttttttttaagggggtcgttcgatattcgttttcgtggtgaacgttaagtcgcgtttgaattttattcgttcgaatatttgtacgttatttcggcgcgttcgagcgcgagttcgggtttcggggaggtttcggcggcgtttggtttgaggagggcgtgcggggcgcgtgagggtgtatacgcggggggttgatagttcgtaatttggagattgcggtcggggtcggcgttatttgttagaagtgggcgtgtcggagagagaatttaataggtttggacgtattttttttttaatttcgtattttttttttttttttattttcgtttcgtaagggtttgttttttagcgtttgttgttaattcgcgtttgaggtttttaagtggttttttttagaaaaagattttttgtaatcgtaatggttttgtgttgcgatttttataagtgttagtttgacgtttggggttgtagatttgataattgtaattttgtaatattatttaagattttttggtatggtttattagggttaattaatgtggttgggttatttgtaatttaaattgggggataatgtcgtttgagggagcgttttcgtttt

SEQ ID NO: 165 - DNA, 3003 bp, Artificial Sequence
  Chemically-Treated DNA
aaaacgaaaacgtttttttaagcgatattattttttagtttaagttgtaaataatttagttatattaattggttttaatgaattatgttagagggttttaagtggtattataaggttgtaattattaagtttgtaattttaaacgttaaattagtatttgtaaaaatcgtagtataaaattattacggttatagggggtttttttttaaaaggggttatttagaaattttaggcgcgaattaataataaacgttaaagagtaagtttttgcggggcgggggtggagaagagaaaaaagtgcgaggttaaaagagaagtacgtttagatttgttgagtttttttttcgatacgtttatttttaatagataacgtcggtttcggtcgtagtttttaagttgcgggttgttagtttttcgcgtgtgtatttttacgcgtttcgtacgttttttttaagttaggcgtcgtcggggttttttcggagttcgggttcgcgttcgggcgcgtcggggtggcgtgtaaatattcgggcgagtaaaatttagacgcggtttagcgtttattacgaaaacgggtgtcgggcgatttttttggagggaaaggggatattagggggagaaaagaggttaggattttcgcgaggaatgagaggttcgaagttttcggtagttcgatagggtttcgttcgtcgttcgaggttaggtttttttttttcggttcggttaggggacgtcggcggagggagaggaagaggttagcgttgttattcgcgcgttgttttttcgttatcgtcgttcggtttttgttagttttttatttttatttttcgaggttaataaaagtttgtaggttttcgcggcggttttcgagttgttttcggttttagcggtatttcgggggagcgagcgcgtttcggttttttttcgtttcgttttttatttttggtagaggagtcgttcgttcgttatcgttcgtagttttcgtcgtagtcgagataaataatttagtttgtgaacgtagaaggagtaggagggaaatatattttttttttttaaaaaaaggaagtaaatagtcgtttttttttttatgggtggggggagagtttttatttaagaaagttttttattgtttagttgataagttagtttttcgtttcgcgtcgggtttcgcgggtcggggttttcgggcgcgcgtgtttcgtttcggttttagttgtttcggtcgtttcggttgcggcgtttttttttatttatagaattcgttttcgacgggtaggcggtgattcgggttttcgttatagatacgagttcgtaaaatggaggaggcggcggcggagggaagagagcgcggatacgcgaaagggtagttcggtttgggcgagcgagcgggatcgagcggggagcgggtggaggcggcgttacggcgcgtatatattcgtatatacgcgtttttattttattttcggtcgtttttcgttcgaggggtcgcgcggcggtcgcggggaacgatgtaatttgttggtgacgtttggtaattgtaggggcgttcgcggtttttgtttttacgtttttcgcgcgggtttcgttatttcggtttcgacggcgtttgtacgttcgcgttttttggcgtggtcgtttcgttcggtgcgtcgcgtttcgtttttcgtttttaattttttaggaaaaagggtggcggcggtagcggcgggggtcgatttggtttttttggggcggcgttaagagggttatcgagtttttttagttttttttttcgttatttttttttcgttttcgtttagtttcgcggttttagatttattcgggagttcgttttgttttttggcggtaagcgtcgttagtgtttttgcgggtgatagcgggcgggttataagagtcggggcgtttttcgcggttgagttgcgtgagtggttcgcgtcgtcgtcgtcgggtcgagttgcgtgaagtgtgttatttcgaaaggggttacggggttgtacggaaacggtgtcgtagcgtttcggtcgcgttcggggtcgggcggtttgatacgttttttggggaggttttagggaagggacgggatagcgggggtcggcgtatacgtattttgggttcgggggggagtcgcgtgtcggtaggttttttattatcgtattatttgggcggtcgggtttttagttgtcgtcgtcgcgttttcgtattgggagagaagttgtaaagtagaatttattttttttcgcgtttcgatcgttttttattttttttttcgagtttgcgaggcggcggcggcggtagaaggaggcgtcgtttgttaagtttaatttttatttttttcgtttaatgtgtttatattcgaaggaagttgtacgttaaatgtaaaatttttagcgagttggatttttttgtattttttttttattattatgattaaggaaagtagggggcggtaggtttaaaagtaagttgtaggcgaaatagtaagttgttggcgaaatatagtttttttttcgaaatttttgatttttttttttatttcggttagggttcgcgtttaagttttcggtgtaggttttattttcgaattttgatatttgttgttttcgattttgtgcgttgtttattttattacgtttataggatttttgtttttataaataaaataaaatataggtagttttaaaatgttagcgtttaattttttatagatgtttttgttaggagttttttttttagtttaaggggaagggaattcgtggttcgttttgagaaaggagagggtcgtggggcgaggggtgttcgtgcgggaagttttcgttttagtttttttttttagttcgtcgcgtcgggaaggtttggacgatgtcgggatcgagttttttattttgtgcggtatagattatgatttttgtgattttgggaaaggttgtgttgtgtgggtttagggtttggggaggtaatttttgcgtttttataggtgatatcgtttgttagtttttgatacgggcg

SEQ ID NO: 166 - DNA, 4313 bp, Artificial Sequence
  Chemically-Treated DNA
ttaattttaaagattttttttaagttttaagtgatagtaaaattttcgatttgacgattaaagttatacgggtttttcgtttttttcggcgagattttttttattggtattttaagatgttattcgggagattttaaagagttatttttttttttttttttatttagagtcgttttaatgggagtagggacggttttagtttttagttatttcgggtagtattatttttagtcgtcggttttttttgttttgttttttttttacggtagttgtgagaggtttaggggaaaatcgaggcgttttcgttttatttcgttgtttttttaaaaaaatgaaaatgaaatagtcgtttattttttggtataaagaaaaaggttttttaaatggttgggggttgttagggttaggggttttttaattttaattcgttattcgggacgtataatattttcgagtaaacgtttggagagtagtgtttcgatttcggtttagcgtcgttcggtaaaatttcggaagttcgagggtgtgagtaggaagtttttgcgaagcggcgcgggaggaggggtgttggaggcggagggtaggtttttttatcgttcgtattttattcgcggtgtttttgtttttgtttcgggattttttttttcgttattcgtagggttgtatttgagcgattcgggttaggggggcgtaaaattttattcgtttattttcgtattaacgtttttacgtaaggcgttttaaaatttaggtggagcggggtaatttcgttaaaagttatttttgtagggcgtatttaaaacggaacgtcgaggtttcggagtcgagcgcgtagttagattgaatcgggtgttcgggtgtcgtcgcggcgtttcgggtattttttatttttattgttttcgaggttttggttttcgtagtttagacgttcggagttttagggtcggcgttttttcgtttcgggtttcgtatttattttgaaggcgacgggtagcgttttgttgtagcgttagtgcgagggtagtacggagtagaggaagttggggttgtcggtgcgtacgagttcgtttgcgtggttcgttagtacgtttattatcgagcgtatttcgggtcgggcgcgtttttcgggttttacggtcgtttgcgcgtttagcgcgtcgttgttttcgtttattttgtcgtcgtcgtcgtcgtaggggaaggtcggggagggaggtgtgaagcggcggttggtgtttgggtttacgggaatacgtataatagcggtcgttagggcgtcgggtaggcggagacggcgcggtttttttcgggggcggtcggcgcgggcgttttttcggtcgtcgttgtcgcgagaagcgggaaagtagaagcggcggggttcgggttttagggcgtagggggcggcgttcggttattattcgttagggttcgttcgttgcgaggtttcgttggttcgacggtcgttcgtagtttgttcggttagtttcgtattttcggcgcgcggtttcgcgtgcggtcgtttttcgtggttgtttcggttgtttgggtcgcggcggggttcgcgcggggttgtgtcgttgtcgtcgtttttcgtttcgaagttcgttcgcggtcgtttcgatttcgcggtcgtagttttagaataaattttttagaattaagtggcggggtcgcggtcgttcgcgcggggttagtattttcggggttcgcggggcggggttggcggagcgacgcgtcgtatagttaatcggcggagtttttatcgcgggtatttcggtggcgttcgcggggaggaacggggtttgtcggaggtcgtttaacggggaggggcggaaggcgttatttcgcggaggaggttttagtgttatagtttagggttttcgagagttttgggagttcggggtaaatgttagaaatttgtttagaacgttcgggttttacggaaggcgtttttgtcgttttttttcgggtcgtagttttttgacgttggggcgtaattttttcgtttttttttttcgttggtcgcggtcgggtttttttagtttttgttgtttcgggtttgtgatttttgtaatttcgggttgggggtcgcggggttttagggtcggtgacgtcgtattgggagtcgttttaaagaggttatttatttttttcgtttcgtatattattttgatttaagagtttttattttatacgggattttgcgcgtcgtttacgttcggtcggcggtttttgttgtttttagttttgcgcggttttggttttagtttcggtggtttttgtgttaaatcggggataggcggaagggagttttttagggattttaagtagtttggggttaataattttttttttttttgttttttttttaaaataagttttaggattttgtaggtttcgcggcgtcgtttttcgttgtggcggtttgtggttttttgaaaaatacgacgaggtttgtaaaatgcgttttttttttttttttttacgtatgtaattacggttttgtatcgtgaaacggtacgcgcgtcggtggtaaaagaaaaatagtagtggttgtaaagttaagggttttcgtttttagaggagagaattttttttttttatgcgggtggaaagtggtttttgcgggtttaattttatttttttttgggttcgtgcgtttcggttgcgtcgtagggatcgcggatagtttcgttaaggtattgtttgttcgttcggtttcgggttttcgtttttatttttagtcgcgtggtttaattttttttgggttttattgtaaattatttttttttttttcgttttttaagtttgtcgagtagatttaggggtcggttatagttgggagggtaacgggaaagattaagttataattatttcgaattatcgttttagatatttttttagattttggggaacgaacgcgtgttgagttttttcgtcgttttggagacggggttagattttcgttgttttcggttttcgataggtgtaaaataatgaattttaagtttcggaagtaaagaagtttaggattcgacggtggtcgtaagattttattatggatttgatttttgtttagcgcgcgttatttcgtcgttgttaaacgaaattaagtttcgcgtgcgttttaggggcgaaggattttggatttatttcgattatcgggagagttggtttttatttatttcgggattttatagtacgtttttaggtcgtgtcgaaaggaaggacggtaaaggttttttattgaattttttaagagagtttgcgtttggtagttgtcgattgcggatttaggttcgcgcgttttcggacgcgttggtacgagtagtagaattagaggaaagcgagtgatttagtttgggcgtttttattttcgggaacgttttcgagaaggcgtagcgcgtcgtggttaggtagggttttggtcgggggcgggtaatacgtgttgttttcgagtaggttgcgggattatgattcgttgttttaggtggtggtaaattttatttgtcgaatggtttcggtttgtatcgtgttttttgtttgttttttcgtttgattttttttttttcgtttacgatgggtttatagataagtttttagagaatgagggatttttgtgggttttggtatttggcgtagggttcggtacggtttcggtttttcgtagggcgttggtttttcgtgggtattagatttaagggattagggcggcggggggagggggggcgggtgtaggtttttgggtttttagattaaggtcgcggggtcgtttggtaggtatagtggcgggagtcgtcgttagttggcgttcgcgttttgttagtcgcggaggtgcgggttcggtcgggttatagatgcgcgttagttgcggtttcgggtgtaggcgcggcgatcgttttcgaggagttgttttttttttgttatttatgcggttaggttttagataaatcgatggttttgtgttaaattaaggtcgttttttttatttttgataagatggacgttttttgttttcgcgtttttaggtattcggggaagatttatagaataggttagtttgtttttaatttttatttgttttttttttatttcggatcgataaaaattgtcgtttgtttgatgggagggagaatttcgatttttttatttggggtatgtagatattttcgtttttttttagttggtatggatcgtcgtttttttttttttttttattagatcgatggataaataggttagtttttttttagtggtttttatttaagagtattttaagttgtttatagtagggttaggaagtagaaggttag

SEQ ID NO: 167 - DNA, 4313 bp, Artificial Sequence
  Chemically-Treated DNA
ttgattttttgttttttagttttgttgtggataatttagggtgtttttaggtgggggttattggggagaaattggtttgtttgtttatcgatttgatggaagagggagaaaagacgacggtttatgttaattggggaagggcgagggtgtttgtatgttttaggtgggggagtcggagtttttttttttattaaatagacgataatttttgtcggttcgggatggggaggaagtaggtggaaattgggaataagttagtttgttttgtgggtttttttcgggtgtttgaaaacgcgaagatagaaggcgtttattttattagaggtgaggaaggcggttttggtttgatataaagttatcggtttgtttgagatttggtcgtatggatggtaaggaaagggtagtttttcgggggcggtcgtcgcgtttgtattcggggtcgtagttggcgcgtatttgtagttcggtcgggttcgtattttcgcggttggtagggcgcgggcgttaattagcggcggttttcgttattgtgtttgttaggcggtttcgcgattttggtttggggatttaagggtttgtattcgtttttttttttttcgtcgttttggttttttggatttggtgtttacggggagttagcgttttacggagagtcggagtcgtgtcgggttttgcgttaggtgttagggtttataagagttttttattttttggaaatttgtttgtgaatttatcgtaagcggagagggagaaattaggcggaggaataagtaaagggtacggtgtaaatcgaaattattcgataaatggaatttattattatttgaaatagcgggttatggtttcgtaatttgttcgagggtagtacgtgttgttcgttttcggttagggttttatttggttacgacgcgttgcgttttttcggagacgttttcggaggtgggagcgtttaggttggattattcgtttttttttagttttgttgttcgtgttagcgcgttcgagggcgcgcgggtttgggttcgtaatcgataattgttaggcgtaggtttttttaaaaggtttagtaagggatttttgtcgttttttttttcgatacggtttgagggcgtgttgtgaggtttcgaggtgggtaggggttagttttttcggtggtcggggtgagtttagagtttttcgtttttggagcgtacgcggggtttgatttcgtttggtaacgacgaaatggcgcgcgttgagtaggggttagatttatgatgagattttgcggttatcgtcggattttaagtttttttgttttcgaggtttggaatttattgttttgtatttgtcgagagtcggaggtaacgaaaatttagtttcgtttttaaagcggcggggaggtttagtacgcgttcgttttttagagtttagggaggtgtttggggcgataattcggaatgattgtggtttgatttttttcgttgtttttttaattgtagtcggtttttaggtttgttcgatagatttaggaggcgggagaggaaggggtgatttgtagtgaagtttaggagaggttgggttacgcggttgggagtgggagcggggattcggagtcgggcgggtaggtagtgttttggcgaagttgttcgcggtttttgcggcgtagtcggagcgtacgggtttaagaagaagtggggttggattcgtagaggttattttttattcgtatggagaaagaaaatttttttttttgaaagcgagggtttttagttttgtagttattgttgttttttttttgttatcgacgcgcgtatcgttttacgatgtaggatcgtggttatatgcgtaaaggaaaaaaagaaaaacgtattttgtaggtttcgtcgtgttttttaaagagttataggtcgttataacgaagaacgacgtcgcgaggtttgtaagattttgaaatttgttttgaggggagagtagagaggaaaggggttgttggttttaggttatttagggtttttaggagattttttttcgtttgttttcggtttggtataggggttatcgaggttgggattaaagtcgcgtagggttgggagtagtaaaggtcgtcggtcgggcgtggacgacgcgtaaaatttcgtgtggggtggaggtttttgggttagaataatgtgcgggacgagggaggtgagtaatttttttggggcggtttttagtgcggcgttatcggttttgagatttcgcggtttttagttcggggttgtagaagttataggttcgaagtagtaagagttggggaagttcggtcgcggttagcggggaggaggagcgaaggggttgcgttttagcgttagggagttacgattcgagagagggcggtaagggcgtttttcgtgggattcggacgttttaagtaaatttttagtatttgtttcgggtttttagagttttcgggggttttgggttgtggtattggggtttttttcgcggggtggcgtttttcgttttttttcgttgggcggttttcggtaggtttcgttttttttcgcgaacgttatcgaggtgttcgcgatgggggtttcgtcgattggttgtgcgacgcgtcgtttcgttagtttcgtttcgcgggtttcgggggtattaatttcgcgcgggcggtcgcggtttcgttatttgattttggaggatttgttttggggttgcggtcgcggagtcggggcggtcgcgggcgagtttcggggcgggaggcggcggtagcggtatagtttcgcgcgggtttcgtcgcggtttaggtagtcgggatagttacgaggggcggtcgtacgcggggtcgcgcgtcgaggatgcgggattagtcgggtaggttgcgggcggtcgtcgggttagcgaggtttcgtagcgggcgggttttggcgagtagtggtcgggcgtcgttttttgcgttttgaggttcgggtttcgtcgtttttgttttttcgtttttcgcggtagcggcggtcgaggaggcgttcgcgtcggtcgttttcgggggaagtcgcgtcgttttcgtttgttcggcgttttgacggtcgttgttatgcgtattttcgtagatttaagtattagtcgtcgttttatattttttttttcggtttttttttgcggcggcggcggcggtaagatgggcgagaatagcggcgcgttgagcgcgtaggcggtcgtggggttcggagggcgcgttcggttcgaggtgcgttcgatggtggacgtgttggcggattacgtaggcgagttcgtgcgtatcgatagttttaattttttttgtttcgtgttgttttcgtattggcgttgtaataagacgttgttcgtcgtttttaaggtgagtgcgggattcggggcgggagggcgtcggttttggggtttcgggcgtttgagttgcgggagttagagtttcgggagtagtggggatgggaggtgttcgagacgtcgcggcgatattcgggtattcggtttagtttggttgcgcgttcggtttcgggatttcggcgtttcgttttggatgcgttttgtaggaatgatttttaacggggttgtttcgttttatttgggttttggggcgttttgcgtagagacgttggtgcggaaatgggcggatggggttttgcgtttttttaattcggatcgtttagatatagttttgcgggtaacggagaagaggatttcgggataggggtaaggatatcgcgggtggggtgcgaacggtgaaagggtttatttttcgtttttagtattttttttttcgcgtcgtttcgtaaaagttttttgtttatattttcgggttttcgaaattttatcggacggcgttaggtcgggatcggggtattgttttttagacgtttgttcggggatattatgcgtttcgaatggcgagttgagattgggggatttttaattttggtagtttttagttatttagaggatttttttttttatgttagggagtaggcgattgttttatttttatttttttaagggggtagcgagatgaaacgaaaacgtttcggtttttttttaaattttttatagttgtcgtgagaaaagggtagggtaggaagggtcggcggttgggggtggtgttgttcgaggtggttggaagttgaggtcgtttttgtttttattaagacgattttaaatgggaaaaaaaggaagagtggttttttgaggtttttcgggtgatattttaaaatattagtgggggaaatttcgtcgggaggggcgggaggttcgtgtgattttaatcgttagatcggaggttttattgttatttggagtttaaaaggagtttttgaaattaa

SEQ ID NO: 168 - DNA, 2481 bp, Artificial Sequence
  Chemically-Treated DNA
tttttagttttagtttttttcgtagtcgggtagtgggagcgtagggagggtagtcgaggttattagggattttgttcggtttcgtttagttttcgaggaattgggtcggggtggaggcgttcgcgtcgttaggggtttttttgaagtttgtggttaggtcgtcgtttttcgggaagttcgagttaagattagagatcgcggtcggtcggggtttcgggatagtagggcgggcgattgagggcgtcgacggcgggtggagtaggggttaggagggggtttacgggtggggttaggtttagggttggggatattttttgtggttttttagggggatttggttgtaggggaggagaggatagggttttgttttcggcgggtgtggagatagttggggcggaggagggtgtgttagggcgcgttttaagagggtttggcggtagaaagtggaattcgaggtagcggggtaaaatcggggtcgttaagttcgaaggaggggttcgagaagtggtcggaaggcgtagggtcggggttagagtttttcgagaggcgggtgttggggtaggtgcgaataggcgggtagagggtttcgcgggagggtttagaagagagggaaatagggtcgaagcggttttcgtcggacgttatcgcggaaagagaaattaaaagtggagttgggggcggggtcggtagggggcggggtttttcgtcgtcgttagtttcgttttcgagtcggtttaaaagattggcgtaggggcgggcgtcgaatagagcgagttgcggtcgtggtagttgtacggtttttggtttcggagtatgcgcgagagtcgtttcggagcgtttcggagtttttcgtcgtttcgttcgcggcgtttcgcgtttcgtcgttaggtgagtcgggttttgggcgaggaggcgggagggaggagggaggggagtttagggtagttaggagtcgggcgagtttcgggggttgtagaatggggtcgcggtcgcgatgtttttgattttcgtcggttttatttaggtcgtttttcgcgcgcggggttttcgtagtatagttttttttcggttttagtttaaatcgtttagattaggcgcggattttagtttggttagtaggcggcgggcgcggggcggcgagtcggggtcggacggttggagttagaatcggttgttttttacgtttttttttcggtgttgttcggaggtcggatttcgtttttatcgagtttttattcgtcgggaagagtttcgcggagtatagagtttattttttagttgtgtttattgaggttgaacggattcgcgcggatttggtgtttcgtgttcgttttttagggtcgggttcgtcgggagcgtcgtttttcggagttgttcggtcggcgtatatttgttcggtttcgtagcgttttagtttatttttttgtttttttcgtagcgtattttcggacgttatggtttattttttcggttggttttttttgtaggatggtagtatataattaggtggtagtcgataatgtagtttttatagtagtagagtttcgacggcggttagaattttttttttttttttttttttcgttcgcggttttcgcgcgttcgcggtcgtgtttcgcggtttcggtttcggttttcggcgatacgtattttcgtatatttcgttcgtacgtcgattatcggcgtattacgcgcgttagcgcgtttttggacgtttgcggattttattgggggtttttgagcgtgtacggggcgtacgagcggttgcgcgtcgagttcgtgggtatttttttggtgcgcgatagtcgttagcggaattgttttttcgtttttagcgtgaagatggtttcgggatttacgagtattcgcgtgtatttttaggtcggtcgtttttatttggatggtagtcgcgagagtttcgattgttttttcgagttgttggagtattacgtggcggcgtcgcgtcgtatgttgggggtttcgttgcgttagcgtcgcgtgcggtcgttgtaggagttgtgtcgttagcgtatcgtggttatcgtgggtcgcgagaatttggttcgtattttttttaatttcgtttttcgcgattatttgagttttttttttttttagatttgatcggtagcgttcgtcgtgtacgtagtattaattgggatgtcgtgttattttgttattatttgtttggaattatgtgggtatttttttcggtttgggttggagggagcggatgggtgtaggggcgaggcgtttttcgttttcggttggagacgaggtcgtagatttttttttattttttgagggggtttttttttttttggtgttttttttgggtttttttggttgttgtagtagtttaattgtatttggagttaggatttgaattcgtattttttatttttttatgtttatatatatttagtatttttgtataaattaggggttgggggagggtttttggttttatttttttgttgt

SEQ ID NO: 169 - DNA, 2481 bp, Artificial Sequence
  Chemically-Treated DNA
atagtagaaaaataaagttagagatttttttttaatttttggtttgtgtaaagatattgggtatatgtaaatatgaagaggtaggaggtgcgagtttaggttttggttttagatatagttaagttgttataataattagggggatttagagggagtattaggagggggaggatttttttaagaggtgagaaggggtttgcggtttcgtttttagtcgagggcgggaggcgtttcgtttttatatttattcgttttttttaatttaggtcggggagggtatttatatggttttaggtaagtaataataaaataatacggtattttagttaatgttgcgtgtacggcgggcgttgtcggttaaatttggaaggggaaggagtttaggtagtcgcggaggacggggttgagggggatgcgagttaggttttcgcggtttacggtggttacgatgcgttggcggtatagtttttgtagcggtcgtacgcggcgttggcgtagcggggtttttagtatgcggcgcggcgtcgttacgtagtgttttagtagttcgaagaggtagtcgaagttttcgcggttgttatttaggtgaaagcggtcggtttgaaagtgtacgcggatgttcgtgggtttcgaggttatttttacgttaagggcgaaaaagtagtttcgttggcggttgtcgcgtattaggaaggtgtttacgggttcggcgcgtagtcgttcgtgcgtttcgtgtacgtttaggggtttttagtagaattcgtaggcgtttaggagcgcgttggcgcgcgtgatgcgtcggtaatcggcgtgcgaacggaatgtgcggaagtgcgtgtcgtcgggggtcggggtcgggatcgcggggtacggtcgcgggcgcgcgggggtcgcgggcgaggaggaggaagaggaggaaggttttggtcgtcgtcggggttttgttgttgtggagattgtattgtcggttgttatttggttgtgtgttattattttatagaaggggttagtcggaggggtgggttatagcgttcgggggtgcgttgcgggagagataaagaggtgagttggggcgttgcggggtcgggtaggtgtgcgtcggtcggataatttcggagggcggcgttttcggcggattcggttttagggggcgagtacggagtattaagttcgcgcggattcgtttagttttagtggatatagttagaaaatgggttttgtatttcgcggagtttttttcggcgggtgggggttcggtggaggcggagttcggttttcgggtagtatcgagaggggggcgtggagagtagtcggttttggttttagtcgttcggtttcggttcgtcgtttcgcgttcgtcgtttgttggttaggttgggattcgcgtttggtttgggcgatttgggttagggtcggagaaaggttgtgttgcgggagtttcgcgcgcggggggcggtttgggtggggtcggcgagggttaggggtatcgcggtcgcgattttattttgtagttttcgaggttcgttcgatttttggttgttttggattttttttttttttttttttcgttttttcgtttagggttcggtttatttggcggcggggcgcgggacgtcgcgggcgggacggcggggggtttcggggcgtttcggggcggttttcgcgtatgtttcggggttaggagtcgtgtagttgttacggtcgtagttcgttttgttcggcgttcgtttttgcgttagttttttaaatcggttcggaggcggggttggcgacggcgggaggtttcgttttttgtcggtttcgtttttagttttatttttggttttttttttcgcggtggcgttcggcgaggatcgtttcggttttgttttttttttttttggattttttcgcggggttttttgttcgtttgttcgtatttgttttagtattcgtttttcgaggggttttggtttcgattttgcgtttttcggttatttttcggatttttttttcggatttggcgatttcgattttgtttcgttatttcgggttttattttttgtcgttaggtttttttgggacgcgttttgatatattttttttcgttttagttgtttttatattcgtcgggggtagagttttgttttttttttttttgtagttagatttttttaggaggttatagaaggtgtttttaattttgagtttgattttattcgtagatttttttttagtttttgttttattcgtcgtcgacgtttttagtcgttcgttttgttgtttcgaagtttcggtcggtcgcggtttttggttttggttcgggtttttcgggaagcggcggtttgattataggttttagaggaatttttggcggcgcgggcgtttttatttcggtttagtttttcggaaattgggcggggtcgggtaaggtttttggtggtttcgattgttttttttgcgtttttattattcggttgcggaagaaattgaggttgggga

SEQ ID NO: 170 - DNA, 198235 bp, Artificial Sequence
  Chemically-Treated DNA
attattaagaaataagagtttttttttaaggtggttttatttgtaaggtaattttttagtttggtttttgagggttttattagagtagggttttggtgattttattggtttgttaagaaggttttttaaagttttgtgtaatgatgatgaatggtagggtaaaattatgttaatatattataaataattttaggtataattagtattttatattgtattttatttttttttataatattaattagatagataaggaaagtttaatggtaatgtgattttttttaataatataaataaagtgttattatagttaatggtggttaattggagatttattttattttaattatgtaaagtatttttatcgtattttttatgtgtatagtgttgtagaatattagttattttttaaaagtattaattttaaaaagagttatggaaggtaaaagtatgaaaattttgataataaaagtttttaatataaaaatatttattgtatatttatttttatttaaaataaaaataattttagtaatttaaaataaaagtaaattttggttgaaaatttaagaaggtataataaataaaattattaaaagaaagtttttttaaaagaaatgtaatttattgttatttttgtaaattttattttggagggaaaaatttaatgaaatgagttatttggagggtttacggtagattttttaaaaggtttaggtgtatggatttatttagtatttatattatagttttatttattaatagttttagaatttttttgattgagcgagtttttttattttttattagtgtttttattttttgtgtttagtttggtatgtagaataattttgttgttgataggatgtttgtttgaagttatttttttggggtagtttagatgaatcggtatagtattatttatgttttatttgattttttttgtatttagtgagatgtatattttatgattgtttaaggttatggttgtttaaagatatggaatagaatgatttattgggtaagattaaaggatttgtattattattttttaatttagttttatattgtttaattttataaaatttttttttgtattgtatataataaatatttagaaatagatgtttttattaattagaaggttgttattaaatattttgttagttaaaattgtatatttattgtttaaatatttattagatatatttagtttgaaatttatattattgtattgttaaacggagttgtattttgagttatgttgatgtttttggaatttaaaggtcgtattataaattttaaaatgttttttatttgttatataaggtttttcgtagaggtattatatcgattttaatataggttttttatatttttagttttggttattttgaaaatttttaattttttgatttaaatttgggaatgttttatatttaaaaatttttttttttttttatttttttaataaatgttttttgttttataataatttaaaaaaaaaatttttgaaagatttaaattgaataataataaagatttgattggaatttttataagtttgataatgtagaattgtattttttaaaaagtgtgtaattatatttgtttgggttgtaaaagatattatagaataagattagaatagaattttaattgattttttaatttttttagaatggtttgtatttcgagttttttttgtttttttttgatagagtaggtgtatattattaattataagtgataagaaagtttaaaaatagttattgttttaaaagtatagttggaattaattagagtttaagtttatatttataaattatttgttttaggataagtttaattataaatagagattatttgtaattttgtttatttaatagattttggaggtgaaagttagatatgtgttgggattgttttgattatttatatttaattttgattattataatttttttcgatttataattattttttaattttttttattgggttagagttatatttttagatgataagtatttattaataaaataaagattatatataaatggaaggttatatttgaatatagagaggtaagtgagttgtggagagaatgttggcgttttgtttgaattaaattgaggtgtttttttaattttgtgattttattttaaattttaagtttgttagagttttttgtttttgttaaattttcggagacgattcgatggttatagattttgttagttgttattttggttttttttgcggagtatttgtgtagcgagggattgggagggtcgaggaggtttttagatgtttttttttttttggggttttttttagagtttttgtttttaatttggaaagtgtatatattttatttaattttgattttggttagtgtaaagaggagtatatatagaggattgtttttttatttataaagagtagttaagatgtagatgtgaatttttttttaatataaaatagggatggttttttgttgtttaattgtaaaataattagatataatgaaaaaaaagaagaggagaaaaaaatgattagttgaggtttttatatatatttattgtttttaatatgtttttaataataaggaaaatgtaatattaattatttttagagtaagtgtagttataatattgtatagttttggggttaagaggttgggtatatttattgttattaaaattaggtaataaaattttatagtaaaaggtagttagttagtaattagttttcgtgattttttaatatatatatattttttaaatattttgtgaatttcgtttgaataataataaaagataaaataggttttatattaaaaacgtttacgttttttattgttatttttaaagtagtttggaggattttattacgtggagtatattgtaaattgattttattaaaatgattttggtaggatagtagtataggattggatattttatatttattattttgataatgtaaattttttataaaataatattttgtttaaaaattagaattatttaaaggtttgattattttgttttttgaggttcgtcggggaggtttggttttatattataggttttttgtttttttggtggagcgtaagtattattgtattttaggaagattttgaaggatagttatgagaaagttttcgcggaaggagggtaggagggttttgggtgggtttgtgttgaaataggttacgtaaagtaattttttaaaggttaaattattatagatttgaatttgttggttatttgttatttggatttttaattgaatgaattttatgggtttaattaaatatgtatgtaattttgaatattatgaattaaatgcggaattgtttagggacgaggaaatttttaagaaataaggttaaagggataatagatataattgttataataaataattttgttgacgtggaaatgtatatgatttggttgaaataaagttttttagtggttagtgatatttaggttttttttaggtagttgagatttagggtttattttatttttttagaatgtttttgaagaattaagagataaaaattttaaatagaaaacgattatttttgtttataaatagtgtataggttataattaaatataattaaaaataaaaaaacgttgagatgtatgtatttttttaaagtagttttcgaaatattaattatagtattaaatattgaatagagtatattttaaagttaatatagataaatggtatataatgtaataatgttatagagttattttattaatgttttaaggttgattttaaattggaagaaaaaaaaattttttagtttatttgttgaagatgttattttttttgttatttttttatagttttttattattgattttttttttaatgttttaggatgtatagataatttttatattttatatttggaattttttttttgttaggtttttaaataaaattaaattatagtgataagataatgttttatatgtaattttatagataggggttaattaatttatgatattttattttaatgttttttttaggatttgtgattttttttaaagttatttaaagttttgttttaaatttataggtgggttaaggttatatagttaacgtgttatgtgttatagttaaaatgggtcgtggttattgtttttttttacgtttttagtttttattatgtttttttgataggaagggtttagggtttttgttttttttttttatagtgatatatgttttaagaagggtcgtggtttttatgttttacgtgaaaacgggtttatttggagggttttagggtgataggtttagttatatttttttattgtttttttttgatagtggaattttgagttttattagtttttagatattcggagattatattgttttgttgattatttttggaggaggttagtgagggtttcggtttagttttaggattaggtttttaagttgggatataggtaggttttgcggatttcggttttttaaaagtaggtatttgtggcggtttgatgttttgggtaattttagtttttttgatgcggaagttatcgaaatgtttatttttttaagttttagaggattttgttttttatttagatagagttagtattgggagttggggggtgcgtatttaaaatatatgaatatatataattagggtttaaggtattggatgatattgtataaattgttaaaatgtttttttcggtataattggtagtttaaaaaaatatttttttatgatttaagggtattttttttatcgttgtttttcggcgtggaaattttagtgggtattaggtttatttgaagtttttaatttttttttttttattaggtatgtattatgtgagttatatgtaaagagttttttttttaggttagggaggtatggatttttttttataggaattttttttttgttaatattatagtttttagggtaaagaaatgtaagtgaatgaatattttttttttagtttttagtagttagaaagttagtttttttaatgattaggttttttttttattcgtttgttttttagatggtgattcggttaataatatggaaagcgaatttatgtttataggtatagaatatttaggtggagttatacgaagcggtgtttggtaattagtggtcggatttttaaagataggagttttgatgggattgttttaaataaataaattttttttttttaataatgtaaaaaataaatgatatttttttttggtagtaaatagttgattcgacgttttgtttgaagattgttaattgttgtgtgtgtgtgtgtttgtttgtgtgtgtgatgtttatatgtgtgttatttttttttaaatagtttgtagttttgttttatggtatattattgataatgtatattatttttattgttttagtgaattttttgtatatttgtttggggtaggtatgttgattttatttgtggtttagataggtatttagggtgatgtaagtttttattagggttaaattgagtagagtttttagagatagttaggagaaattaaatagaggtcgtatgttggggtcgtatagttttataaaggtattttgtagttgggggagaggagggaagaaaaagaaagagtattagagagagagtagagaatgttattttatagagaaagaggtattttgttagggtagtttgggtatttttagaagggtgagaggggaaaaggtaaatgttttttggaggttatgatttagaaattattgtttttattaatttaaggtatatttattgagattttttttacgtgttagttattttagagatatagtagtgtataaaatagattaaaagtttttattttacgaagtttttattgagtggaatagtatagatagtaattaatataaattattatatggtgtaggagagagtgttaagggtcgaggagaaaaatagtagaggtagttagaaaatattagaggttttgtaattttagttagtatgtttatttataaaagtaataaaatttagtaatgatgatgatcgttatatttttcgattgagtgttgatattttattaaatgtttgatatgtattattttagtttttgtattaaattttttttttttttttttttttttagagataagagttttgttttgttgtttaggttgtagtgtagtggtgtaattatgatttattgtagtttcgaattgttggatttaagagtgatttttttgttttcgttttttgagtatttaggattattatgtttggttaatttttaaattttttgtagagatagggttttattatattttttaggttggttttgaatttttgggtttaagtgagttttttgttttagttttttaaagttttgggattaaaggtatgcgtttttttatttagttaattttttgtattaattttatgaagttattttatttgtttttgttttgaagatgaaaaagttgagaatcgtagggaataagagattttttaataagtggtagagttaggttttgaatttagatagaaattagtatttttttttttgttgatgttttggcgtggttaacggtagttttatgagagtatttggttagttaagggtttagttagtggaggggttaagggcggttttgattggtgtagtgttaatttttaaggttaaggtttttttggggaaagggagttgttagggggttttttttgggggtggttagattggacgattataattttgtatttatttaaattgtggattttataaggtaggagattaggggtgtgttattggatgtgtaggtttttgagagataaaaagtgttttttttttatttttatttttttattttaagtcgggtttgtagtgtgttgtagtaaagtttattttttggatgggtttggattgagtaaattattaattgtttattttttagattttggggagattatgttttatatttgggtttaatgagtatttggataattttttgaatgaatatttgaatatataaattagtaaatgaattttttttatttttgatttatttaggatgaagaagaaaataagaatagttttatattatttttaataattttgatttaaagtatatagttttattataggaaatagtaatatattatgattttggatatcgttgttgggaggggttttaatagtgtatagaggggttttttttttttggggtaagggttgtagtagtgggattagggattttttttgttttttttatgttgggtatggttgtggtgtattataggtgcgtagtaaatgtttgtttatttaagttttttgaatataattattggtttttggtttaatgttttatttaaatgtttatgaatttgtttgaaattattttttttatatgtaatagtttttgagaattttgaggtagttttgatgaggatttaaagtattgttagggtaattttttatattattaaatatagatttatataattatttttatgatatataaaatgtgttatattttaaaaaatttatgtttatagtgtttaaaatttttgttattataaataatattatgatatatttttgtatataaatttttgtttatttgtttagttgtttttttgaaataaatttttagaagtgattttagttaattagttattaatattgtttttagatattatgaagggtttgttttgagttatttttatatttttatggattgttttttaattaatgttattttttataaaaggtaggtaagaatttagggcgagggttatattgagagtgattttgttttttaggggatatttggtaatgtttggaagtatttttagtggttatgatttggggtgagggtgttattggtatttagtgggtagaggtcgcggatgttgtttaatattttataatgtatagggtagttttttaatgttaatagggtcgaggttgagaaattttggtttataagatgttttgtaattatagattatagaagaatagatgatttattttgtgtgttaatagtattggttaaattagtataattagttagtttagattagcgattgttaatttagtgggttttttgtatttttggaggtttttggttaatttttattaggagagggcgtaagggttttttttttttttttaaatatttattgttaaatatttttaaattttagtgttagaaaagcgaggtaatagacgtatataaaatgtgtgtttagtgtttttagtatagagttaaggtataattatgattgtttgttaagatgtatatttttttttatataagtagggattagtggggtaggaaggagttaggatttttttataagttagaattttgttttttttagggagtaatttaagatattatagatacggttgtaaatgttaattagtttttttatttatgtttttttttttgagggatgggtaggttgaaatttttaatagtttagttaaaagatattttaaatttgttagggtattggtaataggttgtttgtaatttggtttgatattgagaaggttagtggtcgggttttgaatttttttagtaattaatagagttttgtgtggtaaaatttgaattagattaagtttttgattatttgttttgtttggatttgaagttattttgggaaatcggaggatgtagggatatattttagttggtatttttttttagttggtttggtatatagtgttggagagtagaagaaatgttgttttaaatatttttatttttttagagttggaataatttttttttattatttttatttttatataaataatagtgttttttatgaatttaataggttatttttgatatgtattacgtagaataatgttatttttagagtgagatgagttaaattagtagtttttggtttaaagttttagtatagagatgttgttgttattttagggggttgagaagggtatgggatttggaggaggagtgtgggtgaattttggttttgatattttattagtttataatttttagtagataatttagtttcgagttttatttattttatttatagttataaaatttattattgtgaagattaacgtaggttatttaaagttatttgtaaattggatatagaaagtgagttcgtggtagaataaatattttgtttttgtttgtttttttgtagatttgtttcgtatttatttaatttgttttttttttaagaagttttgttgagtttgtcgttttgtagaagtaatttttttttttagttttttgatttgaggatagttcgtaatttttataggaattatgaattaaaatgtatatatttcgtgttttggttaaagatgggaagtgataatataatgtttatttatttgtttttttttatatattattagagtgtagggttagagggtaagttatttaattttttggaggttggagttggtttttaaattttgtttttttataattttaaagtgtaaaggagattttgcggtttcgggattaaaatgatttgaaagtttttttcgtagaaagtttttttgattttttaaatattttgattggggcgattttcgaagtttgtttgaatagtttgttattatttgtttgagtttgaaagttgttttaaataaatatatgtttattttatgtattaaaagtaataaagagggaaaaagaaaatttgggtcgttatgtgattcggataaaattttagtttatatatttaggaagttttgtgttttttgtttatgttaggattggtaagggtttattcgattttacggattataggtttatacggaaaggttggtatcggttttttttatgaggaggagatgggtagggttttagttttggtggttttgtttatagtggtttttttataaatttttaatttagaggttatagaggatttgagttttatttagggttggtttaaggggataggatggttaaatttttagtcgtagttttgttgtaggtttggaattaggttaggtaggtgtggacgggaatagattagggttaagatttttaaatttagtaaaggtgtttttattttttcgggttatggagtatttttatttgggaggtagttattttttaatatttttttttttcgtttagaatttttaagaatttttttttttttttttttttgagatggagttattgttatttaggttggagtgtagtggtttttaggtttaagtaatttttttgttttagtttttcgtgtaattgggattataggtattttttattacgttcggttaatttttgtatttttagtagagaaagggttttatgttggttaggttggatttaaatttttggttttaagtgatttttttattttggttttttaaagtgttgggattataggtatgagttattatttttggtttatttcgagaaattttacgtaaatttaaaatgagaattttttttaaaaaaggttagattgttaagaatggaagagaaggttaattttaagtgttgaaaagaatggtatgcggttggggatatgggcgggggttttaaaataatttttatgtttaggtaaaggtaaatatggagattttttgaatttggtaatgtatattaaaaggtttttaaaaagtttttgttagtaattttatttttagttatttattttggaaaaataataaagtgtatagattatgtataatagtataaatttggaaataaatgtttgaaaatagatgattgatagcgcgtttatatgatggagtgttgtttagtattaaaagttatattttatagttattggtaagaaattgtgtttttaaggttatattgagtaaagtaggataaaacggttagtaaaatacgattttatttttgtaaaaatttaatatatatatgtgcgcgtttataaatagaaaaaaataatataaaggaaaacgtaaagatgttaatagtgattatcgttgaaggtagaagtaggtatgaggatatggtatttaagaggttattttgatttttttttttagttgttttttttaatttaatataaatatgtatattattatttatgaaatatattttaatatatattatatagaataatgttatattttaagtgtttatttaatttgaaaaaaatttagattttataatttgatagataaaaatgttgggagatgatgtttagtagtggggagatatgggtttttaggtagtagttatgatttagaattatgtaataggttttcggttaagtgagggtttttttagattttggtttagaagaatttttatgagttttgttttttagattaatgtttgtaataagaggtttaggtttcgagtttagtgtgtgtttttagttttttatatattggggaaatttaatatggtttggttggttataagtaaattcgaaatttagttatattttatagtttttgagttgattatgtatgtagacgttatataatcgaagggaattttaagggagaaaagttattttgtttttaaagagtttatattttagagagaggtaatgtttttatgtgtatatttgaattaaattaaattaatgggtgtcgttattttgtttttgtagattgtagagttttatcggtagtaagaagaaagtaaaaagaaaattagattatgttaatgggaaattaaatatagttatcgaatgattttgatattttttattttttatgagtttataattttgtttttatggggatttttggggatttttttttttatgataattttagggttaggaagaaaaaaggaaagggagaattattgtaatagaaaattttgggttggaaggaattttaaagtatgtttagattttttgaattggtttaataatgtttaataaagatattagttttttttttaaataggtgaggtgagtgaaattttgataggtaaagtaaattttttatagtgtgtatttataaggaaattcgtggtggataggagcgtgaaggttgggttttatttgttttttgtatgttattggttagaatgttggtaagtagttggtttttttttttatttagggaattttttttttgttttttttaatttgtttttttttatttcgatttttttttttgttttaatttggattttagtttaaaataagttttatttgggtttttaagtggtgttgaagaaagttatttaattttgtaggtaggtgttgttggaaatttatggtttttaaatttagtgagttttgatattatttagtaattttttattttttgttagattttttttgttttttttgatgattgtttttaatagttattatttgttttatatattttttttattttttggtagtgaatattgttttttatttttttgagaaaattgggattattgggtaagaattattatagttttttattttggtttatgtataaatgtttatttttgtttgtttttttttgtttttttttatattttattttgattttattattttttattgttttaggaattttttttcgttaattgtttttgtttttaattataattttaatcgtattttttttttttgattttaggtatttttaaaatgtttgtgttgatgcgtgttttattttaattattattttttttgtttttgtttttttagaaaagttgttaagttatatttattggtttattttttatttatatttgaatttatttagtttggtttttttttatattgtgtttttgaaattatttttatagagattattaatattttttatgtggttaaatttattgggtgtgaggttgtattttagtaggtgttttgatgtttcggatattaagattattgagggtttttcgtgattttgttttttttgggttatttttttttttttgaagaattttttttttgttttttttaggggtattttttttttggtttattttgataagttttcgatgttgtttattaggtttttgtttggatatttttttttttttttttgattaattttttttatttttttggttttatatattatttttatgataatgtttttaatatttttatatttagttttatttttttttttaattggtaaatatttattttaattgttttttaagatattttttagggagttcgattaatttgttttaaatttaagttattattattttttttattaagtttttttttttttttgtttttaatttggttatggtattaagtaaatttatagttttagagttttttagatgttttttttttttttatgttttatatttatttaatagtaaattttatggttataggttagatttttttagaaatagattttaagataaagatttgagtgtaagtggtttatttgggagatgatgttaggaattttaaggggagtagggaagggagagaaaaaaaggaaaagatttatgtatgagttattttattaagtaagttattgttatcggtaaatagagtttatttttgttagggaaatttgagggtcggtgtagattatgtattttttgttaatttattgagggattagggagttggggtatttatatattaatttttgttatttattggttgaaggttgtttttatggaatgttaatattttagtatttttagttggttatgttataggtgaagtattaattaaggaaatagatatagatgttatattttttatagttggaggtgaagttagtgagtattgaagtggtaaaggttaggggataggatagaatagggtagtagatgtattgttaattttattatttgaatatttttttttttttttattttttttttttaggattattgttgtgatttttagtttgatttttttgtttttgtttgagttttgtgttttgtttgtaaattttttttgtgtattgtagttagagtgatttatttagaattaaatttgttgtttttatgtttaagtttaaggtttttaatgttttggttttaatttagtttttttgtttagtttgttatttttaagttaattttggtttatttagagatttagtttaattattttttgtaagtaattttttttaaatttttaggttgagttaaataattttcggttgttttttgtttatagtattatacgaagattatttgtttatatgtttgttttttttatttaattattagtatttggaggtgtaggattatgttttatttatttttggatttttggagtatgtgtttgttatacgttaggaatttagtaaatgtttgtggagttgaaataaattgatttgttttattatatggtagattttttaaatattttaatagataatatttttttaaaaggggagtatttagagattaaataaaggattggtttagataaaatttagtgtttttttttttttttagtagtagtttttagtgttttttttttagggattgatggttagtcggtttttaaggatatagagggatttgattggttagtgtttttgttatattggttagtaaatattattatttttatttataggtgtttgattttttaagaaagggagtagtattttttaaatttatttggtttttaatttttttgttaaggagattgttgttatgtttggagtattaggaagataaattttgataagtgttgtttaagagggtgaaaggataatagtagggtattggtaagaggggtagtattggtgtttgtggtgtagggtaggggagacgattagaggttaaaggttgtttttagatatttatgtaaacgtagagattattgggtatgttttgattttagattttattaagagggttggagatttattggtaatattatttgtgattattgcggttatatagaatttatgatatgtaatcgttaggtgagagagaacgttaggagaaagagaaaggatatgaaggaggaagtggggtagatagatatttgttttgtagaaagagcgttttatgaagttaagtaagatttttttgatattagagttggtttagagtaagagggggagtaagtcgtattggcggttgggagtggtggtcggtagagtatacgtaaggaagtgaggatttttttttatttgaataaagtagttggtgaggaagtgattttatttttttttttattatcggttcggtaggattttttttatagttatattgtgttgaatgagtttagagggtttcgtttgtagagtagtgtggttttggtagttgtatgtttgtttttgttttttgtgattttttttttcgtattttttttttatttttaaaatattgttttcgggtttgggggaaaaggaaagggaaaaaaataatttttgagtatataattgaaggatatatagttgtttgggtcggagatggtgaagaggtacgggagcgtgagaagtataaggatttgtttttttttaggttggcgaaggttgttttttaaagttatttttagtgtttgggggttgattttggaggaattttgggtttagggggaggggttggttgaaatatgggttaatgatattcgtgaaatttaatttttatgttatttggatgtaataagaaatttgttggagatatggtaggagatgaaaaatttaaataaaataaaaataaaatttgttcgtttattatagttggtttagggaagttttggtgtgttttgttatgtaaatttagttaagaatgtaaattaggtaggggtttttaggagttggggaggttgaaaaatgagaagtttaaatgggtgttttttttttttggtattatttttatagtttgaaaataatgtgtaaagatggtttatgttatgggttagggtagaggaagtttggttttaattatttgttaatggagattttagtcggagttggttattttagagatggattttagaggattttttagtttaattattttttgggttggggtagaagatggtgtttggagggaagtatagaattaagttttttattgtcgtattagttatgtaaatattgtagggtatttgtgggtttatgttttttttgtaagaaggtgtggttagtttagtaatttaaaagacgtatttttgaaataggtggagaaatgtatttatagtaaaaagtgttaaaaatatgttaatagttatgttatttggtttattaggttagtgtaataaattataataagagagattaaaggtcgtatttatatgattttgaaattttatttttagcgggtttatttatttagtaattaaattatttttgtaaggtgttgagtatttagtttaaagttaaataagatatatgttttgttttatagtaattgtttggtaatatttttagtggtttttatgggtttgataatttttttagtattgaatttaaagtattttgtgttttgtttgtaggtttatttgtttagtagtggttttgttaggagagaataggtttatgtttttgtttttattttaaggtatatttgaagaggttttaaagaaagggtttatatatatataggttttagttatttgttttttagtgttttggttttaaaacgaagtttttttatttttttttttattttttttattttattatttttttttggttagagttttcgagggttttgtttgttgtggtgtttagtttttttttgttttgggtttatgttattttattgtttcggggggaagtattaagtataaagtgataaatttaatatttttatgatattgtgttggatatgaaaatatgtttagtaaaaaatttaattattataatttaataataaaaacgtaagtagttaaattttaaaaaaggttaaaggattttggtagatattttattagtgaaggtatataaatggttagtaagtgtatgaagagatgttttattattattagttattagggaaatgtaaatcgaaattataaggagagattatatttattagagtggttttaattttaaaaatagataataataagtgttggtaaggatgttgagaaattgaaatttttgtatatgattggtgggaatgtaaattggtgtagttattgtgggaaaatagtttgttgattttttaaagagttaaatagagttattatatgatttagtaatttaatttttagtatatttaaaggaattgaaattgtacgtttatacgaaaatttgtatataaatgtttatattagtattatttataatagttaaaagtggaaatgatttaaatatttattaattgatgaataaataaataaaatgtggtttatttatataatggaattttataatttagttaaaaaaaggagcgaagtattgatatatgtaataatatggatgatttttaaaaatatgaggttaagtgaaggatttaggtataaaggttatttattgtttatgagtttattgatatgtaatgtttaaaataggtaaggttattaagataaaaagtggattagaggtttttaggagatggggagacggggagattagggagttattgttaatgggtatagggtttttttttggagtgatggaaaagttttggaattagttaagggtgatggttgtataattttttgaatatgttaaaaattaatgcgttgattattttaaatggaattttatggtacgtgaattatattttaataaaagagtttaattatgttttttatacgatatgaagagggattaaattatttttatattatatggaattttatagaagtattggtttgtgatggattttcggtttataagtgtaatgaggaatgagacgttgttggttagaaaatgtgtattattgttattttttaaaagaaaaaaaggaagaattgtagtaggaggtggtatggtttgtgttttggatgagaagttaggggtcggatgtatgagtagtaatcggggtatttttatttgtaaggtgagtagtttattttatttttgggatttttaattttttttatttgaaaatttcgtcgtagcgaatttttaagaagttttttttcgttttattatttgggtttatttagttagtgattttattttttattttttttcgtgtatttttgaggatgtgatttgggttttgttggtgcgtgttagagttgtgttattgtaattattgtagaggattttttgttttttttttgtgtggtttattttttttattcgttatttttttattgtttttttttttatttggttttagatttttttgttgtgagttaggaggaggttttttttggtatagtattgaagttgtgatttttgatgtgtttttgtgtttttaatttttttgtttttatgagtataatttaagttatttgttttagattttaatttttatatgtttataaagttttttgttttttatgttagttttaattagaattggtgatattagtgtggtttaaagtagggagtaggtgggaagttttgattatatttaatatcgaataggattttttattgtttgataggggttggggattttataggtagattggcgtttggaatagatttattaattttttttttttgggatttggagttatatatgtggtttttttttttattttacgttattgtttatatttgttttcgtatgtgagtagaatataattattgtgtgttttatagggattggcgataggtaaatatgttttatttgtcggttatgatttgggttaagcgtgtcgtggtttttgtatttgttatgtgattcgtgaatacggggtatggtttaggttgtttttttttatttttgttattgtaagagttaatttatgaaaatacgttaaaaatgggaattgaaagtagatgtttgttaagttttgtagtttggtttaatcgttgttattaggatatcgttgttgggggtagtgaggggagggagttttttatttattaaacgtggagggttagagttaggggttaaatgtttggtttttatttgtttaaattagtaagtgttgattgaggttggtggtgtggggagtataaagaatttgtatgttttaataggaatttgttgaaagtggttttagatttggaggagggtatgtagaagaaaaagagtaaagtagattaggttggaggatgcggtatttttagttagttgggtattgttagtttttagttttgttttgtttggtatttgttttttgggattggttaagaaattagtttgggtattttttttggaagttttatattgtattagttttagggagttttgatgatttatcgtaggtttagatatttgtcgaggattagatgtatttcggatggtgttggttttgttgtttttggtttggggtaggtaagttataaatggttgaaattttatagtttgtttatattttatttaaaagtattttaacgtataatagttttatttagattttagttttttagttttgtagtttaatgggttattttgtgatcgttaaagtgattgcgatgattttttgagaagtttatgggagaggttttttatttatattattaatttatcgattaggaagagaagaataattatattttttgtgttttgggggataaggggagttgacggatggtggtgaattttttagtgagttttatatgggtatgttaagaaaaatttgtttttattttgtagtttatgatttagtttagtttatttggaaagatttaatatgaataaaattagatgtattttaaggaatattgtttggttttttgataatttttttttttttttattagatagtttttttgtgtttagggaagatagtagatttttttattataaggaaaatgtagtttttgttagtggtagtagttgttagtattaggataggtaaatggtgggttaggttagtttgtggttttggattttggtttattaatatatggataagatacgttggcgtggttttttatttgaatagttgtttacggcgaaggatttttgatagtatgttttttgttgtaagaaggatattgttgtatatagaattagagagagaagtaaaaatagaaatttagagagagaaacgggagatttagagatttagaaagataaagagaaagagaaaaagagaagttgaaagtaattatggatgagttttaagtgagtggaggggttgaaatattttttattagtataatttataggggtatagttgatagttggttgatttgatttaaggatacgtttttatagtgaagttagtgaagttggttttttgggggtaggagtaaggttagaatattatacgtgtttattgtataaggtttgttagtattgttagtagtgggtatttaatacgagaaaagtcgtgtttttgggagatttatttttaaggtaattgttatttttcgttaaacgtttaggatcggttagatatttttgtagtttgtagcggcgagtttgggggattttgtttgtagaagggatgtaagtatgtgttggttgtattgtaaatggaatttgaattgtgttacggggtttttatatatcgattattttttaggtaaaaatggtagagttagaatattttaggtgggattggtagttgagtggttagtggttatgtttatgtatgtgtagtattggtagaattttgttgttattgtagaaattttggagcgagttggtttaggttgtatttagggatgtaaatatttattgatcgtttgagttgtatatagtattgtgtagagtgttgtaggggagatagtgagtttgattttatgataatgagttttttaaggtaggatattatgtttattatttaaattaggtatttagtaaacgtttttttaatgggatgatttagagatatgtatatttaaggtcgtaggaataagtttaagtttgggttggtgaaggttttaagagaaattttaggttaagtaaattgttatttttattgaggaaattttttggttaattttggatttataggtaatatgttttttatagtataattggcgttaattttggatagttcgttttagtttttttttttttttagttttgatttattttttggatatatttgaatcgagtaatttaattataggtaaattattttaaaaagtatttatttagtatttatttttggttaggtattaaatttgggatgataagagatatttaattgtggtgttaaagtttattaaggtggtttttataaataattttagatagaagagattgttattagaaaggttatataatttgtttaaagttatttagtttattgtagtaaagtcggggttcgaatttaggattatatgattgttaggtatgtatttttttaattatattttgttttttttaaaggaagtagaaaagatatataagatttaatttcggttttttcggagtaataaatatgagaggttaaataggaagtttcgaggagtgatagggaacgtttaagaaatgtattaagagtgtttaagatgggttggaaggcggatagaaagtgagataggagttgaggttttaggattttaaataaaagtaagaaaattaaggatggtgttttagggtaaggaagtggtatgggagtttggggttattttggtgggttttaaagtaagtcggtgtatgtcgttaggggtgagttagagcgaatggggttatattaatagaaagaagattttgtgattatggagaaattattagttataggattttttttattattttcgttttcgtcgttttgggtattgtgtaaggttggattttacgggaacgtgtgcggtatattttggaagtttttgattgtggtttggttttgttgttagggttgtacgtgttattttaagagtattttaaaatgttgtatgatatagatttaaatttttaaagagaaattttttttatattatttaggaaaagtttttttatttatagggttgttttatagggaattttagaatgtgaaagagaataaaatttttttgagttataaaaataaatttaatttgaggtttaatttagaatattaaaatatgtggttttagagtttttatagtggtaattggattttgatttttttaagtgattagtttaattatttttgttggattaaaagtggttgtgtttgtaacgtgtatgaataagagtggttttatattacggatagagtataagtttttaaagaagagatttagggggatatagggggtttttttggttattcgttttattgtttaagagatttagggggtgggggggtttttttgggtcgttcgttttattgtttcgttatttgttttttgtatggtttttttttttttggaggtatttttcgtgattttttatgattggaaatagtttttttttatttatatttaaaaaatttttataatttaataaaggtagatatttttaaatttttaggaatttatttgttaagtgttttataagaatttagttttgtttattaagtatttaattttttaatgttcgatgtgttattggaaggttagaagtttgtaaggtaagtttgtgattgttgtagttagatttaataagttaaatatttttttttagtattttggtagttgtatgttgagagggaatgtgtttagtgtaatatttttaatatattaaattaaagatgaataaataaaaaagtagaattatagtattttttatgtatagtgattataagtttagttttgtttttagtatataggatgtttaagattttgttttgtggggtagttgaatagcgaggagttggtgggagataaaaaatggttggatacggtttaggtttttaagattttttaaattttttttttttgtttttattataatttagataggattttcgttttattttttaaattttttttttttgttaaaattttttttattttttttttttttattttgttttttgtttttttgttttttttttgttttgtattttattagttgaagtttattttttagtttcgatttttataattcgttttttatttgtttgttgtagtttaggatagaaaatttagagtttgaattttttggaagatattaattttttatttttttagatatataaagaaattaagtgttggtcgagtgaaataagtgagatttttgtagtcgtagttagggtttggttatagttgcgagggattttttagttcgttttttggtagaaggacgttggtcgtggatattgatggggaaatggcggttgtttttgagttttttaagaaatggagcgaggtaattagaggtagtgtggttattatttgatcgtggaagtttgataggacgttaggtttgcgatttacgttggagttagttagaggttcgttttataagttttttttaatttttgaggagttaaatgttggtattgtggttatgggataattggagagggatttgtgttggataaaggagtagaataaaaacgtttaaattttattttttttttgtgtgtttttatttttgttaaatttttggaatttttatgttttataattttatgtgttttttattttcgtttgaattagaaatattatttaaatgtttttggaggtaattttaatttattgaaatatttcgagaaattgtgaaaaaagtattaggattacgtttggtgggttttaagaaatttttgatttttaggtataagtttatggttgatggaatatagatttaaataggtatgttttattaatttggtatattatttgaagaaagtgattttattaagggtaattttaaatgcgaaaaaaataattttattgttattatgtttataatattttttggcgagaaaataagaattcggagtttttaatgtttggtaatggaatatattttttggaggggaggagttttaggagagtttaatttttggttttgaagtttattatgttattttagatttataatcggataagttggtttgttttgatgttttggttttattataagttatataatggtaagttgtggggtttgagtgtcgacgtatttttttttagtttttttatttgtggtttagggatttatttttttaggttttgagagttttatttgtaataggaagagatgttttatggttttttaaaggtttttggtgatatttaagtgatattatttttagattttgggatttcgttttatgtttgtgtattaaaagtagggaggatgaaaagggtttgatatagttggggtattgggagaaataggtgtttgtagttttgttggtttgtatttaaagtcgtaatgtgttattatatttattatcggtgtaaatagaggtttgaattttagaggggattttattagaagaagtcgggacgtgatttgtcgtaatatagaagttaggaatgtttttgatattttagatattaaaagaaatataagttaaaatttttatggtattagatattagaattttaggtagggtttgtaaagttttaattatttttgtttaagaatttatttaagagatatttcgatagtttaaatggtatgaaaaatatattttaataatattgagatgattttatgaaaaattaagggatgttttttttggatgtgttttattttttagttataaataatatttattatttatggtaatttttgatgataagttaatattttaattaaaggagtttatggtttttatttttatttttcgggtaatggaattatatattatttaagattatagtgttattttttttggatgtttttaggagatattttttgtattttttagaatatttttttgaattaaaagtttttatatttaagtttttttttagaatgttttattttttatgttcgatttttttttgtttggaaaatgtagagaaaatttattagttatttttgggttattagattgtgataaatttgttttttaagttttagaagattgttgaattgcgttttttcgtttttttttattttagataatttaaaattggtttggattcgtgatattaattttggtatgtatgaagaacgaggaatgaggattttgttttgtttggaattaaaagagaagaatatttatttttttttttttttttttttttatttttattaagttagtattttttttttttagttagatgatgtatatttttaatattttaggaaaaaagtgttagtgatatgcgagttataataaaagaaaattaaaagaaatgtaattataagggatagggaattgtattatttttaatataaaatgtttagatgaaaatttaatttaaaaaattattagtattatataaatgagaaaagaatataagaaaatatttgttattttaaaaattagtttaatttttaatttttttggtttttggatttttaattttatttttaaaggttaaaaatggtttttcggtgttggattaggagtaaattttttaatgatgtaatgagatattgtgaagtggtaacgaatttttttggtttttggtttgttgtttggaatgtagtaggaaaaaaaaaaaaagttgttaaataaaaatagtgaataaataggatgaaataataatttttttattttttttattatagaggtatttattataaataaaaataaatatttatatggtacgttgttgttgagaaagtgtttttatatagattatttagtgtggtttttttaataagttatagataagttattattgttgttattttttttttagagatgattaagaatacgtaatttttttaaggatatttagttaattaattatgaaattagaatttaaatttagaattttgatataaaatattttgtttttttatttaattacgcggtttttttaaatgtagttatgatttttagttaaacgggtttgtttagagttacgaagttataagtgtgtatggagtagcgacgtgtttatgttgatatttttgtttttttgataacgtttatattatgagaaaagaattaagtttatttatgttagtagtttataatttttttggtattagggacgtgttttgtggaggataatttttttacgaatggggtgggggattattttaggatgaaattgttttaatatagattattaggtattcggtttttataaggagtatataatttagattttttgtgggtatagtttataatagggtttgtatttttaggaaaatttaatgtcgttattgatttgataggagtcggagtttaggtagtgatgttcgttagttgtttattttttgttgtgcggttttgtttttaataggttatagatttatatcggtttcgggttatatgtataagttgtaattgttggttggtgttagacgattttcgtttgttttgtttttgttttttttttagtttagggagatgttattttgttatttttaatttatgtgaggggaagttggaattatttacgtatttatagggagagttcgaataattatgtagtaatttagttttttttttaaattttttgtttgatgtaatcgttaatttttattttaggtttgaaaaataatattgttatgatagtgatcggtagatgattaatagtgaagaagagaggagatgttattaataatattgatttttaattttttttttagtttttgtttggaataaatatagtgtttaattatatggttttttatagaaagggtttttttgatatgaggtatttatttatttatttatttatttatttatttatttatttatttattttgagatagcgtttttttttgttagttatttaggttggagtgtagtggtgcgatttcggtttattgtagtttttgttttttaggtttaagtaatttttttgttttagttttttcgaatggttgggattataggtatttatcgttatgtttggttaatttttgtagtttttttgtagaattggggttttattatgttggttaggttggtttgaaatttttgattttaagtgatttttttgatttagttttttatagtgttgggattataggcgtgagttatcgcgtttagtttgatatgaggtttttaggtatagaaagagaagttttttttgtttagatgtaatttttttttattttgtttgggttagtttgaaaacgaaagaaagagagtgatttggtggtaagatggttaaggttttttttttttttagtaatatttagttgaagagtggatattagtgaatgtattttgtttttatttttaatattgtgggtttaggagggttgaaagaaaagtagaaaaattatttttttgtttaacgggtattgtgatggtttttttttttttattgttaacgtacgtttttttttgtttttttttttttttgcgtttgaggttgttattttttatttttttttcgtatttttttggttttttttagttttttttggagtgatttttttttttttttgtgaaattattatttttatgtatttttcgtgttttatgaatatgttataagttttagaattagattttgtttagttttttcgtgagttgttttagtttgatattttagtagtttttaggtaggaaaaaagaagtcgatttaaatatgaatttttataaggttgaagttaagttaatatattttggagattttgtggtagaaaaatgtttagaaatattggattataatataagatttgatgtttaagaatgagttattaggtttgggggtgagaaggggtattaggtttttaatttttattgggttatttttgttatattttttttagtaagataggtaatattttttaaaggttattaagttgcgtttttattaagaaggaaaatgggattttttttattttgagttttttttgtatttttagtaaatgatttttgaagttattttgatttttttttttataatgtaattaggggtattttttgtttttttgttatttttttaattattgaaagaaattttttttttttttgtgtttttttttataattagttttatagattggttaaattcgtttgtttagatttttttttaaaatttttttttttatattgattgcggtgattttaagttatttttttgtttatggtcgggttattttttttaatattaatttattttgtaattgattaatatttaatttagtagaaattattgggtatttgtaatatgattggtatgattaaaattttggggtggatttaagagaaaaatgtaattatttttttttttttatgaggttaggagtaagtaatataagtaagaatgttttggtggtagaaggggtggttatgacggtttagagaagggcgagtttatttaggtaaggggggcgataatagatggggggcgataatagatgaggggttgggggcgaggggaggggatagtataggttatagggggaggataaatgtgtgtatagggaatgttaatggtttggttcgattttgtgggttttaaaataaaattttatggaaaagataatttaaatgaaaatcggagtttattaattttttgtaggtttagtttaattttttatagtttttagttatgttggtatatgttagttttcgtggtagtttaagataaagtttttaatgcgatgtgagttttttagagattagtattattataaatataaatgtttaaatataagtaagttgaaattaaatgttttttaaatattggttttttgttatatgaaggtttttagtggtgtattgaatttttggataaatgagttagaaaatagagagttaaatgggtttattggttaaattttatggtcgggtttttttatgggagggaagaaggaaatttagtagttgttttttatttatttaatttatagtagttggtaggatagttttggaggataattagagaaatgtttttagaatttcgagtaggggattgagtagggtatttaagattttgattaaaatagagggtttttatttaaagttaatttgtaaaatatttttttgtttttattgttttgtatgatttttaagagatttattaataattagttataaatagatattaaggagtttgtttatttaattaagagaaaataatgtttgagttttttagaaatatgtatttgatattatattaatgtgttgttttgggagtagaatcggagtttgtttttttggggttggtgttttgatgtggttattatttgtttagtagagtttttatttggtaatatttcgtttgtttaattttaggtatttgaaattttaaaaatatattttttttaagaaaattttaaaatgaaagagtttttttaaaaattaattcgtaaatattttttttaaagttattttaaaatgtttgagattttaaagaattatatttaagttaagtttggtgagggtaaatagatatgataatgattaaatttattttttaattttttaatatttgtgtataaagttaaataattaatatatatatagagtgttatttttaaatttttttgttattaaaaaataaagggttaattaagtatttttaggaggtaaaataatagtttattatgtgtttgtttttagtgtttattagagttttttttttttttggaagatataatgatttgggttgggtgaaattgtatattatttatgagagtaggatgttgggttgattaggtgataatgttttattatatttttaatttttgtattttttatttatttgataatgggttttttagcggagattataagacgtgagtatatttatataattttagtttagatttttgacggcgtttaatttgtttgtacgaatatttattgtttgtttatttttttttatttgagaaaattatttgatttagtttttgtttttgttttttattttttattttttttagaatgtttatagtttatttatgttagtagtattggagaggaaagagtatatatattagagttagatagatttgtgtttgaattttaattttgtaaattattagattcgttaatgagttgaatgagttattagtttttttttcgttttttgtaatgtttaaatttaatttatgttagatgagttatttaatttttttgagtttaaatttatgaatttataaaatagagaaaaataaaaggttgtagttgtcgagtggttaggaggatgaaatgatttttgtgaagtgtttggtagtaaaggtattaaaatttagttatgatttttttttattttttttttatttttgtattgaattgttagagatggtaattttttttttttaggtattttttttatttataagtagtttatagaaaatgtatatatgaaaggagttgtgtgaaatttttgaagttagttaagttttttttgtagagttcgtaatttttaattttaggattttattttttaatatttttagttaaggtaagtttttaaagaaaaaatttaaatgaagtttaatatttgtatattattagttaggggtttggaagtagagttttggagttagtagaagtgattttttgaaatcgttagggtagagcggttagttaaattttgagatttattaaggtaggattttttatttaatagtaagaatatcggattttgtattaagttatgaggtttttatttggaatggtttatttagaattttttatatagatttggttattttaaaaagttagtggtgagtttagaggagggtagttgaaatgggataaattaggtttttagaagataatgatgattttgggaagggtaggtttgaatgtggattttgggatatttatgaagtttttatagtatagaaaggattaagttataattttattgtgaagtttttaggtttatgatttttgaattttttttgaattttaaattttagtttgcgattaaatagatttgtatatttattaggtatattaaatttaatatagtataaagggaattgattatatttttttaaaatttgtttttaagggtttaattagtttttttgatagtttttagtttatattttagtagaaaaatcggggtgatttttaattttttttttttttttttttatggatatattattattgttatttttattttatagaagttttttaggatgttttttttttttggttttatagaagttatttttgtttattttattgtatggtttatttagatagtggtaagaagtttttaatcgatttttttttattttgttttatttagtttttttttggagtatttttagggtgtttgttagatttataaagtagttgcgttttttttttttatttaaatgttttgagtggtttttgttatttatagggcgagttggttttgatttacgtttttagatttttttttttttatatttattgtttgttttgaattttatgtgattattggtagtattagttgtagtttcgtttttttatagattttggtttatatgtatttttaggttgggatgttattttgttttttgtatatttttttatatttagtttaaatattattttttttgtgaagttttttttgattaagtttttatttttttattatgttttttttttattttgtttttttaaggtttattagtgaatttattgttatttgttttttttttttttgggggtattggttatattttttttattttggtttttttaggttttgatagtgtttggtattttgtaaaagttgtgtgtatgtttgtagaatgaatgagtaaatatatggaaattaaaattatttaaataggtttataaagattgtgttatgtttaaggaagatggatttattatatattttaaaagaattttaggattttttgggattggaatggtaatatcgtgtggggtaaggagtttagaacgtttagttatgtttttaagtcgttatagttttattttatttaagatatttaatatttttgagttttaatttatttatttataagaataagaggacgttataatattaattataaaggttggggtgagaacgatacgggtttatgatgttaaacgtttggtggaggtcggtatagggcgggtagaggtggtaaatggtagtgttttttgtttttaattaatagaattgagttgaatatgagattttgagaaaggttcgggatagtagggttatagtacgttttttggtttttagggatagttaatttgaggaggcgataaattttatttgtaaaggtgagaaattgtatagtaagttaatagtatcggatgagttacgagataggacgtgattgatgtcgggtgggcgtggaatgtgttgtgtattgcgtggggagggtttttagtgggggtgagtttggtgggaaaaggagggtttcggagggtttagttgttggggtggaggttataggggtttaggagtgtagggtgggcgcggtaaagagattgtcgttgttgtttttaggttgttttgttgttttttgtttttttttgttggtttgggagggaagagtagggttgttggttgagacggacgttagagcgagtaggtgagaagaggttgggaggaatcggtaatgtagcgattaggagtaggtggtggagcggggaagagagagggagggttgtttggttagatgttaggtattttgttaattgtaggttttgtagattttgtttcgagtttagggttattttgaatttttttttttttttttttagagtgtttgtcgtattttttttttttttggggtttttatttatgttttttttggaggttagaggtttatttttttttttttaggattttttttcgtttttttagttagtgtgggttattggtgtgattaaggtgaggggtatttggtgtttttgggatttttgtttttttttttgtttgagggtattttttaagtaagattagagattattttagttttgagtgttttagttaatatttatgaggtttgttgagaagttaaaaaaaaaaaaaaaaaaaggtttggacggtattagacgggttggtaggggaggggggtgtttaaagaggagaagaaagtaagagttaatatagagttttgtttagtaatagtatggaagggagtggtagtttattgttttttaggaaaataaattgtaaataatttttttcgtttgtgttaatttagtgtttttaatttataaattattagtaggttttagaatttagattaattgatattttgggttaggtaattttttgttgtggggaggacgggttgttttgtgtattggaggatgtttagtagtttttttggtttttgtttacgatatgttagcggaaatttttgtttagtgtgaaaattcgaaatgtttttaggtcgtgttaaatgttttttggaaggtaaagttatttttatggagaattattgttttagattattgttaggtgttatttaaatgtttaatatttgtattggtttttttagttttatttttatttgagtattgtaagaacgttttattttggcgtttatttttttcgtttatttgatgtttacgtaaatagaaatagaagttttttttagaagttaaggaatttttttttaagtttagacgttgtgggttgggggtgggggtgtaggaatgtttttaattttgtttagtaattgtaattttatggattttataatggttaaggggattttatatttaaagtttttattttttaattttttgggtagttagggatttaggtagaaacgtttgtttaggaggcgtttttttggtggaggagtaaattttggagaatttgtttttcgtttttttttttcgtttttttttttatttttttttttaggagttagttggtgagtagttatcgtagttatttatgtgaatatgaatttggggttatttttttttaaattttaatagtaagttttggaattaaataagaaagtttttgtataaataaataattaagttaattgtgggtttgataaatattttgttttttcgaggaattaagtatgtatttggggttaggtttttgggttgagttttttgtgtaaaaaattagaaggtaagaaattgaaggaatatggttaaagttttttattttaaaattaaggatattgagtttcggagaggtgaattgtttgttagtacggaaaataggattagatataattatggtattttgttttaagtgaagttatttaatgttttttttttatttaaataaggatttgggatatgtcgtttaggagggtggttttaaaggggatttttagaggatgtattattaagtatttttgtattttaggaggtggtttattttatggaaattttttatttggggttgtttatagaattatgtacgcggtagttgaaaaggggtatttacgttttgttttgtgatattgtttttagtgaaaattagcgttcgttgtttttagcgttaattttaaattttagttggttttatttttttttatttattataattgtaacgtagtgtattgtgtaaaggttatatttgtgtttatacgttatatgttattaaaatattatgaagagaatattatgtggtttttattagaagattaaaagagaaggggtgagaagtagattttttttttaatttagggttttttagttttttttaaatattgaaataggtttatgtgtattattgttttcgtaggagtttatgtttaggttaagtacgtgttgtttattgatagagaaataaatatcgtttagtatttgttcggttttagagtgatgagggagtttttaatttggatttgagaaaatttttatattgtatttaaatattttttttttttttttttttttttttttttttttgaagttaaaattagaataaaaataaatatatatagagttcggcgtagtaggaaaaagaaatttagtttaagatattttataagaaaagttttaagtttatttatatttatttggtttggaattttgggatttatttgattgaggagggttataagttgtattttagaggttcgggaggtattattcggtaggaagatttttttggttttttaagttggaggagtagattgaaaggatgtttggggagtgaggaagtaataggggagtggatgtagaaggtattttgttgtttaatttagtggttttttgaggcgtattaatgagtaatatttatgtattttttttttttgttaaggtagaaataatttggtattttttatttggtggtcgagtgatttggttttattagggattttattaattagtatagttttttatagtttggttttgggattggttgttatacgtttttttttatattagttattagttgttttggatttttcgagatttttaggtagtttgatagttagtgagtagaaagatttgatttttttttggggtttttttttttagaggttttttacgaagttgtgttggttttgtttaggtagtggatataagtttgttttaattttagaatttaaggtttaagttatttttaataaggtattgtttgaaattatgtgggataaaaagtttttttttttaaaataatttttaatgaagttaggttattattggaatttattatatataatgatatataaaatgttaagagaaatttatagcgtcgtttgtttgtttattatttaggtattggtgagttattaatttatgagagatttattagtttataaaagatgttagataagttaatttttaaaaattatgtgagtatagatttatgtttaggttatttattttaaaaaaaggattttttttgggttgtttttttaaagtagtgtaatttacgttaattttttattttattgtttttagtttatgttttagagagttgttgaaggatattggagtttgattagaggtagggttgggtttattgagtgttattaaaattataaaaatataattgaaagagaattgtttttaaatatttatgtattataaaaggggaatttttagaggtttttgatattagtaatttgtttttttattttttttttttttagttttaagatgagatgatgataaaaagattgattagtgagaaaaagtatgaaattttatttataaacgtgtaaatcgatatagagtaaatttgtaggaatttttatattcggttttttgatttgttttgaaaagggggaaaaagagagaaaggaagcgtattttcgtttttattaagatattaatattaattttgtttttttaattttatacgaatattattgcgtttggagtttatgttttattttttttgttaggtaaaagtaattttttttaagtaaaagttttgaaacggattttttttagaagtagagataattgggaatttttttaaaattagtataagtatgaatgtttttttttttattttttatttttataaatgtatttagggttaaatgtattggttaattttgatagaatgtaatagagataggagaagtagtttattttagtgagtgagtggatatttattaggtatttattttttataggtttgggatattaggtattgcgggggtgttgtatttaggaaatagaagttaaaatttaattgagtagggaaatgagttaaatagaaatggatataaagatattaaaaatatttataaaaatatagatgaatgtgtagaattagttggagtttttatgagttgagttgaatttgtttattttgtaaagattttttcgtatagtggggattgtttacgcgtacgtattttttagtttttgttggttaattcgaatcgtttttagcggggttatttatatcgtgtttattttttttggtttttaaatttaatttattttattattttaagagtttttatttttagtattatttatatataataaaatgaatatattatgtgtatagttttatgaatattgataaaggtatatatttttttaatttatttttttattaagatatgtagtatttttatttttttagaaagagtttttggagttattttgtttttaaattatttgtatttgaatatttttgagtggagattattaaagttaaatgtgtgggaagaaagtttaattattaattatttattataaatataggtagtaaaggttttgaagatggtgcgtgagtttgtatagataagtttgcgggattgggttttgttatgaaatgttaaaggggttttttagcgataggtacgtgggttttttttagtcgttttgtcggtatttagatacgtaattaagatcgagtgggttttttttttggttttgttttttaggtattagagtttatatgtttagaaagagggaagttgaggttgaatagttatatttattatatttttataggggtaaatgttttttgattaggagggtttaattatagtgtagagtttttttttttaaaattttgttttaatatcgagaggagtttatatgattaggtaaattagagatttttttagtattttttgttttttagattttagaggagttttttagggaatgtttggtttagggtagtatatttaggatgagggaaaaatggttatttttaggtttttttaattattatatttttttttgtttttatttgggtattttgttgttttagtgatttgttaaagggatgggggcggggttgcgagaaaaaagttatatcgttttttttggggtgggggtaagggtatttttgttttaggggttttaaattgtttattagtttttttgttggagagggattagaggtggaagatttgttagagtgagtgttaggtagttttagatttttgggtatttattttttataaaaggttgtagtattttttggatatttgaattttatgtttttacggtaaaaataatttaaaatgttttaaaatattatgtaggaaggagtttttaattttttttaaattatttttttaaaatggtattttgaggtgattttgtttttaattttttagtaatgaaaataatgtggttgaaaagttgatagtttttaatttttgaaaaggttatttttttgttttatattttttcgtaagtattaagagtataacggatattttgagttatatgtattgttttttgtttatttgtatttggtgaaattttttttttggattaatttagtaagtagtgttttgggtttttttggtgattgtttttttgttttttgtatatttttttttgtgaaaaaaatttagatttagttagtgaaatgaagttgtagtttttgttattgatgttttttttttgtttagatgatttttttatttcgtttgggatagaatttttttttttttgtaacgaatgaagattttcgaggtttagttgaggtttttgtattttaagattttttgaaagttttttcgtttttttttatttgattttttgttggattgatatatttttttatattttagttttagatggtttggtgtttattattagattgtgttattgaaagttaattaagggttttagggttatttataaagtgggattgtaagagaaagtttagttagatggaaatgtattttaaatatttttaagttttagtataggggtttttattaataaaaagttttatttttaaatatattgttgaggacgtagggtttcgtttttttatttgacgtattatatattacgttagttgttataggaggtttgagtgttttatgaagttgtttgtttttttttttatttttatgtgtaagttaattattttggtttttagaaatatatttttttttttatgagtaatttaaaagtgatttatttttagttttattagtcggtttatgtgatttgtagtgttggttgagtgttatttatagatgtgtaaattaaagtagtttttagaatatagatttttttttttacgtgttgttgatttttttttgttatatagggagggaacgatgttagatatgagtagttagggattgttcgtttcgtatttaaatttggaatgtgtttattagaggaaataaaggttattatttagtgatagaaaagaagagataggtaaaaggtttaatatatttattttagtattagtagattattaagaagttttgagaaaattttataaaaattgaagacgatgatgatttatataaataaaaaattgtttaaagttttttttttgagttagtagaaatttagattttatgaaatagagatgatatttatatttattttaattaaaattttattaatacgtttttattgtttaattagaaatatatttttgggatttgttgtggtttgttttgggaatttatatatatgaatatgtttttatttttttaatttgtttttattttattattattaaagaatggtgttaggtttagttcggggatattattggtgtaggtaggtacgcgggtgatatagttggttagtattttagatcgtgttttttattttttttttattttttattttttattaaattaaatttgaatttatttgtttgttttgtgaagatttttataatttagttattgtcgtttgattttttagtattatttatgtttttggtataattaatttttggttattattagggtagtatttttattgtttttttaaggaagatattagagtttttatttttatgtttttatttttttaaatttttaaattttgttttttttttttttttttttttttttttttttttttttttttattttttttttttttttttttttttttttttaaattgagaaatttttgttttgttatttaggttggagtgtagtcgtaattatagtttattgtagttttgaatttttaggattaagtgatttttttgttttaattttttgagtagttgggattataggtatgtgttattatgtttggttagtttttgtagagatggggtttggttatgttgttaaggttggttttgaatttttcggtttaagttattggtttatttcggttttttaaagtgttgggattataggtgtgagttattatggttggttatttttttttattattgtttgtatttttattttttgggagtatttttatttttattatttaaattttaatttatttttttagtttagtttattttatttgaaaatttttttattttttttatttgattatttaagttgttattaatgtttatattttttaaatttttttaatagtttattatatttgttttttagttttgttttgttatttaatatattattttttatattttttaatattgtttgattgtaagtttttttgggaggggtattatatattttatttttattggttttatagtgtttagttttataatagtagatgaagtaatttttagattgaaataaatattattttaatattgttaaaaaggtgtaataagtaaggttttattaaatttttggttagttgttaaatttgattgtatgttgtttgaaagagaaattttattttttattttagtaggaagttatgtggagaggaataatgtattggatatttagtaaaatgaaaaaaaatatataataatagttatttatatagtattgtgtataagtattgatttaagtatttaataaatatttatttattttaaattttatagtgattttaaaaagtaggtattattatattttttattttatatatgaggagattaaagtattggagggaagttgtttaaagttatatagtggttaagttagatttaaattttggtaatttggtaattagattttttagagtttgtgtttttagtggttgtgttatatttttgttaataggtgtgtgtttttatatggttttttttattgaagtaaagaggagtttattttttgtatggatattatgttatagttatgtgtattaaatttattatgagttaagtttagtgtaaagaaaattgatggtgagatgttattttttagggaagttttagaaagaagtatggtggtggtatgggagttgaataaatagagttttttttgaaatgaatggagtaaaattttttagttcgtttttaggattttgtgatatggtattatttttttatgttttgtagaaataagagatttgaatttttgggtaatttttaggtaggtttgttttagaaaaatattattatatatttaagagaatttttttaaattttatttttttaatataaatttaatataatttaaattatagttgttattagatttgtttataaattttaaatatgatttggtagttttagatatggtatgtttgagaattttagattaggtataagaagaaaattttattttggtggttaaattacggtaggaagtgatgttattgataattatttttgtattagtagttgtttaagtattatgaggtttttagggggaaagattgggaggtagtggttggaaatgaagtttattattaatgtagttaagttttttagttggatttaataaaataaaaagttttgtttagattagtgtttgtagtagaagatgttaaagagttgttttttaaaaatttggttttattgaatttaggttttatatatagtattttttttttttgaatggttgaaaaattattttatgtatttgaaattattggaggagaaatgaatttaagttatggtaagaaagtatagttagatttaaggcgtgaacgttagcgtttaaggtaatggaaattttggtagttttgtagatagatttttaagagagattgtgaaatttttaagttaattaatagaagaatattttttataatagtaaagatttggaattaatttaaatgtttaataatgatagattggattaagaaaatgtgaatgttagatgacgagttagttggtgtagcgtattagtatggtatatgtatatatatgtaattaatttgtatattgtgtatatgtattttaaaatttaaagtataataataaataaataaataaataaaaatagaagaatatttttattaatttaatttaggtttaaaattattattgggcgtttattatgtgttagtttttatgtggtgttttgtaaggttttaaggatattaagatgaataaatataattattgtttaggaggaatttataatttaagggaggaaataggagtttagggttgataattatggagggaagtgttttggtttggatgaattttattgggtgtgattttgttggtttttgtttttttttttgggtttgttgttgttattttttatggttttggttttgtttttattgttttttgattgttttgtttttattttttaggtttttagttgtagatttttttggtttggggagtcgtaggtattttttgtgtttatttttttaattatatttttggttaatggttgtttttgtttttatattttgtttagtaggtttatttatatttattaggaattttggagagattttttttattttaaattttttttaggttaaatggttatataatcggaaaaggagtcgtggagaaattgattttttgggggtgaaggtttcgggtttaggtgttttatagttatttgtgtaataaatatttataaagggatgtaaagggtttagatattggcgggagataaaaagagattgagtaagattttgtttttaaggattttaggatttagagaaggtttgtaggggaggggggtggaatttaagttcgaggggatgttcgaataataaataagttatatgataatgttgaaaatagagtttatttttaggttgggtttaattgagttagatagttattgttaaaaattatatgttttaaatgggtagagttcgtttgttggatcgttttaaagttgtgtcgtttgttttgaagtaagtttattgttattttgttaaataagggttttttatttaatattggttatggttagggttgtagatttataggatataaagtttggtttttagtatgaggattagttgttggttggttttttcggagggggattgtgggtttggggggtatttacggttttatagattgtttagttttatgttttagagagaggtggttggtaggaagaaatgtgatattaggaagtgttaaggagaaagataaggtagtttttagagtggggagaaggattcgttgtggaggaggagaaatttggttaattttggaatgggttttggaagacgagaggatttggattgggggatgtaaggcgaggagttaagttagttttaggattttggacggggtagggacggcgtttttggattttggatagtacgtatattttgattggggaacgaggtatttgtagaagttatattgttattggttgggaggatattttgtagttgattgcgttagtttttattggttaagtttatacgatattatgattagattatggaaaacgtatatatattaatagggaattttggtgaaatatattttttggaaattatttaggagataaatagtataataatgaattggtgttttttagaatagtgttaaataggagtgagtattaatatatttttttaatattgggtagatgttattattgtattgatttggagtatgatagtttatcgacgggatatgaggtattatataggttaagtttggttagtaaaatattaatgattgtagtattagaaatgatgtatttttgataagggatattatcgttttatataggtttttttattatattggttgattgatgtattttttttttttttttttttttttttgtttttttttttatggagtattgattaggtgttaggtattgggttagatgttgagattatacggtagaatgagatgtaatttttgttttatggtcgtatgttttagttagggagattaatagttaataaattttaatgttgtaatatgagaaggtgttggagtagagggatgtgggaaaggtgatgggagtacgaaggaaggtggtttttgttttgaatgggttttaagaggttttttttggtgtataattttataataaatatgttttattgttagggggttggttgttttttatagttatttattttttgtttttttcgtttttttttatttatttatttattttttttttttttttatttatttatttatttattatgaatattatttatttatttatttatttttttttttttttttttttatttaatatttattatttatttatttagttttttaggatattttaaatatataatttttttttttaagttagatttttttttttgttataggaaaagtttagttattaaggattattttgttaaagtgaaggttgataaaggagatttagaattttttttttgggtatatttaaaaataaaataggattggggttaggtgtgatggtttatgattattattttagtgttttgggaggtcgaggtaggaggattatttgagtttaagagtttgaaattagtttgggtaatatagtaagatttttatttttataaaaaaaattaagaattagtcggatgttggttgggcgtggtggtttttgtttgtaattttagtatatggggaggttaaggcgggtggattataaggttaagagattaagattattttggttaatatggtgaaattttgtttttattaaaaatataaaaattagttgggtgtgatggtgtatgtttgtggttttatttatttaggaggttgaggtaggagaattatttaaattcgggaggtagaggttgtagtgagtagagattatattattgtattttagtttgggtgatagagtgagatttcgttttaaaaaaaaaaaaaaataaataaaggaattagtaggattgaggtaggaggattatttgagttcgggagtttgtggttgtagtgatttatgattatgttattgtattttaggttggataagagagtggggttttttttttaaataataataataatatgattgttgttatttggttggaatgggtaggtggttttgtttaaaggtagaggggtttattggagaatgtgttaagagtgtttatgtttttttgttttatttattgttaatgtattaaggattattttgttaaagtgaagtttgataaaggaggtttagaattttttttttgggtatatttaaaaataggattggggttaggtgtgatggtttatgggtaggaggattatttgagtttatgagtttgagattagtttgggtaatatagtaagatttttatgtttataaaataattaaaaatgttttaagtttttttggattattagtagttgttatttgttaatattggaattgatcgtttaggttaaatgttgaggtggggattgaggttttggaggatgtatatttatagtttttgaggttattttttgttggttgtagttttaatacggattgatgattttgtatggagagttataggaggtttatcgttatttatagttgacgtttatagttagatatttacgagatgtttaaatttagaatgttatgtggttagtattttttaatgtttaaagtttttgatttgtttttaattggggggaaatgtggattgtttcgtttattggtatgtttggtttttgtcgtttaaatttttaaagatttttttattttttgtgaagtataaagtttttttggaatgttagggttttttaggcggtttgtatgttgtaggaagagaaaaggtgatttgagggtgggatttagaaatattgtattttttttattggaatttaaagtggggagttatttttaataattaattagtaataatttaagtttttaggattgaatacgtttagcggttatttgtttttattttggggttttaattgtatttgatgaaagttgtttattggtttaatagtattgaataaataggtaaaatttttagtttttggttgatttttttgaagtatttttagttttgattttgagaatttaatatgggttttttagtattataggtataggtaggtatttgattatttttggtgatatttattttttaatcgattttatggagggttttttttgggcggttagaaataataggtttttgttttttaagttaaatgtagatagaatagtttttttttttcgtgtttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttgttttttttttttttttttttttttttttttttttttttttttttttttttttttttttttttttttttttttaatggagtttcgttttgttatttaggttggagtgtagtggtatgattttggtttattgtaatttttattttttgggtttaagtaatttttttgttttagttattcgagtagttgggattatagtgtgtgtgatattatgtttagttaatttttgtatttttagtagagaagggggttttattatgttggttaggttggttttgattttttgattttatgatttattcgtttcggttttttaaagtgttgggattataggtgtgagttatcgtgtttagcgcgttttttttaaggggtagatgtcggtggtcgttattaaagtaattttaatgttatttaaaatttttattttttgagaagaatagagatgattttttaatgtttttttatatattttttaatgttttttttgtaattgtaataagtaaatttatgttattaatagttatattatgatcgtaattagtgattagtatgtggaaggaagtttaatttggtgattaatagtatatatatggttttaaatttggtttagttatttattattgtatgattttgcgtaagttgttaaatgtttttgtgttttagttttttttatttataaaatggggttaatgatagtgtatattttattaggtttttgggagtataaaatatgttattatatacgatatgtttaaaatagtgacgggtatatggtaagtgtgagtttttatattaatgaatgaataatttattgaattaagtaatattaagtagataaggtagtatttagaaatttgggtttttaatgggttataataatatagtaatgagtttggaatggtgttttgtgtatagttagtgtttaatgttagtaattcgtaatatggatatttgggttttatttttgtttggaattgttttatatgattttgatttaatttatttaaagtttagttatattatattttgtttttttttttttatttttggtgtttatgcggaaaagatttaattttaggttagagaaagttttttattaatattgtgagatgtaagttatattcggtatatgattagtaaattgggttttattttggagttttttttttattttattatttttttgtaaattttttttgtgtttgttttttatatgtgtttaagattttaaattatggggttatttgtattttttaaaatttttatttagtcgtatttttattttgtatataaggaaatataagtataaacgataatgtgtaaagtaggtatgaaattaattaggtttgttatggacggttattgggtttataagttataggtcgtatatgggtgattgttaatagttggttggatattgatagagagttatattaatcgagtgtttttttttaaaaatttagaattaggtagacgttaatgtttttttaggtatttttagtaaatagatttttttgagtagattagaaaaggaacgatttatttttgaaataatgttagtaaaatatataaatttagtttttatgagatttttttattgttataatgtttttttttattttgaatttaaagtgaatttttaaaatgtttaaaaattatgttttgtttaagtatttataagttatgtgtgatacgtgtttattatttgataatggttagagtttattagtgtaatttttaagtattagtttttgtgttaggttaatggatttaagaaaaaaaataaaaattaatattttaatttttaagatttggttttttaattttttaggaaatgaaaggatttaaatagtttgttgatatattttatagtgtgtttattttgtaattttattagtacggtgtgaatgagtttgatttattgttggagtgagggaggttaggagattttgataaatttagataatatgtaaagaaaatgtttagtaattggtggtttaggagtatttagaaggtttgtaagggtaaagtatttataattatgaaatgagaagggatgttattgataataattaattgattgataatatttagttataatagagtttagttaagtgtatttataaaatagttatatgatgttataggtaaaatgaaattttgaaagaaagttagtttatatatggtaaatatgttttaagttgtaagagataaaaataataaatatggttaggtatatagtttatgtttgtgattttagtatttgggaggttaaagttggaggattttttgagttttgaagtttgagattagtttaggtgatagagtaagattttgtttttataaaaaattaaaagaaaaaaattatttgggagtggtggtataggtttgtagttttatatatttatgaggtttaggtagaaggattgtttgagtttaggggtttgaggttgtagtgagttatgattatattattgtattttagtttgggtgataaagcgagattttatttttaataaatagatatatatataaatatatatataaattagatagaatattaaatatatttgttatatattagagttagattttaattttgatttgtaattgggttaatatttataaggtataggatgattttgatttttatgatttagagtatgttgagtttagtatggttttatgtattaatagtttaaaaatatagtgaatgaatataattttaatgaataatttttaaagatggatagagtattttatttggtaattattttttatatttttttatttacgtatttatttgttgtatagttattatttttttattcgtgagtattattttttatttatttgtttgttgagtaagaataacgtagatattaaatattttgatgttgtttggttttgaagaattggtgagatggatttggtttttttattagaatattattatttttttatttgagtttttggggatttaataattatgttttgagagtaggtattaaaatggtaaatagtgaattttcggtcgggcgtggtggtttacgtttgtaattttagtattttgggaggtcgaggcgggtggattataaggttaggagatcgagattattttagttaatacggtgaaattttgtttttattaaaaatataaaaaattagttaggtgtggtggcgggcgtttgtagttttagttattcgggaggttgaggtaggagaatggcgtgaatttgggaggtggagttggtagtgagtcgagatcgtgttattgtattttagtttgggcgatagaggaagattgtgttttaaaaataaaaaataaaaaataaaaatagtgaatttttatttaaatgattaattttatttgaaaatgtaaaagtatttaatgagattatgaaggtagaaaagttatgatgtattaacggattttaatttcgtatttattttttttttaggttagttttgtttttatttgtattatagtttgtatttttattgattgattttacgtaggatgtttataaatagtaattaaaaattgaaaaaagatattatattgtttaatttgaaataattttttaaaattataaaaagtttagttttaatatagaagttgtgattaatttttttttttgttttattttagaaagaaattggtatataatcgtaattaaaaattgaaaaaagatattatattgtttaatttgaaataattttttataattataagaagtttagttttaatatagaagttgtgattaatttttttttttgttttattttagaaagaaattggtatatgtaagatgaagaaaaattttgtttttaatatatattttgttaggtttatcgttaaaatatatataagttaaaaatatcgattttatttgaatattttgggggttgtttaaatatgtttgtttttttagtgaagttaaaaatgtttttttttggtgtttttgaagagatatttagattaaaataaaaataaaaataaatgatatgtataaaaagttatagttattagatttggagtagaattcggaaagcggatggaggaagtgaattttaagatttgtgtagtagtttttttattttggttgttttaaatagacgtggaaaaataaatcgaaagaaaaaagtttatttttttttattttgtataaatgagatataaaaattgattttttatttggagttaagtttaggaatagattaatgtatgtttatgtaatattttttttgttattatagattaaatgttattattatgaattttaataggataagattttttgtttgtattagattttttattatttggtatattttagatatgattgagtttaaaaattttagggggatgaaaattataaagaaatatttattgtagaatattgattataattaaatttgatttgtagtttttttttaagtgagaaaaatataataagaattttagtatagaaagggtttttttatttggataattggaatgaggtttatggttttggaaaatttttgaaaatattaggttaagttttttgtgtttgtgaatttttttggagagaggatatatagttgtaatttaattattaaaggatgtatatatatatttataatattatatgtatatatgattatatatagatatatatatatatgtatatttatttatttaatttttaaaatttttatgaaatgagtatttttttgttttttattttatagataataaataaataaagattatttattttttaggttagtagttgttttatttaatgttaagggatttagttaagattatgaatttaaaatttaatgagaaatataattgaaatttagaatttttagtacgtatggacgggtggatgaatggatgttttaggttttttattgttgtttttttttttttttttgtttttttttttttgatgtatgtggatggtttttttgttaatttataatttagtttaatgttaaatattaatttatatttgttttttttgagatttaagtaaaaaatggtatatttattttttgttataaagagtataaagaggttgggtatggtggtttatgtttgtaattttagtattttgggaggtcgaggcgggtgtattatttgaggttaggagttcgagattagtttggttaatatggtgaaatttcgtttttattaaaaatattaaaattagtcgggcgtagtggtaggtatttgtaattttagttattcggggggttgaggtaggagaattgtttgaatttaggaggcggaagttgtagggagtcgagattatgttattgtattttagtatgggggataagagtgagattttgttttaaaaaaaaaaaaaaaaaaaagtattaagaagttttacggtttttttttaatttttttgttattttttttaaaatattaaattttgtggaattttattaagaattatatagtatatttttaaaaatatatgtttgtcgtttttatttaagatgttatattgatttataaatttaggttgaggggtatttgttttgatattgtttgaagtttattatattttgttaaaagttattttttttaaatattatcgttattcgtaagttttttataagtatttttttagttattttttaaagtttggataaagtttattttttggaattttgggtaattaaattattagtatttatgaaaaaatattggaaaagaaggtttagttttaaatattgaataatttttttgttgatttttaaaagatataggtaaatttaaagattgttttatttgttaattgattaaaaaaattatgaaatataatttaagttagacgtgggagtggtattagttaaatgttatagtcgaattagttaattatttgttgtattgtttagagatttttatatatattatttttaaaagttatatttaaaatatttagtaattagtatagtgtgtatttaggttaattagattaggttttagttagttgtaagtagttagtatagttgggtaatttaggtgaattttagttttgttagtttatgtaaggtttttattggtgttaaatttgttttattaatggatttaagaaggaatttaaagtgtgaaaatttaggttttaggaagtgaaggggtggtttggattaattagttggtaaatgatagagaggagatttaaagttagattttttaatttttgtttttttttttttttattatataggtgtttaaaaatatttttagggagataaagttgtttggagttttacgttatattagatagtaaagttattgggattatttaggagataatttatttagatatttttttaagagtattaggagtttgagagacgggtattttttgatttttagttttttacggggtttatatttttttgaatagttttattgtaattttttttgttgtttgtgatatgggaggtatttatattggagatgtgatttgttatgatggaaggatatatgatttgggatgatgggaaggtgggtgaaaattgtggatggaatttttaagtaaagggaaatttaaaaaatgattttagtttgaatttttatagcgtggtttggttgtttgtttttttagacgagttgttttgttcgttttggttaggatttggtatggtttattgaaagaatttttttttattagtatggggagtaatggtaggatggaaatgagtgttttgagaatgtttgagataaaattattggtagattatttaatattttttataatgatgagatttaatttaataaattggtttgttttttattttttggttagttttttttgatattagagatttagtgggtttgaggagggtagtttaggaggttaatgtgggtggttaggtatttggggattagggttttaaaattttttttttgtcggtttttaatagggtgtttgtttgtttagatcgtgttaggtatagagttagtatttgtttagggattgtttgttgattgaatgagtgagtgaacgagtgaaagaaaggatgaataaattaaatagtgaataagttagtgaataaaagagtgagtgggtggtagtagcgggtaaatgggtaagggtagtaatagtttttttttttttttttttataattgatatatagtaattatatatatttatagagtatatgtgatattttgatatatgtatataatatttaataaattagagtgtttaggatatttattattttatttattatttttttgtgttgggaatatttaaaatttttttttttagttattttgaaatatataataaattgttaattatagttaatttattgtgttattaaatataataatttatttttttatttaattgtatgtttgtatttattaattagtttttttttattattttttaatttttttcgaagaatttgatgtttttttttttttttttttttttttttgagatagggttttatttttattttttgggttggagtgtagtggtataattatagttttttgtagtttcgattttttgggtttaggtgatttttttattttagtttttcgagtagttgggattataggtgtatatttttacgtttatgtaatttttttatttttagtagagacgggtttttattatgttgattaggttggttttaaatttttgggtttaagtaatttattcgtttttataggggtgagttattgtattttgttaatattttttaaaagtaaaaaataaattaaaaaaaaagtttttagtggattgttgagttttttttgataggaggtattaaatgtgttttttttgaggataggggaagagtttattatttagttatatttttgtatattttataaaatttatttttattaaggatgtttttttataaaatgaggagtagtataaagaatatttaagaaattaggtttgatttagggtttttgatgttggggtaggtttttcgcgtgttaatattttaggggattttgttgtagttttttgaatatcggttgtgagttttttaattttagttgagttttagtattttttttatattatttattttttttgtttgtttttggcgcgtttagataattggaatttttgttgatattttaaatgggttggttatttttttagcgtggaggtatttagtataaggtgtgatagattagtatttgttgatgagtaataaagttattttggtaaattggattttttttttgaaacgttttggtttttatatttttaatgatgggttaagaaatagtttttaagaagaaggggcggagatagggggtaggattttgtttgaagtttttaagttgattttgtttgtagttatttaatttattagggagggttggatttgtttttttgtggtggatttttcgtatttttagaaagtgtaggggtggagaattaatttagttttttttttttttataagagtttcgttaggttagtttgtatgaggagggtacgtgtatatttttaaaaggattggtgtagttatttttttaagtttatagttttagtgtgagtttagggtttagattcggggtttttggtgttttaggcgtgagttaagttttttgagtaagaggttttatgataaattagttggagtttgggggttatgaaagtattggttatggtagaaattattagttcgttatcgtttatgttgttttgtttaaaaatgatatcgcgtaagggattttgttaatttttaatttcgggagattatttattatttggttgtggttcgtcgttgaataggaaagtatttcgagatgttaagagattaaaaggttcgtaattgttgtttagaaatgaaaatggttttaaattataattagagatggaagcgcgttttaggggagggcggggcgttgtgtaatcgagttttttatgcgtaaggcggatataaacggtttatggatgtgggcgaaggtttttagagtaaagaatgtttatttttattagattaaaatatagtttgggaaaataattatttgtttgagattttgggaaagtaaaattttttggtttttttgttaggaagaacgattgtaaaataagggttgagaattttttaaataagattttagaattttatttaaatagttgtagtttatttttgaggagttttagatttatttgggtttgatggatgttgtaatattaagtttgaggtttttttagtttggtgttaagagtgggttttaggggataaatagagaatagttgtttttttaatcggagtagaaaataaaatttttttttttttttatttttaatttttttgttttgttgtgaaattgttattgcgtttttgaggagtgattaaaattttagttatgattaatttaaagggtaggtttttaggtagggaagggaaaggggtttaaggtaaaaaaaaaaaaaaaaagttagttgaagtgagtttatggaggatttggggattataaaagttatgggatttgagttaattaaaattaatggaaaagtattaatatgtaatttaaaaaataataataaaataaagtagtaaggatatttttggtttgttttttgtttttatttttgagtttgtttgggaattttggagtagattttttgaagtatagtatgagtgtttaatggttgttttaatttatttttttgttttttatatataaagattttgtaatggagagtgggaatgaatggtttatttatttttgaatattttttgtgagttgggaatgcgtttagtaaggttgttggagtggagggaaaagaaaaggtgtttgagttttttagatatgggtagaaaaggagagaatttgagataggttgagagaaagttgtttcggttggtagtattgttagatttttagatatatcgtatattttagttttcgaaaaggttattttgagtttttttagggtttttggggtttttattttattttaaatatttggaattgtttgtgtttgttataatatataagagtttttttttatgtttttttttggtgttatttgtaaaggtgaggaaaggtaacgatattaaaggagttttaattttatgggtttggtttttagaaagttttatgttgcggtgcggaaggtaggtaaggaggcgaaggtttttaattttatttaggggagggagtatattttagtaaaggatttagtttttatttagtttgaattttatttgtggtttttggatggatatttatattgattaagttaagagatttcgattaagtttttttatttttatttttacggtggggatgataatagtatttaattcgtcggtgagagtttttatgacgatgaaatgagttgttaggtattatagtgtttagaatgtagtatagtatatagtagtttaatagatgttcgattttattgttgttgtaagtgtttttattttttgattgattatttatttagttttttttttttttatttaatgagatttttgtagtattgtgatgaatgttttatagttattttttttatgaaagattttagagttttaagttataaaagtatatggttatttacgtaatttattaattaagtattatgttttatttgattaggaaatttttatttttcggtattattttttttttttttttattttttttttttttttttttttttaaatttattatatatgtttagttgatattttattaatttttgacggtttatggaaaatgtgttttagttataggaatattgatgttttatagttaagttgtttttttgaattagatattagttttttagttaaatggggaagagtagggaagggagatattaaaattttttgttaaagtagaagttttgggtgttgttaggaagttttgttttttagtaaaaattgtagtaggaattttttttttttttttgtgaaacggaaaataaacggtttgtttcgatttttcggttttatgggggttgttgagtagtattgttttttttggagagagaaggtggaggtagaagttgttcgtttattttattttagatcgtttattttattttaggtttaatttttatggcgttttttatttttttaggttgattacggtaacgtgaatgtttcgttgttagttagttgagtattgtttttggtgagaattttgtttcggagaagtagggggaattgaagttgtattgtaggatagggggtttttagttaatgtttttagattttttattagtgatggggtttttaaattattagtgatggggttttttattattaaggttttttagttttttagttttcgggttttttagggtttttacggtagttgtttttatgggtagatatatttttttttttattatagttatagtaaaaataataagtagtaaatttattaagggttttgtgggtttttatagattaatatttttataatgtttagtggaaacgtgttagtgtatagacgttttgatttattgtgatttaaggggttttttatgtttttaaaaataaatattaatgtggagaagatgttttgttttattatgtatttttatggtttacgacggaggttttaaatgtaaagtttttaggataagtaagtgtaatatgtaagatagattagttatttttatttttgttattagaaatgaaaaagcgttttttttttgtttggttgtaggttattaatttggaggatgttagttttagagtttattttagtttgatttgtaaatgaaaggtggaatttagttaaaattatttttgtgtggttgttggttttggtacgtttcgtatattttttttttttatgttgaggtgggatagttattgaaattattagaaagagtaattaggaggtgtaaaataagttttggaaggtagtaaagttttgtgagtaatatagaattttttttttttagttttgcgattgggatttttatttgtagagaggattttaagtattggtcgttagaattatttagggcgtttgggaaaaatgtagatgtttggattcgttagtgagttcggatttttgtgtttttttttagtttttttaaaataatattttagaattattgttttttagtatagtagagagaacgaagttatggggagggttaatttgaaatagagttgtggattttttttaaggtttattattattaagttttttttgtagaatgttagatatgtgtttaattttattattattttattaaatttatatgataatttgtaagtacgatttgacgtttttgttttgtggatgaagaaatagaagttaagagatattttagtgaattttggatttggaaatttacggttaggaagtagtttgtttgatgggaagggtagatgtatgtaggttttatagaaggagttttgtttttttttttgagttttttttggttttttacgtttaagtgtagggttagagatggggtaggtatatcgtttttttgttggggatttttaggtatttgttggggggtatttttttattttattatttttggttagtttttgattttttttttttttttggttttaattttttttttttattttgttttgtttttttttttttttttttttttttttttagagagtagttagttttaattttgtaaatatagtgaaattatttggagagtattgggttttatttttagggagtgtggtagaattgatttggggtgtggtttggatattagaatttttaaatattttaggttgattttagtggatagttaaggttggaagttgttttttatttagagttgttagttatagtttgtataattaggagatttatttggatatgtttaggttgaagagggtttggttattagtttacggtttgaaatagagttttgtgaagaaggattaggtggttttagtgttagtttagttatatttgtattgagaaaatatagagttattattagttgatcgtatggagcgaggattttaatatttgatggataaaatgcgtttttggttggtttttgtagagaagggattgtggaaaaatatatgttgtttttttgagatcgggggatgtttatagggtgggtgataggaagaagagagagtagttattatagttattttgtatattaaatagtttgaaataaggggtggttgtgtaaattttatttttttgttataaattagattataaaataggttttattggtttattttgtaaattaattttgtagttttattatatatataaatatgtatattatatgtaggataaaaaaattttgtatagagttttgttttgtattaatttttttaaggaaattttatagacggtaaataaaattttatgtttttatttggggtatttgtttgaagataagagtaatttattgtaaaaggatttttgttgtaagatagattgtagtttattaggggagagtaggatggaaatagaggttttttgaaatatttgaagggttttgtaaattgttgaagttacggtattgtttggagtatttagtatcgagttgggtatgtttaggttattgacgaatttttgttaatgtataaatgagtagatgtatgttatattgatggtggggtttagatttattttttgttatggataaggaagtgttggggaaggaaaataaatataaaattttttattcgaagtaagattagttggtagatgagcgtgtagaaggggtaatagtaatttatggagggtaagttattagagagggtaggaaatgatttttttggatattttttttttggttgtgggttagtagtgagggagagaaagaagagggtaggtgtttgtttttttattgttttaggagaggaaaatgttttttatttttatttaggagttggtgttgtggtttatattatagtaggttttatggaagttgagttattatggcgaagagggtgaggtggggtatagagttgtttgggatataggatttgttttttttatgggtatgggatagttgttttttatgagagatagttgtagatggggttttcgcgtttggttattagtttagttgtgttcgtgggtattttagagggttaaagtagtttttagatgagagaaaatttaaagataataagaagtaaattaattttgaaaaaggcgattgaagataagggttggtaatggtattattttatgtgtggaaggagtttagaagaaaggaaatacgttatcgttttttgtatggggcgggggcggggggtttaaatagatgtttgagaattgtatatggatatttgtaattatatagtttttatagtaaatatttgtttggagagaatttttttgttttttttttttttttattttttgtgtatattaaatagtgtaatttatgttagtaagaataattatatattttttttattatttttttttgagtgtattttaaggtagtattttattatgttgtggaaggagtttgtatggggttttgtttttaaatatattatttttaggattatagtggtatagacgtatgatagagtagaagagaaaaaggtttcgtaaagaaatagaatggttttaattttgaagtgtttgattataatttaattgagtatttgtaggagatagagttattaattagagtagggatttatcggttgttggttgagaggttaacgttggttttggttatggataaggagttttgattaattatttaagaagattttgggaatgtacgtgtgggtttagtttgatatcgatttatttttttaattttttgtatttagattttgtgtttattaagttgtttttgtagtatatttggttttttaggaaaatttttttgtagagagagtatgggttggttaggtaagtatgaatattaatttgaaatatttttattatagatgaatatattggtatttttgtttgaatatttatatagttggtttttaatgggtgttagtttttaagagatggatttggtttttgagggatgaatagattagatttttaagtatgttaggaggaagtttatagagttttgttttgtattaatttttttagggaaattttgtagattgtaaataaaattttatatttttatttggggtatttgtttgaagataagtgtaatttattgtaaaaggatttttgttgtaatatagattgtagtttattaggggagagtaggatggaagtagaggttttttgaaatatttgaaggtttttgtaaattgttgaagtttttcgattatgatgaatttagtaagtaatgttatttttgaaggcgttttgagggttatatttttagtttttttttgatgatattcgagtaagttgttgaaagttttttttggttattttttgaatttttatttttttttttgaatgtagattgtagatttagaaacgattttgagttttttagggtttggatgtttgaatgtgattaatgtggttttagaagtagtgggtattttggttttattttttagcgatattgttaattttatagttgataattatttttgatttgttaaattttttggttttgtttaattttgatttaattagattgaaagttaggtaagaaaggttaattagagggagttatgagagatgtttgtttttatagaatataggttttggttgggaagatataatatatatatgaaatggttaaatatatttagtgttataaatgaaaatatagtttatattgattaagaagtgagtaggttagaattgggtggtattaattttaaaaggatttttgaaggaagtatttttatggaaaagtagtgtcgtgataaaaggataggtttttaggttaattttttgggttttaacgtttgattatttgtgattttataaagtatggttaaggttaggtgagtggggtaggaataaagtgtttgatatatagagatgttaaaaaaagtgtttttataaatatttttgtaagggaaaggatgagaagagataagaagaagaaaatttgaagtgttttttttagggttagttgttttttatatggtattttatttgatttttatagttatattgtaagatgtttattattttttgtattttataaagaagaaattaaaggttaaggttaagtaatttatttaaagttattttgttgatttgtggtagagtttaggtagtaatttttattttgtgttaggtattattttaaatgttttatttgtattaattatttcggttttataattttatgaggtaggtattatttttaattttatttattaaggaggaaattgaggtatagagaggttaagtaatttgtttaaagttaatatagttagtaagtaatagagttaggatttgaatttaggtaatttgggttttgagtttggaatgttaattattttattatttttttttattatatatgttatattgtttttttttgaagaatatttatgaatagataaaattgttaaaatagtttggagttttaggatgaatattttaaatattataaattttttattcgtaggggagtggttgtttgatatggtttttgttgattatttagtaatttatttaagatagtgatgtgtatagattattttggttttagttaatatatagtattatataaatattgatttaattggagagtttgaataataaattattattagtttaagtgttaaaatagtatttgtttttttttgtgtttgagtatgttatttatttatattttgtttatttttgtggagtttaaattgttttatgtatattttattattgttgtatttatatggatttattgtttttattatatatatgtgattaatgtattatataacgtttaatatttattataggaattttagtttttaattagttttttaatttatgggtattattgattgtttttaatttataattagtggaagtttgttaataataaaaattatagtattttattgtttattttttagtttaatttattttgtatatgatatgattatttttgtttttgagtatgaattatatattattttttggtttttttttataattttatttatggttgattttgaattagaataggtttgtgattttattttttaaagtttaatatatgtattttttttttgtttatgttgatatttgtattggtatacgtgaatttttaaatttggtttttatttttttagtttttataggtaaaaaataaatttggatgatgtaatagttagtaaagaattttaaataaaggtttttttgattagttggaggatatatggaaatttttaattgtggtgtatataaattgtaaatttaagtttatatattgttaggagttaatagaatttaagatttagtagtattttttagtattagatttataaagagaaatgaagaaagaattgttatttgatgtttttgttttgataaataaaaatagttaattgtttagtttatagttggggtattttgtttttttttgttttttttttatgtgaatatttatttttattattgaaaatagaaattttaattttaagtatttttttgtttttgtaaaaaggatattatattaatagttttttttaagaataggaagttatcgttttattttatataagtttttatagtttttattttgttttggtgtgttatttgttagtgtgattttaggaaggtgagataggtatggttagatatgagagatttttaaaagttatagtgttaataatggtgttataaggggagtgtttagtaatagagttatttattttaggaatgtttttgtattttggtaattttgatatgataaggttttaataaggttaattaagtaatttgtagttaatatttttatttaagagaggttagatgtttggggatttatagttgtatagatgtattgtgtgtttttttattttttttttatgtatatgtcgttttttttatttagataagtgggtatttttatttttatgattttttttttaggatttcgtgtagttattattttttttaaaaagttttttttaaaattaagttggatgtttgttttgtgggtatagttttttatatttattttatttattttaatgggttgaaaatattaggaaaaattttagataaagattatgttttagtaaatagttgaataaagaataggtgaagggtgttagaaaagtaagaaatggagatagaggtttggaatggtttttttagtattgttgttgttatttttatatggttattttgggggtatacgtggagttgtggaaatttttaaaattaaaattaggttaggtttagaattagttcgattaatatagattacgttatttgaatgtttttaaatgtagattttgtttttttatttttttttgttttttattttattaaaataaatagtggtatggtatttttatttgaattaggtttagttttgaaagttggagtagtttttagatggtatgttttatttggtttttgtttatagggttggcgtttagattatggaaatattagtagaatcgaatgtatttgggtagtttttataaattttgtaagtatacgattaaagttaagataaatgggaaatatagaataattaataataatggtgagtggaaaatgttagtaagttataataatttaaagtatgttttttatttttttttaagtagttatttgttttatttataaagatattgtttgaaaaatgaatttattagttttatatttgaggtagaatgatatatggaaatagtatagtttttggcgttagatttgagttttagtgttagttttgaaatttatttgttggttgtatggttttagtaagttttttaagatggtagggtttttgtttttttattaatttttataattttggaggtttagagaaaatataagtataagtgtttagtatattataggggtttaataagggatgattagtgttattattattatttttaatattattgaagaaatagtaaaataattagtttggaaattatgaatgattttaaattgaattggagtttaattatataggtgatagaaataaagattggaataagtaaattagaatataaattggaaaatatttaataaatgtaagaaagtaaatttttgaataatttaattatatttattttattataatattatgtatatattaataaattttaatttgtattaatttgtaataatattaattttaatttataatatttataatttttaaattatatattagttgaatagtatattatatatttttttagaaaatgttatgaatatatatgtatttgtatatgtatttaattttttttttattaataaaataatattatttatatagatttttattttttttttttataataaattttagatattttaaaatgtgagtttatatgtatttattattttttttaatagtagtattttattttatattagtttattaatttagttagtattttatatagatatttttttttttttttaagttttttttttttttttgttgtaaaattaaaatatataatgttgtaatagatatttttatatataggtagaaaaaatttgtagaagtgaaattattaagataaaggttatgtaaatttagtatttttaaaattaaggttaaagcgttttttaaaaattttataagaatttatttttttattaatagtatataaaaaaaaaaaaaaaagaaaaagaaaaataatttaggtttttttatatttgttttttttaattttttttgtttaggtttgttttagggtagaaggtataatttagttatattaataattgatttaaagggttattatttagtatttagttataatttatgatagttttttgtagttattttttgttgttgtttagtttgaaattataaataacgttggaggttaaaaagtttttgtttgttttaggttaggtatattaagtttttttagttgaaggttttttaattatgtaggaagagtttttttatttttaaaagaaaaaagtaaaagtaaattaaattaattatagataaattgagttaagttattttgtatgtattgaatgtttttttgcgttaggtttagtattagggggttttttatatattatttattttaggttttacgtatttttgaggaagttttttagattgtcgaattatatttgggaaaacgagaattggtgttttattttttatttatcgtatttaatgaagtgttgtttttaattagtaaaaataggttattttattattagttagaaatttttattaatagtcgtttttgagataattgatgtttttcgtgtgattttgaggtttggtgagatatttaagtgttttttaagttattagaagagataaatatgtgtttagtatagttgtggtgttaagtatattttgttgtatttgaattttataaaaatttgttgtggaaaagtggtttattgggtatttttagattaaatagaatgttgaattaattagaatacgttatttttttagttgtttgggggtttattgtatttaagataaattgggatttattatattatttagttttgattttggtattataaattttttttttattttatttttattgttatattgagcgaaagaatagaggtttttttttttaggataaaaaaatgtgaaaaagggtaattttttattattttttttaaaaagaattttatgtaagattgttgaatttattttaaataataatttttaaattaataattattattttgagatgagagtaaataaaaaattggattggaatgtagagtttgataaaatgattttatgttacgggatattttttgtgatttgcgaatataaatgatagtttattttttatttaaaatattttttttaaggttaggtttttgaaatttaatttatattttttttttaaattaataaggttagattttaagtataaaggaatgttttatgaagtattagaagttggatattaatagtattgtgagatataagttaatatttaaagtttattttttatttttagatggtagggatataattgttatttagtttatgttttttgtaagggaagaagggattttttttttttgagggttaagtttttggagattgtttttaattttagaaattatgggtttgttttagtaagtgaaagttttattttattttatttattttttaaaattttattttaagttttgggatatatgtgtattatgtataggtttgtgatataggtaaacgtgtgttatggtggtttgttgtatttattaattattatttaggtattaagttttatatgtattagttatttgttttgatgtttttttttttttcgtttatttttaataggttttagtgtgttgtttttttttttgtgtttatgtgtttttattgtttagtttttatttataagtgagaatatgtagtgtttggttttttgtttttgtgttagtttgttgaggatgatggtttttagttttatttatgtttttgtaaaggatatgattttatttttttttatggttgtatagtattttatgatgtatatgtattatattttttttatttagtttattattgaggggtatttgggttggttttatgtttttgcgattgtgaatagtattgtaataaatatatatgtgtatgtatttttataatagaatgatttatatttttttgggtatatatttagtaatgggattgatggtttaaatggtatttttggttttagatttttgaggaatcgttatattattttttataatggtttaattaatttatatttttattaatagtgtaaaagtatttttatttttttatagttttgttagtatttgttgttttttgaagtttttattttatttatttttattttagtaattataataatttggttttttaaggatagatttatttttaattgaattttatttttgaggtagaaaaaattttgtgagattttagtatatttaaaaatagttaatttgtatttagtagtgttattaatttatttatatgaaaaaatattttgtgtgtatgaaatatattatattttaagtagttgaggtgggtttttggtgaaattatttattgtaggtatttatgtataagtagttgtttattgaagaagttaagttagttttggagtttaggataagttttaaaggtttttgatgtgttaagtggagattttgaaatttgtgttagagagtaggttttaggtcggtgtatttgtaaattattggaaaaagtagtgtatttgaatttttttaggatagattgttgtatgtgattaattaatttttgattaattagaaataattaagcgttgaggttgaaatatgaaattaaaaaagaaaattggtttagtttttattttttttgtattattaaaaaataatttataaatacgtttgttatatttaaattatttatagtttgagtgttttttttttttatttgataaattatttattgaattattatgtgtagggtgtttatttagggtttgggagtattgtcgggattatgataggtatggtttttgtttttatggattttaaagaataaataagtatagtattgattgtatagaaatatttagagaattaaagtagggtgataggagagggaatgattgggtgttttaggggagttttttaaaggaagtgatatttaagttgagatttgaaaggtaagaaggagttagttttgggaaagttaggggtagtataatgtaggtagaagttataagtagtggaagattttaaggagggagtaatttgatgtgtttggaggattaggaagttagttcgagtggtttataagtaatgggggagtgtgtagttggtgagagttgaggtttgagaattagtgcgaaggtagtgtaagattttggaaattagatcgagagtttggatattattttaggatgacgggaagtatttggggtgataagataagttaaaaagtatggtttatatattttttttataaagattttaaattagagagatggttaataagatggtaggtgttttgaggtgtacgtttattttttggtgttttttatttaaagagttagatttttgaaagtattgatggtagttggttttttggaatgatattattaggggatattacggttatagtatttgttattgtattagttttaatttggttaagatttatattattaagatttttttttttatttttgttttagtatttagatttaatatagttttttatttttttttagaaatgtttttttgtttatttttgtatttttaatatatagaagggttttgtttttaagtattgatagattttatatttttgtgtaattaattttggttaaaaatatttttaatatttttgaaattttgaatgcgttttattaaggaaataagggtaattaattttatagttatatttgttttatgtatgaagagaaaaatttttaaataatatttcgtgatgaaatgttatatttaattattaaagatttatttttagtaaagttaatcgttgagtttttagttaaatgaaaggttatgtgttatttgagaagtatatgttattgtggttattaaattgttaatttggggtaaggtattttatggaagatgtttgttatgaaaggagagtgtattgtagtgattattgttatttagaaatgaggattaatttataaaaatgataaggagaatatgaatttaataattatattttaaatgatgttttaaatatgtttattaaagtgatatttgtgtgtgtttgtgtgtgagtgtgtgtgttaagaatttttaatatgagatttgtttattttttatttttgttgaagggtaattttttatttttttttttttttaggttttgataattattattgtgttttcggtttttgtgaatttggttattgtagatgtttatataagtggaattatgtagtatttgtttttttgtgattggtttattttattgagtatgatgtttttaagaattatttatgtagttgtatatgaaaatatttttaaggcggagtagtatgtatgtgtgtgtgtgtgtgtgtgtgtgtgtgtatatatatatatatatataaatatatatatatatatatatatatatatatatatatatatatatatatatatttttcgtatttatgtatttgtgaaatgatattttttgatatatattattagtggataaaaatgtgttttgaggttttagtatggtggtttatatattaaatatatggttttaaaatgatattattatatttagtatggtattgaaaagattgatgtagatttatttttttattagtatgattttaagtaagatatattatatttttaaattttggttttttatttgtaaaaaataaaaataattatatttattttttatagggttgttgtgatgattaaatgagataaattatataatatagtatatgatatagttattgatatttaatatatatgagttttttttttttttagttttttgtttttatagtaatttaaatttttggtaagttaatagtttttatttttcgatatagttattagtattatttaattttatataaattataaataggttggaatttttgtttatttgtttgatgttgaagtagaaaagtgtttgttagatagtaggtgtttaataaatagttattgaatgaaatgaatgaatgggaagttatattggaatgaggttgaatgtgaaggttagttaaatattttagtagaattattggatatgtttttaatggaagagatatatttttaaatttttttttttttttttttttgagatggagttttattttattgtttaggttggagtgtagtggtatgatttcggtttattgtaatttttgttttataggatttaagtaatttttttgttttagtttttttagtagttgggattataggcgtgcgttattacgtttagttaatttttgtatttttagtagagacgggattttattatgttggttaggttgtaataatatagtgattattatagtatattttatattgtagtatagagattgaggttggtatattttatatatgattatgaatatttaattattatgtttatgaattataaaaaaattagtagataatttataagtgtagttatgttataaaataattaagtataaaaattatttaataaagatagtagtggttttattaaattttgtgatattttaattataaataaagtattaatgggaaaagtttgattttaagggtttttggattagtagtaggttagtgatatttaggagagtaggaattatggcgtataaggtttgttttggatttagttttaggatttgagagtcggtttggggaagttttggtaatttgtaaggttatttttatagaagagttagtggtggtaggtatcgtttttttagtttttttagtttatttttttatgatagtgtagtgatatattattttagaattatgattttagaattatgtagttatatggagggggtatatttaatattatagtggatggaaatcgattagagtgattttagaatattaagaaaatattatagtggggatggaaattttttttgtttataaagttggggattgggagttaattttgttattaataagttgtgtagttttgggtaagttattgaattttggtttagtaggttttggttttattatttgttatttattaatataggtcgtttttatttttatttttttattttagaagttttatgtttggattgtggcggttttggttggtatttttttttatgttttgttgttttggaaaagttatatgtgtagaaattatagatggtagtaggggagataataaggaagaaaaagttatttttttatttttttttaaagtattatgtttataattgtttatatttggtatattttaatagtaattatttgtaaggtttaaaaattttgaattatgaaagtgaaagaaggagttttatttttaaaaggaaaattaaagatttggagaggattatttgggatttttttattatatttagataatggtaggtattattgttttatgtagtagtatgtttttatgaatagattaatatatatttttaggttgtaaaatagtgttttaggatataatatgttgatttagatataaaataaaatattgtttgtattgtaggtttttaatgaaaagtttaaaaatatatttatttaataaatttttatttttatagggtttgtttaaaaaagtttgttttaaaaaaaatttaagtatgggtggttttatatttagaagtggtataagaattttttgttagacgacgtgttttaatttttgttatggaaaatgtggttattataattatagtttagagaaaataaaaggtttttaaaattttatgtaggaggggaataagagtttgttagtatttaataaaattataatttaattagtttttaggtatagcggaattagtagttaaattatagtattggataattttttattttattttgtggttatttgtcgaagtgttttatttttttttggagatttaagttttttgggaataaatgttaagttatttgtatttttgtaatttttattagatttggtatacggtttgttttttgtgtttaatgaattataaagaattttttaggaaaaattatttgagaaatattttagagtaagaggaaattaatgtataatttgttaaaaattatttttttaggttgaaagatattttaaatatatattttaaaaggtttatttatggaaaaagtttagttgtgtaggttttgaaatgagatttagttaagaaaagtattaatattaattaagtattgataaagaaggaggggggagtttagttaggtaatttagttatttggttattaaaatttttttttcgatggaaagaaattattagagattgagcgatttatattgaaggaggagttataatgtaatcgtttttttttatgtatggttttttttttggttttgaaataaaagggttaaaggtaaatgagtttattgaaaattaatgagagttgaacgttgtatgttgttaatatgtttatttaatttaggtattaagaaagaatcgtgcggttttttattatacgggataaaatataaaagtttttatatataatttttgtttgttaattaaaaataattaaataaaaattttaaaaatttttttaaataaaagttttttaggaaggttgggcgtagaaggatttgaagttttttgtatatggaaatattatagttatgagttttttttagtttggattttttgtattttttagattttttaattttatagtgtaatttattttttttttaattatgaatatgtattaattagaaattttaatattttagtatttgaattttatttttttaattgtattttattattagaagtagttaaaaaaaggttttttttaaatttattttttttacgttttgattttttgtaatagaaataggatgacgataaatataggtgagagaaaataatgttttttcgaaataggtaagaaagttatggtttgttgatatgtggttgttaaatatatatgggtggaaatcgatttgaagggtttgggtttgtgtaaagatgttgtatgatttttagagtttaattcggttaagcgttttttgttattttttagttgtgtgattattgataaatcgtttattttttttgagttgttgttttttggtttgaaaatggagtaaatgttcgtatttgttataggtgtttagggtttagatagtgtaagttataagtttatagtagtatcgtgtttgttatgtggtgagaatttattatatggtggttatttttggtgttattttttgtagtaatttgttttgtttgaattgtgtagaatgtaattaaatgttaaattttttttgtatttttagtgataattttttggtgatagttattttagaggacggtgtttgtgaggcgttagttatttttatagttgatttttttatgtttacgtttgtttaattaggggaacggttatagtaggaatagaaaagggaagggagagaggaaaggagggagggaaaaagggagagaaaggaggaagaaaggaagaaggaagtgagggaggaggaagtttttataagatgatgtaatatttaattttttatttttattttttgttaatcgttattaaatattttgaatttaaatgaaaagtatgttagttagatattgaggggtgaatttgttttttgtgagagagtatagttttgttggtaaatgggagtggagagtagaaaagaaatataaaataaatagagattttagttaaattgatttgttttttttagtttggtgtgggattttttttattgaaaatttttgttttttaatattgtattataaggtggattttatttgagttttttaggttatttggttttttttttgtaagaaagtagtttatttgtttttataataaagtagagtggtttttggttgaggaaggagagaattatgagttgaaggaagacggttttgtatgattatgttatgtttttgtatacgtaaagatgtagagatatatatatatagatatatatatatatatatatatagagatatatatagatatatataaatatatatagatatatattgatatagagatatatatatagatatatattgatatagagatatatatagatatagagatatatatagatatatattgatatagatatagagatatatatatagatatagagatatatatagatatatattgatatagatatatatagatatttattgatatatagatatatatagatatagagatatatatagatatatattgatatatagatatagagatatatatagatatatattgatagagatatatatagatatatattgatatatagatatatatagatatagatatatattgatatatagatatatatagatatagatatatattgatatatagatatatagatatagagatatatatatagatatatattgatatatagatatagagatatatatatagatatatatagatatatatagatataaagatataatagatatagatatatatattgatatatagagatatatatatatagatatatatagatatagggatatatatagatatatattgatatagagatatatagatatagagatatagatatatattgatatagagatatatagatatatagatatatatagatatatatagatatagagatatatataaagatatatagtgatatatagatatagagatatatatatagatatatatagatatatatagatatagagatatatattgatatagagatatatatagatatatattgatatatagatatagagatatttatagatatatatagatatatatagatatatattgatatatagatatagatatataaaagatatatatattatataatatatgtatatatagagatatataaatgtatatatataatatatatatagatttatgtataggtatagatatagagacgtagatatatatattatatatattatatagatatatatatagatacgtataatatatagatatatataatatatatattatataatatatgtatatagaaatatatagataaatgtatatatataatatatatagatatatgtatagatatagagatatatatatatattatataatatgtatatataagatatataggtatatagatatagagatatatataatatatatagatatgtatagatatatataatatatatagttataaatatataaatattatataatataggtatatatatagagatatacgtagataaatgtatatagataatatatatagagatatatgtatatatagatatagagatatatataatatatagatatatgtatagatttatatatatagatattatataatatatatatagatatagatataatatagatatatatataatatatgtatagatatatatatagagatatatatatatacgtagatatatgtatatagatatatatataggtatagatacgtagatatattatatatgtatagatatatagatattggtatagaaatatatggagatgatatagatataaatatatagacgtatacgtatatattatagtgaggtttattttatttttgtgttgtgagtggtataattttttatttttttttttaattaagaaattttgatatttttaattattatatatggggtaaatacggtagtacggattaaaatcgtaataaataaaataacgcgtatatatgtatatatatatacgtatatatatatatacgaaggatatttttaagtaagttagttttttatgaattttttaaggtttagttcgtaattttagttttagacgtatatttttgattgtttttaatatgtttttgttttgtttgtttgggtttatttgttttcgttttgtaggaagtttttatagatatgatagggtgatttaattttgtataaatttcgttttttttagtttttagaatgaagatagatattattatcggtatttttagagttagatttatatagttttttatattaaatagagtgaagtagaatttatattttattggaatttttatttttaggtatttgtaggtttttttttatgatataggaaattaaatatgaggtattattgtagatagtaataaatgggtttttaaaatgtttttagtggttggtagaataataattgatttatattttaaaaggggtaatatatttgattttttatattttgtaaaggaaaggaagattttagatatttttttgttaggtgtttaaatttatttaggataatagattgttaaagttatttttgaagggattggtaaaagtttttttttatattttcgcgtataagatagttaagagttaaaaatgatagagttggtagtgggttatgggatgggaaaataaattaagttttattttttgttttgtttttttttagagttagggttttgttttattatttaggttggagtgtaatggtgtaatatagtttaatacgggtgggagaaaatttattaatttttgggaaaaagtgatttttttattttagttttttaaatagttgggatacgtttggttaattttttaatatttttatagagatggggtttcgttaggttgtttaggttggttttgaatttttgggtttaagtgatttttttattttagttttttaaagtgttgagatataggtatgagttattgcgtttgggttaaattgagttttgaatgaaggggtttatttttatggagttaatgaattcgttgtatttttagttttagtaggtacgggatgtttgaaataagttaggtataatttgtattaaatgggtaatgtgtaggtagtattacggagtagaagttaagtgataggttggggggtttacggttttgatgatttttgtttttgttgttacgttgatagttagtttattgacgtatatatagagattatttttaatcgtaggttgaattgtttttattaagttatttgtattttgagtatataataaattattgtgagaaaagttaaattttttttatttaattttgatatttaagattttttgtaagatggttaaaatgttttaagatttaaatttttgaaagttttttaaaagacgttagttaatttatttttataattttttttttttttatcgtttttaatagaaagtattttgggggaattttttttggttaatatataagtaaattaaggagatgattttttatgattttacggaattagtgatttttaaataaatttttttaaaaaggaaataaatgtgtttttatagtagaaggatttatgtatatgtatgtttgttgtggtattatttataatagcgacgatttggaattaatttaaatgtttattaataatagattggataaagaaattgtggtatatatatattatggaatattatgtagttttaaaaaaggatgagtttatgttttttgtaggaatatgaatgaaattggaaattattatttttagtaaattattataagaatagaaaatttaatattatatgtttttattcgtaagtaggagttgaataatgagaataatatgaatttagggaggagaatattatatattggggtttgttagggggtgggggtttaggggagggatagtattaggagaaatatttaatgtatgtgatagggtgatgagtgtagtaaattattatggtacgtgtatatttatgtaagaagtttgtacgttttgtatatgtattttagaaattaaagtataataataataataaattttataatgaaaaaaaggaaataaatgtatttttttggttgggtatagtgttttatgtttgtaattttagtatttggagaggtcgaagtaggcggattatttgaggttaggagtttttgattagtttggcgaatatggtgaaattttgtttttattaaaaatataaaaattagttaggtatggtggtgtatgtttgtaattttaggtatttgggtgtttgaggtaggagaattatttgaatttaggaggcggaggttgtagtgagacgagatcgggttattgtattttagtttgggcgatagagtaagatttagttttaaaaaaaataaaatatttttatatttatataatatttgttagaatattggtagtataattttatgataattattttattaagatttagaagatttggtttgatttagaataattgaggttatttatttaatttgtttgtatttttgttaatttatttttaaaatggtgaggtttggataagacggtttgtaagataatttttagttttaatattttgtgattatatatttatgtagattttatttgtaaaagatacgttgttagatgttatagagataaatatgtaaagatatgatttgtatttcgttttgtttatagtattattgtttggttgtatttttaaatttttattataggttattttgattaggtattaaatttttatttttttttaattttttttgatgtttagaggtttttagataaatggggattagtattatatgtataggttttgtttaaatatttttatatttatttttattttgtgtgttttgtgtagttatggtttttttggtatttaatattattaggggttttttaaataaggattatgttggtttgttttgttgtgttttgggaattttataatatagtttaatttttgttttcggagtggatttttttttttttttttttttttaagaataagcgttttggtttatagtttgtagtttggggattggcgatttgtttgaaaatttgtgtatgtcggatttgttagtatttaggttggggaaaataggttgtttttgagtagaatagttttgttaattaattacgttttaggaaagtgggtggtttgtatgtgaggtttattttgttaggattaagttttttacgaaaacgtttgagtgtgaattaaaagaaagaaaatagtttattttttgtatttattgcgggagggttagataaggttttatttaaaaaaattttttttttttgaagtttgaaagtaagattttgggtttaaagagaattttttcgttaagatttattagaggttatgattaggagatggagtttttaatttggatgttaatgatatgtgtaaaataagagaaaattttagggaggttttttatttatttagaaattagaaattaattatttatatatttttaaaaagagttttttgaggtgatattatatatgattgtgattgtattagtaaagtaattagtaagttgagtatatgtatatttttagaagttaagttagatataagatataagtttttattagtaagatgcgattaatgggataacgttaagtttattgttatagggttgggtatatattttggttattatttgttagttggggtaagttaggtaatttttttaagtttttaaatatatttatatatatgtatacgtatatatatatatatatatatatatataatggggttaattatatttttaatttatagaattgttttgagaattgagatattaaaagtaaattaagtgtttttatgttgtaaatataatagaaatgtaaagtattgttataatagatatatttgtatttttttaaataatgtatatattattttatttaaaattatttgatttttattttagtttttatgttttttgttattttaggagtgagtttttaattaatttagtttatatgtattttttatttaaagtttttttatatttttaaagtttttgtacgagtgatagaaaaatataagtttaaaatatttagagaaatagtattatagaaataggatagatagataattgagaaggtatttgttttttatttagtatagggttagtattatttttggtatttattttgtttatatatgaattgattaatatataagattatttattggagtattatttgtaatattaaaagattggaaataaataggtgtttattattaggggttggttaattattttatgggtagtaaatagttatataatgatatttaatgaattttttattttgaaattgtttttatattgattttgggtttggttttatgatttgtttttgttaatggaatattaattaatgggatttaagtagaagtttaataaaatttttatagcggggttaatttttttttgtttttgtgggatttagtcgttatatgaagtagttggggttggtttatttaaggtatatattttaattgaggttagatttttttaataatttgttagtgaggttattttagattatttagttttaaataattatatttatatgaataaatttaggtaaaagtagtagtaaaaaatttttggtagattttaggttaaatagtttatttatagaattatgattaataaaagggttgttgttttaaattattatgttatggagtaatttgttatgtagttaattgataattggtatattttgatatttttaaaacgatgtaatattaggaagtattatattatttaggaagaaaggaaaagtatgtattttatgtattgatatggtatattttaagatgtattatgataagattttatatggtaaaattttaagatatattgttaaattaatagggtaaatagtaagttgttttttgtgtaagaaagggaaaattttaaaatgtgtatatgttattttgtatggatgggcgttggatatatatttaagaaattaatagataatggttttttattttgatggaagagcgagtagtgaattgggtggatggggacggaggtgttagcgagattttttaataaatatttttttaaattgttttagtataggaattatgtgattaatatttatgtaaataagtattttgaaaaagggaaaaataaggttaatataagatagaaatgataaagtttgaaaaagttgaattttaaattgacgattataattttgttatgtaattattttttattaataatagtttttttttgaatcggaataatcgtttttttgtaatatatatgattatttgtatatttggttgttttttttgttagattgtaagtgttttaaaagtagggattatattttatgtatttttgtttttttagtaagtggtaagtattttgtcgggtatagaagaaagttttgtttaataattgtttgttgagttaaaaaaataaataaaaatattcggattttattaatagtgtttgttgttaatgttgatgagtttaataaaatttttaatagtttagtttttatttgtatatattttttatatattattttttaggaaaatggtgagtattttttatgatttgggtttatgaatgtattttgaattattggggagagtatatataaaagttaaattcgaatattacgaaaagaaaaatgtaaaataattttttttatttaaaaaaataataatatttgattagagggggtttagaaaaagaaaagaagaaggattttttattattttttataagtaatatatttgattattgtggttggaataagtagtttcgtttttattttttgtttgtaaagtaaattaagttattcgaataagtggattatggggatatagaggtagaaaattttcggttttatttttaggtttttagagaatttgatatttaagttacggtggagaggttttttgttatgagtttagtatttttaagaaagaggagattataggttttttttgtagtttattttaagagtttgatagtttttattggaaatttttattttttttgaatttgtatttttttgttgtgttttaggttttttttttttttgagagtttttgtttttatgtttgatttttgtgaaagtgtaggtatttaaggaggaggtttgggttttttttacggtggtgtttatattttttttagggggatgtgttcggtaagtgtgtatgtagtattattttagttttgtgtattttggatcgtattaataaatagtattatatagtttggggattatgtttagatttatacgtagacgataagtatcgtggttaatatttaagcgttagataattaaaggtttttttaaggataaatataagtaagagtggaagtaaaggaagtgtatacgtttgttttaagaaagatagggtatgtagttttttttttaggattttttattattttcgttttttttttttatattaaatgatgttaattttttaatttttttaggttttattttttaatgtttttattagttttattgttttttgcgaggttgaatttttttaattaagggtagtgggagacgttttatatttggagtttttgtgaggtagtaaagatggagagttgagattgattatttagaatttaggtgtgttttcgttatatagaataataagtatcgttgatgtttttagtaagtgttaggtgttgggttagatgttgttggagatataaaaggtggagatattatttttgttatttaatgagagtgatattgatcggataggatttaaagaaggggattttggtgtgggtgggaagagtatagtgggagggttggggtaggggtacggttttgggattagagtaggtggaggtagtggggcggggaggaggaaaagaaggaaggaagaggtcggttagaggaagtttaaaagtggatttttggatatatagtaaaaaggggaggacgatttaaagacggtttttagatgtgggggtttggggagaagggaagtttttatagttgttgatagaggttgatagatgtagagagggttcgtggtgagttggttgaattcggggtaaataagaggagattttatgttttattttagatgaggaaataggattaggaatatagttttatgattgaagtcgtgatagaaaagtttttttaaaggagtatagtggaggagagaattggagaagaggtacggagatcgttaagcgttttaggtgtaggcggtaggagggagtttaggatgtcggtagagcgagttttggtttgtgaattttagggtcgatgggtatcggtttatttaatttatttgtgtatagatttataaaattgtatttggttgtggtcgttagtaagtgttatataaatgttttataagtgtttgttgaaggaagttgaaatgtagtcgttagaagagtgagagggaaattagcgatagagttttgtaagtttaagaaaaagaatttaaagatggttaagagttaatattgtatagggaattatagtattttcggaagattaagggtaattttgattgttttagattgtttgggagtattagagtttgattgttttagattgtttgggagtattagagtttgattgttttagattgtttgggagtattagaggtttgggtgggggtaggagttagtttatttggaatttttgtttttagtgtattgagtttgtacggattattagggttgatattgttttatttaatatgggggtgggggaagtttttgcgatatataatggttttaatttaaattttgtgttgtttttattttagttgtgtaatttggaaattttaaataaaaagtttgaaaggaaagttggattatttaagtttatatagattttattaatgttatatggttattttatttttgattttggaagaaggagaaattggtatgggaatatatttttttaaaaaaaatattatttaaaaatatgaaagtttatttaatatttaaggaaaggtatttaattagagggatatttaataagaagaattgaggatttaagtaaatagtttttatttgtttttggttttattatttggcgattattttttttttttttttgatagattttagttaattaattttgttttatttgtgtaagttgagaggttatttgttatggaatatatttttatattaaataaagtgaatattttttatttttgtgttttttatatgatttttaaaatataaagtatttatttttattttaaatagatttaagaaatgttgattttgatgaataggtataaataaggtaattttttgtttatgaaaattgttaacgatttatttatagaaagatatgttttgcgttatattgtattttttattttcgtttattcggtttttcgatgttggtgaattaatttatttatacgtttttgtttatttttttggttgttattagttgaagtgaagaaaagatattttataaggggatatggtatatttgtgttaaaataggtattatataaatttagagaaaggagttaaaaggaaatattaggtagagggaatagcgtggataaaggtaaagttgagaagagggtaagtgtttcgtgttgggggatggtgtatttgggggttggggggagtggggtatagtgtattgggttgaggatttatagttaggaaaattggaaataaaggggaaggagattttgtgaagggttttaattatcgggttaaggaaagttgtattgtttttaataattgggtattagtggaagtttagagttaggaatataattgttatagaggtgttttggattgaataatattgtggttgtaggtagttttgggttgggggttgggaggtataagtttttaggaatttattgtagtagtgtgggttttgttacgttgttttgaataaagtgttatggggatggatataaatatgaagtgaaaattttagagattatttgatttttacgtgttattgttttgattgttggattatagtgatgtttggggttttttggaattagtgttagtttagagttagttattagtagtttttaaaaggtttgattaattttttttttttagtgtatagttattttggtaaaaggttataggtttttttggggaaggttgggagaaaaagtaatagtattaatttttgatagtgtggtagggtttttcgttaaggagattcggttttttttttatttaagggtttttgggtcggtaaattggtgtaagtgtgtgaattgatcgaggggtcgtgattttttgtttttagggtgtaagttgggtttttgttttttttatttagaatttttttatttatatagattaagtaagggtttagtagatgttcgtttatgttatttttaggaacgttatgaggatagggttggaagtgggggaaatgaagtgttagtttgtgtacggatataaagaaagtgagatgatggaattgaagatgattaagatgtggggagttaggattagtggtttttattggtaggtggttttttaattggtaatgttagggagaagtgtataaatttttaatttaatatattgtatttaatatattgttagtggcggagggagaggtagagtttggtttgaaatggtgggggattttttaaggtggtatggatatataggatggaaatgggagacgtgttaggtttggagatatgggttttggaataatttgtattaaaattggaaggattagagagagtaggtgagattttcgagatagaggaaatagagcgaggaagttaagatttaggttggggtaaatgtttgaatttatttgagtgggggaagatagagaagttggtatgttggatagagatgattggttattaagatagaaggaagaattaggtcgtttaataggattaagagggtttagtgtttaaagagagatttttttaattgttataggaaagtaaaatgttatggttttagatatttgttgaaattggtgtatgatttttttaaagatagtgtttttttaaaaatttgggaaaagaagagtttttggtgtggtggagggtggtagtagggatagttgggagtgaagttgtgtagttaggaagaaattatttagtttgaggaagttaaagatatggggaggagatatagtgtagattaaaggagtagttaagttaaaggtaatttttttttaggatttcggggttttaagtaaatttgtgggtagtgaatatgttggaagtgtttggattgtttaggtggagaataggtagtataagggacgaaaagtaaatgtttagatggcgattagtggaggttttgggggtggaagattttagggtttatttttgtggttattattttagtgagggggttagtgtggattttaggtttaaggaagaataatattttattttttataaaatagtgtatgaaagattagttttgagtttttataattttattattggttttaaattttaattttatattatattttttaagtatattttgttaaaatttttttaatttataatattttaattagtaatgagtttttatttatatgtttatgagtatatatattaatttaaaaatttgtattgtttttgtatgaatgaaatataaagaaattgaatttttaacgaatgaaagacgttggatgaaaagataatattttatttgagttttagtttagttatatgtttgagaatgagtttatttagtttataagttttttgttttttttttagtttttttttttttattgttatttataggttttttaaagatttttttatttatttttgtaggattttgttaaataatgttggttgtttgtagtttagttttattttggagatgtggttttttttggtagttttggcgatttatattttggattttatttattattttattgttttgtgatttatttttgatttttttagtttttttttttattttattttatttaagtttaaatagtaagttttacgtttaaattttgttttgtttttgtttttcgttttgaatttgtttatttgtttttttgtagtttttatttttttttatttttttttttttatttttttttttttttttttttttttttttgagatagagttttattttgttatttaggttggagtgtagtggtgcgattttggtttattgtaattattattttttgggttttagcgattttttcgagtagttgggattataggtgggtattattatatttagttaatttttgtatttttagtagagacgggattttattatgttggttaggttggttttaaatttttgattttaagtgatttgtttgttttagttttttaaggtgttgggattttaggtgtgatttatcgcgtttggttatatttatttttatttttttaaagattgtagaaatttgttatttgagagaggttggttttgttttttttcgatttaaatttttttttggttttttaagtttatgaaaatttttatgtgatatttttttatttgtagttttaagttatttatatatttttaagtttttatttttaaatttttattgatttttttttgtaggtgtattgttattttggtaatttaatattgtttgtattttattttggtgtatgggcggggggttttggtttcgatttagttttttagatatatatagtgaaataaataggtattcgacgatagtatgtgttgttgttgtgtagtttttttgtttttgaatagtaaatattattggatttggtattgttttattgtggttgtaagttgtgttttattatagttaacgttagtgtagaggagttatgttacgtaaaggttttttgcggtagtattagtttgaagttttttagttatgaaaattagggaatacgttattgatgattgttttggttttggtataggttttattaaaatgtaattaggtttcgttagaaatgtagttatgtgattttttttttttttgagggaggatggtgtttatgaatgtaatggtagtatatgatatttttagttgtttttaattatgtggttttaaaaatattttatttaggttaggtgtggtggtttacgtttgtaattttagtattttgggaggttgaggtaggtggattataaggttaggagttcgagattattttggttaatatggtgaaatttcgtttttattaaaaatataaaaattagttgggcgtggtggcgggcgtttgtagttttagttattcgggaggttgaggcgagatagaattgtttgaatttaggaggtagaggttgtagtgagttaagagtatgttattgtattttagtttgggcgatagagcgagattttgttttaaataaataaataaataataataataaaaaaaatataaaaaaattttatttagtagttttgaaaattttaagttttttttaaagaagggaggtaaggaaggaaattatgatgtatttaatagttacgtgaagtagatagttttattttagagattagaaaattaagggtagagagtgagtattataataggtggttataagttatagtgggaatttagggagtttaggttaggattttaagtttttttaaataaaagttgttattttggtcgggtgcggtggtttataattgtaattttagtattttgggagatttaggcgggcggattacgaggttaggagttcgagagtagtttggttaatatggtgaaattttgtttttattaaaaatataaaaaattagttagttatagtggtatatgtttgtagttttagttatttaggaggttgaggtaggagaattatttgaatttagaaggcggaggttgtagtgagtcgagattatattgttgtattttagtttgggtaacggagcgagattttgttttaaaaaataaaaaaaaagttgttatttttatataaaggatgaaaaagtaggaaagagattgtaggaaaggaatgtgagagaggaaaaatataaagaaattttaaatttgtgaatatattttttttttaatttatgtgttgtttatgattaggattaagtgttgaagttagaggtgatttaaatttttaggagtagaggaggatagaggtaggtaggtaggtcgatttttgttggttttttgtgttatttttgtttttataattttttttatataggttggttttagattttttaataaaaatgtatgttaaaattgtaaaaataataaaatatgtaaattttttttatttgtagttaattgttattatgtaggtattttttttggtaaatatttaaatgttattagtattacgtgtttaatattattttagttaatatgatttgtgttaaaatcgtttgaatttagtgattgttggattttattattattaatgtaggtttttatattatattttttattgttgatgaatttataagaaagattttatattttaagaattagtatttttttagaaaaggaagaaaaaaagtagtttttagtaaaagataaattatagagtaattgggtttagatgagttgtatatattaaattatatatatatatatatataaatatatatatatatatatatatatatatatattatgaaaatgatgttgaggtattgtttaatttataaatgtgagtaagtttataatttaggagttaaaacgagaattttatttatgatttttttcggtattgagaatgtattgaagaatgatgaaattatattttagattattttatttgtttttttgatagttttgtggattattattatatagaggttttttgtttggtgagattttgattatttgatatttttttttagagcgggttggttagagttttttcgacggtagaatttatagggtttattttaacgtataaggaagttttaggtttttagggatttttaggttttaaaaaatagtgttagataaagaaattaagagggggttgggagaagtattttgttaaatagaaagtttatttatagaaaatttagggatgaatagagttaagatgggttgatgattttgaagttgtagttaaaatgatgaggttaggtgggtttgttggttaagaaatgtaattttaagagtgggttatggttgtgatgtttaagtttttttgtgataaagttaagaaatacgggagaaatggaagggagaggggtagaatagataaggaagatgggaagtaagaaggataggaagtgttagtagatattagtagtagggacgagtgtagaaagtgttagataatttatgaattggaggaggatatttagtgaggagggaaaagggattggattgtgttattatttttgtaggggaggtgagataaacgttcggtgtagttcggaagatggtttggaaggtttaatttttttatttgtttgatttttgatattacgatatatatagttatttttaaagtgtttaaaatataaattatatttatgggaatttgaagttaggttttattttgatatttatttatttgtgtatttttaaggttgatttaaatgttgaaaagttatttgtgatgtgttgtattatttgagtttttgataaaaattataaagaagtaaattaaattaggagggaaatttttagttgttatattaattaaaaattgtcgggtaataaaaaaaaaaattatgttaaaaataaaattatatttcgggttttaaggtttatttttttttttttttatttatttatttatttatttatttatttttgagatatacgtttattttgttatttaggttggagtggagtggtacgattttggtttattgtaattttcgttttttggttttaagtgttttttatgttttagttttttaagtagttgggattataggtatgtgttattatgtttagttaatttttgtatttttagtaaatggggttttattatgttggttaggttggttttaaatttttgattttaagtgatttatttgtttttgttttttaaaatgttgggattatagacgtgagttagtgtgtttggttttttaaggtttatttttataaataatatttttttagaatttaattttagaaagcgataattattttttaatgaatttttttttatatatattattgtgatggttatattattgttttatatttgttttgatgttttggattttaaatggataaggtattttatttttttttgtaatttagaggtatcgttttttggtaagatatagaaagatttgttggtagaaatacgaattattatgttatttagaaagtaatttggaaatgtttattttaatttaaaaatttattttttttttaattaagttattttacgttttgtaagtatagaaatgtttattatagtattatttgttatagttatatttaataatttatgttatagttaattaaggaatagtacgtagttatgaaaaaataaaagagggattttagtaatttattattgttaaatgagaaaaagaaagatgtataaagggatatatgatatgatttgatttgtataaaaaataattataatatatatttgtgattataaaatatttggtaagattgtagaagtataaagtatggaaggatatagataaggttgatgttattggtaatttagaagagaggaattagagtggaaggagggaagggaatgagaggaaaaaagtaaataagtgaaaaatgaaagtaagtgtttatgataagaatcgtatgggtgtttttattttatttatgggaaattatgtgtgtggaggtgatataaatatatggtggtgagatggtttttaaaatattaatggtttttattttagggtggtgagattttttttaataaggtgaaatgtttttaaaaataatttttattttattttttttataggtattattggaaatatgtataattatatgaattatttatataattagaaaaaatttattgagagagaaatatgaaaagttttatgttaggtaatgtatgtttttagaggaggtgtaagtagggagatgaggttgtaaagttaatttagaatttgattaggagggttttaagtgttaggtaaagataggagtttattaatatattaataatagggttgtggttttgtttgtttgtttgtttttggtggtgggttatgagtgattttttttttttttgtttgtttttttttatttttcggatttttttgtaaaaattttattttgtttttgtaattagaataaaaatattatgtaaaaaataatatagtggaagtggaagtggataattattaaagtgttgatttttagtaaaagaaatgaaaatttatttatgaattagtaacgttaaggtgagttagtaaggattttagataaagaagaaatagcgaatattgaaaggaatataggaggttttaaatgttttttaaaaaaaaaaaaaaaaagaatgagtgaaattttgtttaggaagaattgttaaggtttagtggttttttgtaaagtttatattgatgtttgtaaaaatatatttaattaaatgttaaagttggttgataggatttaaaaattatagagaattgtaattgttttagagattggtttatttttattattaagtttttaagtatagttatattttggaatttatattaaggaaaggtataatattaagggaaaaggtaatagaagtgatagaaattatagaagtggaagatattgtgttaagatgatgtaaagagtttttttttgtataggagagacgtgtattattgaaagtattgttttaaagaaatattgggattttgtatattaaaaaaagattttaatgtgattttggtttgattcgttttgtagtgtagttaatataataaatttacgatttatgttaggataaattaatttaaaagtttttatttaattgtggtttttttttttttaatagttggtatattttgagaattgttttttgttagatatatttagggggaggatggtggtattacgttgaagaaggcggtagtaggaggtttttaaaagaattttttagttttaagattttttgattcgagatgagacgttatgttaattattagattttatgtttttttttttttagatgttttaattgaggtagtttagtaaataaattgtgtttatgttttttagtatttttgaagtagatgtaatataattgaaggtaaataattttagtaatgtaatttatgtattgttatttaaatattacgttattatgaaattgaaatgtttattaaataattaaagtttaagataaagaaatcgaaaggtattttgtaaggtaaagtattagttagtatttttaataaaataatttattgagagttattttggagtggtttgttagaaaaagttaatgtgatttggtttttaattattaaaaggattgttttgttgttatttttaatggttaggaaaaaaatgaggagaaattgggtttgtttttatagagtagtagggtttttttaatagagttttaggataggttggttagaaggtaagtaacgttttttttttaatgatttttaatagtttatttatattttttaaaagtattaaattttgttttgataatttggtaagtgttgatcgttaaatgataggttttttttttatgatgttgtgaaataagagtgattattttttgagtttagttttagtttttttattaattggttacgtgtttgtgggtaaatggttttattagtgttgagttttagtttttttaagtaaaatgttaaggttagataaagtgatttttagaaattttttgatttttggtaatttatgattttttataattaattttaggttttgtttattacgttttaggtttaatataaaattagacgttgagtgtttattttaagtaaaatggtaaataataggttagttttatgggttttttgtattacgaagatgtgaaatttttaagaaaatgttatagagttgagtttagaaaaatagaagaatggaaaaaaggaaggaagggagggatagagggaaggatagaaagataggttttagaatatgtagaaattgtttttaaggttagttagtatttttttttttttttgtatcggtggtgtgttttttttcgtttttttttttgtttttataatttttatttttataatttttagtatggtttttttattaatttaattttttttttttttttaaatgtggtttaagtttatgttttttttgtttgatattagtaagttttgattttttgttttttttgagtttttttttggtgtgttatttaattaatatgaaattagtagtaagtttattggtaggaatagtttaggaaaaatgtttattagattttttaaaatttttaatgtttttttttattggggtatagtagagaggtagagagaagggaaaagttttttttttttttttttttttttttttcgtttttttttttttttttttaatttaatgtttattgaatattttttttatgtaaagtattgtttaaagtttttttatatattattttattttatttttttataatttttttggaaatttagagttttggttaattaaattttgattttttttgtgtttttttattattatttatttatttttttttatttattttatttatttattttattttttatttatttttattttttagttatttttattttttatttattttattttttatttatttttattttttatttttttttattttttatttatttttattttttatttatttttttttatttatttttattttttatttatttttatttatttatttttttttatttatttttatttattttgttttttgggattgtgtttggttgttttttttattttggttttttttttaattaattgttaattttgaattttatttttggtttttttttttttttttgtttttatattttttttgaatatttaagtttttttttaattggtttttttgtaattaggtttttattttaaagtatgagttggttgatattattgtatttatttaatattttatgtgattttattttttatataatataatttgagttttattatttgatattaaaggatttttaatttttttaaattaatattattaaattttattttttgaatatattaggttttttttgattttttaaatatggtttgtaattttatttttgtaggtttttgtttgtgttgtttttattatgtggaatagtttttttttattttagttttagagaaaaattttattttttaaatttagtttaagtgttattttatttttttaagttaaaagtgattgtttttttttttgaattttttaaattttagtggtttatggttttaaagttgtttttaggttataaagttttggagggtagggattttttttatttttttttgtattttaatattatgtattaattatagtagaattttttttttttttttttttttttgagacggattttcgttttgtcgtttagggtagaatatagtggtataattttagtttattgtaatttttgtttttttggtttaagtaatttttttgttttagtttttttacgtagtattttttaagcgtaagtagaaatgaagttgttaattttgataattaatttattagttattattgttttttaagtgtgttttcgaatttaaaatttataagtattgatgagggtttattatgtataaagtattttggtaggagatgtaagggtaagtgagtttaggaataatgatgtttataatgagttattttaaagatttattttattttattatgttaggttattaaatatattattattatgaatatataatttagtttggggattattaattttttagaagttttttttttttattgaatatattagcggtaaaattcgtatgttttaaaatgtatttaagaaaagtaggtttagaattttagaaatcggggtttttatttttttttagaagatagagtggttgataaagaagaatgaaggtatttgttatttagtagtattaatttttaaatttataatttagtttaattttagttataatgcgtatttggagttatggaagtagttgaaaaaataagaatgtttggaaaaattaaaaattttattatttgtaaagttgggttcgtggatgaaaatttttgtaagggatgataattttttgtttgaaagattggtattaagagtagttgtgtaaatagttttgacgagtttaaggtgatttagaatataagttgatcgtttgttttagtatgttagggaaagttttaatttatatttgttgtttttgtataattattattattgtttttttttattttgaaaattgttttagtttgtatgaaaaattttataattattgtattagtgttattgttagatattagtagtttttttatataatatcggtggtttgtataggtttattagggagtagagaaatggggtagaatttaggttttttgatattaaatttaggttttatttaaaagaatatattttttttaggtttttcgttattaatttatttataggaaaatattttggaaaatggtaaagatatataagttatggtttttgtaagttagtatttataattttggggagatgaagtatatatatatttaataattaaagaggattagatgaatttattatatggtgttaatgatatggtttaaatgataattttaaaaggagttagaaaaggtgaaaaattttttaagagttttagattttagggaaggttttcggtaggtgatggattttgaaagatgtttttaaggagaaaaaaaaaaaggcgtttttttttgaaaaaataaaggtagaaaaataaataaattggtatagtaataagttatttaaataatttaataagtattattattttgtatttaagaagagaaaaatataatagtaagttaagataaatataaatggtatatgtggtttttttaaaatgttttagtgatttaaggtttaataagtattggattttggtgttttgataatttggtaagtgttgttagatgtttttttttgtgatgttgtgagataaaagtgattattttttgaggttagttttattttttttattaattggttacgtgtttgtgggtaagtggttttattagtgttgaggtttagtttttttaagtaaaatgttagggttggataacggatttttaaatgttttttgatttttggtaatttatgattttttataattaattttaggtttgtttagtatgttttaggtttaatataaaattagatgtgagtgtttatttttagtaaaatggtaaataataggttaattatatgggtttttttttattataaggatgtgaaatttttaagaaaatattatagagttaagtttgggggaaaaaaagggaaaaaaggaaggaaaagggggatagaggaagggagagaaatagaggttttagaaataaagataaaattgaagttagagtttttatgtaaggttgattatatagtgtttaaggaagttttagattttcgtaaatgttttcgaagttttgggaatagtggtgagattttaatgtttatgtagggatatgattttggttttgtatgaggtagcggggttagaattgagttttttttttaaattttaaagttttaaaaagttattttaattatgaaaaggtggattaaagtattttgtttattgttttagagataaagagtagaatatttttttgtatttttagtttaggatatttttgggaaattagaattttaagtatgaattatttttagttgtaagatcggaatttatattatttgtgtatttgagtaggggaattttatgataataaattaatataaatatagttttaggattattgaaagtttttagatttttagaaaagataaatatatgtttattatgtagaaacgattttataatttaggatttataagatttttatagaaaagaggtcgggtatggtagtatatgtttgtaattttagtatttttggaggttgaggtaggtagattatttgaggttaggagtttaaaattagtttggttaataaggttaaattttattttaatataaaaattagttaggtatattggtatatgtttgtagttttagttattagggagattgaggtaggagtaatatttgaatttgggaggtagaggttttagtgagtcgagatcgtattattgtattttagtttgggtaattaagtgagattttattttaaaaaaaaaaaaaaagaaaaagaaaaaagaaagaaagaaagaaaaaagaaataaagaaaaggaaaaatatttgaggttgaattgttagtattattttttaatatatatataaataaattgttatgagggatagtgataaagggaaaaaaaaaattttaaattttaagaattggaaagatataattttaaatggagtataaaataagattgtttaaaaatattatagtgataaagattaaaagttataaggagaaaattaggattatatgaaaaaaagagaataagtagatttgaaaaaataaagtagaatttttagtaattatttaatggaaaggttagatagtagagtaatataaaataggttattagtgaatcggaagatagttttgagaaaattaaattaaaatgtaatataggatttttaagtaaaaatggagaattgaatatattgtatttaatatggtttttatttgaaacgttattgtaacgagggaagatgattttttaaaagatataaaattattaggataataggagaggagattttaaatattttttgatttttggtaatttatgatttttttataattaattttaggattgtttagtatgttgtaggtttaataagtaataagattttagaaataatagtaataagattttagaagacggaaagtagatggagaagtagtgatagaattaatagataaaggaagttgaatttttagtgaggagtaggaaagttaggaataattagtggattttttaaaggtttaggaatagatagtatcggtgatttttggaattgtgcggaagggagatgagttattaaaataagaagaatagggtagggcgtggtggtttacgtttgtaattttagtattttgggaggttaacgtgggcggattacgaggttaggagattgagattattttggttaataggtgaaatttcgtttttattaaaaatagaaaaagttagtcgggcgtggtggcgggtatttgtagttttagttatttgggaggttgaggtaggagtatggtgtgaattcgggaggcggagtttgtagtgagttaagatggcgttattgtattttagtttgggcgatagagtaagatttcgttttaaaaaaaaaaaataaataaagaagaatgtgagggaaattgtttaagaattagttagatttttggattttttttttgaatttattttgttaggtagtagtttttattataattgttaatattggaggtttgaattttgggagaggattttggaattgggagatgttatatattaaataaaaggaaatatgtatgttgaaggttgaattttttagttttattttttattttagtttttagtttgggataggtagggcggtattttgtagttaggagtttggaagagtgttttttggagaatttgattattttttggtttttttattaggagattttaggagttgttagtattaggagttttttaatttatgatagaaatattttattttatagtgatgtttagagttgataagttttttacgtatttttagagtttttaatatatttgttatttatttttaaatatggttagataattaggattgttcgatatgtaaggaaagtttttataggaaagatagagtttaaaataaatagattgaaaaagataatatggaggagatagagattaggagaggtaaagataatttttgaaaagaaaaaaaaatgtagaaaattaagagaatgatatatattttgaaaatagaatagaatgtttaaaaaattatttatagatgaaaagaggaaatttaagacggtaatagaaatgaatttaatagatgggttggaaattgaagttaaagaaattgtataaaaagagtgaaaaaagataaagagatggaaaataggtgagaaaatatgaaaaaattataaaattgtttaggaagtttaatttttaaataatagaagttttggaaagaaagagtagtttatagagagaatatagttttgatagattgaaagattataatgattattgagtataataggtgaaaatagatttataattagaatagttatcgtgaaatttagaatatagggggataggaaaaattagaggttttaggggaaaagaaaaataaggtaaggtatagaatattaagaattagaatagtggtagttttttgatagtaatattgggagattgcgtgtaataaagtaatatttttaaatttttggggaaaattgttttttaatttggattttttcgtataagatagataagttattatgtgatataatagaatgaagataattttagatatgtgaagtgtgaatgtgttttttagggatttattttttataggttattgtaagttgggagttatagaaatgagagagtgtaaagggagttttatgagaattaatataggattataatagagggatgacggtattgaagtgagatattttaggatgatgattggtttagttataggattagttatttagatagggttagtagattaagagtaaggtatatgaaggttgttattattgtattaggttttaattttgatagttgttggaggttgtgtttttttaaataatggggtaaaataagagagagaatttaatatagaagaaaaggtaaagggaagttttagaataatagtgaagataaattttaggatgttagttatttagtaggtcgagagagaagtttagttagaaggaaaatgtaggtttttagtagagatattattaagaaaagaaggagaattgatagattattaatgtgattagttttgtggaaaaaggtattgtgagtttatggaagatagaggaaaagtttgtattaggtataaagattaattaaggatatgaaaaaaagatagatattaattttattgttaaaggtttagttgttaatgttatttattttgataaaatagtgaaaatattaggggttgatttatttttaaattgtaatataattatattgggagaaagaggggagaggaagttgtggatatgattatattagataggtaaatttttatttattataatataaggttaagatatatataaaattgatgaaataaaagataatagtatatatattatttagaaatgtagagatatatatatgttagaagaaaaagttaaaatatataaagttatattttttgagaatagggattggggtaagtaaagtggtattgaattggtttttatagaaattaaggaattagtatataagtaaatatgtataaggatgtttatggttataatgtttgtggtgatgaagtaggattatttttttgaacgttttatgggtgggaattggagtgtatgggcgttggaatttgttagttattttggtattggtaggggtgaattttatttatgaagatatgttgtattttattttttacggaggtggagtacgtaggtgagtagatgtaggagttaggtgagtgttttttgggtgttggaaggagcgaattttatattagttttatagtagcgtttggagtagtgtttgtaatttttgaagtttaagaggataggttatagtatttttttagttttgttatttatggacgttttaagtgttaatagtttagtgggggcggttagtgtgatatagtattttatatttgtattgtggtatttaagtttttgttcggcgtttaggagaaatgaggtcgtataaataaattgaagatggtaaatatagaggattttattgttaatgaaagtggtttttagtaggaaggggagttgaaaaggggacggggatggaaggtaatttttttttgaagtttagttatttttggttaaatttttgtttgaagttatatcgttaaattgtttttttgaatttaagttatttttttttaacgtttaattgtagtttttaatatttagttgttttttttttttttgttagtggagttagggattttttatgggtttaggatgggaggtagggtaggttatgggtggttttggaaaaggtaatattcgagtgggaaaatagggatgtaaattttttttttggattatggtattaggttttttagtttgagggtggggtttttattgggatttatttttttttgtttagaatttttttgttttttgtttttattagtgatataaaattgaaaataatttgaatgtttattaatagggagaaggttgaataaattataatatagttataatatggaattttatttagttatttttaaaaatgaattaaatttgtatttatttatttggagattattttttatgtattattaagagagaaaaataagttgtgaaaaaatatatgttgtatgattggattttttttgtaaataatagtaataaaatatttttatttaagatatatatgaatatatatgtgtatgtgtttataggagtttggagaaatatgtagaagaatgtatattaagtgttaatattggttattttggagggataggaataaaaaaggtagggagatgttaaagaaaaaaatagaatataaaaaagagagatatgagaaatttgaaaaatatatttagagatatgaaaaagagaataataaggtttaatatatatataaaagaggatttagatagataaatagaggattgaggagagaaaatatttagagattaggataaaattttttagaatcggtgaatgttaggaatttttagttttgaattttaagtaggattgtggtgaaatcgtagattattaaagataaaaataaaaaaaaattttaaagtaatatgagagagagagagagaattttttaaataaatgatagtttgaagtagattatattttattaattatataaattaaaaggtaatgaaataatatatttaaatgttgagggaagatatttatgtaaaattttatatttagaaaaattattatttaagattaagagtgaattaaagatatttttagttagagattgagatgttttaatatttttaaatttttaatgaaatagttatttaaggatgtattttagtaagaaggaatttgaattgggattataggtgtatgttatgtttggttaattttttgtatttttggtagagacgtggttttatcgtattgtttaggttagttttaaaatttttggatttaagtaatttgtttgttttagttttttaaagtgttgggattataggtgttagttattacgtttagtttttaaatataatttttaatgtttgagggtaataattgttaaaataataggataaaatgtatatattataaattagtggaaaatagtgtaagaaaaagttaagtaatttaatgtgaggtagaataagaagaaaaaataagtaaagaagtagtatggtatatagaaaatatttaggtttttagtgaattttaaatatatgagtaattataataaatataaatgattttaatttgttagaagatagaaaattttagattggattttttaaaattttagttttttataagaaagaagtttaaaatataaggattaatataaaggaagagaaagtaatattatagggaaatgtttataagaatttggtatagttattagataaattagtttgggttgttatattaaaatgttatagattaggtgttttaaatagtagaagtttattttttatagttttggaggttggtaagtttaaaattaaggtgttggttgattttatttttggtgaggtttttttttttggtttatagatggtcgtttttttgttgtgtttttatatggtttttttttaggtgtatatatagaaagaaaaatttttttttttttttttttaaaagattattaatgttattgtgagggttttgttgttttgatttaatgatatgggaagagaatattttatttaataagtatggaatatatagtagagaatgtaattttaattattttttaaaggttttatttttaaatattattatattagaggttggagtttttgcgtatgaattttggtgggatataaatatttagtttatataagtaatataaatattaggtggtttttttaggtttttgtttaagtgttaattaatttaagagttgtttacgattatatgatatagaatagtataattttatattttttagtataattttatttattttattttgttttatttttttttatagtattatattatttgataaattatatattttgtttgtttattatttgtgatttttaaataaaatataagattttttagatttaagagagtagggatttttttatttgtttattattgtatttttagtgtttaggatattttttaaaaataataaatgtttaataaatgtttattttaattgaattagtgaatgaataaatgaacggatttgataaaatagattttatagttaaaagtaatttttttttttttttgagatagaattttgttttgtcgtttagttggagtgtagtggtatgattttcgtttattgtaattttcgtttttcgggtttaagtaatttttgtgttttagtttttcgagtagttgggattataggtatgtgttattaggtttaattggttttttgtatttttagtggagataaggtttcgttatgttggcgaggatggtttttaatttttgattttgagtgatttgttcgtttttgttttttaaagtgttgggattataggtatgagttattacgttcggtttatagttaaaagtattttgagggataaagaggattatttgttaatatgaagatatatttattagaatttttttgtatgttttatgacgtagtgttaaatatttatagtaaaaattgaattaattataagaaagtaataatttaaaattatagtgggagattttatttatttatttatttatattttattttttatgtttttattgaatttaatatattaaaaatagaagaaaattattttatatgtatttaatttattattttaaaaattgaggtatttaatgaaaatgttaaaaatatgtaagaaaatagaatataggaaagtggtatttaggtggtgtgattgtgtgtttttgtatttagaatgaagttttttgttattaattgatatatttgagtatttgttttttcgaattttatattgaaatataatttttaatgttgaaggaggaggtgattggattatgggtttggattttttatgaatggtttagtattatttttttggtgttttttttgtgatagtgagtttttatgatatttagttgttttaaagtgtttggtatttttttcgtttttttttttttattttttttttggttatgtgatgtgtttgtatttattttattttttgttacgagtaaaagttttttgtggtttttttagaagttgagtagattttggtattatgattgtatagtttgtagaatcgtaagttaattaaattttttttgtttataaattatttagttttcggtgtttttttatggtaatgtaagaattttttggtttatttttgtttagttaaaatgttatatttatgaggattttttttatttttttgtaaggatgggtgttttggatatgttgttttatttattatatttgtgattttttaatatatatgatttgttagaagtatatagtgggagatttttagtatatatttttatgaaattgatagtttaagttttttttttaaaaaagggaaaagatttaatattgaaataaggtattatataagttttagttaatgatatgggaagagaattttttatttaataaatagagaatgtatatgaaatgtttataaaaattgaataggttttaggttatagaataaataataaattttaaagaattgttattatatagattatattttttaattaaaatataataaaaaaattgagatagataaaattataatttttaaatttaagtatattttgaaattttagaagtatattgttaaattattaatatgaaattaaaatgaaagtaaaatatatttaggattgaataattgaagttttaaattttagttgaagaaaatgtttagtattgaatttaatattagtaaataagaaaaattttaagaaagttagagaaagggtaataatgtaaatttaaaaataatagaagaaaattttttttttatatatggttaaagtagtaggaaggtaataataaagataataaattaatagaattaaaatagaaataatagagaatagaaataaaatagaggttgattttttaaaaagattaataaaataggtaaatatttgataagattgagtaaggaaaaagaaagagtataaataaatattattaggtataaaatgggttataattaaatagagtaaagattttaaagtatgagaatttttttttgtattttaaagtaataaatttaaaaatagataaaatggaaaattttttagaaaaatatgttattaaagttgatatataaaaatatggaaaaagaataaagaattttgaatgtatttttatgagtttagtttaaatttatattgtagaaaaatattaagataatataaaaaaaggtaagtattggttaattttagttaaagtattaatgtaaaaaatttgaaaaaaaaaattagtaaaaattttagtagtatagtgtgtgtataaatatatagtatttttttaatatatatatttgagattatatttattaaaatattatgtttattatataataaatatacggaatgtgtgtgagatgatttagtaggttttattttagaagtttaagtaagagttaatattagaaaattttaatgtaattttttatattggtaaattaggaaggaaaaattatataattattttaatagatgtagaaaaattatttaataaatttaatttttatttataatttaaaaataaaataaaatatttagttaatagaaatagaaggaagttttttttaagaatttataagaaattttaggaatattttttttaaaattagtaattagataaatatgtttttttttttattattttatttattattgtatgagatattttgttgatgtaataaagtaagaaaaaggagtaagaaaattagaattagaaatgaagggggaatatgtggtattatttgtaaatgataagattgtttatatagataatttatgagaaattatgaataattataagaaataagagggtttggtagggacgttggagataagattaatatataaatatttatggtattagtaataattaattagaaaatgtaatttttataagatgttattagtaatagagattttatatttgtgaggtatttaggaataaatttaaagaaagaggtgtaaggtttatatggaaaaaaaaattataaaattttattgaaatttataagatttaaataaatagagatatattttatgtttaggagtgagaagattttataattttaatattaaattttttaaaattaatatataaattgaatgaaatttatataaaaattttagaaaggttttttttatggatatttgtaatcggttttaaaattgtggtttaaaagtagttaagataattttgaaaaagaataatatggggatttgttttattagatattaagatatatataatatatttaattatgttataaaattaagatattatagtattggtgtaaatatagataattagattaacgtaatagagagagttttatatatgtgggaatttggtatgtgatagagatagtattataaattatggggaaaataaaaattaaattaataggtggttcgtagataattgttatttatatggagaaaaaaaatagattattaatttatattatatttaaaaatgaattttaagagaattatagttaattttaaaatatttaggaaaaaatgttttttagatattatttttatggttttaagtgagggattgataaaaaaaaatataaattataaagtaaaaaagaagaagaaggaaagaagataaaattgagaaatttgatgttaaatattttgtgatgaaggatgttaaaaaataatgtttaaaggtaataaatagttttggagagagaaaatttttgtaagtatttataatatttagtgaatatttagtattttataaggaaaaaataatttattataaaaaagtgagtaaagtttagagttaggtaatataaagagaaagaaaaaaattttaaatgatgaaaaatcgtaggaaaaattaatattaaatatataattttataagtaattagagaaatataaattaagataattaaatatttttttaatatattagattagtaaattttaaaagtttaataatgttaagagtgggagaagatgtagaataataagaattgtatatattgttgttgaaagtaaattgagagtaatttggtaacgtttattaatttttatgatgtttgtattttaagatttagtaattttattttttttgtatttttgaaaagtttaataaatttatatggaaataagtttagagaaggttataatagaattgtttataaaatgataatttggaaatattagttagggagtggatatattatgatatatttatagaaagaaattggtttatgtttgagtttttttaggttgttataatataaatattatagattgggtgatttatgtaatatttattttttagttttgaaggatggaattttagattaaggagttagtagatgtggtggtgtggatttattttttggtttatagaggatttttttattgtgtttttatatagtgaaggggtaagagagtttcgtggggttttttttagaagggtattaaatttatttatgagggttttatttttgtgatttaattatttttaaaattttgttttttaatagtatcgtatttgggattaggattttagtatatgaattttgtagggaaagaaatatttagtttataataatataatagttaaaggaattagttttatatatattaattaggataaattttagaaatataattttaagtgataaagtaagttttagaaagatggattattgataatattattattcgttttttaaatttgtaaaatgatattagttattgtttatgatagtggtttttaatttttttggtattggtttaatagaagatagtttttttatagacgggggtgggggatggttttaggatgatttaagtatattatatttattattagatttttataaggagcgagtaattaagatttttcgggtgtatagtttataatagggttgcgtttttatgagaatttaatgtcgtggttgatttgataggaggtggggtttaggtggttatgttggtttttttgtagtttattttttgcggtgttgttaggtttttaataggttacggatttgtatcggtttatggtttgggggttggggatttttggtttatgatatataattatatagtaaaatgtaataggtatgtaatagtgtaatttttaaagagtgtttattgttgggaaagttgtggaagaatgttgttagtttggggttataaaagaggtttaaattataatattttttgttaaaaaatatttttaaaatgtggttaatgttaatatttattaaatttgagttggggtatttgattgtttgttatattattttttgtaaattttgtattttaaatattaaatagtttataatttttaaagttattgtttaaaagggtatatatgatttttttttgtatatttttttaatatttttttttttttttaaaatttaattttattttattttaagtattgggatatatttgtaggatgtgtaggttagttatataggtaaacgtgtgttatggtggtttgttgtatttattaatttattatttaggtattaagtttcgtatgtattagttatttattttgatgttttttttttttttgttttttttaataggttttagtgtgtgttgtttttttttttgtattaatgtgtttttattgtttagtttttatttataagtgagaatatgtagtatttggttttttgttttcgtgttagtttgttgaggataatggtttttagttttatttatgtttttgtaaaggatatgattttatttttttttatggttgcgtagtattttatggtgtatatgtattatattttttttatttagtttattatcgattatttttttaatattttaatttaggtatatagttgtgttggtagtttgggatttgaggaatagtttttgttttaatattattacgttgagtgattttgagtaaattagtgaatttttttgggttttatttgtgtgtttatttgtaaaatggggatatttatagtagttatgatttagaggtagtggttaagcgtatgggttttggaattcgatttggatttgatttttagttttgttatttattagttgtgagattttagttaatttatttaaattttttaagatgtattatttttatttaaaaatgtaaatagagatagtatttagtttatagattttttatgagaataaaataaaaggaataatgaaaattttttagtagattattattaataaaataaaattataaaattaagagaagatatttgttgtgtatataatggataagggagtggtgttaagtatatattatatattttaataagttaataaagaaataacgaattaatagaaaaacgggttaaggaaagaaagagataatttatggaggaaattttgattattcggtatgtaaatgaaaatatgtttaattttattggtaattaggaaattgtaattgaaatttgaaataattattagattggtaaaggaaaaaaatttttaaatatgattttaataagtattgaagagaatattgagtattaggaatttttagattttgttgttgagaaggggtttgtattttggagagtaatttggtaatatttagggaagacgatgtgttaatttattattttgttattggttatatatttaagagaaattattaggtatggtgtgtaaagaatatattaaaaagttagatatatttgtagtatttttttaaaggatattttaaaattagaaataatttttatgttttttatttgataattataatatagtatggaaaatgtatagaggtttatgttttgtaacggataaattttataaatataatgtagaatataaattttatgatattttttatataaagtttaaatatatttaaaaatatatatatatagtttaaggatatatatatgtgaaagataaaattatgtatggttataatgagtattgagtattatatttaaattgatgattgtgacgtttagggaaggaaaaagcgggtggaaatggggaaagtttattttttttttataaaaaagaataaggatatgataaaatagtggtgaatgtatatttatatataattttattttttgtattttttgtttgttcgagattttttataataaaaaaatattgtgtgatgtttaatgtttattattattatgtatggttttattttttatatgtgtgtatttttaaattatatatatatatttttaaatgtatttaaattttatataaaggatattatggagtttgtgttttatatttataagatgatatgatttggttgtgtttttatttaaattttattttgaattgtagtttttataatttttacgtattatgggaggtatttggtgggaggtaattgaattatggaggtgggttttttttaagttttcgtatattgaataagttttataagatttgatggttttataaatgggagtttttttgtatatggtttttttgtttgtttttatgtaagacgtgtttttgttttttttttattttttatagattgtgaggtttttttagttatgtggaattgtgagtttattaaaattttttttttataaattatttagtttcgggtatttttttatagtagtatgaaaatagattaatatataatttgttaataaatatttgtttttaggagttttttaaagtaggtaggagagtgttaatatgattatttgatagataatagaggtgcgggataaaaagttgatagagtgggttcgtggtttattgttttataatgttaacgttttatttttgatattatgatgtttattttatttatttagtaatttatttaatatagggaattggaatttgacgtaatttagggtaggcgggtgaagaagataatttttttttttttggaataaattatagtttgaggaatataatgatagaattcgataaaaagggaagaaattagattgttttagttatttgacggttttttaatgaatttgtaatttatttacggagggtttgattatttattgcgtatttgtcgaagaggaggaaggggtcggaggaagtgagatcgatggttttcgttttagtatgatttcgtttttttagtattttatttaaattaagaatagggtattgcgttgcgtttaggggtattagttttgagattttgttcgggataggttttttttttgttttgggttttttttgtttaaaattgaggagtagattattatttcgaggttagtgaaattttagattttttattttgttttttaggatttttttttttttttttttttaaaatttgaaacgggagttttcgtatttattatttgtacgtggttttgaggcgtatttttggttatattatagttatgtttttttgtttttgggaaatatataaaatgtttagtaatagtttttggtggcggttggtttttataaacgtcgttggtcggtttttattttatttttatattacgattttttttttagttcggggattgtggtatggaggtcgagagaggtttattttaaggaagaagtaagatatatgtattattttatttaaggagtaaataggcgggggggaggtgggcgtggtttcgattaattattttttttgaagttgtattatatgtatattttaggttggaaataagaaagaattttttggttgtaggaattgttaaataatagggcggatgattaagggaggtttcggaatttttttttgagatttttaaaaatgcgatataagatcgtatgtttgagatgattttttgtagttttggttagagatagacggattaggtgttttaacgggtttgattttttttttaaggtatatgattttgttttttgtttttttttatttttagtaatatttttagtgttttttttatatgtttatttttttggtgaagtttatttattgttattttttaggttagtttttatttaatttttagtttttttatatttttttttgttattttatggaaagttggttaaaggttagagttgtttaattttttatatatagtttggtggtagtatttgatatttagataaaatacggtaaggattttaatattagtatattgaagtttaaatattaaatttggatggaaatagagaattagttgttgttaataatttattgtaaatgaaaatatgattttggtaattgattttaaatagttttttttaaaagaatttttggtcgtattttattaagaatatagagttttaaaagcgtttattttagggttggattttttttttttttttttttttttggtttaaattttaaatggttaagattttagtttgaataaataatgtgggtggtgatttttttgtgaggtttagtagaggatgtaattatttttttattcggtttaatattaaattatgtgaaattagtttgattattttatataatttttatttcgtaatggagggtaatataatatgtattttttttttgttttttagggagaaagaaatgaatttttttaattgggagtgtttaattatgtataaagttcgttgattttataggcggttgttagatgattttgttaaggtttgtgaacggtattttaggaatgtagtgatgtgggtagaaatcgagtgagtttatgttatcgaatgttttaaatgggatcgaattagtagtcgtttagaaagattttagcgaaaatagaatttttggataattagtaatttaattttatttaagtattttgaggtttttaaaagtgattgttataaattagaaatttaggaaaaattttataggtatggggtttataataacggggtgaagtaattttgtttgttggttattgttatagttggttggaaatgtatgtatttgtaatgttttgttttcgttttagaggtaatgttttttgatttttttgttattgatattaaaagaaaatgatgaagtaattttatttataaatatatggtggggtttgaaggagtgtgtagagtttatgtttatttatagttttgatataatgtagtttttatatgtgtatgtagtaattatatttatttgttagtaaatgttttgaaatgtgttttttttacgtagagggttgggtttttttttttgggtttagggagcggaagggtattagtaagatgagcgtatggattgtgtgtttttttttgtttttatttggagtatttttatttgtttattgtgaaaggattaggaaacgttgggagacgggttggtatgtgttttttggtaacgagagagtagagtttttggagagttgtgggatggttaattgcgggagttttgttatttcgggtaggggagaggcgggggtttgtgaaataggtgggtttggtgttttttataatatttaaattatttgattgggggtttaatattatgtttttttagtagtttttttattaaatatatattttatttatttaaatattatgttttcggttggtaaaattttataggattatattttaaaataaaattttgttgtatttatgttggtatttttattgttatgagtataaagaaagggaggttggaatttagttaataattttgatattttgttggaagtaaaatggaaggggttttttttgagtattttttagattaatttaaaagttttgaatttttttttaaattaattatttaggttttgagtgtataatgtttgtttgtatttaattcgagttaatttaatagatatttggaaaatataaataatggataaggtaattttggtgatataaaaattaggttaggcgtagtgatttatatttgtaattatagttttttgggaggttaagatgagcggattatttgaggttaggagtttgagattagtttggttaatatggtgaaatttcgtttttataaaaataaaaaattagtcgggtatggtaatgtatgtttgtaattttagttatttgggaggttaaggtaggagaattgtttgaattcgagaggtggaggttgtagtgagttgagatcgcgttattgtattttagtttgggagatagagagagattttgttttaaaaaaaaaaaaaaattagaattttttattaggttatattaattttaattgggaggatttgggtagtttttatgtatggaatttttttagggttgggggttgaatttttaaaggggtttaataggttaaagggaaatgggaatttattaaaattttagtttatattcgtatgtattgtggagaagagagagatgtaattgttattgagttttgttattttatggttagggttttataattttattttgattttttgtttgtttgttttaagatagggtttcgttgtgttttttaggttggagtgtagtggtataaatttggtttattataattttttttttttgggtttaagtaatttttttattttagatttttaagtagttgggattatagacgtgttattacgtttggttaatttttgtattttttggtagagacggggttttgttattttgtttaggttggttttgaatttttgggtttaagtgatttatttattttggttttttaaagtgttgggattatcgttgtgagttattgtatttagtttattttgtttttatagtttatttgatatttgagggtttttttatagaagtttttttttaagatttatagtatttaatattatattgtgaagtgaataattagtaaaaaagaaaaggaattttttttgtttttttattttgataaaggaagtttttttttaaatgtttaaaaattttttataaatatgattatttttatagttataggggaaatatgtttttagataaaggaatttggatataaagtaatattttaaattatttttatttttttggatattataatttataaaattttatgaaggaaattagtttgattttttatgaagttttttattgggaaattattgtgtgttatagttatggaagtaatatttttgtgtattttttaattttttgtttttgtcggaggtttttattatttttaaattattatagtaatttagttattttttgtttgtagtacgtgttgtattttgtttggttagaggtaaagatgaatatatgatttgtttttgttatttgagtatataatttgtttttgttatattataagtttttggaaattagagattgatgtatttatttttatattttttagcgttattaatagggttggtgtttattgaaagaatgaataaacgagttagtaaataaatattatgaaaatatttatagtatgggttggaaaatatttttagtgaaaaattagatagtaaatattttaagttatatggtttttattataattatttaattttgatgttgtagtgtgaaagtagatatagataatatatagtaaatgggtatagttatgttttaataaaattttatttataaaagtacgtggtgagtaagatttggtttataggttatagttttttaattttcggtttttggtggttatttttgttgtaaattttagtatattttttacgtttttatatagcgtttgttatttttaataatgagataaagtgtagaaaatataaatgttaaagggttgttttggaattttatagtaataaatttatttaaaaattaattataaagtatatatggaaattagttgatttattaagtatattttatggttatttattttgtatattgtatttttttaaagcgaaaaatttttattttaagaaataagggtagtagttttgttatttacgttattatgattgagataatttgatatgataagattttagagttattgagtgaaaggtttggtgttaggttatgttgaatttgatatttttttgggaaaggggaagaaatgtttttttattttgttgtttagtagattatttggtttttaattttattgttaaaatttttttcgaggttattaatgtagaagatattttttttttttgataattttttggaaaatatttagttagaaagagtataatagaattttataagtttagtaaatatatagaaaagttaagagtaattacgagaatttgatgaaaataagatgtttcggtttgttattttggtttgatttgagagtgttttattcgttattatttttgtttcgttattaggttatttttcgtaaaaaatataattttgaaaaggagttggatttgaattgtggtcgatattaataggatgtaaagttttaggttaattgtttggtttggaataaatttaattagttttttttaaggtatgaggaaatatataataaataatgtattaatgagtatttcggttgatattttgtgagatgggtgattttaaggtgtagatttttaaattgcgttagttatttataggttgtgatgaaatagttttatagattttttttaagaaggaaaaaaaaatgaaatttgagtttttttattatgttaagtttttttttaatattagattaagtaatgggatgaattttgtgttttaagaatatgagaaaatagaggtttggaaatggaaggtgttatgaggtagttaaaagatttgagattatatttattatatttaatttatgtgatatgaggtagattatttgattttaatgttatttgatgttttaatttttaatgtagggttgggaagtatatattattgaggagaaattagggaatatatgatatagagtttaatttattttaataaattttgagattttattgtgtgttagtgttggagagtgtaaaacggttgttagggattttgagtatagcgtaggtgagtattttatggggagagtattatatattgttttatttgtaatattttagtgtttaattattttgagttttttttttttgtttattgaatttttttttttgttagtttattataattttttattattagtttttttttattaaaatatttttttttatttttgttataaaataaggagggtatttttatcgttttttagaatagggttgtagtaaataattttacgtatgtgaagtggtatgatttatattagtttaattgatattagataaaattttaaattgttgaaaatgtatgtggtaatgtatataggaattttattgtaatttgggtttggggtaagatgtataaaaataaagataagagtttgaaagagggattaggtggagaagataatgaaagggaacggagaggcgttggaatattgtgaaatgttttaaaaagttgtttatagtaatttaggataaatttttatattttagttacggtcgtttttaagtaatatggattgggtaaggtatgttttttaaggcgaaaattattgaatatgaagtgtaaatttattagtatttgtattatttataatagtaaagatatagaaataattttaatgtttattagtgatagattggataaagaaaatttggtatatatatattatggaatgaatatttattatatagttataaaaaagaattagattatgttttttgtaggaatatggatggagttggaggttattattttaagtaaattaatattaggaatagaaaattaaatattgtatgtttttatttattagtgggagttaattgatgagaatatatggatatatataggggaataatatatattaggatttattagaggatgaagggtgggaggagggagaggattaggaaaaataattaatgagtattgggtttaaaatttgggtgataaaataatttgtataataaagttttatgatataagtttatttgtgtaataaatttgtatatgtatcgttgaatttaaaataaaagttaaatttaaaaataaaaattaatattaaaaaatttattagtattttattgtgaagtttgtgtagggaggaggggtaatgttttagggtgagggttgaaattttttgtttataatttttttttgtttttatttcgggaaatcgagtatgggaatttatggagaatatttgatttttattttttttaaaatagttttttaggttgtgtttatagaatataaattaatggtttaagagaaaaaatatgaataagttaagggattaatatgataaatttttaatttaatttaatatcgagatagatgtttttaatgttttttgaggttttatgagaatattatttgttttttttttttggtttttaattttattattattgaaaatttttatttgaaatataaaatattggaagagttatttttaagatttttagaagtttcgcggtcgggtgtagtggtttacgtttgtaattttagtattttgggagattatagtaggtggattatttgaggttaggagttcgagattagtttgtttaatatagtgagatttcgtttttattaaaaatataaaaattaggttcggtatagtggtttatgtttgtaattttagtattttgcgaggtcgaggtgggtagattgtgaggttaggaatttaagattggtttggttaagatggtgaaattttgtttttattaaaaatataaaaattagttgggcgtggtggtaggtatttgtaattttagttattcgggaggttgaggtaggagaattatttgaatttgggaggcggaggttgtagtgagtcgagatcgcgttattgtattttagtttgggcgatagagtaagattttgttttaaaaataataataataataataaatataaaaattagttaggtatggtgacgggtgtttgtaatttttgttatttaggaggttgaggtaggagaattatttgaatttaggaggcggaggttatagtgagttaagatcgtatcgttgtattttagtttgggtgatagagtaagattgtttttaaaaaaaaagatttttagaagtttcgtttggtagagtaaatggattttttttattagtatgtttagaataatttaggtaaaatgttgttgtaattaattgttttaaagttaatttttttggcgtgttattttagtattgagaaataggattagatgagtttattttattcgttttaggtagtattttgggtagagtaaatagaaaattttaaggaaagaaagaaatttttagagttcgttttgggtttttgtggattttttttttaagcgttataagattggttttagattatagatgtaatttttggatgttagatttattagatagatgtttttttttaaagttgttgttttttttttaatttgtttatagcgtgtttttattttagtttgtattttttttaagtttttattgttaattgtacgttttaaaggttttttgtttttatatataaaaggttatttttttattatgtgttttgttttttataaggaatgtatttatttttcgggtgatttgttaatttattattggtgtgtttgttttttgggttattttcgagaaatgtgttaaacgttttatatatatattattaattttttaagttgtgtggtgttagaaagagttttttttttagaaataaattatttaggttatatgattggtattagttttttaaattaattgagtattaattgatggatttttataatgtggttagggttatttatttaaatttgtgttttttggttttgagtttgtagatggtttttatataagttagattaaggaattttatttttatattaattaagtagatttttagtgttaatatattttaattaatagattttaaagatttatttatttttttttattgtagatttttttagaatatgatttagattaaaagtaggatagtatttgttgttattttttatatataaaagtatagggagataagggagttttttggtagggatggaataattttgtgttttgatggcggtggtggttataggaatttagatatggggtgagatatatatatatatataaattagtgtatataaattatggtgaaatttgtttaaggtttaatattaacgttagttttttggtattgataatgtgatgttatatatatgatattatttattattgttatgtaagacgttattatttaagaagtaggatgaagagtatatgggttttttttgtattatttttgtaattttttataagtttataattattgtaaaataaaattttttaaagttttatgagaaagttattgtttataaggtagtagtttgtttaatttagttcgattgaatttgaagttttaaattgttttttttttttatttatagtatttttaagtattttttataatttttttttaagaaatggagtttattgattttttaatttgtgaaaggtattttttgttaatatgagagttttagagagtgggtggggtgggattaataggtttttgaaaagtttatattgggtttattagtattttgtattataacgagtattttaataaaatagtattttttagttgttttgtggatgtttttaatgatttagaggtttaaagaggtattaggttatagttttaagtggtaaatatatatatgaggttatttagtgggagaggagttcgtttgtttttttttttgtttttaagtttttttttaggattttttagggttggttttttattttataggttttaagttaaagaaataggttttgtgaaatttatatttaaattagttttttttttgtattagttcgtgtttacgttgttggtaaagatatatttaagattgtgtaatttataaagaaaattataaattataattatggtggaaggcgaaagatatggcggtaaataagagaaaataatagaatttgtgtaggtaaatttttttttataaaattattaggttttatgagatttatttattattataatagtataggaaagattcgtttttatgatttaattatattttattcgtttttttttatgatatgtgggaattgtgggagttacgatttaagatgaaatttgggtggggatatagttaaattatattattattttttttagttatattttacgttatttattttgttgtttgttacgtttttatttttcggttttatttattgtttatgtggtattatgagaattgtgtttttttgtttatattgtgtttttagtatttaggatagtgtgttatttgttgattgaaagattgaagaaatgaatgaaatatttttaaagttatggtttatttttagataatggtgattgttaaatatgtagattattattaaatagttttaattaatgattatttaggttagtttatgtaggtaatgattatttttatgtttggttacgagaataaataagataaatttgagtgatgtttttaatattagtagttgagtttaagtgttatggggaattttaatgaaaagttatgatttttattgaattttttgatcgggttagaaagagattagtaggtaggtagatagatggggagataggaatgaatatatatttaagtatatatatatacgtatatttttttatttttgaagatgtaataggattttttttttttttttgagacgaagttttattttgttgtttaggttggagtgtaatgatgtaatttcggtttattgtaattttttttttttaagtttaagtaatttttttgtttaagtttttcgagtagttgggattataggcgttcgttattatttttagttaattttgtatttttagtagagatggggttttgttatgttgattaggttggttttgaatttttgattttaggtgatttgtttattttgattttttaaagtgttggtattataagtgtgagttatcgcgttcggttataataggattttggtattttttttatttttgtaagttaatttgtaaagaatggaaattttttattaggggaagaattagaaaaatattagggagataggttttttgggtataggtaggtagagtattagggagaaggagttttttgttgcggttggtggagagcgttttgaatggtgttattatttttattgtttggatttataaggttatgagaggttaggagtgagggatgttttgttattaagttattattttagtgttaagttggtttttttattacgttatattaatgtttaaaagaggagaggttttagataatttattatgtttaagatgtcgtaagaaaatttagagggttatgtttatagatatagtgaaatatatttttttaattattaattttatatgtatttgttttagtaaggaaaaaaaaatttttttaaaagatttttttaaaattatgggaataagaaataaagaggttaatgattttataattttaaaagtatatatggtgttaagtagtttaaaagttagttttttgatattagagttagtatgtgttgattgatttttttttattttacgttttttttaaaagaaaataggttggattgttttagtaaataataaaaggttagagaaacgttatttataatatgagtaaaataattgtttaatttgttaaaatgtttttaaaggtttaataggtagaaaaatttagtggtgaaataatttacggatttgatcggtgagaaaaggttttttttagtaaaatttgttattaggtttttggtttattttttattaatgagaaataaaaataaattacgtcgttaggttttgttaatattgagatgttatgttttttatagtaaagtaaggttgtttattatatagtttttagatttttcgttttagattatattttgattttaaggttaagtgtagaaatggtggttaaataattatgtatttaaaaacgaagtttaaagagtttattttgtaaaatttttttttgaatgaaattttttattggtttagtttttacgtttattttatttgtagaattttttcgtggtgaattggatgttaatattattataagagttttatagagagatagagaataagtatattcgagagagaaattaggattttgtattttggggatattgttttaattgaatttgtattagtaattcggtgggatattgttttttttaaggtatttttgttattagttatgtagataatgttattattaatggtttattgttagttttgttgtagaggtgggattttatttattttcgttttttataggattttgcgaggttagtgtttagtatatttattgggttgagttaatgtttttatattgtattttatttttggtttaaaattatagagtagtattttatagagtattttttatgaaatattggttttgtaagatgttatttgggtgtaatataattttgattttatgaagaaataagttttagaaatgttttttattatgattatattttttaattttagaattattatgtatatgggtatattaaagaattagagaagttttgtaggaaagaaatttggtgaagttagtattttttaaatgttttttagaaatttttttttaattaatatttatttttatttttagtaattagtgttttggagagggtattttggggaatattattttaaaatagtttttaatttatgtttaattatatttaatgtgttattaagtttaattggttttttttttattatataagattgtgattagttttgtttatttaatattttattgttaattttttagttttaatttaatgttttatagtattatagtattatagaaggatagatttggaagtgttttagaaataattataaagtaaaggttaattggttaagtgtggtggtttatatttgtaattttagtattttgggaggtcgaggtgggtggattatttgaggttaggaatttaagattagtttggttaatatggtgaaatttagtttttattaaaaatgttaaaaaaattagttgggtatggtggtgcgtgattgtagttttagttattcgggaggttgaggtaggagaatcgtttgaatttaggaggcggaagttgtagtgagttgagattgtattattgtattttagtttgggtgatagagtaagatttcgttttaaaaaaaaaaaaaaaaaaaaaaaggtaagttttgaatttaatagaggagttaattaagatttttagggtgaagggatatgtttaagatgttataatatgatacgtttgatttattaaaaaaaatggtagttttaggtattatttttttttttttcgtttatttggtgaataggaattagaggagtaggtttttagtgtggaaggaaagggaagttagtgttgtggagtatttatcgaatgtcgtatcgtatatttgtatatatatttttttattttaatttagtaagaattttgtagggcgggtattttatagattaggaagtttaagattatatagtaagtaagtagttgtgttaggatttgagttaagaatagtttgattttaaaatatatatttttgttagtgtattatattttttttcgataaggaggtttttaataaaagtatattgaattatatagtaaattaggaattgtatatttgaagttggtggttgtaattattatcgttattgtaaaggagaatatatagtgagtttttggttttttattaaaatagtttattatttgtgaatgtaggaaagagtgaatttttattatttatgaaaaatgaattaagttaatgaagttataaatattaattgagagtattattgaatatataaataatatatttgtaaatttttataggattatttaatgttagggtttgttggttttttttgttaagttatttttgatggttggttattttttatgaaatttataatgggtataagtttagttaatatgatgacgatgatgatggtttatttttattgtatatataaaagtatatattatttaaagtcgttggagttttaatggagaatggaaattttttttagggatagataattgataaattttaggagtatttttttttatatttatttttttatatttgtattttttgaggtatttggaatattgttaagtgatttttttttttatttattagggatttgttgttttttgaagaatttttgaaataaatatgtggtttataagtttaagtaaaatattttaaaaataataataaattaataaatagtaaataataatggttataaatttatgaataattaaatttaataaaatattgatatgtaaggatttttattgtttattataattattaatatgtaatttagtttatggatattacggagttttaatattggtgggtggggatatttttaattttagtatttaaaagttgtaggggagagagaaatggtttttttttatcgttttgggttttttggttgggttatgaattgacgtaagataaattaatagaaagaaattttatatttaataatgtaggtgtatatgggagttttataaaatatgagatttgaagaagggttatacggttgaaatttatttagtattttgagttatggaacggaataggggtttggggtttttgggggtggtggggatataagttgtgcgttgatgaggggaggttttgtatggtgggttaagtgtgttttattatgtagagaaagttttttaggtattagaaattatattggaatagtttttggaaaaggagatgatagtttggggtggtatgttttgagtttttataaagttaattatgattgtgtaattttaagaaaaagagtgattatttagtattttgggaggtcgaggtaggcggattattaggttaggagatcgagattatttcggttaatacggtgaaatttcgtttttattaaaaaatataaaaaaattagttaggcgtggtggcgggcgtttgtagttttagttattgaggaggttgaggtaggagaatggcgtgaattcgggaggcggagtttgtagtgagtcgagatttcgttattgtattttagtttgggtgatagagtaagattttgttttaaaaaaaaaaagaaagaaagaaaagaaaaagagtgattgatattaaggaaggtttttttttttttttttttttgacgtagttttttttttgttgtttaggttggagtgtaatggcgtgatttcgttttattataaattttatttttcgggtttaagcgatttttttgttttagttttttaagtagttgggattataagtatttgttattacgtttagttaatttttgtatttttagtagagatggggttttattatgttggttaggttggttttaaatttttaattttaggtgatttatttatgtcgattttttaaagtgttgggattataggcgtgagttattgtgtttagtttaaagaaggtattttatatttgattgttaagatatttttatttaattttaagtattgaattttagtattaaagtatgtaaagaagttataaggatagaattatgtttttattaattttttagtttttaaatataagtaattttaatatttttaatattttaaaaaagatattaatgagatttttatttataaagattattagatatagtgaagtaaatatttataaggaaataaaatttgttaaaattttaatattcgtgttatattttattgatagaaaatttgtttttgaaagttaattttgagttttatttttttattttttttgagttttatttttttattttttgtatatgtttttatattttagtgggagagtttttattaaaaaatagtattttatttttttttatatttattgatacggtttggttgtgtttttatttaaattttattttgagttgtaatttttataatttttatatgttgtgggaggaattcggtgggaggtaattgaattatggtggtaggtttttttgtattgtttttatgataatgaatgagttttataagatgtgatggttttaaaaatgggagttttttgtataagttttttttgtttgttattatttatgtaagatgtgatttgattttttttttttgtttgttacgtgagatgtgttttttattatttatcgtgattgtgaggtttttttagttacgtggaattgtatgtttaataaattttttttttttgtaaattgtttagtttaaggtatatttttattaatagcgtgaaaatagattaatatattttgtaaatttgatggggttagttttgtattggttgtatataggagtaattttgtatagagaaatagattaagtttggaattagaatagagtaggtagtaagtagaaagtagaaggaagagtaagtaaaataaataggtttttaatatttgttatttttcgatttttaaaaagtgaatgtatagataatagatattaattttgtatataaaaatatattttaatgttaattagaattattttttagatgtatatagtttgcgtttgtttatgtatggtgtagttgttatttacgtagtgtttattatatagttggtattgttttaagtagttaatttataaacgtatttaaagtttatagtagttttatgaggaaaatgttgtaatacgtggtatttagtagatgagtagaaggagttttagaaaagtttgggtaggaaaggatagagtagaggtttgaatttaggtagattatttttagtttatattgtttatatttgatattatattgatcgtttacgaagtttgttgtatttattttgttgatatgtttggaaaagaaatatattttaagtagttaataattaattattttttatataagaatatattgtaatatttagaaaagggttaaaatattttgtaattttattattatattatattgttggggtagtttaattatcgtagagattttatgaaagaggtttttgagttttattttaaaatattagtgattagggtaaaatttttttttaaatttaagtcgtttatagtataaatttgggaaggaaattatttgagatggtcgttggagatttttattagaataatttgattattttttttatagtttatatatgaatagttgaattatttaattgtaggagttaaaagatttgtttgtgtttagaaaaatgagatttttatttgggattttttagtatattagaaagatgatttttagtaaattgtgggtaagaaggaaataatatatatatttgtggttatgagagttaattagaaaaaaaaaaaagaaagaaagaaagaaagaaattttttggattcgtatagttttaaaaattgttgaatgttgttttttttttttttttattttattaagtattttttttttatcgaggaggatttattttttatttgttttttttacgtttttgaaatatatataaagttagtgtttattttttatttattgaaattttgtttaagttattttttttttggtttttatttttagaagttataatttgttttgaaaatattagtatgagagaaggtttttttttatgtattataaatttttaattatttagaatgtttgttttagaggtaaagagatgtttggtggtttttttgttttgtaataatggtcgtgtaaataatatgattggataaaattaaaaatgtgtttagatagagttttttttttttgtttaggtaaggtggtttacgtttataattttaatattttaggaggttgaggcgggtggattatttgaggttaggagtttaagattagtttgggcggtatagggaaattttgtttttgttaaaaaaaaaaaaaaaaaaaaaaaaaagttgggtgtggtggtgtatttttgtgattttagttatttgggaggttgaggtgggaggatcgtttgaattagggaggtagaggttgtaggagttgaaattatgttattgtatttaagtttgggtaatagagtaagattttgttttaaaaaaaaaaaatggaattttttttttttttgatgagtgttttttattattggggttataattattaatattagttttttatagtttaacgttatttgaaatatttatatgtttgtgttataaattaatatacgtatttaaaatatgggttatagaaaagatattatatgtagtggtttagaattttgagttgtattgtttttgttttttatatggggtattagattttaattaaaatgaagattatatttttaagtagattgttagaaggtattatattggaagtttacgggtagtgtattttgtttaatgagggtagaaagatagtgatatatgaggttttttaaaggtgatatggaatgtaggtagagatgaaatgtagaggagaaagaatgtaaagttgtaaaatatgggttttatttgtatttggatttggtttttggattgtagagtttattgttgtgtgtatagatttggtaagtgtacggttgttagtttgatttcgatgaagggtatttagaagaattaaaggatgaaagataacggaaaggagttaatattatgatttttattttattgatggtatggttgaggtttaaaagagttaagtgatatagagttagagtagtataaagttagtatttgttattttttttagttttataatttataatttttttgtggtatatgtttttggttattaataaaatgggatgatagtgtggatagttttatttaaattattatttttgataaataaattaaatttagggatgttgttggtttagagttgtttttttttttttggggattggtttatgttttaggggtttaaaagtattattatttttatttatttttataatgaaattttgagggatacgattgtttatatttttaattggaaagtcgtatttgatttatttaaatgtttagatttttaaaaagtaaagtggtttagagtggaattttaaagttgagagtatggatttagggagatgttgtttattagttaggataagagatgtggtttgaaagagttggattttttttttttattttgtaattgatttgttgattaaatttgggttatttattttttaattttagtttgttttgaattttttttgtgtaaaaaaatatgggaagataatatttaaatgttttttagggatgttgtgaagaggattttatcgatgttttaaattatatggttttaggaaggtgttatatattattattattaaaattatttgtggttggttgtagtttttttttttcgttatatatataaatattttttattaaaaaaaaaaaagtaagaaattaattttttttttatttgaagggattttataaaattttttattaaagtattaatattttgaaaattgaatttaatttaatgtggtaagggtatgattgataattaattttaattttaatttttttttttttaaggagagaaagaattttatttgatggttaattaattaaatatagtcgatgggatatatttagttaataatattttattttagatttagtttagttagagaagattagaaaaatggtgttattgtgtattggttgaatgtttaagttttattagttatattattttaagttggtaaaatatatatgggaagataatattatggaaaaaaattattattatttgagatcgagtttcgttttgttatttaggtttaagtatagtggtgtgattttagtttattgtaatttttattttttaggtttaagcgatttttttgttatagttttttaagtaattgggattataggtgtgtattattatatttagttaatttttgtgtttttagtatagacggggttttattatgttggttaggttggttttgaattttcgatttcgagtgatttgttcgttttgattttttaaagtgttgggattataggcgtgagttattatgttcggttaattttatggtaataaattaagatagtgaaagcgtgatttatttaagggttatatatataaaggtgatagatttgtatgtatttatttaaatttatgtttaatatagtatatgttgggtaagaatttgtgagttagtttagtttataaatggtttagattaggggtatgtggtaaggggtatggggttttatttatagtttagggttataaaatagggcgatttaatttttttattttatataaagtttgttttttttttttgtatattttttatattaggttttaattaattaatttaattatttatagagtaagtagagttattaatagtatgttttattttattaaaattagatatatggttattaaataaggttgatttaggataattattttatttagaatgtttttattagtttatgttaaatgggaaaaatgagggaaagtaatgagttttttgaaagttaaatttatttaaaatttttaaaattgtgtaatttattttaaggttatgtttttattattttgttttttatgttaaatgtttttattttattagtgagagtaaataatagttgatttattaatattttattttggtaaaataaaaagttagtatttttgtattggtttttaaaaaaaagaaatgaaaagtattgaaatttaaagtttggttagtattattttagaatggtttatttgttgttaaaaatttatagagagatttatgcggttattgtgttatgtgattaaatatttataagatataaagttttattttaatatgtaatgttaaaggatattaagaaaaacgaatagatagttttttaatttagagtaagtaaagtatgttgttatttaaaattaaataaatgtagattttaaagtattaaataaatagaaattatgttgttattttttaaatggtataaagtattttaattaaaatttagagggtatgtaaaggtataataatttaggagatagagttacgataatattgtttattggtttttaatttttagattttattaatagaagttgtagataaatatttatttttcgtttgaggataaatgatagaggatttaattatttagggaattgaaaagaatacggatggtattaagtttggttttagttgatagaggtttagaggtagaagatgggagtcgaaagagtgaatgtttttattttttaaatgagtaattaagtgatgttttttaaggttaatagaatgagaaatgaggtttttaagaatttgtttgagaaataagtaatgttttttaagtggagggacggagtatggagagggaagaggtttgagagaagatatagacgaggttgaattagggagagaaattttattgattataaaaggaaggtaataaattgagaaagagtagtgttatgggtcgaattatgtttttttaaaagatatgtttaagtttttagtatttgtaaatgtgatttaatttggaaatacggtttttgtaaatgtaattaagttaagaggaggtcgttagggtgggttttaatttaataggattgcgtttttataggtagaggaaaatgttatgtgaggagggatatatagggatatagagggtaagttaaggatcgatggtatttttaggagttggaagaggtggggggtggatttttttgagtttttagaataagtgtggttatgttggtattttgattatagatttttagtttttagaattatgagataataaatttttattgttttaagttatttagtttacggtattttgttatagtagttttagaaaattagtataaatggtattattatatattatttaaagatatgaaggtagttatttaaagaatttttaataaagttgggagggtttaaaggtgttttttttggaaagtgggattaaggaaggataggatttaggtagggttgttattttttattaaaagttttttgtgttatttggttttttaattatatagatgttattttgattattttttaaaaagtataaaatatttatgtgatgttattagaataaaatttggttagttttttttatagtggatgataaattttgaggattgatagttattttttttatttgttttttggcgttgtttttcggttttttagatttttatatacggttttcggttttagggggagtagagtcgagttgggagggtattggtttggattttaaagtagtttaaatgttttggtacgttttgtttatatgtttattatttttattttaaaattaaatataaattatttttggattttttacgggtttgcgttatcgatgatggtgattttttttattgatttggatgattaagaatcgattaaagggaaaatagagaatagtggtgagtttgttattggttttttttgtagataaaaatgtaaaataatgtttgataaagattttagtaattatgttatatatgattagaaaattttataatagagttttattataaatatttgtttattatattttattgaatttataaaaagatattttaagtgttttttatggtttagatggaggattttcgtattgtggtgtaggttgtgatttttttggtcgttagaagttttatgttttttgtttattttaagaagaatgtttatattgagttttgtagtttgtaatgtggtaaaatgttgttgttattttttatatgaatagggttattgatgattgtgggggtttagtgtaaaggtattagtttttattatagaaagaaagcgggtagcgtgtaagtgttttaagtatggtttcgagagaaaagtagaatgtaaaaggtaaacgtagtttgtatgtacgtagggtttcgttgaggtttatttgtattcggttttttatggtagttggggagtattttgtcgttggttggtattgaagtagtgttaggtgggtgaaagttgaatgaaatgtttaatagttattatatggatgaatacgtaggaagtagaataaaggagtagtattttattagtagtagaattttgatggtagttattgtttaaggggaaatcgtttgtttttatttttattttggtttttagtttttttgggtaatattttttagttattttagtggttattttatttatttacgtggttattagacgtttagatttagttaggtgtttttttattttatattgtagggggtaaggttatttcggaatggatttttaaaggtaggtgggaattacgttaatgagaaagtaagttataatttaaatattcgttgtatgtgggaatttatattgaatagaaagaataaaatgattttatttttattttgtgaatttttttttttagatttttatatagaagagagtgtggatttatttaaggttgattatatttaattgtatatatttgttttttaattgttttagttattattttttatagttggtttttttttcgtttttgtttttaaaatattattttttaatatattgtgaggaagattaaatttttagatttagatgttttagaaatttgatttattagttgtgttttgaatacgtttggttattttttatttgttttttttttttttggttatatgaatattgttgtaaataaattttgtagtttgagttatgatatttattagaaaagtttaataatattgtagtttttattataatgtataagtatgaaatatttaattttttttattttatatatatatatatatgtatgtatatgtatacgtatatatatagtaatgtattatttgaaaacggaggtatagttttttagtaatataattaaaaatatggtaatattttttggatttttaagttttggatttattatgtaaattgtttgaggtttatgattgaaggttttaagattttattttattaaaaaagattttagtagttattagtttatagaattttttttgatagtagggtatttttgtaaggagttgttttgtttatgagttaggtacgttttggttagtaggggcggacgatagtatagatagtaaagggttaattaggttagaatagtgttttaatttttaggaataaatataatttaattttttaagggttaggttcgttattaatgaggttttgcgttatgaaataaatttacgagagaaaggtgatatttagttaattgattttaaaaatggaaaaaaaaaagtggtttatgtttttttttatttttttggtagataacgggggtagatgaagtgggagaaataagaggaataataatttttttaaaaagaagaaataaaatgaaaaagaaaaataaatatgagttggattaggaaaaaaaatagggtaaaataagtagaaatgatttttagataagaatagtattatataaaatagtatttataatatgttaaagttattttgtagtataaattatttttttataaagaattaaaagaagaagaataaatataaaaattaattaaggtttagggaagggttttattttttttcgaggggttgttttttatttaaatattggttgatttatgtaggtattgttaggttgttttagagagggtattttttatttttgtttgattttgtttatagagtgatttttttattttagtttgtaaggaaaggttaagtaggaggagtagaatgttattttatttagaaaagaatttaatttattttagggttttaggtttagtgtttttttttggtgaattagttttttaagagtcgataattagttgtttggttgtgagtgatatgaaatattgtttttttttttttggaggaagaaattattagtatttttttaattgtttttattgggaataaggtagatggaagaagattagtacgatgtttgatttatagggagtacgaattagatatttattgaaggagtaaggagtaagaaatagatttttgatttaaagtgataaaatattaaagttaattgtttattttattagttgtaagagagttatgtagggtagtttttttttttataagataatttagcgtggagttgttgaatgaataggaaaaagggagagttttgaaatttatatagaaataaaaacggttttaggggataaattatatttatattatattatttacgttatttaaggaatgtggttatatattttttgaaaaataaaatgttttattttgttttaaaaaattgaatttgtataatattgggtttgtttaaagagtaaagtatatatattaatttttttttttgttgttattttttttttttttttttttattttgagatagaatttcgttttggagtgtagtggtatgattttaggttattgtaatttttattttttaggtttaagtaatttttttgttttagttttttaagtagttgggattagaggtttttgttattatgtttagttaatgtttgtatttttagtagagataatgtttttttatgttggttaggttggtttcgaatttttgattttaagtgatttgttcgtttcggttttttaaagtgttgggattataggtatgagttattgcgtttagttaatttttttatatttttagtataggtggggttttattatgttgtttaggttggttttgaatttttggttttaagtgatttatttgtttcggttttttatagtgttgggattataggcgtgagttattgtgtttagttatatatattaattttttttggagtaaaggtataagtatatttattgtataagtatagaatttaggaaaattattagaagagttttgacgtaaagagtatttgttatttattagtagttggtagtgtggttgattatttttttgaaatgtgtaaacgtgtgtggtaaaagtaaagaatcggaggtagggaatttatattaggtttataattttattttttgtttagagtaagtgttgggttgttgattaaattaggtttttttggattttcggagtagtttttttgtatttttaggaaggaggtggataagtggttattttggtttgtttgtttatttggtttgtttgtggttggttagtttattatttagtttatggttaggttggaggattgggtatttttgtttcgattagttagatattttattatgatataggttatttattgtagattagagggatttaataggaaagttttacggggtaagtaaatattattattatttaaagtaaaattttaggttaggggttagtggtgtttttattataggaaaaagggaaagtatattagaatttgatagaggaataagtattaaattgttgtttttaaataaagaatttatattaataaggaatataaaaatgttatttaggatttttgtttttagatgtttaatataaaggagagattgttgtgttagggaataaagtgatttaatatttataaagttagaatttttttattgtatattttgtttttaaaatattaaggaatatagtaagattttaagttggagtaaagaagttatttttggaaataagagaggagataattgaagatttttatagaggggttgaaatttttttcggaaaattgtgtttattagggaattttagtttagggggtagcgagggtggacggtgagttgatttatttttagatatgtggaataggtattgggtgtgcggggggtgtagtgtagaatgaaggttgggagttgttaaagttatagaatattttagtagtatattacgggaatttaggaattttaaacgttttttaaaaattaacgttttgggtttagagttttaggtagtttagtgtaattttatttttattgggattgttgttagaaagaaataagtagtgttttttgattatagatttttaaaatttgttttgttatatgtaggtgtgtgagattttaaggagatttatttaattaagatgggggtgagggagtaggagggttgatgagtggttttttttttttgaatggttattatattggattgtattatagaataaaaatttaaaagttttaattagaaagataatttaagggtgttaatttgtttttttcgtttttagtttattatttttattttttattggaagtagttatattattgtattattatttttttttttattggattgagtatttttagagggtaatgtaataggattgaggtgatggggttgggaaattaggttttttggatttaattttggttttattgtataatgggattaatgttaagttatttttttttaatttagtatttttatttatataatcggaataatggggtttattttttggattgttgtaaattttttttttagacggagttttatttttattatttaggttggagtgtaatagtgtaattttagtttattgtaatttttgtttttcgggtttaagcgaattttatttttgtatttttagtagagatcgggttttattatgttggttaggttggttacgaacgtttgattttaggtgatttatttgttttggttttttaatgtgttgggattataggcgtgagttattacgtttagtttgttgcgaattttaaatggaatagtatagtaaaacgtttagtatgtagatggtttcgtttttgaattcgcggattgtattttattcgtttttatatttttttttatatttgtttatagtagggttttatattaaaattttttaaagaataataaaatgttttattttttttagtttattttttttttgataatatgttttttgtttgtgttttaaattttttttttggtattggattggatgttttagattagttgtgattaatattttatatattttttgtaaaattggatattagtatttaagtattattttaattaacggttagagagtggtaaaattaaatatgagatgatttattttaatgttttattgtgttttttatttttggaattttaaggggtttttgttaaaagtgagtgtataaaggaaatataaataggtaaaggagaggagaagggagtagtagagatagataaaagttaggaaattatagttcgattttttgtattgtttttaaattattggtgtttttgaatagtttgtatgatattaaatatttttaagaagttataatttatgataataaaaattgtagtaaatattaatagaaattgatatcgtagaaatttttaaggggattatttattaaagaaatatatgatttggaataatttttttttgtgtaattaatgggaacgaagagatagttaagagatttgtggtttttttagttaatatgatattttaaattttttattttttttaatttttttggttaaagatatttatagggtatttatgtggggagtacgttgttttaagttttttcgggatgaggtttttgtggtaaggggttgtagggggtttaaaggaaagaatacggatttttatcggtgatttatggaaagaaattaagtgttaagatttggagaggcgttagggtttttaagggattgggagaatagttgcgtggtaagtggagaagtatttgtggtattttaggtggttttagttagaattttaggtttttttgtcgttaattaaaataaatagtgaagtaattaaagtgagtattcgagttttattagtagagtattacgttaaggttttgttggtagtagagtttgggaaggggaagggttataatggtaaggggaaagtaaaagaaagagaagaaagggtttttgtttttgtgtaattattattaaatttggagaaaataatataataaaaatagttattagtaatttaatataggacgattttttatattgtggtatgtgatttttatagttatttgtaattttgggatatagatattattaatttattaaatattttatttaagattaaagaaatagagatgaaattagggtagttaggttagtttgattttatagttggtttttttagcgattatattttattatttttttttttgaaataattttatatatttatgtatgtatatagaagaggattttataatttaggcgtggggaaggttagttttaattatgatttaaattttagaggttataaaagaaaaaaaattgataaatttgattttatgaaaataaaaattttttgtatggggaaaaaatattattaataaatgataaattagggatttatttggaatatagattatagataaaggatatatttttttaatatataggaaatgtttataaattaatatgaaaagagttaacgaatattaaattagttaataaagaaaattaagatagtttataaatatattaaaagatgtataacgatttataataagaaaaaagttggttaaaaatattagaagggtgaatattaaaatattttattatataggtaagggtgaggttaagaaggaaggggtaattttataaattattaatgagaaaataaatgagtatattcgttatgagggataatttggtattatttattaaaattataaatgtatttgttttttggtcgtaaattttaattttaggattttattttgtagattaattcgtatgtgtgtaaaatgatgtttgtaggaagttaatttttgcggtattgattgtattagaaaatgtttgagaataatttaaatatttaaaaaggagattgattaaataaattatggtatatttttataatgggttattatgtagatatagaagagaagaggaagtttttaatatattgatatggaataagttttaaggtatattgttaattaaataaagtaaattaaaaattttaagtagaataggttattataaatataaaagaaaattatatagtgtttatatatatatttgtaaatatttttggaaagatatatagggtatgggtgataggagttgtttttggggagaagtgggaggtaaagtgaggagggaggtttttgttattgtatatattttgtattttttgaattttataatatgtgtttttattgtttatttaaaaaataaattgtatatataatttattatatattaaatatatagatgataaattcggaattaatttggaatataaattttttttttttttttttttttttttttttttttatatatatatatatatataaaaatatatatatttatattatatataaattaaaattaggagttatataaaggtagaagtagtttttggtttataaggttgtgtgattttgggtaagttgttttattatttaagtaaggttttagtttttttatttataaaatggggattggaatttttttttttttttaaagtttggagaagtaaaggaaggaatatatgtaaagtttttaggttagtgtttggtatatagtaaatttatgtaagtgtttgttaaataagtttattcggttggttaaggaagatatttttgaaaagtgtttttaaagttagattagaaagtttagtaggagttaggtaaggaggagagaagtaggggaaatagagagtgttttttagaaggagtggtttgtgtaaaggttaggaggtgaggagatgttcgtattgagggaagtttgggtgattggtatagagtttgggagggtaggggatagtacgatgtaaggtcgaggaagtgagagcgtggattagttacgatagtttttttgggggtgtttagtaatttatggagtatttatataggggtatttcgtgtttgggtaggtttttttagaaaaatttttttggtaagagttaggaggataggttggagagaggtaaaaattgggtggtagagaggttagttggagattgttgtagtaatttaaggaggaaatgatgaggttgtgaattaaggtagtggtagtaggtaggggatggagtggggaagatataaaggaggtgtagttagttgggttgtttgatttagatggtggttagaggtgggatagaagaaagaattgaggataattattagagttttgattttattagtttggaggattgtgatgtaatttattgagataagaagattaagtaaaggaagtggcggagggagtaagatgatgggttaagttttaaatttgttgaggttgaaatattttataggtgatttgtagttagttatatgtgtttgaattttagatgaaggatttgtagtaaatatatatttttgagaggtattagttaagtttttaatattgaaagttttggattgtggttaagggagttgttattaatggtttttttggtttataaaggagattttggagaaggtatgttatttgtaatgtaggtaaatttttgttttttttttttttttttttgtttttttttttttttttttttttttttttttttttttttttttttttgttttttttttttgtttttttttttttttttttaaaaatataataaaagtttttataagaggtttttttatatgttttacgtgaagtaatttatttttgattagttttagttaattagcggcgatgtttttattttttttaatatttttgtattttttttgtatttttttttacgtatggcggaagttattagaaagttgttattgttgtgtatgtgcgtttgtatattatcgtgagtagtttgaagattttatttttttaataggggagtaatttatagtttattaatgaaaaagagagggagggaatattaagtgtatgttttatgagtgttgtttagatgttttttagaaagagtattttgtggtttttttttgtgtttattgtttttagtaaaattaatttttagttaaggatgatttattatatggttttattaagagattttagaattgatttttaaaagggtatatatttttttattataaaaaaagtgtgtttaggtaagatttttggaataatttagttaggtgaggtttggggttaagatttaaggatgttagttttgtaatttatttatttatttatttgttaatatgtttttaattttgttttagttttagttttttttatttataaaattgagacgaattgttggattatttttaaatttttttttggttttaaaattttgtgagtttagttttgagtaagggtttatattggttttacgatagtgtggaatattttaataatttaaaattgttattatatatttaaagtaattttattttggaggtttgttgattttatgattgggtaatagaaatattatttataaattttgtggtaatgataaatatatttattttaaaggtaaatttttattattataatttagtagatggttagtttttaaattttatatttgttagataagttttttttttatggtttgaaggaaatataggtagggatttataggggagggaaaatagtatttaatttatgaaagtattaaatattatatattattattattattcggtttttttttttttttttattttttttttaaatatagagtttttttttgttgtttaggttggagtgtagtggtgttattatagtttattgtagttttaaatttttgggtttaaatggtttttttgagttagttttttaagtagttaggattataggtgtatatatattattatgatcggtaattttttaaaaaattttatagagatggggttttattatgttgtttaggttggttttaaatttttgggtttaattaattttattatatcggttttttaaaatgttgagattataggtgtgatttattatgttttggtttattggtttttagttatgtaaagtatggatttatagttttaaaatatgatatggaaagttcggtgtgttaagaaatgggtaatttatttttttatttgtagagatttatgagatttttgtgggatttattaagaaatatggataaggaaatttaataaataatagatttttatttttttttgttgagggacgtgggattatttagatgaatttagttattatattaaagaaatagttattaaaatttgttataagggatttttatttaaattttaatttatagaaaaatattaaggagaaagtggttatttttatttaaaagaattttgtttttttattatgttagttatttggtgagttttttataatttgtgtgtttttggtaaaaagtaatatatattagagtttaattgatttaaaatattgtattttaaaagatattatgtaatgtgtttttataaattaaaatttgatttgattagtttgaaatgtattattttgaaaaataatgttagtcgaaattggattttagtaatatgtttttggtaattatatgaaggagaatgttaggtattttttaatatttgtagtatatttattgttaataatatattaatatagaaattagttatttaatttattagaaattaggtataattttttagtgttttgagggggtagaaaggaaaatgtataaataggtttttatttttgaaatgtatatatatatatttaattataaaaatttatttttttttttttaaagtgtttattatatttaatattatttaaaataagtgaaagggtaaattaaattataagttgggattattattttatttattatttttataagtatgaaaaaagttgacgagtatttatattgttagtagaattgttaattgttaacgtttatggagggtaatttgataaaattaatcgaaatgataaatgtatttatttttagttgtaataattttatttttaggattttttttttagagatatataaaataatgtgatatagagttatttattgaattattgtttattttgggaaaaattggaaatagtttaaatgtttattagttaggaagtagttaataagttattatatagtagtataatgtagttttaataaagaaagaagaagtttttaatttatcgataggtagtatattttaaaatgtatttaaaaggtatatgtagaatagtatatatgtttgttattttttgtataaaaagagggaaagtatttatatatatatgtatttatgtatatatttatttatatatatatgtgtatatataaatataaatatatgtatatataagattttgataatatagattttgcggaaaggaaattttttttttagaatagaagtttggggataataggaggaggaggaaagaaattattgtatattttttgggatttttttaattttgaattatgataatatgttatttatttagaaataagttaataaatttgattaataaattgtttattgataagtagtaaatatatatttatatgtattattatttaataagaatttgaagaattttttttttttgagatagtttggttttgtcgtttaggttggagtacggtggtgcgattttagtttattttgattttcgttttttaagagtttaagtaatttttgtgttttagttttttgagtagttggaattataggtatgtggttattatatttggttaatttttgtgttttttagtagagatggggttttattatgttggttagaatggtttcgaatttttggttttaagtgatttatttatttcggtttttcgaagtgttgagattataagtatgagttattgcgtttggttaaagaattatatttttaaaatattaaaatagttaggttaagattgtttttttttaaagtaaaagagatatatagttaaagatatgaagaataaaaattaggtatttttttttttttttagttttttggaatttttataaaataataaattaaatttaatagtttggaggaaaattaattaaagggatataaattattattaattttttttttagatgaatgataaagagatacgtgttttaattaatatcgagtaatattgtgtaaagagtagtttgtagtggaaatgaatagatggtaaataagtaaaagaggtattggagagtaagaaagaaaatttgatttgatgttgaaaattttaagtaattgaaagaaattatattttaatgaaaatagttttaaaaggatggatgaattcgtcgatttaattttagtttttaggtatatttagttttgttgtttttaatatttagtttttataaggttaatattattttaatttttattttattttttgtatttgtaaataaagttatatattaattaattaattatttttttataatagaaagattttttatttttaggtaatgaatggtttagttattttaaattaagttagtattttagtttaataaaaggttttggatattattttggggtttaatgtaataagagttgatttggaggtttatgttttaataattatttttttttttttttttgaaatagagatttatgataggaggtagagaagggggtaagattttagggttgatgaatttttggtatgaattatcgtgtaggtacgtaagaagtttttttttttgttttttttttgtttaaaggtaaattggagttaaagttatggggaagtatagtattatttttttttgtttttaagtttattttgtttttaggttttttttggtggaaataagagtgttataagtaattaagttttattagttgaatttttagtaaagaattagtgattgattttatatgcgggagattttaatttagttgatagatgttatttttttttgtttttgttgatttaggttggggagatagtatattttagataggatgtttttttaagagttgtgatgtaattttggaaaaaatatttgtttaagattttaagttaggatttggtttttgttaatttagagtgatagggattagcggttaagatattggttattataggaggtatgttgaatttatatatatttaataatagtagatatttaatattttcgtgttttttattgtttaatttatatagagtattttaaattgtatattttgtagtgtataatggttggataaaaaataaaaaatttcgggtaaatattcgagataatttttgttttttatgtaaaaaaaatagaaatgttttttgtttgtttgatttttgaattttaaataattatttaaagaaaaaagggagataattggttaattaggttatttttagttatattaataataatatttaaggttgagaattataagtataaatgatttgtgtaatttgaatgtttagatttagattgatattttaatttatgtgtttagagaggaatatagagatatagattataaatatatatatagtaggttgtcgtatatattttatataaaataggtagtttttattaaattatttgaggtattaggatttaaatttaatttttttttttatttgagatagtagatttttttggtttgaggatatttttaaatataaaagttaattattttattttattgtttataaatttaatttttatttttgaggttgtttttgttgtagattttttggtagtttatttatattatagtttgtttataatttagtttaaaattatagtaaagatagagattgaaaaaaaaaaaaaagttttttaattttttaggaagatttgataatgtagtaggatttttataatgatatagataattaagtttattttttatgaaataagagtttttaagtggtaaattttatagataaaatgtagaaagtataaagtagatttatgagtggggttaacgttagggtcggaatgtttttttttggttaggttttttagtaaaattaattaattaatatatatggaaaatgtattatataaattttttagattagagttggggttttgttttgtgttagtcgacgaagaatttttaaggtcgttttggattgaattttagcgtagagatatgtaatatgttattaattttttttttttttatcggtttttttgaaagagagttttttataagtagtttaaggaaaaagtatattaataatgataatttatatttattagttggggtggtgaaggttaaaggtaaattaaagtaaattgataatgataaagaatttaaaagtttatgttttaaaaaaaaatatttaaatttgtttttcgattgttaggtcggtcgattagttgtataatttttggtagttttttgaattttttggattttatttttcgtgtttatgaaatgagagagttgaatttagcgattttgaggttttttttagttttaatcggttatggtttatgattaaaggttgtggttatatttttgattatttattttttataaagttttacgtttgattttttttttttaaggttttgtttatattgcgttgtttgaattttataggtgatggtggtaaatgaaggtggtatgatatttttttgttgtttggtttttataagtattttagattaaattaatattaaagagggaaatagataaatgaaataagattattaagatgatattttttataaaggaataaaaatatatattttttaaaaaggaggggaaaattatttttggaaattttttggatatttttttttaagaagggatttagggagttatttttatattgtatttttttaatttttatttttgaagttttaaatttttttgttttttattttttttgagattaggaaggagggagagatattttttttttttattttttgagttggttaaatttggatgatttttatatgtttttacggtaattttttatgttatgttaatatttgggatttgttggtaaattttaattaggtttatttattatgggagttaagtttttataaagatattttttttttttttttttttttttttgagatggagttttgttttgttatttaggttggaatgtagtggtgtaattttggtttattgtaattttttttttttgggtttaagtgatttttttgtgttttagtttttcgagtagtggggattataggtgttcgttattatgttcgggtaatttttgtatttttagtagagatagggttttattatgttggttaggttggttttaaatttttgattttaagtgatttgtttattttggatttttaaagtgttgggattataggtatgagttattatatgtagtcgattttataatgatattttaaataatattttttttatattggatatgtataaagattaattggtgaattttttttatttttgtttttgaagtaaacggaattgtagggtaataagttttttttttatttgtcgcggaggatttagtaaaatttcgggtgtggagtttgtagggatttttgtttttaaatttatttttttttaaatgaagaagtttttaagtatttggttgaatttaagtattcggtgatttgatgggtaaatataaataaaagtttaatttttaaaattaaaaattttgaatttagttatgtatacgttgtagagtatagtgttgttattatatttgggttttatatttacgggtttaaatatttattgattaatatatttaaggatagaaatagattttgtttttatagttttgtgtgtggtttttgtagaagtatttatttgattattatggtatatatatttatttttttgttttaatatttttttatataaaaaaaaattaaggttaggtgtagtggtttatgtttgtaatttttgtattttgggaggttgaggtaggaggattgtttgaggttgtagggagttagttacgttattgtattattttagtttgggtgatagagttagattttgttttaaaaaaaaaaaaaagggaaataattttcgattaaggtttatgtaatttgaagattagtgagttattggagattatgttaaataaggttagattttatgaaaatatatttagtaataataatgttttttatttttgttttatttttatttaataatagtaagttaaagtggtttttttttttttgtttttttcgggattattaaattaaattttttagtggttaaaggatggaagagaatttggaatgggtgtttttattttggtgttaaatattatatagtcgtgattttttttttgagtatattttgagagtgtttcgagtgttacgaataatgagttttatattgtcgaaaaataaaaataaaaaggatttgtttaagtagttttatatgtaaattaatagagtagttattgtttgtaatttttagtttagggtttatttaattatttttttattgtttggaaggttaggtatgggggattttagttataggaaaggtatttgttatggttaatttttgtaggttaagtaaattttggcgtagattgtagtagattttattggggtgtttacgtggtggagggggttatttaggaaaggaaggttttttggtaaaataattttagtgtgaggtttaatttattaattttttttaattattttgtaagaatttgttatttattgtaggaaaaggaattaaaatgagttgggagtgtgtgtatggtgggaagggagtgatggttgaaatttgttttaggtgatagttaatatttgttattgtaaagggtttagggtataaaggatattatggggtgtttttattttattttttattagagggaggtttttgatggatggtttaggtggttttggggtagaaagatagatttttgggtgagtttaagtttgagatagatagaggttagtttggtatttttgtagtttatttttgggggtcgagtttttgttaagtgatatagaaattttagttttttttttattatttttatgaatggtagatttttttaaaatttaggttgggttattttatttttttgatttaaattgtttgttggttttttattatatgtaaataaaatttaaaatgtttgaaaaagtatttggaaatttatgggggttgttttggtagttataggataattgggagttattagtggtatttaaggggtggggttagataggttggataatttgtagtatatgggatggtttagtataagttataaatattttatgttttttaggattttttagttttttttggaagggttgaaaagtttacgttattttatttgttaatataagggttttttttatgatttttataaatgttggattttaatagggaatgatgtattttgttttgtttagaattttattaatacgtatttattattttagaaatattatattattaaagttaatatcgattatgttatttgagtggttaatataatatatttgtagttatttggatttatagttgttacgtttgtagtgattttataagtgggtgtaaaatatatgattatattattatgttttttagtgtagttatgaaatattttttagtttatgatatatttttttttttttgtattttttttttattatagttaaggtattgtatggatggtttgtaatgatgtgggtagataggttatattttttataaattttattattgaagagtgaaaagggtgttattaaatatttattataagaagtgaggttttgggtttggttagggttgtttttttttattttatttttcgttatttttttttttttttattgtaatattttttttttttttgttggtatgtttagtttttgttttggattttttatttgttttttgtttgggagattttttttttagagatttatagggttttttcgttatttttttttttttgtttttgatttttttttttttttttatagaatttattagagtttaatattatattttttatttaataatttttcgattgtttttagtattagaattaagttttatgagagtgaggattttgtttattttgttttttagtattaagaatagtgtttgagatataaaaggtattttttggtcgggtgtggcggtttatgtttgtaattttaatgttttgggagattaaggaaggaaaattatttaaggttaggtatttgagattagtttggcgagattttgtttttatataaaaaaaaaattgttaatgagttagtgtagggttttatgattgtaattttagtgttttgggaggttgaggtaggaggattatttgtttgggtgatagagggagattatgtttttttttttttttttttttaaggtatttattaattttagtagatgattaaaggaagaaatatatatataaaagtttggttttattaatgggtttagtttttttaggaattaggaaattttatttttttatttttataattattgttgtaaaatggtttttttttttattgattaggttttttatgtttattttttgttaggtaaagagtagtaaaagagaaaatggttaatgaaaaggagggggaaatattttttaaaaataattatatttttaggataggttttgtgtgagatatattttaacgtggggatacgttatagtttttagtggtttttgtttatttttttaatttattgtatagaaatattttatggaggttaatatttgattttagaagttagtgttttttaatttaatttttgtaattttatatttaataaatgatgtttaaaaataaaagtagttattttaagattattaaatattggttggtgatggtaaaattgtgtttttttttatttttttttttatttttgttttttattaggttattgttttttttatttttttaaaatgaattttatttagaaattattaggaagaaatattatttaaattaaaattttagtagttatttttgtagattttgataaatttattttaaaagttatttggaagtttaaaaggttaaatatagtttagatatatttgaggaaaagaaaatgaggtgaaggttatattttataggatattgataaagatttttttagattaaatttaggtcgggtttttcggagtttttttttttattagattttgattttgggtttttttttttgttttatagaatttagtttaagtaagaattttattagttttagtgaaaattttttatttttggtatttgtttttatttttaatttttgatattttattattttggtttgtttttagtaagaattttgttgagttggtttagtaagaatatttttgtttttgatgtttttttttttatttattgattttattttgttgtttgattataaatttttttttgtttttgtagaagttggattttagtttaatttttttttttattatagtaagatttcgttgtagtagtttttttatttattataatgtttttttttttgaataaagttttttttgttatttttaataaatgttataaatatttttttttaataatattaagatttatagagttataagtaagatagtgtggtattggtataagtgtaggaaatagattagtggaaaagaatagatagatttataaatagatttatatatatatagatatttaagttttgaaaaatttaatattatagcgtattagaaaaaaagatgtttttttttagtaaatgtggttgagttgattggatatttatgtgggaaaaaaaggaaatacgttttttttaaatttatagtatttatataatttaattttaggtgtattatgtagatataaatataaaagataaatgatataatttttagaagttaatataagagaaaatttttatgattttgggataggtaatattgttaaataagatataataagtgttaattatgaaggaaaagagtgataaatgaggttatattaaaattaagaaattttttttattaaaagattttgttttgagattaaaaagataagttataaaatggaagaatatatttgtaatatataaaattaatgaaggatgtatagttagaagttgtaaagaatttttataaatttataagaaatagaaaatagttgaaaaatggataagagatttgtataggtacgttttaaaagaaaataagtatatgaaaagattattagtaataagtaattagggaaatgtaaattaaatttataatgtgatatttttgtgaatatgttagaatggttaaaattaaagagattgatagttttaagtttggagagtatataaaataataggaatttttatatatggtattatatttataataattttattatttggtgtgtttttaatagaaatatatgtataaggtattaaagaataggtataataatgtttatagtagtattatatattataataaaaataataggatgaataaatatagtgggtgaatttttataataaaatataataaggaaaatgaataaattttagttttatgaaattttataaacgtaattatgagtaaatgaagtttaaaatataaattatatatattataattttatttatatgaagttaaataataagtataattaatttatattatttagggtgatatatttaggtggtaaatgtgtaaggaaagtaaggaattggttattataaaatttaatataatttttatttttggtggaagatatagggttatgattgttaggggatatggttttatgggggttggtaatgttttgttttttttatttgtatgatggttataaagtgtttattttaaaatagtttaatgggatatatatttatattttatttatattttggtatatttattatatttttaaataaaagattttttaaatgaaggaaaattataaattaaaaagatagaagagtatttatgttaaattgtatgagattataggttttggagtgagatatatttgtgatttaattttatttttgttattgattaattgtatgattttgaatgagttatttaaatttttaaagttttagttttcgtatttattaaatgaaggtgataatatttattttttagggttgtaaaatgaattaagattttatatataaagtatttagtagaatatttggtatattgtaagttttaagaaatggtagtattgtaaattgtatatttgataacggattaacgtttagaatatgtaaagaacgtttataatttaataataataaaataatttgattttaaaaaattaataaagaatttgaatagatatttttttaaaaataagataaatgaatggttaattcgtatataagaaagatgtttaatattattaattattaggaagatttaaattaaaattataataagttaattattttatatttatgaagagggttattttgaaaaattagaaaataagaaatatcggttaggaattagagtagttggaatttttgtatattgttggtagaaatgtaaaatggtgtagtttttatggaaaatagtatgatggttttttaaaaaattaaaaatagaattataataggatttagaaatgttatttttggaagtggaattttaaaagaattgaaagtaggtatttaaatagatatgtgtatatatcgtttatagtagtattatttatattagtttaaaaggggaagtagtttaagtatttattaataaatgaacggagaaataatatgtagtagatttatttaatggaatattatttagtttttaaaatgaaggaagttgtgatataggttaaaatatggatgaattttgaagatattatgtttagtgtaataagttagttataagtgtgagtttatttatgcgaggtatttagagtagttaagtttatagaggtaggtagtagtatggtggttgttaaggttgtaggcgtgggggaataggtattattgttgaatagattttgagtttttgtttgagaagaaaaaaataatttggtgataaatggtggtgatggatgtatgatattgtgaagaaattttatgttattaagttgtatattgaaaaacggttaatatgataaattttatgttatatatattttattataatttaaaaaaattattaaaaaatattaataataggttaagcgtgatggtttatatttgtaattttagtattttgggaggttgagataggtggattaattgagtttaggagtttgagattagtttgggtaatatagtgagatttttgtttttataaaaaaatataaaaattagttgggtatggtggtacgtgtttgtagttttagttatttgtagggttgaggtaggaggagtttttgagtttagaaggttaaggttgtagtgagttatgtttatgttattgtattttattttgagtgataaattgagattttgttttagaaagaaagaaagaaagaaagaaagaaagaaagaaagaaagaaagaaagaaagaaagaaagaaagaaagaaaaagagagaggaaagaaagagaaaaagaaaagaaatagtagtaattgttattgtaagatatttttatatattagagaagttaattttaattttaatatgttaagaatagagagaagttaatatgtttattttaggttgacggtttgtttatttgtgttgttgttggtagtcgggtttgttatttttaaagtagtttatttaatattttattaataattttagtaagttattttattttttaatataaatacgtataaggattttttttggttaagattaaattaatattagtttatagtaggagttaatattattatatttattaagtattttatttgtaatttgattgtagtttatagttttttgtcggttaaagtgagtttaatgttgattaggtaaattaaaaattatagttaattaaaagggtataaatgttatttgatttaataagttattttaattaggtttgttattataagtttttgatatatgtaattaagaaagttaagttataggttattttttgatgatgtttaagttgtagttttgattatttttaaattgcgattttaatttagagttgtaattagtagttattttttttatggattaaaagattagaattttttttggaagtttattagaaatgtttttaagttttaaaatatttgtttgaagtattttatagtggttttgaaaacgatttgtttaaatatttagtttaatttatggtttaagaaataaagaaagttgattttatttatttgtttttttttttttttaaatggtagtttgatttgtaaagtacggtaatggaatgaaaattttatttttaaggttagttttaataagtatttaatattttaaatgttattatatattttatttatttaaaatattaaaaagttattaatacgatttttttaaaatttattaatgatttttgtgaaaggtattgaatttttgtaattagataaagtaagattatgtatgttaaaatataggttttggtttatagaaaatgtttaataaatagtagtaaatatatatagatatatatattataatagtataagttgaatgtgtagggtttatgtaagttaaatttattattttattttagttgaatagattttagaatatttagtgattttattttattttgtaaattattgatttgtattaatttaaaaatttttttgaaatttaatttttaggtatttggtttttgtttttgggatttttattgttttagagaatttagttttaatgggtttttttttgagaaattttttattggttttgagaagtatttttattgaatgttttatttaattttattttgtaattaatgaaatttttaagatttatttttttttttttgaaaaatttttagttattttttttttgttttttgggtaattaggagtagtaaattatttttattaagaattaaaggtagtaagtatggtaataaaaatattaaatgttaaaataaatgttatttttcgagttttgaaacgtttattttttagaattaaaaatattttatgttatttttacgggtttttggttgttagtttttaaatggatttacgttttgattttagtaaaatttaattaaaagtttttagggtttttaattttttttgataaaaatatttaattttttttagtttgggaggtatcgtttttttttgtttgtgaaattttattagtttggtaataaaataaattattaatttagttgtttattatttttagtttaaagatgtttgcgtggttagttgagtataaatgtattgtatttgcgttttttttttttaaagttttaaataaataattattgaataaaattagttaggaatgattttttgtttatgggaatcgtattttaatttagaattatacgtagaagagtgtagggtttcgaggtttgttattttattaaataattttttttatgtggtgaaaaattggttaaattatttttttagcgatttcggaatttttagtttaattttattttttttaagttattagggtttttttggtaatggatgaaattatgaagtttggtttagaggaagtaaagatatatttaaatgtgagatttaattgtttttcgaggattttttttgttttttagttttaggtagattaagagtatttttaaaataaatttggcgtttgttttttattttaatggaaaatttgattggagattttatagcgatagtaaagaatttttatttttttggataattaaaattcggtttttgttattttaattgtagtaggttagtatatagggtattagtgtgtttttgagcgcgttgacgaatggatatggtgttggtagttttggtttgggggtatttttgaggagttttaaaaaatattaatttttgggtttttttttttagtttagatatttttattaaattggtttgagatgtggtttgggtggtaggatttataatattttttggatgatgttaatggaagttttttgaggtagaagaaggtagataggattgattgggagcgtattattaattatttttgtttttttattaagaagtttaagaatattttaaaataggggtgtagtggttgaggagaaaagagaggaagttacgtatatttttgtaggtttttatgtaaggatttaagtgtgtgtgttaagtatagtttttaaataggggattttagaagttttatttttaagatttgaattgtattaaaggtagagagattttttttggggttatttgaaataaggtagattttgtttggtatgtatgcgttagatttagtttttgtagtgtttatgtggtaatgtttaagtagtttttagtattcgatagggtattttaaataattttattagtttgaaattttaaatttaaaaaaagttatttttaaatgtatgatttaagagtataaaattttagagtagagaatatcgttaggttagtaggtgaagtattttatttttaaatggtaagggggaattttgagtaaatatttggttgtaatgtattttaggggtggggggtttggacggagaggaattattggtttttatttaaaatttttttttcgttgggtttaggttaggtttatatagttttggttatagattgtgagaattttggaaggttttaggggttggtttttattatgttttattttagtaagggtagacgttaggaaaaaaatggaaagggggagttaggtatggaaggttttagatttgttgtaggtaaaaggttgtagagtatttttagggagtagagattttataattaggttttttatttcgttgttttttagggtcgtttatagttggtttatttgtagttgtattatttaagagatagagataggtttatacgtagtagttggagagaaggggttggaataaggattttttttaaacggaaaaataaagattattgggggaatttttcgtttatttagtagtttgtgtgtatttagtttttttggtagggaatgagggttcgttgttttttgttgaagattattgttttggagatgggatgggtgggaagaaaaatgttagtaggggttttgtttttgttattttttttttttggttgatttttggaattttttttttggttgatttttgaaattgagttttgggaacggaaggggattttgtgatgtttttaatatttttttaagaatgtacgtttttagttggagttgtagttaggtaaggagttagttgtaaattgtattttttttataattttgtgataggggaatatatgtaaatatgagatgggttattgtcggggaggtattggatgggggatgtgtttaggaggtttttgttagttatggattgaatatatgttagttatgtggtacggtttttatataaaaatagaattttgagtttggttttataaataggtttattttttatttttgagtgtgtagcgggagagggtgtatcgtttttatgtagggtaaatttgtttgtatggggttgggggttttgtattttagtatgggtttggaaagtattagaagtgtattttatttaatttgatttagtaagtatgtttttgtggtttatggtttgtgttggtaatttaaatttgatagtatataaattatgtgatggtgatggaggggtaggtatagtaacgtttagttttttatttttaggtagtggtattttttttgttttttttgtaatagtagtttgggaggtttttaatgtttttattttttttgggtatatttgaattatgttttgtttttatatatataaaagggttatttgaggagttttggttatatggtagttgtttggaaataggttgtttgatgtattgataattataagaaatttggaagagtaaaatttgttttatagttggtatgttatttgtatattaaaatgagagtataatgtaaaagaaatgttttaatattttttttattaggtttaaatttgttgtgattatttaggaatttattttatttaattaaatatgaattgagtattttttatatagttgggggtaggggtgtttaaatagatatgaataattatgatataaaatttattgtatatatatatagaaaatggatgtagatataaaatgaataaatatgaaatgaatgtagataaaggataggttaatttttattgaaggggaggtaggagggtttaataaaggagttgaacgtagttgggacgtaagattagggtaggagtaggggcgaggattgggagtagaaagtaaggaggatagagaattttaatgggaggtagattggaaagtgggttggtgttagttttgaaggttagttgtatattaaattttgtagtttggtatataatgatttttgagttaatttttagggttggtattttgaaggttattgaaggggaggtaggaggatttggtttgcggtagtttttaggtgagaggtaagaagtaaggagagaaggtagagatggtataggatggtgggaagggagtttttggtgtttaatttttgttaggtagggttttattttgttattttatgatttttatatgatgattgtatggagtagatgttattatttttattgtagatttgggttttttgggtttttttttaaaataagatttatttaaaagatattttttataatacgggtttgaattataggtttttcgaggttattatggaaggatattggtatttatttaatagtaaaattgttttaaaatattttttgtagatatttgtttttttttagcgttttgttttttgtggtagttgttttttttttttcgttttttatttttttttttattattttttttttggatttttttttttataagagttttaggttattattttttatttagagtgattttttgtttttttgatttgtttattagttgttttagttagtaagatgaagggttttttttaggaattaatttttttagaaagtattagaattttgtatgttttttattttatattttggttgggttatattttaataaggaaattgaagtttggagaaattaagtgttttttaaggtgtttaatagagatgttttaggaagataaatggtattgacgaagaggatggatgggttgggaataggtgttgaaagagaaggatattaatttatgatattttggaaaatataaaattttagggatatagaagagaagagaagttgttagggttaagggttagggggtggcgggtagtttgagtataaatttttattatgaaatatgtttggggggtgattgatttgttttgtatattgattagagtagtggttatttttttgtttatttattaaaatttataaagttatataaaaatgatgaattttattgtaggtaaatttaagaataatttttgaaatgataggaagattggttaggaggttatagtatatgtaagaaggaatgagaggttgaattagagtagtagtagtagtaggataaaaaaataataaaataattttaaaaatttaaaaattagagatttagggaagagagatttttagaagtaggatttagatatgtggggagtatgagtgaagaatttagatatgtagatttttagggttggaaagaattttaagagatgatttaggaaagttttattttatagatgagaaaattaagttgaaaatgatttaagagtttggggttttgtttgggtggatagtgatattattaagtagatagaatagatatagatgagtaggcgagaggaggaagttgatgagtttattttggatattttgattttggaatatttatgttattaagatttttttttttagtttttaggaatttgaaaataaaattgttgggttttggtattgagtgtaatatttttttataaatattgttttattatagttataatgaaaaagaattttgaatatagatttttatatgaagatgatatattagttttttttgagttgtttttgttttgtgatttttttttagtattataaagagggaatgatattgatttagtaaagattttaggtatattatttattaatatatttgttacgaatattattatatttttatgtgtttatataataaagtttttttttttttattaaaaataatataaattaagttttgaaaagtagttgttttttatttttattgatgttaggttataatttattgttgttttgttttcgttttagaatatttagtaagtaattaagggaagatgggtattgatttgttattagttagtaggtatagtttagtgaaagtttttatgttgtatatagggttgaaattaaggagttttttgtttatattttagagtaatttggaaaatgatttggtttagtagttaaggggagaaaagaagtagagtttttaatattattatagttattgggatatgtaattaattttaagaattagaaatttaagttgtaaattattaagaaagtataatgtttttggtagtaaagtttaattatagaagaataatataaatataaagttaatagtatttataataattgtttattgtttttttaagagttgagtaaagtgaatgtaaagatggtgagtttaaggaagaatttagaatgttggtatatttaggtagggattttgttttgtttgttgataaatttatatgcgtagtatagtgtttggtatataataggtttttaatatgtaattgttgaatgaatgaatgaatgaagttaggagagaagtgaataagtaaagtaagagatagtaaagttattatattttatttatttatttagtaaatgttattgagtttttattaatgtgaggtttttttttaaggtatggtggtggatatatataagtttaaaataataatttagaaaatagtttcgggttttaatatgtttataatttggaagaggaagaaggaaaagtatagtaaatatttgtatattaaagtaatattaaagagtatgtgataaggtttggaaaaatggtataaaaaaaaagaaaaaggttgaaaaggtggtaaagatttagaaattagcggggttatttttaatagggatattgttattttgaaggtgagattagatttgggttttaagggatggagaattttgatgggaatagaatattttgggatgtaaaaatagtaggaaaaagatttttagaatagagaaggtagggcgggtttagagtatagtaattttgttaaggagtagtagggaatgatgaagaaaatgttatataggttgtagtgaaagatggagagaggaatttgaatagttggataaaggaaaatgaagatttatttaggaaaagaggagttttaaaataaaaaaaagggtggtttatgtttataattttagttttcgaggaggttaaggtaggtggattatttgaggttaggagtttaagattagtttggttaatatggtgaaatttcgtttttattaaaaatataaaaattagttaggtatggtggtgtatgtttgtaattttagttatttgaaaggttgaggtaggagaattatttgagtttgggaggcggaggttgtagtgagttaagatggttttattgtattttagttgggtgatagagcgagattttattttaagaagaaaaataattagggaagaattttaattaaattattataaagtataagataaattggagtgcggagaaattggagtaggtgaatgaatttttttagggaagagttaagaaggtggtggtagtaagattagtgagggaggaatggagggtagtgaaggatgttgggtttaaaaatttgagtagaagttggaagaatgtattttaggttttgagtttgggtgatcggaatagtgatgagagtaggaagagaaattgttgagtttaaggaaggttttggagggatgacgatgagtttagttttggattaaatattttgattatgtgtttaatttgaattgttaataggaagtttagatagaaagggttattaggaaatagtatataagtagaattggaatttgtagaaatatttatttgagaattagttgtatatagacgatacggaagttgtggggatgaaaaaggtttcgtataagagaattaggaaaaaaaaagtgagataatgagttaagatagatagtattaaaggaattttttaattatttgtttaatgtaaaaatggaaatgaggcgaggtttgtttttttagaatatgttttttatagtaaaagagaatttatttttaaaattggtttttatttcgagttaaagaaaatattttaatattttatttatagtaaggattattatagtaattttgtgtgataaagtttaggataaatgttatggtaggaattttatttgaatgagatagtaggatggaaggaaggaaataggagtttttgttttggagagattattttttatgggtttagtttaggttttatttagtaggaaaaaaatttgtaaggtttaaataagtatttttatttggtagaaggtaatggaaaagaataatttaatttatttaatttgtagttgttatagatataaaaataagagaagatatgaatattgtgtgggtcgaatgttttttttttatttttatttttattttattcggtttttttttttaggttattattaatatattttaaaagttttcgagatggtgataaagcggtttattatttgtgaattttttttttatagaagagtgataggttttaagaataaatttttttattttagtatggaataaaagtttgattttaatattcggtatttatagttgttttttacgaatagaaagaatatagttaatttaattggttttttgaaggtacgttattttttttttgtggtttaatttatgttgtagattgaaaagtgtaaaaaagtaaaaaatggataaggtttttataagagttatttagtagatgttgatttttttttaatattaaatgtttgaggcgtatatgattggtttttatttttttgtatttgtcgaaagaatttttaaattgttttttaaatgaattattattttgattggggatattgaagtttacggttatttttaaaaattatattttgtaaaaagttattattttttttattaaagatttataatatagtgttgatgggaacgtgatttagttggatagttatttttagatatgtttgatgttttttaataggttattatttgtattagaaattaatatttattaagtgttaataggtttatagtttcgttttgaattatttagaggaagttaaatataagagtttgtaatttaaattaaagtgtattattttaatttgtaaaagattcgggaatatatgaaagagtataaagataaagtaaatagttttgagttatttagtttagttggaattatttttgttatattattaatcgaggttttggagtatttatgagtattttttttttttttttttttaataaagcgggaaaaaatgttgaaagaattttttagatgtattttttttttgtgttggaaagataattttattgaaataggaatggaatttagtttatgttttttttttttatttttagaattttaaataaagaaatgaatgtttataaggtggtttggggaaatagttagaagatttttatgggaagtaagttaaattgagagtttaagaagattagaaattattttatattagtgttgggtttataggagagttaggtgataggagaaagggttagtgatgtggatagattatgatagtgatagtgaagagagtttaggtaagatttaacgaatgatttaatagattaattggagtggttttagtggataggtttgtatgtttttaacgatatagaaatttataaaatagtttattggtttttagaaaaatattggaaggatttattataaatttttagttttagttaattttagtgtaaaaaaaaaaaaaaaaaaaaattatgtttaattttttaaaagatttatatgtgtagggttattattttagatattagtttgtttgggattattttggtttattttattgttttagaataatgattaataataagtgttttagtttggatgagatatgttatgattattttagatatgaaagaatggtaatttaataggttaatgaatattaagataaaatatttttagaaaggtttttttttttaattgtggttttagattttatatagcgtatttatacgtattatgttagttgggatttgtattttggtaatagaaagggggggtttgcgtatagaaggaaatgggtttatgttggtattatttaggtgtttagtaaatggatagtaaataaatcgtcgttgaagaaaggtaatgaaagaattttttttattaatgttttgaatgaatggttttttagttatgatatatcgtattgaggaatggtttaatagttttttttgattttgggagtgaaataagtatgggggtaaagagtattaggaagatttttattgtaggaaattttgtgaagaaagtgttgaagaaagcgtttttttattacgtattagggaaggagtttaggagttttttgttaattgtagtaggtacgggtttagagatagaagatttttgtggtttgggtattttttttgttgttgtaggtgatgagtaataatagcgacggtttttatgttataatttggtggtcgttggatttttattttggttggagggtgtgtttttataggggaagtttataagagttaagttgggttttgagttttatgtaacgtgtaagatgtgtattaagacgattttatttttggttggatttagtttcgggataatatttttatttcgtagagtttagttaggtttttagtggttttaagatagtatataagtagttgggatgggaaaataaggtttagtaatatgaaattaaaatatttttttagtttgattgtattgtttaggatgaaattttttttaattttattgaatattttaaattaaaatatatttaaattttgaatattagtagtattcgtattttttttttttggggttgtgaagggagggtggagtgttgtaatagaataataatttttagtataggaaaatttttaatatgtaggttgttatttgtttgatttattttttttttaattaagttaagtaattattaatagttttttatgagatattttttattgagattaaaggaacgattagtaagaaatagtgtatgtgttgtggtagtgtgagtgtgggtttttaaatgggtatatttttagaagacgggatagtaggttttgaggaggtagttttgtggaagagattggggtgtttagaggattttggatatttggaatatttatatatggtgtttgttttggggttggggggagataagtatatatagaaatattataattagttttttttagtaaatatattaaaataaaggaaaatgggattaaagtatagttagtaacgtgaaaagttttattttaaaatttaaagtaagattttaaaatagaatatgttttaatagagtatgtaaatttatggaaatatttttttattcggtttttgattttttataggtattttttatgtaatagtttagttttaaattttttttaggaagtagttggttattagagatttttatttttgtgttttttttttttttttttttttgtaaatttagtattttttttttatgtgatgtattatgtttggagttggtagagtaaaagtttgttatttttaaaatatgaagagaataatttagcgttttattttgtgattatagagaatgtaattaatattttggttgttttggtatgtagattaaattttttgttatagtgttttgtagtgttgttgtttagggtagttttgttaatttttttattttaatagaaacgatgttagatttttcggtgttaagtaaagtataatgaggcggaagaggtggttggaatttttagtgagggaatgtgtttttgggatgattttttataaaatataaagttattttaagatttaatagtttttgtatttttgtatttacgaaatttaattaaaataaattttttaaaaagaaaaagtaggttgggtagggtggtttatatttgtaatttttgtattttgggaggtcgaggtcggtagattatttgcggttaggaatttaagattagtttgattaatatggtgaaattttgtttttattaaaaatataaaaaattagttgggtgtggtggtatatatttgtagttttagttatttaggaggttgaggtaggagaattatttgaattcgggaggttgaggttgtagtgagttaagattatattattgtattttagtttgggcgatagagtgagaattcgttttaaaagaaaagaaaaaaaaaagtagttaaatttttatgttatttatttatggtttaaaagttttttaatttatagaaggtataagatagggaaaatttttttaaatcgagaatatgtagtgatttattaaattatatgagtaatgttggagaattattatttgtgtaatattagattttgaagataggagataagaaataattataatttggttgagttcggtggtttatatttgtaattttagaattttgggaggttaaggtgggtggattacgaggttaagattagtttggttaagacggtgaaatttttatttttattgaaaatattaaaaaaaaaaaaaaaaattagttaggtatggtggcgagtgtttatagttttagttatttaggaggttggggtagagaattgtttgaatttgggaggtagaggttgtagtgagtcgagattgtgttattgtattttagtttgggagatagagcgagattttattttaaaaaaagataataatagtaataattattattattattataatttatagaaagtgtagggataaggagaatagagagaattaagaaagataagtaggtataaatgtttttagatattatattataatatgtatgtattggttatagttgtaaagaaattttagatttaatttgtgtttgttaagggttaagtgaatggtttaggttaatgattttatttgttatagattttagtgtttttagtatattagatagtagaaagagtagtagtgagaagtaaaatttttatattattattgatagtttattaatataatttttgttgattttttggttttcgaaatttatagaattataaaatgttagtgagggattttgtaatttaatttttttatttgtagatgaagaaatgaaagtttagaagagtatatgatatgtttaaatagtaagtgtttggcgggttagaagaatataatttaaggttcgttgttttaaatgtttttaataattatatagtttttatttatatttattttttttttttgattaattttttttttttttttagaattgtatttttttaattttttttttaagttatttttaatgttgggtgattatttgggttggattttttgtttttttggtttagggtatttgttttgtttttttattttttaaggattaaatttagttttaggattttttgataggtgggatttattaattttgttttacgttgttaggaattttttttaatagtagttgatttttaatagaagaaaacgttttttggttgtgattatatgtttgttttattttgattttgtttttttttaatgggttttaaaatttagtaagttttatttttatattgaatatttattataggttttgattattgtgttttattagttagttgtagagtatgtttgtgtgtatttatatatatatgtatatagaaatatttttaagtgggttgtgttttattatttttggtatagaaataaaagtaaatatttttatgtataaattttagtgtatttttaatagatattagaatagaagtcgaaagttttatttttaatttttttaatttagttgtaatggtttagtttggtaagagttagaaattattgaagtttttttttttgagataaggttttattttgttatttaggttggagtggagtggtataattatggtttattgtagttttaattttttattttagttttaagggatttttttattttagttttttaagtagttgaaattataggtatacgttattatgattggtttaattgttttgtgttttgtagaggtagggttttgttaagttgtttaagttagttttgaatatttgggtttaagtgattttttagtttcggttttttatagtgcggggattataggtatgagttattacgtttatttagaaattattgaagttttatttttggtttaatttttagggtaggttggtaatagtgattttttatattttagtatgtttatttgtaaaagtatggtgaggttttttttgtttagtttagtagattgataatgggagttataagaatatgaatatgaatgaattttaaaaagggttatataattgtagtttattgaagaaaaaaggaaaggtttttttatttttttatatagtaatatttaattatgggaataaaaaggtgattatattgtgtaataaatggttagtagtttagattagtgttgtttaatagaaatataatgggaatcggtttcgtacggtggtttacgtttgtaattttagtattttgggaggtcgaggcgggcggattacgagtttaggagattgagattattttggttaatacggtgaaattttgtttttattaaaaatataaaaaatttagttggggatggtggcgggcgtttgtagttttagttgtttgggaggttgaggtaggagaatggtatgaattttggaggcggaggttgtagtgagttaagattacgttattgtattttagtttgggcgatatagcgaaattttgttttaaaaaaaaaagaaagaaagaaatataatgggaattatatatgtaattttaaatttttagtggttacgtttagtatattttattaaattaatatatttaaaatattattattttaatataaaatttttataaaaattattgataaaatattttgtatttatttatttatattatatttttgaaatttagtaaatttggtgtgtattttatattttaatcgtattttaatttagattggttatattacgtgagtttggtagttatagttacggtattggagagggtaggagtagattttagatataatgttatggtgttatattttggtggtatagagtagtttttttttagtgtttagtatagtgttttttagtgattaaatgtttaattaagatgtgtaggatgagtaaatgtttggatatatattgtgatcgtagaaaatttgtagaataagaggaagaataaaggattttttgaaaaagtattagtttgtgttgatttttttttgtttttaaaatatagaagttttggttcgtagattgttaaagggaaagtcgttgtttataatgaaattttaggcgtggtatcggttgatggggtgagttattttttcgtaagttatttttaatttgtttttttgtggatttgtttggttttttaagtggttgtttttaaaagtttaggaatattgttgaaaatagatgagtacgtgtttttgggattcgtatttttgtgaaattatttgtattttattaggtaaatttgtataaaattggagttaagagagtttggttgggtttttaggtcggtattttttttttgtgttgttatggttattagtatttattattatttattagggtggtcgagtaagatagatttttaattagaatcggtagataaatggaattttttttttatgttgatatgaaaattagtgttttttggggtaaatgagtgaaggaatttcgagttgtaatttggttgtcgtattttttgttatgataagagtttattttatacgattttgatttatggtttgaaaatatagtttagtcgtggttgtaatgatttagaacggtatatatatttgaatgttaaggagtttagattttggtttatgggttatttgggaaattaaatttattattttttattttagaaagttaagggtttcgatttttaaagtaaggtttatttttaagggttttttttttttttagttagttatgttgatggtaagttttaggtaaggtgtaaatagttatttttaaatgtatatatttatttttttttttgggataaaggataaaagttaaattatagtgatgtttaatttatttatggttaagggaataaggtaaattatataatagagaaggataaaggtggaaggaaaaatatatagaaaataatgtaatgttattttatattttgttatttttattttaattatttatttttttttaggattattttttagagaaattttatttttattataaaattagttttttatgttagggaaaaggttgcggagttgttattattgttattgttatttttattaaggttattttagatggtatgtttacgtgagataaatggttttttaaataggtttttttgtattttgttattatttaggtttgtttcgagttattatttttggggttttgaaagtagtagttttttggaaggtttaaaagttgggcggtagtagagtaatagaattaagggttttaagtattttaaaatcgtttgggtttaaattttagtttagttatttaaatagttgtaatgggtttttttttgtaagttttagtgtttttatttgtaagataaggataaaaatattattattttttagtattgttgtaagaaagaaatatacgaatagtgatagaacgtttagaaagagttgggtaaagtataggttatgtgaatttttgttttattattgttgtgagtatagttggggtgttattttaatatttgtttgtattgtttgttatgtgtatttagttgtttgtgtatttatttatttagttaatattattgagtatttattatgtgtttgttttgcgttaagtattgagtgtttagcgatgattaattgtgtataattttgttgattttattttagaatatttttttaggtagttttattttgggagtttttattgtttatgttttggggtagttgtttagtatttttatttgggtatttgattttatttttttatttggtttttttgttgtttttagtgttattaatatattgttattagtagtatttttattaataaaaaaatttagttatgttatttagtattttgttagaaattttttattggtattttattgtaggaaaggtttaattaaattttttagtggggtatatagagttttggagagcgagtttttattattttttcgttttatttttttttattttatttttaattgttttttttttggttattttggtttttttgttatttttaagtttggtaggttttttaattattttgtttatttgtatatggtatttttttatattttttagagagtaagattttttgttttttttttttttttttttttttttttttgaataaatttttatgtattttttaagtttaggttaaacggtattttttttgtgaaattatttttaatttttttaggaaaaaatttattggattgtaatagatttgtttgtgtgtttgtttttttaggagattgttttttttaaggttagagattatgtttagaaatttagtaggtataaagaatgtggaataaataaatgattacgttttattgtatagtggttttaaaatgaagttaggaggtagagttgaggttgtaaagtagttttttataaaaattattttatgtattttgtagtgggggaggtggtttttttaaatatgtgtataatttaatttatgtatagatagaataatttagatgtagtaagatagtaaaaattttttttagaaattatattttcgtttatttgagttaagtttttattaattttttattttagaaagggaggtaggagatgaaaaagaatgaaagaagttagtaaacgtttttgaaggtttttttgtttatttaatatatatatatttatagagaaggtgttatttggtttgggtttgaaggatatgtaagagtttgtttaaaaaaaaagagaaaaaaataaaaaagaaagagattttgtgttttttttttttttttttttgtgtgtgtgtgtgtgtgtgtgtgtgtattttattttgatattgttgggattttttttttttattatagtttggattgaattattttatataagtaaattttttagatgattgaagtttaaatttttaaaaaattttaattatttggaatggagatatttttgtaatttattatttattttttttgaattttttgattttttttatagaaaataattttgttttgatgatttagtggtattattaggaattattaagattgttttgtgttacgatttagcgagaattttaggagtcgtagagatttttgtgattgtttgttttacgtagaagagttttagagatttttgagttggttttaagagtatttttgtttttttttttgttgttagattttaaaataattttttgaataatttataggtttttattattttttttgttaggttaattttaatttaatatatttgttgtttttattggttgggtggggagtggaaatgataattaattttttgagaaaatggatttttaaaaaagtaaatggtatggaatattatttagttttaaaaaggaatgaaattttgatgtatgttatgatatgggtgaattttgaaaatatgttagataaaataagttagatataaaaggataaatattgtttgattttatttatgggaagaattaaattttttttcgaagagttaaatttatagagatagaaaatagaatagtggttatttaggattggggagaaaaagaaatagggagttatagtttaatgggtagagtttttatttggaatgatgaataagttttggaaatagatgttagtaatggtttatataataatggtttatgtaataaagtaaatgtgttgaaagttattgaattatatatttaaaattggtggaaaacgtaaattttatgtatattttaatttatatatatattatatatatatatacgtatgtatatttatatagatatatttttatatgaattggttgagaaggttggttgagtttttatgagtaatgggtatgaattttagtatatgtattttatgatatttttttgtatagaaggggttgaaatgattttttagtttttagttgtgatttatatcgttattaagaaataatgattttcgaaggcgttaatgtattttgtaattataaagattttttatttataaattatagtattggcgataaataggtatttcgagttttttggagaatattatgaataattttaaagagaattgagttttagaaggggcggggttttgttttttttatacgggaaattagtgcgtttgtttacggtatagaatttaaatttatttttttttttttttgagattaaattttagaattaagaggttatatgtaaagttgttaaaagaataaaaatattgattatttgaatttattaggattttaaggatatgtaaaaattatataatgtagttttttaaatattataatgttgggttatgttttataaatgaaatattttaggtaatattggacgaatatttttaaagtagtttggtttataaaagagaggaggttaggtgtggtggtttacgtttgtaattttagtattttgggagggaggtcgaggtaggtggattatttgaggttaggagttcgagattagtttggttaatatgatgaaaattagtttttattaaaaaaaatataaaaaaatgagttaggcgtgttggtaggcgtttgtaattttagttattcgggaggttgaggttgtagtgagtcgggattgtattattgtattttagtttgggtaataagagtaaaatttttttttaaaaaaaaaaaaaagagagagaaagagagaaagagagagaggaaatagttggtggtttgtttagtttaattaatatagagtttggggtttggggagtttgatggtgaattttgttttgtttaatgaaaggttattattgtttttttgttcgaataataatttttttttttttttggtttttttatgaaatattacgaagttttattttaaaaagttataatatgttgtgtttagggaagatgttgaattgaaattttttaatatgtgttttattaaataaattatttaaaatattatttttgtttttttgaagagtgatttattttgtatatgaatttagagtgagttaaatatttaatttatatatgttttataatataagagatatataaataaatgagaaagtaggggggaaaaagaggtttagtaaggatgtagtaagagttttttattttgttagaatttcgcgtttaagttttttttaagaaagtagttttttggtttatgttgaaatttttttagttttgtaaataatataagggtattttgtttaaatgttattatggaaatattgtgttgttttgggttaaatgtatttaaattaaattgagggggatggaaataatttttttttgatacgttttggttgttgaaggtgggtttgtttttaagtagaataaaatgtatagttgaatataaaaatagatatatttttattttgtaaatttgagtgatatgttattttatttttggattttagaagaaaaaaaatattaaggttatgtttaaaataaaaagagtgaagggaaaaggattatattagaggtaaaatcgtagattttttttatttttttattaaggtattaggtaggttataatttgatagtgagattatttttttggaattaggaaggtattgtgggtttgtttttttaacgtatattttgatttttgtaagagtttttgaattaggtgtttggttttggtaggaattagtgattagtatttattttttaaaggttatttaaatagattttaggagttaaaagggagatagaaaaaaaaagttgttttatttattttttaattatgagagaatttaaaattatatgttgtaggaaagattttattttttagttattaaaataaagatgattaattggttttttaaagaatttaaaaggttatatgtataaagttgtttttttgtaatatgtttttgtttaaatttttgttttaaaaatttaagttttagaggatatgaatattatttggattgtttaaataaaggatgttggttttgttttttattaggtaaagttaattgattttgtagaatttttgttttcgtatttataaatttattttttgtttttagggagaggttattgaggttaaataattttttatttttaaaagtgttaaatttagggtttggtatatattggggtttaataaatatttatttttttttttttttttgattttcggtgattgaggttaatgattaatgttgttataaatggaaatggggaaatgagaaggatgagtaggtaaggaaaagattgcgttaaatattttagttaaaaatagtaaaagtttttttaagtttatattgtttatggtaatttattttaaattgatgtaagggttatattatattaatatatttattatttttaaggtataatattgtttttaattattaatgaagaaaaatttattaaattttttttgtgtaaatttgtagtattgtttgaaaaattttaaagattaaggaagaagttaatattgttttattagtatttttgtattgtattgttttgtttttattattttgtggtttttatgttatattgttaatttttaagttgtttatttttttgatttttttataatgtgggatttataagagatgggagagtttttaatttgttatgttttttgttatagttttagtttttagaataatgattggtttagagtaggttttttatagtaaataaatatttataaatatttgttgattgaatgaatttgtagtaatatgttttttattattgcggaaattttattgatgaaggttttattatttttaatatttaaaaaatatgtattaaatatttttggttatttaaaaagaggagtttagtgttatttttttaattttatttagttattaaaggagatagtgttttagttaatgttttatgagtaaatttaaagattttgaaggatttttttatatttattagtgtttgtttttttaatttttttgttttatattttttttaaattttttaaatttttaagtttaggggtatatgtataggtttgttatataggtaaatttgttggatgttgttatatagattattttatttatttacgtattaagtttagtatttattagttattttttttgatggtttaatgcggtatttttttgggaaaagaaaaaagaaagatggaagagtaatatttataggattatatttacgggtattttcgattaaagttaattataatttttgaaaataataaataaggattttgaggaatttaaagaaataaaggtagtaaatagtatgttaatataatatcgttgttagttaggtgttaataagtaaaaatagttatatatgtttatttaattttaattggtttttgttgaaaggggttgttttatagggtttttaagtgttagagatttcgtacgttaattttattattgtttttttagtttatgtttaagttcgtttggtttataagcgtatttttatagggttttgagttgatggtaggtattaaatggaagtagttagatttttttttgttgtaagtatgagaaacgttgtaaaggttgaatcgaagaagggaaagtaattagaaataaaagattgtattttaatttttttgaatatttttgatatagaaagtagtagagtatattagtttttaaaatgtaatatattttagtttttattaagtaattttgtgtttttatgaatatatatttagagaagtagtataggataaagaaatatttacgggatttttaatttagggaatgaatattagttttttttgtgtttattggttcgtatatatttttgttgggcgaatttttttttttatatgggtataaataaataattaatagtgtgtgtggggaggaaagtagggagaagttggaatataatatttgttttgtttagggttgttgtgaagattaaatgggttaatagatatggaatttttttttagaaattttaaaattttacgtaaaggtaagaaattattgttattttttttattcggaaaaaaattttatgaaaattgttttttataattgaattttttttttaaatatatttttattaattgatagttaataaagatttattatacggtgaattttaataaaaatagtttttaattagataattttttaaaagtgaaataagaaaaaatatatatttgtataaggttaggtgaggtgatttatgtttgtaattttagtattttgggaggcggaggtaggaggattgtttgaagttaggagtttgtgattagtttgggtaataaagtgagattttgtcgtaaaaaaagataagatagatattatttaggtgtggtggtatgtatttgtagttttagttatttaggagattgaggtgggaggattatttgagtttcggagttcgaggtagtagtgaatcgatatggtgttattgtattttagtttgggtaatagagtaagattttatttttaaaaataaataaataaataaataaataaaaaatataaaaaagtatttatatataattagaataatgattatattttttttaagttgtatagaaagattagtaaagttgaggaagaattgagttatgttttaaagtatttagttaattattattttttttaaaaaatttttttattttagttttaattattgtgtaaagttagtaattttttgtcgtttttattattatttttttaggttaggtatttgattttttgttcgtttgttgaaagagttttttatttggttattgatttttttttcgttttattaacggtttggagtggagttagggtgacgtatttgaaataaatttttttagggtgggttatttttagtattatttttttgatttatttatttgtattttttattttagttaggttgaattttttagtttttgtagtttattatgtggtcgtttgtttttggtttttgtttttgaagttttgtttggggttatatttggttttttttatttattttattatattgatttttgtttattttttaggttttagttttttttttgggaagatttttttgattttaataaatgttattattattgttgtatttttttttatagttttaaatatgtttttttgtagttgatgttgaatggtttttatttttttagattaagtttgtttaatttatggtaggttttgaatatagtttaatatatatttgtaaatttttttaaaatattatgaggtttttttgtgttttttttttttttttagtttattagttattattcgtgttagcgtattttacgtgtggtttaagataatttttttttttttaatgtggtttagggaagttaaaagattggatagtattgttttagattattagttacgtcgttttggtttttattttttatttttttagggtttggtttaatatttttttaaaagtatggtataaatgaataattgattttttgttttgtttgttttaattatgtgattgagtgtaaaaaaataattatttatttaaaaatatagagatgtaagtgaattttttgttataataatgagtttattttttattaatattttgttgtgttaaataggtagagaggttttaaaaaagagttaagtattttaatttatattaaatttttttatattttttatattttaaaagtattggtttagttatgggtgatgttttttaagtatttcgtataaaaggtatttttaaattttaatgatatgtatttttatcggttaatttttaattgagttaaatattaaatgtttatattaattagataaagtatttttagttattgatttgtagtgatagtttgtgttatttttatatataggttaagtatgaaatagaaaattaataattttttaattgtatttttaaagtattatttatgggaaagaaaattatatttaaaggaaatttgtgtaatggttgttatttttttttttgagttataagttgttataaagtaggagagtttatttttttatagatacggataagtttaagaattttattgttattggatgtatttattaagaaggaatttggtagtagtataggggatagatattttggagaataggttaattatttgggtgttttttataatttgaagtttttgaatttatttatagataagttgtttgaagagggtttggtaatgggaatataatgtatagatggttattgaagaaataagagggaggaagggaggttggaagagagaagagaatttgtttgtggttttatttatggggataaatttataagttgatatatttatttttttaaaaagtttttggagaagtatggttaagttttattataagtaaataaattaaaattttttttaaatagatgataattgatgagtaataatgttttgagtttgttttatgttaacggatgagggtttttaaaatataaattttattagttgttaaaattatagataggttgtgatgttggtttgaattagaatagagaatttagttaaaagttgttaggttaatggttttatgtaagatattttaggtggtttttttgttgagtagtgtttttagaaatggaattttaggttttgtcgtttttgggaatgtcgtattgtattgatttttatttttaattggttgtttatttttatgggagaagaacgaggggattatttatttttgtgatttttgtgttgtagttttttttatatttgagttataatattgattagagttaaaatttattttgtttttattgtgagaattttgggttagttttgttttttataatgatggggtgatgaataattttagtttttaaaatttttttagtttgggttaggtttgagatgtgaaataaaaggaatgagagtaattaggtatatgtatatatattgtgtgtttataattttcgtataaatagatagaatgtgataattagtaggttggtatttatattagtattaaggattaataaatgttaaatgtttaatatagagtaaaatttagatttttttttaggaataaatgatatatttttttaatttaatgaaaaggatgaaattaaaatatttaataggtatttttttttttttatttttattaaatattaatgaatttgtaggatgggatattttagatatatatatatatatatataaatatatattataataaaagaagtaggagaaaattagttgtttaggatgaattgtttagaatgttttaatataattattttatttatttatttaataaatagttattgtgtgtgtttattatttattatgtttggtgttaggttgaatttaatagaagaaatattttattaataaggaagttttaatgagaaaggatattttgattttgtaagatttagagttatatatagaggatattattaggatatttggaataatattaatttgatttaagttgaagtatttattaagttggtaaattggtagtgggaagttaagttttgaatagtaaagttgtaggttaattattttaatttaatttatgtaagtttatagattatttttgggaaaaggtggggtgtaaataatagtcgtaaattaagatagtattagtagtagtatttaggattatttagggtaatgaaagaaggtaaaagagaaatttatatgattcgaggggaaagatatattatggtttaattttaattttttttttgagatttagatttttatgtttaaggtttattgggtatttttatttggatattttattggaatgtttaaaatgaaatttattatatgtacgttataaagtagtaattgttgttattttttttttttttttggaagatagtattattttttgaggtagttaggatggtatttgagttttgatttttttttttttttattttttatattcgatttgttgttagttttttgattttatacgtgtagtgtgtttatatttgttttgttttttttgttttaggtgttttagattttatatttggtttttttcgtttaggtttagttattgttaattttttttttacgtatatattttgttttgtttgagaatttttgtaatatttttttaatatttttggtatagttaaacgtagttattttttagtaattttaggggattggttttaggaatttttagtggatattaaaatttgaagatgtttaagtttttgatattaaatgagtagtatttgtatatgtatatttttttatatattttattttatttatttgtttgtttatttatttattttttgagatagagtttcgttttgttttttaggttggagtgtagtgatacgatttcggtttattgtaattttcgttttttgggtttaagtaatttttttgttttagtttttcgagtagttgggattataggcgtttattattatatttggttaatttttttatttttagtagagaaagggttttattatgttggttaggttggatttgaatttttgattttaagtgatttatttattttgagtttttatagtgttgggattataggtttaagttattgtgtttgttttattttatatatttttgatttaaagttggttgaatttatggatgtggaatttaaagatagggagggttgtttatataagttttataatttagtatgtagtggtaagtttttaaaattatggatttattttaggagagttttttatgttttagttaaattagattttttataattttttaaatatatttttcgtatttatgtttgttttgacgtttttagtttttattatttgaaagatttttttttcgtatcgtttgtttgttttttaaaatttgttttaatattattttcggtatgaaattttttagatattattgtagttgggttgggtttttttgtttattatatattgtttaggattatagtgatttgtatttttgttttggttttttattgattggtaagttttttgaaggtaaaagttattttagatattttttcgtttaattaaaatatttagtatagagttttgtatggtgtagggttttaataaatgttttttttaatgaaataagttagtgtgtatgtttttttaaataattagattttaaaatttttttttatgattattattatttcggtttttgggaatttagggttaagttttgtggataattgtttattttttttaattaggatttttttaaattattttttttttatattattattttaatgtttagtaagtggttttgtttttttgtttttataattttgttataaaatattttaaaatttttttgtgtgtttttagtgtgtgtgtttttaaagatgttggtaggaatttataaaggatatggttaggagatagttttgaaattttatatttagaaatgttaatgttgttattttttatggattcgtttttttttttttaagaagataaattaatatttaaagttgatgatataatttgtatttaattttatttttattttaattgtaaattagatattaatatatttgagatatagtattgaattaagaagattaagtttatgtgttttatgtttttttagaaaattttaatgtagttgagaggaatatttggttgtaatttaattttagagttaatatagagatatagtatttattatgttgtaaagtagaaaaaatattattttggttatttgttaaggagagttggaaaaagttaagaagagatagtttgtaatattgattttttgtttggtgttttaagtattaaaattggtaaatttattatattttgttgtagtttaattgttttttcgatagttaaaaataaggaaatatggtaattggatttgttataagaaaagatgtattggttttaatggagaaaattttttttgaaaaattaaagttttatttgatatagtgggttttcgggttgtttttgggagatatgataatgagtagagtggagttagttattagtttttgatttattatatggaagttttagagagttgattattaattaaaaatggaatacgtttttatttttgaagttgtgaaggtaaaataagaagtagaatggaaatataaatttttttattgacgtatgtggtttaaacgcgatgtttaagggtaggtgttttttatagttaatttgtttatggaatgtggttgatcgttttagaaaattatttaagttatttttagtatattgttataaatggttatattagtatgttagggagatttttttttttatatgtttaaaagggcgtttggggaagtagtttttattttaagttattttagtttagttagttaaatatttattgaagttttaggtataattttattataattttgtattagaggaattaaagtaagtataaattttgttagtagatattattttttttttgtataggttaaagtttataattattagaggaaaaggatagtgtttggttatagaattttgatttgtttagttgtttgtagtaagtttggggtgagggttatttttttattttgattagattttttatttttgtttttttttgttagtatttaagcgtattacggttttttttaggtaaattttatttattattaattggaagttaataaggagttatatttgagaggttttttatcggtggaatgataaggtaggtaggggatggttataggggtggtggtatttatgagaaagttttatggtttggaagagagaggaataattatttaatttttatttatattgaaggatagatgggtgtattttttgtttggtaaatggagggtagagaaatagtgttatagtatatatagaattgggtatatataagaataataagtgataatttataaaaatatgtttttaagtgaaaatagttttgttggtattttgaaagttttatagtttttatttaaacgaatagattataagtttaaaaaagttcgaaggtaaatgttagtgttataatggattgtgaatttttgtaattagtatcgtagaagtgttttgataaatagaatagtaatataattttaaattaaaataaaatagaagttttttttttttttgtttaaaggaagagttttcgttttggtttaaaatttatttgtattttttggtatataagagttatttaagaaagatagttttttaaattattttgttttagttagtttaatcggagttttgattgttttttatttaaaaagaattaatgaaatgttttagaaattgtagattggtgtttattaagtttttttagtatgtataaatagtgtttagtgggttaatatttaataagggaattttttttgttttttagtttttttaagtatatgtttacgttatatagtattttttaaagtatttatattttggttttgtttaaattaggtttaatgtatatatgaatagttatatggttagaaataacgtttttagattaaggttgaagtatatgtaaaataatttatagttatttgttttttttttttaagtttttgagtttaggattatgtttattaggttgtatgataattacgagtttattaagatgtttgtaatattagtttgtgagtttatttagggtagaagtaaagttttttttgtcgtgtttttaatttaatttaaggtaggatttatgtaagattggtaattatatttgtggaataattgttagtttttggatgatttttattattaattttgtttagatattaaatattaaggttgattaagttaaattaagagggatgaaagagaaaatttatagtggagtaaatttattgagtggttttttatatgtggttgatagaaaggatgattagattgataagttattgttatatttgaataaggtgatattagattattttaaaaaggttgaatagaatttttgaattttaaatataatatatttttgggggaaaaagaaaacgttttatttgtatattataaagatagtgttgttttttagtataaatgtatttttgttgagatattgttttgttaaattattgttaagatataatgagtgattttagaaaagggtgcggaggtatgttgggtgggaagaattattgttaatatgtagtatttatatattcgtttatgagtgggcgtattatttttttaaatagcgtaataggattgggaatagagataagaaaaaataataagaattttgtttgttttttttttatttttaatttatggttttttgttatttggtatgttgtgtggtttgatgatatttaagtaatttgaaatgtattagtttaattaaagattgttaaaaagggtaatttatttttattagaaagtatagttgaaagtaatagaatgcgtaaaagaaagttatgtttttaatggacgttaaatagtaataaaatagaaaagagaatttagttaattataaaattttatgaatgtttagaaataattatattatagtatatgattgaaaattttatgagaaatagtgtgtttttttttattatataaattattgaaaggggttatgtgatttttgtaggtagaaagatgtatttttttaaggaaagtttattatgaaatatattatttaagattagattatttttaagttatttttaattttatcgttttgttgttaaaattggttataagtagttaatttttagatattagaaaaatgatgtttttttatgtaatttgtatattggtatgagaatggtattgttttttagttaattaaatgttttgttggatgtggattgttttgagaaaggaaaaattgtttgttgattaatgaaaaggtagttgaattttatcgggtgtggagaagtttttgtttttttaaattattaatattaaaaaattaaaaaataagtcggattattattttgttaatagaataaagttaattttttataattttttgtttgaattattttatttttttagtggtttttattttatttttttttaagatatgaagttgaatgtcgttatagtttttagtttagagggttattttttattatttgtttaaaatttaattttttgtttgtaagagtttttttgttttaaagaagttgtaaggttattaaagttatttatagaatttaaattgtgttatgaggggataaaataataattaatagagttattaaaagagttaatttttttgtttttaattgaagaaaagttattttattttttaatgggattagtgatgttaatataaattatataattattacgaaaaatatttatgagaagattgggtttatagttgatttatttgtttgttattttttttttatttaatttatgtttttttaaagttagattataatagtggatatttgggaaatattcggtattttaagtaatattatagatttttaaggttattggaaggggataatgtagaatttattttaggtagtaattttttttaaaagatgttattaggaattaaggatggtagttagtatcgttaattttaacgtgtatataaattatatattttgatttagtagttttggggtgggagttgagttttagtatttttataaagtttcgggggatgtatgtgttattgtttataagttatattgagtagtaaggtatttatattttttagaattgttttttttttattgttttttttgttttgtttttttttggatgttatataatgttttatttagatttaggaataaatttatattttattttatagttaattatttttttagtttttatttaatttgtagttttttgggataatttattagaggttgattattttaaggatttgatttatttatgttatggaatataaaagttaaatagatttttttagttttataaggttttaattttttacgagtagtagtaaagaaaaagaaatgatttgtagtttaaagtttggagtatttagtgtagtatttaggagatgggttaatttacggagttttggggatagtgtagattattgttatatgttaagaaaatatgttagtttttttttgaagttttattattaagattattttatattataaaatataatatattattagagatgtaattttaattggtgtaaatgtgaagaaaatttgtttgtatgttaaatgtttaaaatgatttttagattaataatgtatatttgaaatgataggtaaattatttattatttttaaatattattatttttattttaaagtgttttatgagtgtattttttggtatatatatatattttttttttaaatttttttgtttttttatatagttattatttatgtattgttttgaaagttattatatattttattattaattatttgtgtttttatatgatttatttttattagaagtagttttgttaaaaaatttttattatgttttatggtatgttattgtggtttggtattataaaatgtagtttttatatttattaattttagatatttgttgattataaagataggtttattatgaaaattttgttttataaaaagaaaaaagtgagtttttatttaaaaagaaattttagttatatgagagggtaatatattgaaatttagtaataaatattaaggttgtattttaatttttgttataaatatgtgtttttgttttttatatttttattaatttatttgatagatagatattagttattattttggatttattttaagtagaaagaaaatttgtaagtgtgaattttttataaaaatgtgaaatagtaaaattattaaattagttttattttggtttaaaaggattttttgggaatttggaagttttaatttttttagttatagtgattaaaaattaaattatttatttaattaaatatttaataaaaatattttttttattttttagtaaatttttttagaattattaaagatttgataatgtgagattttaataaataaataatttaagaagaggatttaaattttagaaatttaaattggggtattttagttaattttatttttaaatattaaatagtggtattaatattttgttaattttggttaaataagattagatgtttatattaattatttattttttttggttttttttttatttggttttttagtatgagtatattttgtaaaatgtaataaaaatatgtggtgtgttttttgatatttaatttatttgtagtaatttttaggttttttgtttttgttaggttttataaaataatgatattagttatttttttaagaggttataaaaggaagtattgaattgtattttgttttttaaagataattttttagattaaaataaaaagtgtaaaaaaaaaaaaaattttatataagaattatttttttataaatttattattttagatatgagatatagatttttattataatttttgatttttaggaattaaattttttttaataaagaattttagaaaagtataattgtatggtataatgatgaaagttttatttagtatagtacgagaaaaagattattttataaatgttttttaaagttataggtattaattattttaattaaagtaagggtaagataatttatagttaagaattaatttttttatattttatatagatatttagatgtaaattttttttagtcgattataaaattaggtttattttgagtggtgaaaaataaaagattttaatattttagtaaattggtaaattatatataaattatagaatataaagaatgtagtcgatgtaaattttgttattgataaggtagtaaagttatagtttgatattttttaggatattttattacgtttattgggaatatggtatatattggagattttagtttaaggattttggaatgttaatttagttttttataaatataattaagttttttagggaaaaagatttatattggttttttttttttggaaaattttatcgattgatgatgtttttggttttttgtggagtttatttttttaatcgggttgttttttaattttagtgtataacgggtttgttttaggggagtttgtttgggatgtagattgttaagatttaatttggtatttggtttataagtagtttttgaaattttttttcggttttaataagttgtttaagttaggaaacggtggttttggggatttttggatttttagtttgagaaatattgaaggggtattatttattattatattttattggattataaacgttagatttttggatttttacgattagtaagtaagttaaagatttttagatggtaggcgttatcggttaggttgggagtgaacgttttgtttagaggaggaggtagggacgtcgggaagtaataattttgattttatttcgtcggttttatagttttttattgttttaggagtttattcgtattttaattttcgtatttcggatttgtggttttagtttagatttatattattaagtgtatttatttagttttcgttattttggatttaggtgtgtaggtgtcggtttaggtatttagttatttatagggcgatgttgtttattaggggcgatatttttcggttgacgttttttatatatatgattttatcgaatttaaagaaggttataatttttttttagtttatttcgtttttgaagagtttttttattatcgtggtaaagcgttttcgcgcggtgaagggcgttaggtgtagttggttggatatttcggcgaagtcgcggcggtagcggcgggagaagtcgtcgtcggtttggcggagggttaggtggattataggtggtatcgggttgagcgtaggtttcgcggcggcgtcgggggtagtcggggtttgtagcggcgaggttttggcgatcgggtttcgggatgcggttggatggggcgtgtgttcgggttgggaggagaagatgttcggtgcgggggcggttttcgggggcgcggcgtttatatttttcgtattttattcgtagtttttttgcgatagtttataatggatgtattttattattatttttcggttatcgtattttgtttttttagcgtgcgttattttttttagaggaaaagtaacgggggttaacggtatttttcgttttagtttttattttacggtttttagagaaagaagaggagttataatttagttattttattggatgtgttttgtatttttggacgagggggtgtttttaattacgcggaatatttgattttggtgttttttttttggtatgagatgtaggaaatttttattttaatttttttcggatttttattttatgaggtacgttattattagtaagtattgttaatattagtttattttttttgtgatgttgaaaggttaaagaaaaaataaattaataagtaaaaaattaggtgcgtttttttgtatatattgagtgaaagtagggtatatatattataagtaatacggttaaaaagaatgtattaagttgtttggaaattaaatttattcgaatgtattttaagtaaaaaattttaaaggtttttattgaaagttatattaaattaattttttgtgtagagaatttatttgtattttttaagtatagtatgattttttgttaagttttttttttgtaaaattaaaataaatgtataaggtaacgattttattaatttttagtattttttagttatagttgatttgaaattttttaatgaattaggagtcgcggggagagggagtaaaaattaggaggatttttagatcgatttttagatttttgttttatagaaatgttaattcgtaggaattttaatcggagattttaagagttcgagaaaaaaaaaaggtagcggcggcggtagatgaattataatttttagttcggtattcgtagaagttttgtgatgttttttttttttcggtaatttatacgcgcgtatatacgcgcgggtataggtatgaatttttatttacgggatcgttttacgtttttttaggagagagataggggagaggggacgatgaaggagtcggggacggaggtaggaatttttttttgattaaatttcgaatagtaaatgtatttttcgaaaagttgttggataaatgaaggtaggacgcgtttggttcgtcggtgtcgagcgttagaagttcgcgttgtgtgtggtgcggcgaggggtggggagaaggaggtggtgggggagggttttattttttttttttttttttaaaaaggatgattgttacgaagtttttttttttggattttttttttcgttgtattttatcggcgtatttcgttttcgggttgcgtatttttttttttttttttggttttgcgcggcggcgttggttacggtcgtttttcggagttttcgtcgcgtagttcgtttcgagcgttgacggtcgtcggtagggagggttcggagtttcggtattttcgttggtagcggcggcggcggtagcgcggcggggttacggagagcggcgggcgggagcgcggcgggcgggcgggtaggcggcgcggaggggcgggcgcgggaggaagggggcgggagcggggttgtggtgtttgtttttttattttattttttgtatagttcgatcggttttttgtgcgtaacgttatacggtttatttaaaaaaagaagaaagaaagagtttttttttgagttattcgatcgtttttttcgtttcgttttttggttcgggttaaaggcgtcgcggtaggttcgggagtggcgcgtttcgtcgggggtatatggcgcgcggggtcgcggtcggggagggcgcgttcgggtcggttattcgttcgtttcgttgcgttcgcggggttcggttagtgggtggcgcgggcggtataggtttttcgcgcggtcgcggcgcggtgggtgtgcgcggggttttttgtttaggtttgcggtaggtcgcgtgcggatttggtggtcgttggggttcgcgacggggtgggggttttcggggaatcgtacgcggtcgggtcgggcggacgacggagtgcggaggggggcggttggcgggagggtgcgttatgaaaataagggttggaaaagcgtcgggaatcgtttggattttttttggtcgtgtgagtgtgtgtggagtgtgtgtgtgtgtgtgtgtgtgtgtgtgtgtttcgtttggattttttttagtcgtgtatgtgggagtgtgtgtgtcgtttggattttttttagtcgtgtatgagagtgtgtatacgcgtttatatatatatacgttgtgttatcggcgttcggtcgtcgggggaagatttaggttaatgtcgttttttatcgtttttagtagtgggattttagcgttgttttgttgtgaagataggtgattttgtacgttttaagtaatgtttagggacgtttcgagcgtggtgtttatttttaagtagttttttaggtgttcgcgtattatatacgtacgcgtattttcgttcgtgtttatttgaatatttagttcgtggtttaggttatgtagaatttagcgttttagggaaggggtttattaagggttttacgatagtttaagttaatgttttttttttgtttttaatattttttatattggtttagtgttatacgatgaggatttttatatagtaatttttaggtttatcgttttaacgttggggtgggtgggtttttaaaggtttttatttttgtttcgtagttaattttagttggtcgtatttttttaaatgaggtatatagatatatatatatatatttatattcgtagacgtgtgtacgcgtaagtagatagtt

SEQ ID NO: 171 - DNA, 198235 bp, Artificial Sequence
  Chemically-Treated DNA
aattgtttgtttgcgcgtatatacgtttgcgagtgtgaatgtgtatgtgtgtatttatgtattttatttgagaaagtgcggttaattaggattggttacgaggtaaaggtggagatttttaggagtttatttattttagcgttaggacggtgggtttgaaagttattatatggaagtttttatcgtgtagtattaaattagtgtaaaaggtgttagggatagagggaaaatattgatttaaattgtcgtaaagtttttgataaattttttttttggagcgttgagttttgtatggtttgggttacggattaggtgtttaggtggatacgggcggggatgcgcgtgcgtgtgtagtgcgcggatatttaggaagttatttgaaagtaaatattacgttcggggcgtttttagatattgtttaaaacgtgtagagttatttgtttttatagtagggtagcgttgaggttttattgttgggggcggtggggggcggtattggtttgggttttttttcggcggtcgagcgtcggtaatataacgtgtgtgtgtgtaggcgcgtgtatatatttttatatacggttagaaagggtttaggcgatatatatatttttatatatacggttagaaaaggtttaggcgagatatatatatatatatatatatatatatatattttatatatatttatacggttagaaagggtttaggcggttttcggcgtttttttagtttttgtttttatggcgtattttttcgttagtcgttttttttcgtatttcgtcgttcgttcggttcggtcgcgtgcggtttttcgggagtttttatttcgtcgcggattttagcgattattaagttcgtacgcggtttgtcgtaggtttgagtagaaggtttcgcgtatatttatcgcgtcgcggtcgcgcgggaggtttgtgtcgttcgcgttatttattggtcgggtttcgcgggcgtagcggagcgggcgggtggtcggttcggacgcgtttttttcggtcgcggtttcgcgcgttatgtgttttcggcgggacgcgttattttcgggtttgtcgcggcgtttttaattcgggttagggagcggggcggagggggcggtcgggtggtttagaggagggtttttttttttttttttttttgaatgaatcgtgtgacgttacgtataggaaatcggtcgggttgtgtagagaatgaagtaagaggataggtattatagtttcgttttcgttttttttttttcgcgttcgttttttcgcgtcgtttgttcgttcgttcgtcgcgttttcgttcgtcgtttttcgtggtttcgtcgcgttgtcgtcgtcgtcgttgttagcgaaggtgtcggggtttcgggttttttttgtcggcggtcgttagcgttcggagcgggttgcgcggcgggagtttcgggaggcggtcgtagttagcgtcgtcgcgtaggattaggaggaggagaaagggtgcgtagttcggaggcggggtgcgtcggtggggtgtagcggaagagggggtttaggggggagaatttcgtagtagttattttttttaggaaaagagggaaaaaataaaatttttttttattatttttttttttttatttttcgtcgtattatatatagcgcgggtttttagcgttcggtatcggcgggttaggcgcgttttgtttttatttatttagtagtttttcggaaaatgtatttgttgttcggagtttaattagaagaggatttttgttttcgttttcggtttttttatcgtttttttttttttgttttttttttggggaggcgtgaagcggtttcgtggatagagatttatgtttgtgttcgcgcgtgtgtgcgcgcgtgtaaattgtcgagaaggggaaaatattataggatttttgcgaatatcggattgaaaattgtaatttatttgtcgtcgtcgttgttttttttttttttcgagtttttgagattttcggttgggatttttgcggattgatatttttgtgaagtagaagtttgggaatcgatttggaaatttttttaatttttatttttttttttcgcgatttttgatttattgggaagttttaaattagttataattggagagtgttgaagattgatgggatcgttgttttatgtatttgttttggttttataaaaaggaaatttgatagaggattatgttgtatttaaaaaatataagtaagttttttgtataggaaattggtttaatgtaatttttaatggaaatttttgagattttttatttaaagtgtattcgagtaaatttaatttttaggtagtttaatatattttttttagtcgtgttatttgtagtgtgtatgttttgtttttatttagtgtgtatagggaaacgtatttgattttttatttattagtttgttttttttttaattttttagtattatagaggaagtagattgatattaataatatttattaataataacgtgttttatgaaataaagattcgaaaggaattggaataaaaattttttgtattttatgttaagggggaaatattagaattaagtgtttcgcgtgattgaagatattttttcgtttaagaatgtaaagtatatttaataaaatagttggattataattttttttttttttttgggggtcgtggggtgggagttggggcgagaggtgtcgttggttttcgttgttttttttttgggaaggatggcgtacgttgggagaatagggtacgataatcgggagatagtgatgaagtatatttattataagttgtcgtagaggggttacgagtgggatgcgggagatgtgggcgtcgcgttttcgggggtcgttttcgtatcgggtattttttttttttagttcgggtatacgttttatttagtcgtatttcgggattcggtcgttaggatttcgtcgttgtagatttcggttgttttcggcgtcgtcgcggggtttgcgtttagttcggtgttatttgtggtttatttgatttttcgttaggtcggcgacgatttttttcgtcgttatcgtcgcgatttcgtcgagatgtttagttagttgtatttgacgttttttatcgcgcggggacgttttgttacggtggtggaggagttttttagggacggggtgaattgggggaggattgtggttttttttgagttcggtggggttatgtgtgtggagagcgttaatcgggagatgtcgtttttggtggataatatcgttttgtggatgattgagtatttgaatcggtatttgtatatttggatttaggataacggaggttgggtaggtgtatttggtgatgtgagtttgggttgaggttataggttcgagatgcgggggttggagtgcgggtgggtttttggggtaatgggaggttgtggagtcggcgaaataaaattagagttgttgtttttcggcgtttttatttttttttttggataaagcgtttatttttaatttgatcgataacgtttgttatttaaaagtttttaatttgtttgttagtcgtggagatttaaagatttagcgtttgtaatttagtaggatgtggtggtaaatggtatttttttagtgttttttaagttgaaggtttaggagtttttaggattatcgttttttggtttgagtagtttgttggaatcggagggaggttttagggattgtttatgaattagatattaggttgggttttgatagtttgtattttaaataagtttttttgaaataagttcgttgtatattaaaattggagaataattcgattagaagaatagattttatagaagattaagggtattattaatcggtaaaattttttaaaagaggaaaattaatgtaagtttttttttttgaaaaatttagttgtgtttgtaaagagttaagttgatattttaaagtttttggattggaatttttagtgtgtgttatgtttttagtgggcgtgatgaggtgttttgaggagtattaggttatggttttgttattttgttagtgatagaatttgtatcggttgtattttttgtattttataatttgtgtatggtttattagtttgttagaatgttagaattttttgttttttattatttagagtggatttaattttgtggtcggttgaaaaaaatttgtatttaggtatttatgtaaagtgtagaagaattgatttttagttgtggattattttatttttattttagttgaagtgattgatatttgtggttttgaagaatatttgtgagatgatttttttttcgtattgtgttagatagagtttttattattatattatataattgtatttttttgagattttttgttggagggggtttagtttttaagagttaaggattgtaatggagatttatattttatatttaaaatgatgaatttatgaaaaagtaatttttgtgtgaagttttttttttttttatattttttgttttaatttgaagagttatttttgaaaaataggatgtaatttagtgtttttttttatagttttttgggagaatgattaatgttattattttataggatttaataggagtaaaaagtttagaaattattgtaagtggattagatgttaagaagtatattatatgtttttattatattttataaagtgtgtttatattaggaggttaaatagagaaaaggttaagaaaagtagatgattgatgtgaatatttgattttatttgattaaagttgataaaatattgatgttattgtttggtgtttaaaagtaagattaattaaaatgttttaatttaaatttttaaaatttaaattttttttttgaattgtttgtttgttgagattttatattattagatttttagtaattttggaagaatttgttaaagggtgaaaagaatatttttgttaaatatttggttaagtaggtggtttgatttttaattattataattaaaggggttgggatttttagatttttaaaggatttttttaaattaaagtaaaattgatttaatagttttattattttatatttttgtgaaaaatttatatttataaattttttttttatttgaaataaatttaaggtggtaattggtatttgtttattaaataagttaataaaaatgtgggaaatagagatatatgtttatgatagaaattaagatataattttgatatttgttgttgaattttagtgtgttatttttttatgtaattgaagtttttttttaagtaaaggtttatttttttttttttgtgaaatagagtttttatagtagatttatttttgtggttaataggtatttgaggttgataaatgtagaggttatattttatgatgttaaattataatgatatattatagaatatgataaaaattttttgataaaattgtttttagtaaaaataaattatgtagaagtatagatggttgatggtaaaatatgtaatagtttttagaataatgtatagatggtgattatataggaaaataaaggaatttagagaaaaaatatatatatatattaggaaatgtatttataggatattttggaataaaagtggtagtgtttgagaatgatgaatgatttgtttattattttaaatgtgtattattaatttaaaagttattttaggtatttggtatatagatagattttttttatatttatattaattggggttatatttttaataatatgttgtattttatagtgtaaggtagttttaatggtaaagttttagaagagagttagtatatttttttggtatgtgataataatttgtattgtttttagggtttcgtggattagtttattttttgaatattatattgaatattttaggttttagattgtaagttatttttttttttttgttgttgttcgtagaaaattggaattttgtgaggttgaggaaatttgtttgatttttgtgttttataatatggataaattaggtttttggaatgattagtttttgatagattgttttagaagattataaattaaataaagattaaagaagtaattggttgtagagtggagtgtggatttatttttaggtttgaataaggtattgtgtggtatttagagagaggtaggatagaggaagtagtgagagagaagtaattttagaaaatgtggatattttgttgtttagtgtggtttatagatagtagtatatgtatttttcggagttttgtagagatgttaaagtttagtttttattttagagttattgagttagaatatgtggtttgtgtgtacgttaaagttagcgatgttggttattatttttggtttttggtggtattttttaggaagagttgttatttgggatggattttgtattgtttttttttagtggttttaaagatttatagtgttatttggaatatcgagtattttttaggtgtttattattgtgatttgattttaggaagatataaattggatgaaggagagatagtaagtaggtagattaattataagtttagtttttttatgaatatttttcgtagtagttatatagtttatattggtattattggttttattaaaaagtaagatagtttttttttaattaaaggtaagagaattagtttttttaatagttttgttagttattattttatttttttataatatagtttaaattttgtaaatgattttagtgattttgtagtttttttaagataaagggatttttgtaggtaagggattgagttttgggtaggtgatggagagtgattttttaaattgggaattgtgacgatatttagttttatgttttaggagagagtgagataggagttattagaagaatgagatgatttagataagagattgtaggagattggttttattttgttgataagatggtaattcgatttattttttggttttttggtgttggtggtttaggaagataggaatttttttatattcggtagagtttagttgtttttttattagttagtaagtagtttttttttttttaaggtagtttatatttagtaaaatatttgattaattggaaagtaatattatttttatgttagtgtataaattatatgaaagagtattatttttttagtgtttgaggattggttgtttatggttaattttggtagtaagacgataggattaaaaatagtttgaagatgatttagttttaaataatatattttatgatgaattttttttgggaaagtgtatttttttgtttataagaattatatgattttttttaataatttatgtagtagagaaaaatatattattttttatagagtttttagttatgtgttgtggtgtgattgtttttggatatttataaaattttatagttaattgaatttttttttttgttttgttgttatttaacgtttattgaaaatatggtttttttttgcgtattttgttatttttagttgtattttttaataagaatggattgttttttttagtaatttttgattgaattggtatattttagattatttaaatgttattaggttatatagtatattaggtaatagaaagttataaattaaaaataaaaaaaaggtaagtaaaatttttgttgtttttttttatttttgtttttagttttattgcgttatttggagggatgatacgtttatttatgagcgagtgtgtgggtgttgtatgttaatagtggttttttttatttaatatattttcgtatttttttttaaggttatttattgtgttttagtagtagtttagtaaagtagtattttagtagaagtgtatttgtgttagaaaataatattgtttttgtagtgtataagtagaacgtttttttttttttttagagatatattgtatttgagatttaaaggttttgtttaatttttttaaggtaatttaatattattttatttaggtataatagtaatttgttaatttggttattttttttgttaattatatgtaggagattatttagtgaatttattttattgtgaatttttttttttattttttttggtttggtttaattaattttaatgtttgatgtttaagtaggattaatgatgaaaattatttaaggattgatagttattttatagatgtgattgttagttttatatgagttttgttttgggttaggttggaggtacggtaaggagagttttgtttttgttttggataaatttataggttagtgttgtaggtattttaataaattcgtagttattatatagtttgataagtatgattttagatttagagatttagaggaaaaaagtaaataattataagttattttgtatgtattttagttttggtttaagaacgttatttttgattatatggttgtttatgtgtgtattaggtttaatttaaatagggttaaaatgtagatattttaaaaaatattgtgtaacgtagatatatgtttaagagaattgaaaggtagggggagtttttttgttaaatattaatttattaagtattatttatgtatattaagaagatttaataaatattagtttataatttttaaagtattttattaattttttttaagtaaaagataattaaggtttcgattagattgattggaatagggtaatttgaagaattattttttttaaataatttttgtatgttaaaaaatataagtaggttttgaattagagcgggggttttttttttgagtaggggaaaaaaaagtttttgttttgttttggtttgaggttatattattgttttatttattaagatatttttacgatgttagttatagaaatttatagtttattgtaatattggtatttgttttcggatttttttgggtttgtggtttgttcgtttaaatggagattgtaaaatttttaaaatgttaataaagttgtttttatttaaaaatatatttttatagattgttatttgttgtttttatatatgtttaattttgtatatgttatagtattatttttttgttttttatttgttagataaaagatatatttatttgttttttagtgtgaataaggattgaatgattattttttttttttttaagttatgggatttttttataggtgttattatttttgtgattattttttatttgttttattattttatcggtgagggattttttaggtgtagttttttgttaatttttaattagtgatgggtaggatttatttgaagaaaatcgtaatgcgtttagatattagtaaaagggagtagaagtggggagtttaattaaagtgagaggataatttttattttaaatttgttgtaggtagttgggtaggttaaaattttgtgattagatattattttttttttttagtgattataaattttaatttgtgtagagaaaagatagtatttgttggtaaaatttgtatttattttgatttttttagtgtaagattatagtggggttatatttgagattttaataaatgtttgattaattaaattaaaatagtttagggtaaggattatttttttaaacgtttttttaaatatgtgagaaagggaatttttttgatatattggtatggttatttgtagtaatatattgagagtgatttgggtgattttttggggcgattaattatattttatgagtaggttaattgtggaagatatttgtttttgagtatcgcgtttgggttatatgcgttaatggggaaatttgtgtttttattttgttttttgttttgtttttataattttagggatagaagcgtattttatttttagttaataattagttttttggggtttttatgtaatgagttagaaattgatgattgattttattttgtttattattatgttttttaaaaataattcgagaatttattgtgttaagtgaagttttaattttttaggggaggttttttttattgagattaatatatttttttttgtgatagatttagttattatatttttttatttttaattgtcgaaaagatagttaagttgtaatagagtatggtgagtttattaattttaatatttgaagtattaaataaaggattagtgttgtaggttgtttttttttgattttttttagttttttttagtagataattaggatgatattttttttgttttataatatgatgaatgttatatttttatattaattttgaaattgaattgtagttaaatattttttttagttgtattagaattttttaaaagaatatgagatatataaatttagtttttttagtttaatgttatattttagatatattgatatttgatttataattaaaataggaataaaattaagtataaattatattattagttttaaatattgatttatttttttgaaaaaaaaaaagcgagtttataaaggatggtagtattggtatttttggatgtaaaattttagggttattttttagttatattttttatggatttttgttagtatttttaaaaatatatatattgaagatatatagagaggttttgaggtattttataataaaattataagaatagggagataaagttatttattaaatattaaagtgatagtataagaagaaaatgatttgaagaagttttaattgagggaaatgagtaattgtttataaaatttaattttgggtttttaggaatcggggtagtgatggttatggagaggggttttagaatttggttatttaggaaaatatgtatattaatttgttttattgaaaaaaatatttattgaggttttatattatgtaaagttttatgttaggtgttttagttaagcgaaaaaatgtttaagataatttttgtttttaaggaatttattaattagtaggagattaagataaggatataaattattgtaattttggataatgtgtagtagatagagaggtttaatttagttatagtggtatttgaagagttttatgtcggagataatgttgagataagttttagagaataggtaggcgatacggggagagggttttttaggtagtggaaattggaggcgttaaagtaggtatgaatgcgggaggtgtgtttggggaattgtggagagtttgatttgattggggtatggagaatttttttgagataaatttatagttttgagaatttattattgtatattaagttgtgaaatttgtatagatagttttttttatttttgggttttatatttatggatttaattaattttggattaaaaatatatggggtagggtaggtatagtggtttaggtttgtaattttagtattgtgggagtttaaggtgggtggattatttgaagttaggagtttaagtttagtttggttaatatggtgaaattttttttttattaaaaatagaaaaattagttaggtgtggtggtgggcgtttgtaattttagttattcgggaggttgaggtaggagaattgtttgaatttaggaggcggaggttgtagtgagtcgagatcgtgttattgtattttagtttaggggatagagcgagattttgttttaaaaaataaataaataaataaataaataaataaaataaagtatataggaggatgtgtatatgtaagtattatttatttaatattagggatttgagtatttttagattttggtatttattgggggtttttagagttaattttttgaggttattgaaggatggttgcgtttaattgtattagggatgttgaaaggatgttgtaaaggtttttagataaggtaggatgtgtgcgtgggaggaagattgatagtgattgagtttggacgggggagattaggtatgaggtttgaagtatttggaatagaaaggataggatagatgtgggtatattgtacgtgtagaattaaaggattgatagtaggtcgaatgtgaggaatgagggagggaaagaattaggatttaagtgttattttggttgttttaaaaaatgatattgttttttagagggaaaggaaagataataatagttattgttttgtggcgtatatgtgatgaattttattttggatattttagtaggatatttaagtggaaatgtttagtaagttttagatataaggatttggattttaagagaaaaattgaggttgaattataatatgttttttttttcgaattatgtaggttttttttttgtttttttttattgttttaagtggttttaaatgttattgttgatgttgttttagtttgcgattgttgtttgtattttatttttttttaaaggtaatttgtagatttgtatggattgggttaaggtggttaatttgtagttttgttgtttaaagtttggttttttattattagtttgttaatttaatgagtattttaatttgagttaaattagtattgttttaaatattttaatagtattttttatgtgtgattttaggttttataaaattaaggtgtttttttttattgagatttttttattaataaaatattttttttattaaatttaatttggtattaagtatagtaggtaataggtatatataatgattgtttattgaatgaatgaataaaatgattatgttagggtattttgagtaatttattttaagtagttaatttttttttattttttttattatagtgtgtgtttgtgtgtgtgtgtgtgtgtgtttgaaatgttttattttataggtttattaatatttaatagaaatgaaagaagaaaaatatttattaagtgttttgattttattttttttattgaattgaaaaagtatattatttatttttgaagagaaatttagattttgttttatattaaatatttgatatttattggtttttaatgttaatatagatattagtttgttggttgttatattttatttgtttatacgaaggttgtagatatatagtgtatgtatatatgtttagttgtttttattttttttgttttatattttaagtttaatttagattgaaaaggttttgaaggttgagattatttattattttattattatagaaagtagggttggtttaaggtttttatagtgggagtaaggtggattttaattttgattagtgttgtagtttaaatataaaaagaattgtagtataaaagttataaggataaatgattttttcgttttttttttataaaaataagtagttaattgaaggtggaagttagtatagtgcggtatttttagaggcgatagaatttaagattttatttttaaagatattgtttaataagaagattatttgggatgttttatataaaattattggtttggtagtttttggttgagttttttattttggtttaagttagtattatagtttatttgtggttttaataattgatggaatttgtattttgagaatttttattcgttagtatgaagtaaatttaaagtattgttgtttattagttgttatttgtttgagaaagattttgatttgtttatttgtagtgaagtttgattatatttttttaggggttttttaaaaagatgaatgtgttagtttgtagatttgtttttatgaatgaaattataagtaaattttttttttttttttagttttttttttttttttttgtttttttagtggttatttgtgtattatgtttttattgttaggttttttttaagtagtttatttatgagtgaatttagaaattttaaattataaaggatatttagataattggtttgttttttaaagtatttgttttttgtgttgttgttagatttttttttaatgaatatatttagtgatagtgggatttttgagtttgttcgtatttgtgagaaaatgagtttttttgttttgtaatagtttgtggtttagggaaaaaaatgatagttattgtataagttttttttgaatgtagtttttttttttataaatgatattttgagaatatagttaaggggttattagttttttattttatgtttggtttgtgtgtgagaataatataagttgttattgtaaattagtagttaaaaatgttttgtttggttaatgtgaatatttaatatttggtttaattaaaaattaatcgatgaaagtatatgttattggaatttgaaaatattttttgtacggaatatttaaagggtattatttatgattaaattagtgtttttaaaatatggagaatatggggaaatttaatatgagttgggatatttgatttttttttaaaatttttttatttgtttggtataatagggtattgataaagagtgggtttattgttatggtaaaggatttatttgtatttttgtgtttttaagtgggtaattgtttttttgtatttagttatatgattaaagtagatagaataagagattagttatttatttatattatatttttaaaaaaatattgagttaggttttggggaagtgggaagtgagagttagagcggcgtggttgatagtttagggtagtgttatttaattttttggtttttttgggttatattggaagaagaagaattgttttgggttatacgtaaaatacgttaatacgaatgatagttgatgagttaaaaaaaaaaaaaaagtataaaaaaattttataatattttaagaaagtttataaatgtgtgttgggttgtatttaaagtttgttatggattggataagtttggtttgggggagtgaagattatttaatattagttgtaggagagtatgtttaaagttatgagaagagatgtagtaatagtggtggtatttattggagttaaggaagtttttttaggaaggggattgaagtttgaaggatgagtaggaattaatgtagtgaagtgggtgggaggaattaagtgtggttttaggtagaattttaggaataaaggttagaggtaagcggttatatggtggattgtaggagttgaggagtttagtttggttggagtggagagtgtaagtgggtgggttagaaagatgatgttagaggtggtttattttggaagagtttgttttagatacgttattttgattttattttagatcgttaatgagacgggggagaaattagtgattagatagaaggtttttttagtaaacgggtaagagattaagtgtttgatttagaggaatggtagtgggaacggtaagaaattgttagttttgtataatgattaggattagagtggagagattttttggaagaggtaatgattgattgaatgttttagaatatggtttagtttttttttagttttgttggtttttttgtataatttggaaagaatgtggttattgttttggttatatataaatgtttttttgtgttttttgtttgtttgtttatttgtttgtttttggagataaggttttgttttgttgtttaggttggagtgtagtggtattatatcggtttattgttgtttcgaatttcggggtttaagtgatttttttattttagttttttgagtagttgggattataggtgtatgttattatatttagataatgtttgttttatttttttttgcgataggattttattttgttgtttaggttggttataaatttttggttttaagtaatttttttgttttcgttttttaaagtattgggattataggtatgggttattttatttgattttatataaatatatatttttttttattttatttttaaaaaattgtttggttaaaaattatttttgttagaatttatcgtgtgataaatttttattaattattagttaataaaagtatatttgaggaaagaatttaattatgaaaggtagtttttatagaattttttttcgggtgaaaaaaatgatagtggttttttgtttttacgtaggattttaaagtttttaaaaaaaaattttatatttgttggtttatttgatttttataataattttaagtaaggtagatattgtattttaatttttttttatttttttttttatatatattgttagttatttgtttatgtttatgtaaagaagaaagttcgtttaataaaggtgtgtacgagttaataagtataggaagagttgatatttattttttgggttgggaatttcgtagatatttttttattttgtgttgtttttttggatatgtgtttataaagatataagattgtttagtagagattgaaatatattgtattttgaaaattagtatattttattgttttttgtgttaaaaatgtttagggaaattggaatgtagttttttgtttttggttattttttttttttcgatttagtttttgtagcgttttttatgtttgtagtagagggggatttagttgtttttatttggtgtttattattagtttaagattttgtgaggatgcgtttatgagttaggcgggtttggatatgagttgaagggatagtagtaggattgacgtgcgaggtttttaatatttgaaggttttgtaaaatagttttttttaataggggttaattggaattagatgaatatgtgtgattgtttttgtttgttgatatttgattagtaacggtgttatgttagtatgttgtttgttgtttttatttttttgaattttttagagtttttatttattatttttaaaggttgtaattagttttaatcggaagtgttcgtaagtgtagttttgtaaatgttgtttttttattttttttttttttttttttaagaaaatgtcgtattggattattaggaaaaataattaatgggtattaggtttgatacgtgggtggatgaaataatttgtataataatatttaataagtttatttatgtgataaatttgtatatgtgtttttgaatttaaaagtttaaaaaatttaaaaaggatgtgaaataaaaaaattaaaagaataaatattaataaatatgaagaagttttttagagtttttaaatttgtttatagagtattgattgagatattattttttttagtaattaaataaaattaaaaaaataatattgggtttttttttttaggtgattaaaaatatttggtatatgttttttgaatgttgaaaatggtggagtttttattagtagggttttcgtagtagtaaagggtatgttattgtaagtttatttaattaataaatatttataaatatttgtttattgtaaagagtttattttgggttaattattgttttaggggttggagttataatagaaaatatgataggttaagaatttttttattttttgtgaattttatattgtgaggaagttagaaaagtaaataatttaaaaattaataatataatataagggttataaagtaatgaaaatagggtaatgtagtgtaagggtgttgatgggataatattaattttttttttggtttttgagattttttaagtagtattataagtttatatagaggagatttaatgggtttttttttattaatagttgaaaatagtgttgtattttaaaaataataaatgtattagtataatatagtttttatattagtttaaaatgagttattatgaataatatgaatttaaagagatttttattatttttggttaaaatgtttagcgtaattttttttttatttatttattttttttatttttttatttttatttatgataatattggttattggttttagttatcgaaagttaggaggaaggaaggaaatgaatatttattgaattttaatatgtgttagattttggatttaatatttttagggataggagattatttaattttaataatttttttttgagggtaggaagtggatttatagatgcggaaatagaggttttgtaaagttaattgattttgtttggtaagaggtaaaattagtattttttatttaggtaatttaagtgatgtttatgttttttggaatttaaatttttaaaataaaaatttaaatagaaatatattataaaagaataattttatgtatgtgattttttgggttttttaggaagttagttagttatttttattttaataattagaaggtgaaattttttttataatatgtaattttaagtttttttatagttaaaaaataaatgaaataattttttttttttgttttttttttgatttttagagtttgtttaaatagtttttgaaaaataagtattaattattggtttttattaagattagatatttgatttagaagtttttataggggttagagtgtgcgttggaaaaataaatttatagtgtttttttggttttagagaaatgattttattgttaaattgtaatttgtttaatattttaataaaaaggtggggaaagtttgcggttttatttttggtatgatttttttttttttattttttttattttaggtatgattttagtgtttttttttttttagagtttagaggtggaatgatatgttatttaggtttataagatgaggatgtatttgtttttatatttagttgtatattttattttatttaaaaataaatttatttttagtaattagggcgtattaagggagagttatttttattttttttagtttaatttggatatatttggtttagaatagtatagtgtttttataataatatttgaataggatgtttttgtgttatttgtagggttaagggagttttagtatgggttaggaaattatttttttaaaagaaatttaaacgcgaaattttgataagataggaaatttttattgtatttttattaaattttttttttttttttatttttttatttatttatatattttttgtgttatgaaatatatataggttgaatatttaatttattttgaatttatgtgtagaataagttattttttagaaggataaaaataatgttttaagtggtttgtttaataaagtatatattaaaaaattttaatttaatattttttttgggtataatatgttatgattttttagagtagagtttcgtggtattttataaggaagttaaaaaggaagggaaattattattcgggtagagggataatagtgattttttattaagtaagatagagtttattattaggttttttaaattttaggttttgtgttagttgaattgaataagttattaattatttttttttttttttttttttttttttttttttttttttttttttgagaaggagttttgtttttgttgtttaggttggagtgtagtggtgtagtttcggtttattgtaattttagtttttcgagtagttgggattataggcgtttgttagtacgtttagtttatttttttgtattttttttagtagagattggtttttattatgttggttaggttggtttcgaatttttgattttagatgatttatttgtttcggttttttttttaaagtgttgggattataggcgtgagttattatatttggtttttttttttttatagattagattattttaaaaatattcgtttaatattatttaaaatattttatttataagatataatttaatattgtaatatttaaaagattgtattatgtagtttttatatatttttaagattttaatgaatttagataattagtatttttgtttttttaatagttttatatgtgattttttagttttagagtttgattttaggagaagggaagagtagatttggattttgtgtcgtggataggcgtattggtttttcgtgtgaaaaggataaagtttcgttttttttggagtttagttttttttgggattatttataatgttttttaagaagttcggagtgtttgtttgtcgttagtattgtaatttgtgagtaaaagatttttatgattgtaaaatatattagcgttttcggagattattgttttttgatgacggtgtgaattataattaggaattaggaagttattttagttttttttgtgtagagggatgttatgaagtatatatgttaaagtttatatttattgtttataagagtttagttaatttttttaattagtttatgtaaaaatatatttgtataaatatgtatacgtatgtatgtatgtggtgtgtgtgtgagttaagatatatataaaatttacgttttttattaattttaaatgtatagtttagtggtttttagtatatttattttgttatataaattattattatgtaagttattattgatatttgtttttagaatttgtttattattttaaatggaaattttatttattaaattataattttttgtttttttttttttttagttttaggtagttattattttattttttgtttttataaatttgatttttcgaggaagaatttgattttttttataagtggaattagataatatttgtttttttgtgtttagtttgttttatttaatatatttttagagtttatttatgttatggtatgtattagaattttatttttttttaaggttgaataatattttatattatttgtttttttaaaagtttatttttttaaaaaattggttgttatttttattttttatttagttaatagaaatagtaaatatattaaattagaattgatttgatagaggaggtaatggaggtttgtaaattatttaaagaattattttagagtttgatagtaaggaagaagataaaaatgtttttaaaattagtttaggagtttttgaggtttttttgcgtggggtaggtagttataaagatttttacggtttttggagttttcgttggatcgtagtataggataattttagtgatttttaatgatgttattgagttattaagatagagttattttttgtaggaagagttaaagagtttagggaaagtgagtagtaagttatagaaatatttttattttaaatggttaaaattttttaaaagtttaggttttagttatttgaaaaatttatttgtgtgaaatgatttagtttagattgtagtgaaagagaggaattttagtaatattaaagtaaaatatatatatatatatatatatatatatagagagagagagagaaggagtataagattttttttttttttgtttttttttttttttttttgaataaatttttatatattttttaagtttaggttaaatggtattttttttgtgaatgtgtgtgtgttaaataggtagagagatttttaggggcgtttgttgattttttttatttttttttattttttatttttttttttagagtagagaattagtaggaatttgatttaagtggacggggatgtaatttttagggggagtttttgttgttttattgtatttaaattattttgtttgtgtataaattaagttgtatatatatttagaagagttattttttttattgtaggatgtatagagtggtttttgtgaggagttgttttgtagttttaattttgttttttgattttattttgaaattattgtataataaaacgtggttatttgtttgttttatattttttgtgtttattgggtttttggatatgatttttggttttgggggggatagttttttggggaaatagatatataaatagatttattatagtttagtgagtttttttttgggaaagttaaggatggttttatagagaaggtgtcgtttggtttgggtttgaaggatatataagagtttgtttaaaaaaaaaaagaaaaagaaaaaaaaaaagtaagagattttgttttttggagaatgtgaaagggtattatatgtaaataagtagagtaattgaagggtttgttaagtttgggaatggtaaaaaggttagagtgattagaagagaggtagttggggatggaatggaaggggatgaagcgggaagatagtggaggttcgttttttaaggttttatgtgttttattaaggagtttgattagattttttttgtagtggaatgttagtaaaaggtttttagtaggatattaagtgatatggttggatttttttgttgatgaaaatattgttggtagtagtgtgttggtggtattgagggtagtaaggaggttagatgggaaggtggggttaggtgtttaagtgaaggtgttgggtagttgttttaaggtatgggtagtaggaatttttaggatgggattatttgaaaaggtgttttaaggtagaattaataagattgtgtatagttgattatcgttgaatatttagtgtttagcgtaaggtaagtatataatagatgtttagtaatattgattaaatgaatgaatgtataggtagttgggtatatatgataagtagtataagtaagtgttaaagtgatattttagttatatttataatagtgataaagtagaggtttatatggtttgtattttgtttaattttttttaaacgttttattattattcgtgtattttttttttataatagtattgggaggtggtggtgtttttatttttgttttgtagatgagaatattgaggtttgtagagggggatttattatagttgtttgggtggttgggttggaatttgaatttaggcggttttggagtatttggagtttttaattttgttgttttgttgtcgtttagtttttgagttttttaggaagttgttgtttttaaggttttagaagtgatgattcggggtaaatttaagtggtggtaggatgtagagaagtttgtttaggaaattatttattttacgtagatatgttatttgagatgattttagtagaaataataatggtaatgataatagtttcgtagttttttttttggtataagaaattagttttgtaatgaaaatggaatttttttggggaatagttttagaaagagataggtagttgagataaaaataataaaatataaaatagtattgtattgttttttgtgtatttttttttttatttttgtttttttttgttgtgtaatttattttgtttttttggttatgggtaggttgggtattattgtgatttgatttttgttttttgttttaaagaaagggatgagtgtgtgtatttagaggtagttatttgtattttgtttggagtttgttattaatatagttagttaaaaggaggagaggtttttgagggtaaattttgttttaggagtcgaagtttttggttttttggaatgaagggtggtgagtttggttttttagatggtttatgggttagaatttgagttttttggtatttaggtgtgtgtgtcgttttggattattataattacgattgagttgtgtttttaagttataggttagagtcgtgtaaaataaatttttgttataataaaggatgcggtagttagattgtagttcggagtttttttatttatttattttagaggatattgatttttatgttagtatagggaagagattttatttgtttgtcgattttaattgggggtttgttttgttcgattattttggtaaatggtgataaatattggtggttatagtagtatagagagagagtgtcggtttggaaatttagttaagtttttttggttttaattttatgtaaatttgtttaatagaatgtaaatgattttataggaatacggattttagggatacgtgtttatttgtttttagtagtgtttttgggtttttagaagtagttatttgagaggttaggtaagtttatagagaggtaggttaaaggtggtttgcgaaggaatggtttattttattagtcgatgttacgtttggaattttattatgagtagcggttttttttttggtagtttgcgagttaagatttttgtgttttgggaataggaaaaggttaatatagattaatgtttttttaaaaagttttttatttttttttttattttatagattttttgcgattatagtatatatttaaatatttatttattttatatattttgattgggtatttagttattaaaaggtattgtgttaggtattgagaaaaggttgttttgtgttattaaggtgtgatattataatattgtgtttaaaatttatttttgttttttttagtgtcgtggttgtggttattaggtttacgtaatgtggttaatttgaattgagatgcgattggagtgtaaaatatatattaggtttattggattttaaagatgtagtatgaataaatgaatgtaaaatattttattaataatttttataagaattttgtgttgaagtgatagtattttggatgtattagtttaataaaatatattaaacgtgattattaaaaatttaaaattatatatgtggtttttattatattttttttttttttttttttttgagatagagtttcgttgtgtcgtttaggttggagtgtagtggcgtgattttggtttattgtaattttcgtttttagggtttatgttatttttttgttttagttttttaagtagttgggattataggcgttcgttattatttttagttaaattttttgtatttttagtagagatagggttttatcgtgttaattaagatggttttaattttttgaattcgtggttcgttcgtttcggttttttaaagtgttgggattataggcgtgagttatcgtgcggggtcggtttttattatatttttattggatagtattggtttagattgttaattatttattgtataatgtggttatttttttatttttatagttggatattattatataggaggatagaaagatttttttttttttttttaatgagttatagttgtgtagttttttttaaagtttatttatatttatgtttttgtggtttttattgttagtttgttgagttgggtagggaaggttttattatatttttataggtgagtatattgaagtgtaagaggttattgttgttagtttgttttaagagttaagttaagaataaaattttagtagtttttgggtggacgtggtggtttatgtttgtaattttcgtattgtgggagatcgaggttggaggattatttgagtttaggtgtttaagattagtttgagtaatttagtaaaattttgtttttataaaatataaaataattaagttaattatggtggcgtgtgtttgtagttttagttgtttgggaggttgagatgggaggattttttgaggttgagatgggaggttgaggttgtagtgagttatgattgtgttattttattttagtttggatgatagagtgagattttgttttaaaaaaaaggattttagtagtttttaatttttgttaggttggattattatagttgggttgggaaggttggaaatagaattttcgatttttattttagtgtttattaaaaatatattaaaatttatgtatggaaatatttatttttatttttgtattaaagatgatagaatatagtttatttagaagtatttttgtgtgtatgtgtatgtaaatatatataaatatgttttgtagttggttaataaaatatagtaattaaagtttatagtggatatttagtgtaaaggtaagatttgttgaattttgaggtttattggggaagggtagggttagggtgagataagtatgtggttataattagggggcgtttttttttgttgggagttaattattgttagggaaaatttttggtagcgtggagtaaggttggtggattttatttgttagaaaattttgagattgggtttagtttttgagggatggaaggataaggtaggtattttggattaaagaggtaagggatttaatttaggtagttatttagtattggggatggtttaggaaaaaggttggggaggtgtagttttaaggaagaagagagaattgattaagaagaggaggtggatatgggtgagagttgtgtagttgttgaggatatttagggtaacgggttttgggttgtatttttttgattcgttaggtatttgttgtttgggtatgttatatatttttttgagtttttatttttttatttgtaaatggggaagttgagttatagggttttttattaatattttgtgattttatgagtttcgaaggttagagaattagtaagaattgtattaataagttattaatgatggtataaaggttttgttttttattgttgttttttttgttgtttgatgtgttgggggtattgaggtttatggtaaatgagattattggtttggattatttatttggtttttgatagatataagttgggtttaggatttttttgtaattatagttaatatatatatattgtagtataatatttaaaaatatttatatttatttgttttttttggttttttttgttttttttgtttttatattttttatgaattataataataataataattattattattattatttttttttgagatggagtttcgttttgttttttaggttggaatgtagtggtataatttcggtttattgtaatttttgttttttaggtttaagtagttttttgttttagttttttgagtagttgggattataggtattcgttattatgtttggttaatttttttttttttttttggtatttttagtagagatgggggttttatcgttttggttaggttggttttgatttcgtgatttatttattttggttttttaaagttttgggattataggtgtaagttatcgaatttagttaaattataattattttttattttttatttttagagtttagtgttatatagatagtaattttttaatattgtttatatgatttagtaaattattgtatgttttcggtttagaaggattttttttgttttatattttttatgaattaaaaagtttttggattatggatgaatgatataagaatttaattatttttttttttttttttttttgaggcggatttttattttgtcgtttaggttggagtgtagtggtgtgattttggtttattgtaattttagtttttcgggtttaagtgatttttttgttttagttttttgagtagttggaattataggtgtgtgttattatatttagttaattttttgtatttttagtagagatagggttttattatgttggttaggttagttttgaatttttgatcgtaaatgatttatcggtttcggttttttaaagtgtagggattataggtgtgagttattttgtttagtttattttttttttttaaagaatttattttaattgggtttcgtaaatgtagggatataaaagttattggattttgagatagttttgtattttgtagagaattattttaggagtatatttttttattgagggttttagttatttttttcgttttattatattttgtttagtatcgagaagtttggtatcgtttttgttggaatgaaaagattggtagagttgttttggataatagtattgtaaaatattgtggtagaaggtttggtttatatattaaggtagttaaagtattaattgtattttttgtgattataaaataaggcgttgaattattttttttatgttttaagaatgataggtttttgttttgttagttttaagtatagtgtattatatggaaaggagatgttagatttgtaaaaaaaaaaagagaaaaaaagtataggagtgaagatttttggtagttagttgttttttaaaaaagatttaaagttgaattgttgtatgagaggtatttataaaagattaggagtcgggtgaggaagtgtttttataaatttatatattttgttaaaatatgttttattttggaattttattttagattttgaaatgggattttttacgttgttggttatattttgattttatttttttttgttttggtgtatttattggagaaaattggttatgatatttttatatgtatttgtttttttttagttttagaataagtattatatgtgagtattttagatatttaaggttttttggatattttagttttttttataaagttgtttttttagagtttgttgtttcgttttttaggaatgtatttatttgaaaatttatatttatattattataatatatatattgttttttgttggtcgtttttttaattttagtggaagatattttatagagaattgttggtgattgtttaatttggttgggaggaaaatagattaagtaggtgataatttgtatattggggatttttttatgttgaaaattgttattttgttgtagtattttattttttttttatagttttaaaaaagagaagtacgagtgttgttgatgtttagggtttgaatatgttttggtttaagatgtttagtggaattagagagaattttattttgggtagtgtagttaggttggaggagtattttggttttatattattaaattttgtttttttattttagttgtttgtgtgttattttggggttattgagaatttggttgggttttgcggggtgggagtgttgtttcggggttgagtttagttaggggtgaggtcgttttggtgtatattttgtacgttgtatgaagtttagagtttagtttggtttttgtgaattttttttgtggggatatattttttaattaaagtgagggtttagcggttattaggttgtgatatgagagtcgtcgttattattatttattatttgtagtagtaggaagggtgtttagattatagaaattttttgtttttgggttcgtgtttattgtagttggtagagagtttttgagttttttttttaatgcgtggtgggagagcgttttttttagtattttttttatagggttttttgtagtgggagtttttttgatgttttttatttttatatttattttatttttagaattaaggagaattgttaagttattttttagtacgatgtgttatggttgaagaattatttatttaagatattggtgaagagggtttttttattgtttttttttaacgacggtttatttgttgtttatttgttgagtatttgggtggtgttaatatgaatttatttttttttgtgcgtaagttttttttttttattattagagtgtagattttagttagtatggtacgtgtgagtgcgttgtataaagtttggaattataattagaaaggaaagtttttttaaaggtattttgttttgatatttattaatttattagattgttatttttttatatttaagatgattataatatgttttatttaagttgagatatttgttattaattattattttgggataatagggtaggttaggatggttttaggtaagttgatgtttagagtaataattttgtatatatgaattttttgaaggattgggtatgatttttttttttttttttttttgtattggggttggttggggttaggagtttgtgatgaatttttttagtatttttttgaaaattagtgaattattttgtaggtttttgtgtcgttagaaatatgtaaatttatttattaaaattattttagttgatttattaagttattcgttaggttttatttggattttttttattgttattattatgatttgtttatattattggtttttttttttattatttagtttttttgtgagtttagtattgatataaagtggtttttagtttttttggatttttaatttaatttgttttttatgggaattttttaattgtttttttaaattattttgtagatatttatttttttgtttaggattttaagaataggaaagagagatataagttagattttatttttgttttagtaagattatttttttaatataagaaaggaatatatttaaaaaatttttttagtattttttttcgttttattgagaaaaaaaaaaaaagaaatatttatgagtattttagggtttcggttgatagtgtgataaaaatagttttaattaaattaagtaatttaaggttatttgttttatttttgtatttttttatgtgttttcgagttttttatagattgggatggtatattttggtttaaattgtaaatttttgtatttaattttttttgaatgatttaggacggggttgtggatttgttgatatttgatgagtattggtttttagtgtaaatgatgatttgttgaagggtattaggtatatttgaaggtagttgtttaattaggttacgtttttattaatattgtattgtgaatttttggtaagaagagtgataattttttgtaaaatgtagtttttaaaaataatcgtgaattttagtgtttttagttaaaataataatttatttggggaataatttagagattttttcgataaatatagagaaatggaagttaattatatgcgttttaagtatttgatattggaagaaaattagtatttattaagtaatttttgtgaaaattttatttattttttgtttttttgtattttttaatttgtagtataaattaggttataggaaaaggatggcgtatttttaaagagttagttgggttggttgtgttttttttattcgtggaaaatagttgtgggtgtcgggtgttgaagttaggtttttgttttatgttaaggtaggaaggtttgtttttgagatttattatttttttgtggaggaggagtttatagatggtgagtcgttttattattatttcggaggtttttgaaatatgttgataatgatttgggaaagagggtcgagtgggatgagggtgggagtaggaaagaaatattcggtttatatagtgtttatatttttttttgtttttgtatttgtggtaattgtagattaaatgaattaggttatttttttttattgttttttattaaatagaagtatttatttaagttttgtagattttttttttgttgagtgaagtttgaattgagtttatgaaaggtgatttttttaaagtaagggtttttgtttttttttttttattttgttattttatttaagtgaaatttttgttatggtatttattttgagttttgttatataggattattgtgatggtttttattatgaatggagtgttaaggtgttttttttagttcgagataaaaattagttttaggaatgaatttttttttgttgtgaaaaatatgttttaagggaataaatttcgttttatttttatttttatattgagtaaatggttgggaagtttttttaatattgtttgttttgatttattgttttatttttttttttttgatttttttgtgcgggattttttttatttttatagttttcgtatcgtttgtatgtagttgatttttaaatgggtatttttgtaaattttagttttgtttatatattattttttgatgattttttttatttggattttttgttggtagtttaaattaaatatataattaaaatatttaatttaagattaaatttatcgttatttttttaaaattttttttggatttaatagtttttttttttgtttttattattatttcgattatttaggtttaaaatttagggtgtatttttttagtttttgtttaggtttttgagtttagtattttttattgttttttattttttttttattggttttgttgttattatttttttaatttttttttaggggaatttatttatttgttttagttttttcgtattttagtttattttatattttgtgatgatttaattaaaatttttttttgattgtttttttttttgaggtggagtttcgttttgttatttagttggagtatagtgggattattttggtttattgtaattttcgttttttaggtttaagtgatttttttgttttagttttttaagtagttaggattataggtatgtattattatgtttggttaatttttgtatttttagtagaggcggggttttattatgttggttaggttggttttgaatttttgattttaagtgatttatttgttttggttttttcgagggttggggttataggtatgagttatttttttttttattttaaggtttttttttttttaggtaagtttttatttttttttatttagttgtttaaatttttttttttattttttattgtaatttatgtgatattttttttattattttttgttattttttagtaagattgttatgttttgaattcgttttgttttttttgttttggggattttttttttgttgtttttatattttagagtattttgtttttattagaattttttattttttaaggtttagatttgattttatttttaggatgatagtatttttgttgggagtgatttcgttgatttttaaatttttattatttttttagtttttttttttttttttgtgttatttttttaggttttgttatatgttttttgatattattttgatatataaatgtttgttatattttttttttttttttttttaggttataaatatgttgaggttcggggttgttttttaagttgttattttaggtttgtgtatatttattattatgttttaaaaaaaggttttatattagtaagagtttagtaatatttgttgaatggatgaatgaagtatggtggttttgttattttttattttatttgtttattttttttttagttttatttatttatttatttaataattatatattgagagtttattatgtgttaggtattgtgttacgtatgtaggtttattagtaagtaaaataagatttttgtttaaatgtgttagtattttagatttttttttagatttattatttttgtatttattttatttagtttttaaagaaatagtagatagttattgtaaatattattagttttatatttatgttgtttttttgtgattaaattttgttgttaagaatattatgtttttttggtagtttgtaatttgagtttttgatttttaaaattggttgtatattttaatggttgtgatggtgttgaaaattttattttttttttttttttgattgttgaattaaattattttttaagttgttttgaaatatggataaaagattttttgattttagttttatgtgtagtatggaaatttttattaggttgtgtttattgattaatagtaagttaatgtttatttttttttggttgtttgttaaatattttaaaacgaaaataaaatagtagtgaattatagtttagtattagtaagaatggaaaataattgttttttaaagtttgatttgtattgtttttaataaggaaggaaaagttttgttatataaatatatgaaaatatggtagtgttcgtggtaagtatgttaatggataatgtgtttaaaatttttgttgggttagtgttattttttttttgtgatgttgaaggaaagttataaaataaaaataatttagaagaagttaatgtgttatttttatgtagggatttgtatttaaagtttttttttattgtagttgtaatgaaatagtatttgtggaaagatattgtatttaatgttaaaatttaataattttgtttttaaatttttaaaaattaaaaaaagaaattttggtgatataaatgttttaaaattaaaatgtttaaaatgaatttattaatttttttttttcgtttgtttatttatgtttgttttgtttgtttaatgatattattgtttatttagatagagttttaaatttttaaattatttttaatttggtttttttatttgtgagatagagtttttttggattattttttaagattttttttagttttgaaagtttgtatatttgagttttttatttatattttttatatatttgaattttgtttttaaaagttttttttttttagatttttggtttttaggtttttaaaattattttattatttttttattttgttgttgttgttgttttaatttaattttttatttttttttgtatatgttgtaattttttagttagtttttttgttattttaaaaattatttttaagtttatttatagtaaaatttattatttttgtgtagttttgtgggttttgataaatgaatagagaggtaattattattttaattagtatatagaataggttagttattttttaaatatattttatgatgagagtttgtatttaaattgttcgttattttttaatttttagttttggtaatttttttttttttttatatttttagagttttgtattttttaaaatgttatagattggtattttttttttttagtatttgtttttagtttatttatttttttcgttaatgttatttatttttttaaaatatttttgttgagtattttgagaaatatttagtttttttaagttttagtttttttgttagaatgtgatttagttagagtataaaataaggagtatatagaattttaatattttttaaggaggttggtttttgaggaggattttttattttgttaattggggtaattgatgggtagattagagaagtaggaagttattttgagtaagaaatggtggtttagagtttttgtgagaaaagggatttaagaagggggtagtagagagagaagtgagagacggagaaaagagaataattgttataagaagtaaaacgttggagagggatagatgtttatagaagatgttttgggatagttttgttgttgaatgagtgttagtatttttttatagtggtttcgggagatttgtagtttagattcgtgttgtaggaggtgttttttgaatgggttttattttgaggagggatttaggagatttagatttgtaatggggataatgatatttgttttatgtaattattatgtggggattatggggtagtaagataggattttgtttggtagagattgggtattaaggattttttttttattattttgtgttatttttgttttttttttttattttttgttttttatttggaaattgtcgtaaattaaatttttttattttttttttaatgatttttagaatgttagttttgaaggttggtttagaggttattgtatattaagttatagagtttggtgtatagttgatttttagggttggtattagtttattttttagtttattttttattaaagttttttgttttttttattttttgtttttaattttcgtttttatttttgttttaattttacgttttagttacgtttaatttttttgttgaatttttttgttttttttttaatgaaaattaatttattttttgtttatatttattttatgtttatttattttgtgtttatatttattttttgtgtatatatataataggttttgtattataattatttatgtttgtttggatatttttgtttttaattgtgtaaaaggtgtttaatttatatttggttaaatgaaatgaatttttaaataattatagtaagtttgaatttagtgaaggaagtgttaaggtattttttttatattatgtttttattttaatgtataagtagtatgttagttatggggtaggttttatttttttagattttttgtggttgttaatgtattaggtagtttgtttttaaatagttgttatatggttaaagttttttaagtgatttttttatgtgtataagagtaggatatagtttagatatatttaggagaagtaagggtattgaaaattttttaggttgttgttgtagaaaggatagggagaatgttattatttggaggtgggaaattggacgttgttatatttgtttttttattattattatatagtttgtgtgttgttaaatttaagttgttaatataagttatggattataaagatatgtttgttaaattaagttgagtgagatgtatttttagtattttttaaatttatgttgagatgtagaatttttagttttatgtagatagatttgttttgtatggaaacggtgtattttttttcgttatatatttagagatgagagatgagtttgtttgtgaaattaaatttaggattttgtttttgtgtaagaatcgtattatatggttgatatatgtttagtttatggttggtagaagttttttgaatatattttttatttagtattttttcggtagtgatttattttatatttgtatatgtttttttgttataagattgtggggagggtgtagtttgtagttgattttttatttagttatagttttaattaagggcgtgtatttttggggagatgttgggagtattataaggttttttttcgtttttagaatttagttttagaggttagttagaaagagaattttagaggttagttagagagagaaggtagtaaggatagagtttttattgatatttttttttttatttattttatttttagggtaatggtttttagtagggaataacgggtttttattttttgttaggggagttgagtatatataaattgttggatgggcgagaagtttttttagtgatttttattttttcgtttagaaagaatttttattttagttttttttttttagttgttgcgtgtgagtttgtttttgttttttgggtggtgtagttgtaggtgagttagttgtgggcggttttgaaggatagcgaggtagggagtttggttgtgaggtttttgttttttggggatgttttgtagttttttgtttgtagtaagtttgaaattttttatgtttgattttttttttttattttttttttggcgtttgtttttgttggagtggagtatggtgggagttagtttttggagttttttaggatttttatagtttgtagttagagttgtgtaggtttgatttgggtttagcgggaggaggattttgaataaaaattagtggttttttttcgtttaaattttttatttttggaatatattgtaattaaatatttatttaaggtttttttttgttatttaaaaataagatgttttatttattagtttggcggtgttttttgttttgaaattttatgtttttgagttatatatttgaaggtagttttttttggatttaaaattttaaattaatgaagttgtttaaagtattttgtcgagtgttgggagttgtttaagtattgttatataagtattgtagaggttgggtttggcgtatatatgttaggtaaagtttgttttgttttaaataattttaggaagagtttttttatttttggtgtaatttagattttaggaataggatttttggggttttttgtttggggattgtgtttagtatatatatttgggtttttgtatgaaagtttgtaaaagtatacgtgatttttttttttttttttttaattattgtatttttattttggggtatttttagattttttagtggggaggtagaggtggttgatgatgcgtttttagttagttttgtttatttttttttattttaaagggtttttattaatattatttaggaagtgttataaattttgttatttaggttatattttagattaatttaataaaaatatttgggttggagaggggaatttaggaattagtattttttaaagttttttagaagtgtttttaggttaaggttgttagtattatatttattcgttagcgcgtttagggatatattggtattttgtgtgttgatttgttgtagttagagtgataaaagtcggattttgattgtttagaaaagtaagggttttttgttgtcgttgtggagtttttagttagattttttattggaataggaaataaacgttaagtttattttaaaagtgtttttgatttatttaaaattaggaagtaggaagaattttcggggagtagttgagttttatatttgaatgtgtttttgttttttttgaattaaattttatggttttatttattattaaagaggttttggtgatttaggagggatagaattgaattgaaaatttcgggatcgttggaaaagtgatttaattagttttttattatatagggaaagttatttggtgagataatagatttcgaggttttgtatttttttgcgtgtggttttgggttgggatacggtttttatgagtagaagattatttttggttgattttgtttagtgattatttgtttaaaattttaaaaagaagaagcgtagatatagtatatttgtatttagttagttacgtaaatatttttaggttaagaataataaataattaaattagtggtttgttttattattaaattggtagagttttataggtaggaaaagacggtattttttaggttggagaaggttaagtatttttgttaaggaagattaaaaattttaaaagtttttggttgaattttattgaaattagaacgtgaatttatttgagagttagtaattaaagattcgtagaggtgatatggaatgtttttaattttgagagatgggcgttttagaattcggaaaatgatatttgttttgatatttggtatttttgttgttatatttattgtttttagtttttagtggaagtagtttgttgtttttaattatttaaaaggtaagaaaaaaataattagaaattttttaaaagaggggaaataggttttgaaagttttattaattgtaaaatgaaattaaatggagtatttaatagaagtattttttagaattaatggagaattttttagaaagaagtttattaaagttggattttttaaagtagtggaaattttaggaataaaagttaaatgtttgggaattgagttttagaagaatttttgaattggtatagattagtaatttataaaatggaatggaattattgaatgttttaaaatttgtttagttaaaatgggataataaatttagtttatatggattttgtatatttaatttgtgttattatgatatatatatttatatatatttattgttatttattaagtattttttgtgaattagggtttatattttgatatatatgattttattttgtttaattataaagatttagtgttttttatagaagttattagtagattttgggagggtcgtgttgatgattttttggtgttttgagtaagtaaaatgtgtaatggtatttgagatattgaatgtttgttaaagttgattttgaaaataagatttttattttattgtcgtgttttataaattaaattgttatttaggagggaaaaaagataaataaatgaagttaattttttttattttttaaattatgggttaaattgggtatttggatagatcgtttttaaggttattataggatattttaggtaagtattttgaaatttgaaagtatttttgataaatttttagggaaaattttgattttttggtttatgagagaaataattgttagttataattttggattggaatcgtagtttgaagataattagaattgtagtttaaatattattaaagagtgatttgtagtttagtttttttaattatatgtgttaagaatttgtgataatagatttaattgaaatgatttattgagttaggtaatatttatgtttttttaattaattataatttttaatttatttgattagtattaagtttattttagtcgataaaaggttatgggttatagttaaattgtaaatagaatatttagtaaatgtgatagtattagtttttattatggattaatattagtttggttttgattagaagaaatttttgtgcgtatttatgttgaaagatgaaataatttattgaaattgttaatgaagtattggataagttattttaaaaataataaattcgattattagtaataatataaataaataaatcgttagtttaaggtggatatgttggtttttttttgtttttaatatgttaaaattaaaattaatttttttggtgtgtggagatgttttataataatagttgttattatttttttttttttttttttttttttttttttttttttttttttttttttttttttttttttttttttttttttttttttttttttttttttttttttttttttttttgagataaggttttaatttgttatttagagtgaagtgtagtggtatgaatatggtttattgtagttttaattttttgggtttaagaattttttttgttttagttttgtaagtagttgagattataggtacgtgttattatgtttaattaatttttgtatttttttgtagagataggggttttattgtgttatttaggttggttttaaatttttgagtttaattgatttatttgttttagttttttaaagtgttgggattataggtgtgagttattacgtttggtttattgttagtattttttaataatttttttaaattgtggtaaaatgtatgtaatataaaatttattatgttaatcgttttttagtgtatagtttagtggtatgaagtttttttataatgttatgtatttattattattatttattattagattatttttttttttttagatagaaatttaggatttgtttaatagtaatgtttgtttttttacgtttgtagttttggtaattattatattattgtttgtttttatgaatttgattattttaggtatttcgtataagtggatttatatttgtgattggtttgttatattaagtatgatgtttttaaggtttatttatgttttggtttgtgttatagttttttttattttgaaggttgaatgatattttattgaatggatttattatatattgttttttcgtttatttattgatggatatttgagttgtttttttttttggattaatgtgaataatgttgttatgaacggtatgtatatatatttgtttgagtgtttgtttttaatttttttgaaattttatttttagaagtggtatttttggattttattgtaattttatttttaattttttgaggaattattatattgttttttatagaagttgtattattttatatttttattagtagtgtataagggttttagttgttttaatttttgatcgatattttttattttttggttttttaagatggttttttttatgagtgtgaagtggttaatttattgtggttttgatttggatttttttagtgattaatgatgttgagtattttttttatgtgcggattggttatttatttattttgtttttagagaaatgtttgtttaagttttttgttgattttttaaaattaggttgttttgttgttattgagttgtaggcgttttttatatattttggacgttaattcgttattagatatataatttgtaatgttattattttttgaggtttatagtatgttagatgttttattaggtgttttatatataggattttaatttattttataattttgagaaatagatattattatttttatttaatagatacggaaattgaggttttgaaagtttaaataatttatttaaggttatataattagttagtggtaggggtaggattggattataggtatgttttattttaaagtttatgattttatgtagtttggtatggatatttttttatttttttgatttatgatttttttttatttaaaaaattttttatttagaagtataataaatatattaaaatgtaaataaaatataaatgtatattttattgggttattttaaagtaaatattttgtagttattatgtaggtaaaagaaatagggtattgttagtttttataaggttatgttttttgataattatagttttgtattttttattaaaggtagaaattatgttaagttttatggtagttaattttttattttttttatatatttattatttaagtatgttattttaaatgatataaattagttgtgtttgttatttaattttatgtagatgaaattgtagtgtatgtagtttgtgttttgggttttatttgtttatagttacgtttgtgagattttatgaagttaaagtttgtttattttttttgttgtattttattgtgaaagtttatttattgtatttatttattttgttgtttttgttatgatatataatgttgttgtgaatattattgtatttgttttttggtgttttgtgtatatatttttattgggaatatattaaatagtgaaattgttgtagatgtaatgttatgtatgagagtttttgttgttttgtatattttttaaatttagaattgttagtttttttaattttagttattttggtatgtttataggagtattatattgtgggtttaatttgtatttttttgattatttattattaataatttttttatatgtttatttttttttagaacgtgtttatgtaagttttttgtttattttttaattgttttttattttttatgaatttgtaggagttttttgtagtttttggttatgtattttttattaattttgtgtgttgtaaatatatttttttattttgtgatttgtttttttagttttaaaatagaattttttgatgaaaagaattttttaattttgatgtaattttatttattattttttttttttatggttggtatttgttgtgttttgtttgataatgttgtttattttaaagttatgaagatttttttttatgttaatttttaaaagttgtattatttgttttttatatttatatttatataatgtatttggaattgagttatatgaatgttgtgaatttgggaggggcgtgtttttttttttttttatatggatatttaattaatttagttatatttattgggggaagatatttttttttttaatgcgttgtagtgttaggttttttaaaatttaggtgtttgtatatgtgtgggtttgtttatgagtttgtttatttttttttattggtttgttttttatatttgtgttaatgttatattgttttatttatagttttataagttttggtattgttaaggaaaaatatttgtaatatttgttaaaaatggtagagaagattttatttaaggaggggaatattgtgataggtagagggattgttgtaacgaggttttgttgtggtgaggagagagattgggttggagtttaatttttataaggataagaggggatttatagttaagtagtagggtggggttagtggatggaagaggaaatattagagataggggtatttttgttagattaatttaatagaatttttgttgaaggtaggttagggtgataagatattaagagttaggggtgaggatagatattaagggtggagaatttttattaaaattagtaggatttttgtttaaattggattttataagatagaaaaggaagtttaaggttagggtttagtggaagagaaggtttcggggagttcgatttgagtttgatttaggagagtttttgttaatattttgtagaatatgatttttattttatttttttttttttaagtgtatttggattgtatttggttttttgggtttttaggtgatttttagagtaagtttattaagatttataaaaatagttattgagattttgatttgaatagtatttttttttgataatttttgagtaaaatttattttaaggaagtaggaggggtagtggtttgatgaaaagtaaaaatgaagaaaagaataaggaaagatatagttttgttattattagttagtgtttagtgattttaaaatagttgtttttgtttttgagtattatttgttgggtatggagttgtagaagttgggttgagggatattggtttttagaattaaatattggtttttatagagtgtttttgtatagtgagttgggaggatgggtaggggttattgaggattgtggcgtgtttttacgttagagtgtattttatatagagtttgttttgaaaatatagttatttttaaaaagtgttttttttttttttttattggttatttttttttttattattttttatttagtaaagggtgggtatgagaaatttggttagtggaagagaaagttattttgtaatagtggttataggggtgggagagtaaaattttttggtttttggggaagttaagtttattggtaggattagatttttgtatgtgtgtttttttttttagttatttattaaggttaataaatattttaaaaaaaaaaaaaaaaaaggatatgatttttttttgttatttaggtaagtgatttttttgttttagttttttaaggtattgggattatagttatgagattttgtattggtttattaataattttttttttatatagagatagggtttcgttaggttggttttaaatgtttaattttgagtgattttttttttttggttttttaaagtattgggattatagatatgagtcgttatattcggttaagaagtgttttttatgttttaggtattgtttttggtgttggggaataagatagataaaatttttatttttatagagtttaattttagtattagagatagtcgagaaattattaaatagaagatgtaatgttgagttttgataaattttataggaagaaaaaggagagttagggatagaggaagggaagtgacgaaggagttttgtggatttttgagagaagagttttttagatagggggtaggtggagggtttaggataaaggttgggtatgttaataggggagaaagaggtattgtagtgggagggagggaaagtggcgggaaatgagatggaggaaagtagttttggttagatttaaaattttattttttatgatagatatttagtaatattttttttattttttaatgatgaaatttgtagaaaatataatttatttatttatattattataaattatttatataatgttttaattgtaatagaaaggaagtataaaaggggagaaatgtattatgaattaagaagtattttatgattatattggaagatataatggtgtggttatatgttttgtatttatttgtaggattattgtaaacgtggtagttataaatttagatggttgtagatgtgttatattggttatttaaatgatataatcggtgttgattttagtgatgtgatatttttgaaatggtgaatacgtgttagtaaagttttaaataaaataaagtatattattttttattgaaatttagtatttatgaaaattatggaggaaatttttgtgttgataggtaaaatggcgtaggttttttagtttttttaggggagattggaaagttttgggggatatagaatatttgtggtttgtgttagattattttatgtattgtaggttgtttagtttgtttggttttattttttaaatgttattaatgatttttaattgttttgtgattattagaatagtttttatggatttttagatgtttttttaagtattttgggttttgtttgtatgtaatgagaagttagtagatagtttggattagggaagtgaagtgatttaatttaggttttaaagagatttgttatttataaaaataatgaaggggaggttgaggtttttgtgttatttagtaaggattcggtttttaagagtgagttgtagaggtattaggttgatttttgtttgttttaagtttagatttatttagaagtttgtttttttattttagagttatttagattatttattagaggtttttttttaatgaggagtagggtgggggtattttatggtgttttttgtgttttaaattttttataataataggtgttggttgttatttgaagtaggttttaattattattttttttttattatatatatatttttagtttattttgatttttttttttgtaataaataatagatttttgtaaagtggttagaagaaattagtaagttaagttttatattagggttattttgttaggagattttttttttttaggtaattttttttattacgtgggtattttagtgggatttgttgtagtttgcgttagggtttgtttggtttgtaagggttggttatggtagatgttttttttgtaattggaattttttatgtttggttttttagatagtagagagataattggataaattttaaattggaaattataaataataattattttgttagtttatatatgaaattatttaagtaagttttttttatttttatttttcgataatatgaagtttattattcgtgatattcggggtatttttaaaatgtgtttaagaaaagggttacggttgtgtagtatttagtattagaatggaaatatttattttaagtttttttttattttttggttattgagaggtttggtttagtggtttcggggaggataggaaggggagagttattttaatttgttgttgttgagtgaaggtggggtaggagtgaaaggtattgttgttgttgagtgtgtttttatgaaatttaattttatttaatatgatttttagtaatttattggtttttaagttatataaattttgatcgaaaattattttttttttttttttttttgagatagggtttgattttgttatttaggttggagtggtgtagtggcgtgattggttttttgtagttttaagtaatttttttgttttagttttttaaagtatagggattatagatatgagttattgtatttggttttgatttttttttatataaaaggatattagagtaaaagagtgaatatgtatattatagtggttaaataaatatttttgtaggggttatatataaaattgtgaaggtagaatttatttttgtttttagatgtgttggttaataggtgtttgggttcgtgaatgtaggatttaaatgtaatagtagtattatattttatagcgtgtgtatagttggatttagaatttttggttttaaaaattaagtttttatttatatttatttattaggttatcgaatatttggatttaattaaatgtttgaaagtttttttatttgggggaaggtgggtttggaggtagaaatttttgtagattttatattcggggttttattaggtttttcgcggtaggtggaaggaaagtttgttgttttgtagtttcgtttgttttaaaaataagggtgggaagggtttattaattgatttttgtgtatatttagtgtaggaaaagtgttatttagagtattattataaaatcggttgtatatggtggtttatgtttgtaattttagtattttgggagtttaagatgggtagattatttgaagttaggagtttgagattagtttggttaatatggtgaaattttgtttttattaaaaatataaaaattattcgggtatggtagcgggtatttgtaatttttattattcgggaggttgaggtataggagaattatttgaatttaagaggaggaggttgtagtgagttaagattgtattattatattttagtttgggtgatagagtaagattttattttaaaaaaaaaaaaaaaaaaaaaaagagtatttttataaaagtttgatttttatggtagatggatttaattaaggtttattagtaagttttagatattagtatagtataggaaattatcgtagaggtatgtaggagttatttagatttggttaatttagaggatagagagaaaaaatattttttttttttttttaattttaagggagatggaaaataagaagatttagagttttaagaatgaggattgaggaagtataatgtaaaaatggttttttgggtttttttttggaaaaaaatgtttagagagtttttaaaagtggttttttttttttttttgaggaatatgtgtttttatttttttgtgaagaatattattttagtagttttattttatttgtttatttttttttttaatattaatttgatttgagatgtttgtaaagattaagtaataaaaagatgttatgttatttttatttgttattattatttgtgaagtttagataacgtagtatagatagagttttaagagggaggagttaggcgtgaggttttgtgaggggtgggtggttaggggtgtagttatagtttttgattataaattatgatcggttagaattgggaggaattttaaagtcgttaggtttaatttttttattttatagatacgaaaaatgaggtttaaagagtttaagagattgttaagggttgtatagttaatcggtcgatttagtaatcgaaggatagatttgagtatttttttttaaagtataggtttttaagttttttattattgttagtttattttggtttgtttttaatttttattattttagttggtaagtgtaaattgttattgttaatgtgttttttttttgaattgtttgtgaaggatttttttttaaaggagtcggtagaagggaggaaagttggtggtatattatatatttttacgttgagatttaatttagaacggttttgggagtttttcgtcggttgatataaggtaaagttttagttttgatttgaaaagtttgtatgatgtattttttatgtgtattggttgattggttttgttggaagatttaattaagagaaagtatttcgattttggcgttagttttatttatgagtttattttatattttttatattttgtttataaaatttgttatttaaaaatttttgttttatagaaaatggatttgattatttgtattattatgaaaattttgttgtattattaaatttttttaaaaggttaaaaagttttttttttttttttaatttttgtttttgttgtgattttagattgggttgtaaataagttataatgtgaatggattattaagagatttataatagaagtagttttagaaatagaaattgaatttataggtagtgagataggataattagtttttatatttaaaaatatttttagattagaggagtttgttgttttagatagagaagggaattgagtttgaattttaatgttttaagtaatttagtagaaattgtttgttttatataaaatatatacggtagtttgttgtgtgtgtatttatgatttgtatttttatatttttttttaaatatatgagttaaagtgttagtttaagtttgaatatttagattatataaattatttgtatttataatttttagttttaaatgttgttgttgatatagttaaagataatttgattggttaattattttttttttttttttgagtggttatttggagtttaaaaattaaataaataaaaaatatttttgttttttttatatggagagtaagaattgtttcggatgtttattcgaagttttttgttttttatttaattattatgtattatagaatgtataatttaaaatgttttatgtaggttaaataataaaagatacgagaatattaagtgtttgttattgttaaatatgtgtaaatttaatatattttttgtaatggttagtgttttagtcgttgatttttgttattttgaattggtagaaattagattttggtttgggattttgaatagatattttttttagggttgtattataatttttgggagggtattttgtttgaaatatgttgtttttttagtttgggttagtagggatagagagaaatagtatttgttagttgggttgaagtttttcgtatatggagttagttattggttttttgttgagggtttagttaatgagatttgattgtttgtggtatttttgtttttattaaaaagagtttaaaaataggatgaatttgaaaataagaggaagtggtgttatgtttttttatgattttagttttagtttgtttttgagtaagggggaagtagaaggaggaattttttacgtatttgtacggtggtttatattaggggtttattaattttgggattttgtttttttttttgttttttgttataaatttttgttttaaaggaaagaaaggggatggttgttaaagtataaatttttaggttagtttttgttatattagattttaagatgatgtttaaaattttttgttgaattgaaatgttagtttggtttgaaataattgagttatttattgtttagggatagaaaatttttttgttgtaaagaggtggttggttggttggtgtgtggttttgtttgtaaatatagaaagtgggatggggattggaatagtattggttttgtgggggttgaatattgaaagtagtaaaattggatgtatttaaaaattaaagttgaatcggcgagtttatttatttttttagagttatttttattgagatataattttttttagttgtttgaagtttttagtattagattaagtttttttttttgttttttaatattttttttgtttgtttgttatttgtttatttttattgtaaattgttttttatataatgttattcggtgttaattagaatacgtgtttttttgttatttatttggagaaggggttaatgatgatttatgtttttttaattggtttttttttaaattgttaggtttaatttattattttataagaattttaagagattgggaaagaggaagagtgtttaatttttattttttatgtttttaattatatattttttttgttttaaaaaagagtaattttggtttaattattttggtgttttaaaagtatggttttttggttaggcgtagtggtttatgtttgtaattttagtatttcggaaggtcgaggtgggtggattatttgaggttaggagttcgagattattttggttaatatggtgaaattttatttttattaaaaaatataaaaattagttaggtgtggtggttatatgtttgtagttttagttatttaggaggttgaggtataagaattgtttgaatttttgagaggcggaggttaaaatgagttgagatcgtattatcgtattttagtttgggcgatagagttagattgttttaaaaaaaaaaaattttttaagtttttattaaatgataatatatatgagtatgtatttattgtttattagtgaataatttattagttaaatttgttagtttatttttgaataagtaatatgttattatggtttaaaattgaaaaggttttaaaaggtatgtagtgatttttttttttttttttttattgtttttagatttttattttgggaaaagggtttttttttcgtagaatttatgttgttagggttttgtgtgtatatatatttgtatttatgtatatatatatgtgtatagatggatatatgtataggtatatatatatgtaaatattttttttttttttatgtagagggtggtaaatatatatgttgttttgtatatattttttaaatgtattttggaatgtattgtttatcggtaggttaagagttttttttttttttgttaaggttatattatattattgtatgatgatttattaattattttttgattgatagatatttgggttgtttttagttttttttaggatgaatagtgatttagtgaatagttttgtattatattattttgtatatttttaggaaaaagattttagaaatggaattgttgtagttgaaagtaagtatatttattatttcgattgattttgttaaattgttttttatagacgttaatagttaataattttgttagtaatatgaatattcgttagttttttttatatttgtgaaaatagtaggtgaaataatgattttagtttatggtttaatttgtttttttatttattttgagtgatgttgagtataatgagtattttaaaggaaaaaagataaatttttgtagttagatgtatatatatatattttaaaggtggaaatttgtttgtgtatttttttttttatttttttaaaatattaggaaattatatttagtttttagtaaattagatagttaatttttatattggtgtgttattaatagtaaatatgttgtaaatgttggaagatatttaatatttttttttatgtgattattaaaaatatattgttgaaatttaatttcgattgatattattttttaaaataatatattttaaattaattaaattaagttttgatttgtaagggtatattatatgatattttttaagatataatattttaagttaattaaattttgatgtatgttgttttttattaaaagtatatagattatggagaatttattaagtgattgatatgataaaaaagtaaagtttttttagataaaaatggttattttttttttgatatttttttatgggttgagatttagatgaaaattttttgtggtaaattttaatgattatttttttaatgtaataattgaatttatttagatgattttacgttttttaatagagaaaggtgagagtttgttatttgttaggtttttttgtttatattttttggtgggttttataaaagttttatgaatttttataagtgggaaaataaattgtttattttttggtatatcgaattttttatgttatattttaaaattgtaagtttatattttatatagttaaagattaatgggttaaagtatggtgggttatatttataattttagtattttgggaggtcgatgtggtaggattaattgagtttaggagtttgagattagtttgggtagtatagtgagattttatttttatagaattttttaaaaaattatcgattatggtggtgtgtatgtatttatagttttagttatttgggaggttgatttaggaagattatttgagtttaggaatttgaggttgtagtgagttatgatgatattattgtattttagtttgggtaatagagaaagattttgtatttaaaaaaaaaatggaaaaagaaaaaaagatcgaataataataataatatgtaatatttaatatttttatggattgggtattgtttttttttttttgtgagtttttgtttatgttttttttaggttataaaaagaaagtttgtttggtaaatatgaaatttgaaaattgattatttgttgaattataatagtagagatttatttttgggataaatatatttgttattgttataaagtttgtgaataatatttttgttgtttagttatgaaattaataaatttttaaaatgaagttgttttaagtgtgtaatggtaattttgaattgttaaagtattttatattgtcgtgaaattaatgtaaatttttgtttagaattagatttataaaattttagagttagaaggaggtttggagatggtttagtagttcgttttaattttataagtgaaaaaaattgaagttggggtaaggttaggaatatgttagtaagtgagtgaatgagtgagttataaagttggtatttttgaattttggttttagattttatttggttaaattgttttagaaattttgtttaaatatattttttttgtagtggaagaatgtatgtttttttagaaattagttttaaggttttttagtaaaattatgtggtaggttatttttaattgggggttggttttgttgaagatagtgagtataagagaaaattatagaatgttttttttaagaaatatttagatagtatttatgaggtatatatttggtgtttttttttttttttttttattggtaggttgtaaattatttttttgttggaaaaataaggtttttaggttatttacggtggtgtgtagacgtatatatataatagtgatagttttttagtggttttcgttatgcgtgaaaagagatgtaaaaggaatgtaggaatgttagagaaaataaaggtatcgtcgttgattagttgggattgattagagatgggttattttacgtgaagtatgtaaggaaattttttgtaaagatttttattatatttttaggaaggaaggaagaaagatagaagagaaaaatagagaaggaaagggaaggaagaagggagagagggaggaagagaaagatagagggaaggagggagagagtagggatttatttgtattataggtagtatattttttttaaagttttttttgtggattagagggattattggtggtagtttttttaattatagtttagaatttttagtattaaaaatttagttgatattttttaaggatatatatttattgtaggttttttatttgaaatttagatatatgtagttagttatagattatttataagatgttttaattttaataaatttgggatttaatttattattttatttttttcgttattttttttgtttgatttttttattttagtgagttgtattatagttttttaaattgatgaggttaaaattttggtaattatttttaatttttttttttgttttatttttagttattatttaggttaaatagtttagttgattgtattttttttgtgttttttttattttattttttgtttgttgttattgttttagtttatagttttattattttttttttgagttgttgtaataatttttagttggtttttttgttatttagtttttgtttttttttaatttgtttttttgatttttgttagagaaatttttttaggaaaatttatttaagtacggaatgtttttgtataaatgttttatgggttgttgagtatttttagagaaattgtcgtgattgatttacgtttttattttttcggttttgtatcgtgttgttttttgtttttttaggttttgtgttagttatttaggttttttttagtgcgagtatttttttattttttgatttttgtataagttattttttttgaggagtattttttgttttttttgttttttttttttttgtttaatttttattgagttttttaatttgattttgagggtattttttagagatgttttttttgattaatcgagtagatttatttaataaatatttgtataaatttattgtgtgttaggtattgatttaaaggttttatatatatttttttttttatttttttaaattttaggagaaagggaggattttagtttttattttatggatgaggaagttgagattttgtttgagtggtgaagtagtttgtttaaggttatatagttttgtgggttagaagttatttttgtttttgtgtggtttttgattttgatttgtatgtagtataaatatatatatttttgtgtgtgtgtgtgtgtgtgagagagagagagagagagagagagagagagagatttatgttttaaattggtttcgggtttgttatttgtatatttaatatataataaattatatatataatttattttttgaatagataatagaagtatatattataaaatttaaaaaatataaagtgtatatagtgataggagtttttttttttattttattttttatttttttttaaaagtagtttttgttatttatgttttgtgtatttttttagggatatttataaatatatatgtagatattatgtgatttttttttatatttatgatagtttattttgtttgagatttttaatttgttttgtttgattaatagtatattttggggtttgttttatattaatatattaagagttttttttttttttttgtgtttatataatagtttattgtagggatatattatagtttatttaattagttttttttttggatatttaggttgtttttaaatattttttagtataattagtgtcgtagagattagttttttatagatattattttgtatatatacgagttgatttgtaggataaaattttggaattggaatttgcggttaaagggtaggtgtatttataattttgatagatagtgttagattgttttttataacggatgtatttatttatttttttattagtagtttatgagattgtttttttttttttagttttatttttgtttatataataaaatgttttgatgtttatttttttagtatttttaattagttttttttttgttatgagtcgttatgtattttttaatgtgtttatgaattattttgattttttttattagttgatttagtattcgttggttttttttatattgatttataggtattttttatatattaaagaaatatattttttgtttgtgatttatgttttagataggtttttggtttgttatttgttgatggtgttttttttttatgtagaaaatttttatttttatgaaattagatttattagtttttttttttttatagtttttggggtttgagttatagttaagattgattttttttacgtttaaattataaaatttttttttatgtgtatgtatgggtgtgtgaggttgttttaaagaaagaagtgatagagtgtaatcgttgagaaaattaattgtggagttagattgatttaattgttttggttttatttttatttttttaattttggatgaaatgtttaatgggttagtaatatttatattttagggttataggtgattatgaagattatatattataatataggaaatcgttttgtattaaattattgatagttgtttttattgtgttattttttttaagtttaataataattgtataagaataagggttttttttttttttttttttgttttttttttgttattgtggttttttttttttttaaattttgttgttagtaagattttagcgtggtgttttgttgatgggattcgagtgtttattttgattgttttattgtttattttgattggcgatagagaggtttggagttttggttggagttatttggagtgttataggtgtttttttatttgttacgtagttgtttttttagttttttgaggattttggcgtttttttagattttggtatttggtttttttttatgggttatcggtgagagttcgtgtttttttttttgggttttttgtagttttttgttatagaggttttatttcgagaggatttgagatagcgtattttttatatgggtgttttgtaaatatttttgattaaagaagttaggagaagtaagaggtttggggtgttatattgattggaagagttataaattttttggttattttttcgtttttattgattatataggaaggaattattttaaattatgtatttttttagtggatgatttttttaaaaatttttacgatgttagtttttgttaatatttattatagtttttattgttatggattgtaattttttaaaaatatttaatattatgtaagttgtttaaagatattagtaatttggagatagtgtagggaatcgggttgtgattttttggtttttatttgtttttgttgtttttttttttttttttttgtttgtttgtgttttttttgtatatttatttttaataaaggttttttgaaattttaggggtaggagatatagtggagtattgaggtaggttattttatatttaattttgttattttttggtcgttaattaaaataatgtttgagtgttagtgtttagttttatagggggtgtgtaaaatgttaattataattgatttgaagtatttagtttagtgttagggagagggtttagggtataggtagggagtatgttattaggaaaaaaataaattagaggaaataaaatattttgttgttttttaaaaaattttaatatgaggttttattatgagtaaatatgaaggaggatgtgaagacgggtaaggtgtagttcgcggatttaaaggcggggttatttgtatgttgagcgttttattatattattttatttaagattcgtagtaggttgggcgtggtggtttacgtttgtaattttagtatattgggaggttaaggtaggtggattatttgaggttagacgttcgtgattagtttggttaatatggtgaaattcggtttttgttaaaaatataaaaatgagattcgtttaaattcgggaagtagaggttgtagtaagttgagattgtattattgtattttagtttgggtgatgagagtgaaatttcgtttaaaaaaaaaatttgtagtagtttagaaggtaggttttattatttcgattgtatgggtgaggatattgagttgaagaggagtaatttgatattgattttattgtatagtggagttaagattagatttaggggatttggttttttagttttattattttagttttattgtattattttttggaaatgtttagtttagtaaaggagagagtgatgatgtaatgatgtgattgtttttagtgaagagtaaaagtaatgaattagaaacgggagaaatagattgatatttttgagttgtttttttggttagggtttttgggtttttgttttgtaatatagtttaatgtggtggttatttaagggagaagggttatttattagtttttttgtttttttatttttattttaattaaataagtttttttaggattttatatatttgtatgtaataaaataggttttaaaaatttgtagttaaggagtattgtttgtttttttttggtaataattttagtggaagtaaaattatattggattgtttgaaattttgagtttaaagcgttaatttttgaaaaacgtttgaggtttttgagttttcgtggtatgttattagaatattttgtagttttaataatttttagtttttattttgtattgtatttttcgtatatttaatatttattttatatgtttggggataggttagtttatcgtttattttcgttgttttttaggttgaggttttttgatgagtatagtttttcgggaaggattttagtttttttgtgaaagtttttagttatttttttttttgtttttagaagtagtttttttattttaatttgaaattttgttgtattttttagtgttttggaaataaaatgtgtagtaggagaattttggttttgtggatattggattattttgttttttggtataataattttttttttgtattaaatatttgagaatagaagttttaaataatatttttatattttttgttgatgtaagttttttatttggggatagtagtttggtatttgtttttttgttaaattttgatgtatttttttttttttttatgatgaggatattattgatttttagtttggaattttattttgggtagtggtggtatttgtttatttcgtgggatttttttgttgaatttttttagtttgtagtgagtggtttgtgttatagtgggatgtttgattggtcggagtaaaggtatttaattttttagtttgattatgagttgggtggtgaattagttagttataaataagttagatggatagatagattaaaatagttatttgtttattttttttttggaaatgtagaagggttgtttcggaggtttaagaagatttaatttggttagtaatttagtatttattttgaataggaggtggagttgtgagtttggtataagttttttattttcgattttttatttttattatatacgtttgtatattttaaggagatgattagttatattattaattattgatgggtaataaatattttttacgttaaagtttttttgatgatttttttggattttgtatttgtataatgaatgtatttgtgtttttattttaaagaaaattagtatatgtggttgggtatagtgatttacgtttgtaattttagtattgtgggaggtcgaggtaggtggattatttgaagttaggagtttaagattagtttggataatatggtgaaattttatttatattaaaaatataaaaaaattggttgggcgtagtggtttatgtttgtaattttagtattttgggaggtcgaggcgggtagattatttgaggttaggagttcgagattagtttggttaatatggggaaatattgtttttattaaaaatataaatattaattgggtatggtggtaggagtttttggttttagttatttgggaagttgagataagagaattgtttgaatttgggaggtagaggttgtagtgatttgggattatgttattgtattttagagcgagattttgttttaaaataaaaaaaaaaaaagaaaaaataataataaaaaagaaaattagtatatgtgttttattttttaggtaaatttaatattatataaatttagttttttaagataggataggatattttattttttagaaaatgtataattatattttttaaatggcgtaggtagtataatataaatatggtttattttttaagatcgtttttatttttatgtgagttttaaagtttttttttttttttatttatttaataattttacgttgagttgttttatgggaggaaaggttgttttgtatggtttttttgtagttaatgaaatgagtagttggttttggtgttttattattttgggttagagatttattttttgttttttatttttttagtgaatatttagttcgtgttttttatggattaagtatcgtgttggtttttttttatttgttttgtttttagtgggagtagttggaaggatgttgatggtttttttttttaggagaggaagggtagtgttttatgttatttataattaagtagttagttgtcggtttttggaaaattagtttattaaagggaagtattgagtttgaggttttgggatgggttggatttttttttaagtggaataatattttattttttttgtttaatttttttttgtaaattaaaatgggaaaattattttatggataaagttaagtagaaataaaaaatattttttttgaggtagtttggtagtatttgtatgaattagttagtgtttggataagaagtagtttttcgagaaggaatggagtttttttttggattttaattgatttttgtatttgtttttttttttttaattttttgtggaaaagtgatttgtattgtagagtggttttaatatattatgggtgttgttttatgtaatattgtttttatttaaagattatttttgtttgttttgttttatttttttttttgatttagtttatgtttgttttttttttttattttattttttttttttgaaggagttattgttttttttattttttttattttatttattttcgttatttgttaggagaataggagaagatatgggttatttttttttttttatttttaaaattaattggttagatattatttttttttcgtgagtttgttttataacgtagagttttattagtaacgaatttgatttttaagaagttgggttatgtttatttttagggattaaggtattgttttggtttggttggttttttgttgtttgtgttatcgttcgtttttgttgattagggcgtgtttggtttatggatagggtagttttttgtagaggtattttgttgttagggaaagttttatggattagtaattgttaagattttttttgataaaatgagattttgaagtttttaattatgagttttaaataatttatataataaatttagaatttggagatttaaaagatattgttatgtttttggttatgttgttagggaattatgttttcgtttttaaatgatatattgttgtgtgtgtgcgtgtatatgtgtatgtatgtgtgtgtatgtatggaatgaggaaaattaggtgttttatgtttatgtattgtagtgaaggttatagtgttgttaggtttttttgatggatattataatttaaattatagaatttgtttatagtagtgtttatgtgattaagaaaaaaaaaagtagatgaaaagtagttagacgtgtttaaaatataattaatagattaggtttttggaatatttgagtttaagggtttggttttttttataatatgttgagaggtgatgttttaaaagtaaaaacggagaaaaggttagttgtggagaatggtaattgagataattagaaagtagatgtgtgtaattgaatgtagttagttttaaatggatttatatttttttttgtatgagggtttggaagggagagtttatagaataaaaatggagttattttattttttttgtttaatatagatttttatatatagcgagtatttgaattgtgatttgtttttttattggcgtaatttttatttgtttttggaagtttatttcgaggtgattttgttttttgtaatatggaatgggaaaatatttggttgagtttagacgtttgataattacgtaggtgggtaaggtaattattgggatggttggaaggtgttatttagggaaattgaaggttaggatgaaaataaaagtaaacggtttttttttgggtaatgattgttattaggattttgttgttgataaaatgttgtttttttgttttgttttttgcgtgtttatttatatgatagttgttagatattttatttagtttttatttatttggtattgttttagtgttaattaacggtaaggtgttttttagttgttatggggagtcgggtataaatagattttagcgaagttttgcgtgtatgtaaattgcgtttgttttttgtattttgtttttttttcggggttatgtttgggatatttatacgttgttcgttttttttttgtgatgggggttggtgtttttgtattaggtttttatagttattaatagttttgtttatgtgggaggtgatagtaatattttgttatattataggttgtagggtttaatgtgaatattttttttagagtgagtaaagggtatgggatttttgacggttagggaagttatagtttgtattatagtgcgaagattttttatttgggttatggggagtatttagaatgtttttttatgggtttaataaaatgtgatgaataaatgtttgtggtgaagttttattgtgaggttttttgattatatgtaatataattattgaaatttttgttaggtattgttttgtatttttatttataaaggaagttagtgataagtttattattgttttttgttttttttttagtcggtttttaattatttaagttaatagagaaaattattattatcgatgacgtaaattcgtaaaaagtttaaaaataatttgtgtttgattttgagatggagatggtaggtatgtgaataaaacgtgttaagatatttaggttattttgaggtttaggttaatgtttttttaattcggttttgttttttttgaagtcggagatcgtgtatagggatttgggggatcggagggtaacgttagagaataagtggaggaggtggttattaatttttagagtttgttatttattatgaagaaagttggttaggttttgttttgataatattatatagatattttatattttttaaaagatgattagagtgatatttgtgtggttaaaaagttaaataatatagaaggtttttaataaaaaataatagttttgtttgggttttgtttttttttggttttattttttagaggaaatatttttgaatttttttagttttgttgaaagttttttgggtggttatttttatatttttaaataatatatggtagtattatttgtattagttttttagggttgttgtgataaaatatcgtaaattgggtggtttaaaataatagaaatttattattttatagttttgagggttggaagtttgtaattaaggtgttagtatggttatatttgttttgaaggtttagggggatttattttttattttttttagtttttggaagtgttatcggtttttagtttgttttttgtgtttttgtgtgtttttttttatatggtatttttttttgtttataaggacgtagttttattgggttagagtttattttaacgatttttttttaatttgattatatttataaagatcgtgtttttaaattaagttatatttataggtattggggatttgaatatattttttgaggggatataattcgatttataatattatttttttttagtttattgttttttttttatagttaatggggtttttttttttgatttagtttcgtttgtgtttttttttagattttttttttttttatgtttcgtttttttatttaaaggatattgtttattttttaaataaatttttggaaattttattttttattttgttgattttagagagtattatttaattatttatttaaaaaatgaaagtatttattttttcggtttttattttttatttttgagtttttgttagttagggttaagtttgatgttattcgtgttttttttagttttttgaatggttaaattttttgttatttgtttttagacgaagaatggatatttgtttatagtttttattgataggatttgaaagttgaaaattaataaatagtgttatcgtgattttgttttttggattattatatttttgtatgttttttgggttttaattaaaatattttatattatttgaaaaatgatagtataatttttgtttgtttagtattttagaatttatatttatttgattttagatggtagtatattttgtttgttttgaattgggaaattgtttattcgttttttttgatgttttttggtattatatattgaaatgaggttttgtgttttataaatgtttgattatatgatatagtagtcgtatgggtttttttgtgagtttttagtaataggtaagttattttaaggtagtgttagttaaattttggattttaatgttttttattttttttttttaaagattaatatagagatgttaattttttattttgttagaatgggatattaataaattagttattatttatttttattggtaaaataagaatatttaatatgaaaaataaaatagtaaggatataattttggaataagttatataattttaaaaattttgaatgaatttaatttttaaagaatttattatttttttttattttttttatttggtatagattggtgaaaatattttgaatggaatggttgttttagattaattttgtttagtggttatgtgtttggttttaatagagtagaatatattgttaatgattttgtttattttgtagatggttaggttgattgattaggatttggtatggaagatgtgtaggagaagggggtaggttttgtgtgaagtgggagagttggatcgttttattttgtgattttaaattgtaagtagaattttatattttttgttatatgtttttagtttaagttatttgtaagttgagttagtttataaatttttgtttaatatgtgttgtgttgggtatgaatttaagtagatatatatagatttgttatttttatatatgtagtttttgagtaagttacgtttttattgttttaatttattattataaagttggtcgggtatggtggtttacgtttgtaattttagtattttgggaggttaaggcgggtagattattcgaggtcggaagtttaagattagtttggttaatatggtgaaatttcgtttgtattaaaaatataaaaattagttgggtgtggtggtgtatatttgtagttttagttatttaggaagttgtggtagaagaatcgtttgaatttggaaggtggaggttgtagtgagttgagattatattattgtatttgagtttgggtgatagagcgagattcggttttaaataataataatttttttttataatgttgtttttttatatatattttattagtttgaggtaatataattagtaaaatttaagtatttaattaatgtataatgatattatttttttaattttttttgattaaattaagtttaaaatggaatattattgattaaatgtattttatcgattatatttgattaattaattattaggtaaaattttttttttttttaaggaagaagagattgggattaagattggttattagttatatttttgttatattgaattgaatttagtttttagaatgttaatgttttaataggaagttttgtgaaatttttttagataagaagaaaattaattttttatttttttttttttggtaagaaatgtttgtgtgtgtggcggggggggagggttgtagttaattataggtgattttaatgatggtaatatatagtatttttttaggattatgtggtttaaaatatcgatgaggttttttttataatatttttgagaggtatttagatattgtttttttatgtttttttgtataggggaaatttaagatagattgaggttaagaagtgagtagtttaagtttagttagtaggttaattgtaaagtgagaaaaggaagtttagtttttttaaattatattttttattttggttaatgaatagtatttttttgagtttatatttttaattttaagattttattttaggttattttattttttgaagatttgaatatttgaatgaattagatacggttttttaattagaagtgtagatagtcgtgttttttaaggttttattgtaaggataaatgaaggtggtgatgtttttgagtttttgggatataggttagtttttagagaggaggaagtagttttgaattagtagtatttttgagtttgatttgtttattagaagtaatggtttggatagagttgtttatattgttattttattttattggtgattaggaatatatattatagaaaagttatgaattatgaaattagagaaggtgataagtgttggttttatgttgttttagttttgtgttatttaatttttttggattttagttatgttattagtaaaatggaggttatgatgttaattttttttcgttgttttttattttttgatttttttaaatgttttttatcggaattaaattggtagtcgtatatttgttaggtttatgtatatagtagtgagttttgtaatttaaggattagatttaagtatagatagggtttatgttttgtagttttgtatttttttttttttatattttatttttgtttgtattttatgttatttttggaagattttatatgttattgtttttttgtttttattgaatagagtgtattattcgtgagtttttagtatggtgttttttggtaatttatttgaagatatgatttttattttggttgaaatttaatattttatgtgaagaataaggatagtataatttaaaattttggattattgtatatggtattttttttataatttatattttaaatacgtgtattaatttataatataaatatatggatgttttaaataacgttgggttataaaaaattggtattgataattgtgattttaatgatgagaagtatttattagaagaagaaggaattttattttttttttttaaggtagggttttgttttgttgtttaggtttgagtgtagtgatatgattttagtttttgtaatttttgtttttttggtttaagcgatttttttattttagttttttaagtagttgagattataggagtgtattattatatttagtttttttttttttttttttttttttttagtaaagatagggtttttttatgtcgtttaggttggttttgaatttttgattttaagtgatttattcgttttagttttttaaagtgttgggattatagacgtgagttattttgtttggataggaagaaggaattttgtttaagtatatttttggttttgtttagttatgttgtttatacggttattgttataaagtagaaaagttattaggtatttttttatttttgaagtaagtattttaaatagttgagagtttgtggtatataaaaagaagtttttttttatgttaatgtttttaaaataagttgtgatttttgaaagtagagattaaagaaagaataatttgaataagattttagtgggtagaaaataaatattaattttatatgtattttaagaacgtaaaagaaataggtgggaaatgaatttttttcgataagagagaaatgtttagtagggtggaaaaaaaaaaaagataatatttagtagtttttggaattgtgcgagtttagagagttttttttttttttttttttttttttttttttttggttagtttttatagttataaatatgtatattattttttttttgtttataatttattgagaattatttttttaatatattggggaattttaaataaaaattttatttttttaaatatagataagttttttaatttttgtaattaaatgatttaattatttatatgtagattgtaaaagaaataattaaattgttttagtagaaatttttaacggttattttaaatagttttttttttaaatttatattgtaaacggtttaggtttagggaggggttttgttttagttattgatgttttgaaataggatttagaaattttttttataaagtttttgcggtgattgggttattttagtaatgtgatatagtggtaggattatagaatattttaatttttttttgaatgttgtaatatatttttatatgggaaatgattgattattaattatttagaatgtgttttttttttaagtatgttagtagagtaagtatagtagatttcgtaggcgattagtgtagtgttaggtgtgagtagtatggattggagatggtttgtttggatttaaatttttgttttgtttttttttatttaggtttttttggggttttttttgtttatttgttaagtgttacgtattatagtattttttttatagggttgttgtgagttttaaatgcgtttatgagttaattgtttagaatagtgttagttatgtaataaatattacgtaagtggtagttatattatgtataaataaacgtaaattgtgtgtatttgaggaataattttagttaatattaaagtgtgtttttgtgtatagagttggtgtttgttgtttgtgtatttattttttaaaaatcgggaaatagtagatgttaggaatttatttattttgtttgtttttttttttattttttgtttgttatttattttattttagttttagatttgatttgtttttttgtgtagggttgtttttatgtataattaatgtagaattgattttattaaatttataaagtgtattagtttgtttttacgttgttgataaagatatattttagattggataatttataaaagaaagaggtttattggatatatagttttacgtggttggggagattttataattacggtggatggtgaaaggtatattttacgtggtagataagaggagaggattaagttatattttatatggatggtggtaggtaaagagagtttgtgtagggaatttttatttttaaaattattatattttgtgagatttatttattattatgagaatagtgtagaaagatttattattataatttaattgttttttatcgggttttttttatagtatgtgggaattgtgggagttataatttaagatgagatttgggtggggatatagttaaatcgtattaataggtatggaaggaagtaaaatattattttttggtaagagtttttttattaagatatgaggatatatgtagaaagtgaggaaataaaatttaaagaaagtgaggaaataaaatttaaaattggtttttaaaagtaaattttttgttagtaagatgtgatacgaatgttaaagttttaataggttttgtttttttgtaaatatttattttattatatttaataatttttgtgaatgaagattttattggtgttttttttaagatattaagaatattaggattatttatatttgaggattaaaagattggtagagatataattttatttttgtggtttttttgtatattttaatgttaaagtttagtatttaagattgaataaaaatgttttgataattagatataaaatattttttttgggttgggtatagtggtttacgtttgtaattttagtattttgggaggtcgatatgggtagattatttgaggttaggagtttgagattagtttgattaatatggtgaaattttatttttattaaaaatataaaaattagttgggcgtggtggtaggtgtttgtaattttagttatttgggaggttgaggtaggagaatcgtttgaattcggaaggtggagtttgtagtgagacgagattacgttattgtattttagtttgggtaataagagagaaattacgttaaaaaaaaaaagaaaaaaaaattttttttagtgttagttatttttttttttttttttttttttttttttttttgagatagagttttgttttgttatttaggttggagtgtagtggcgggatttcggtttattgtaagtttcgtttttcgggtttacgttatttttttgttttagtttttttagtagttgggattataggcgttcgttattacgtttggttaatttttttgtattttttagtagagacggggttttatcgtgttagtcgggatggtttcgattttttgatttggtgattcgtttgtttcggttttttaaagtgttgggtagttatttttttttttaaggttatatagttatggttgattttgtaggggtttaggatatgttattttagattattatttttttttttaaggattgttttaatataatttttagtatttgagagattttttttgtataataagatatatttgatttattatatagagtttttttttattaacgtatagtttgtgtttttattatttttagaagttttaagtttttatttcgttttatagtttaggatgttaaatgagttttaatcgtgtgatttttttttaagttttatattttgtgggatttttatgtgtatttatattattaaatatggggtttttttttgttaatttgttttacgttaatttataatttagttaagaaatttagagcggtggaggaaagttattttttttttttttataatttttaaatattaaaattaaaaatgtttttatttattaatattggaatttcgtggtatttataagttgggttgtatgttagtgattgtaataagtaataaaaatttttgtatgttaatattttattaaatttgattatttatggatttgtgattattattatttgttgtttattggtttgttgttgtttttaaaatattttatttggatttatggattatatgtttgttttagaaattttttaaaagatagtaaatttttagtaagtgggaagaaaaattatttaatagtattttaagtattttaaaagatgtaaatatggaaagatgaatatgaaaaagggtatttttagagtttattaattgtttatttttggagaaagtttttattttttattaagattttaacggttttgaatagtatatgtttttgtgtatataatgaaaataaattattattatcgttattatattaattgggtttgtgtttattgtagattttatgaaaaataattaattattaaaaatgatttgataggagaagttaataagttttaatattaaatggttttgtaaaagtttgtaggtatattatttgtgtatttagtaatatttttaattagtgtttatgattttattaatttaatttattttttatgaatggtaaaaatttatttttttttatatttataaatgataggttattttgatggaaaattaaagatttattatatgtttttttttgtagtagcggtagtagttgtagttattaattttagatgtgtagtttttagtttattatgtgatttagtgtgtttttattgagggtttttttgtcgagagagagtataatatattagtaggagtatatgttttggagttaaattgtttttggtttagattttggtatagttatttgtttattgtgtggttttgggttttttggtttgtaaaatattcgttttgtagagtttttgttgagttgaagtgagaggatgtatgtgtaagtgtgcggtgcggtattcggtgggtattttatagtattggtttttttttttttttatattgggggtttgtttttttaatttttgtttattaagtagacggggaggaagagagtggtgtttgaaattattattttttttagtgagttaaacgtgttatgttgtgatattttaggtatgtttttttattttgggggttttggttaatttttttgttaaatttagagtttgtttttttttttttttttttttttttgaggcggagttttattttgttatttaggttggagtgtagtggtgtaattttagtttattgtaattttcgttttttgggtttaagcgatttttttgttttagtttttcgagtagttggagttatagttacgtattattatgtttagttaatttttttggtatttttagtagagattgggttttattatgttggttaggttggttttgaatttttgattttaagtgatttatttatttcggttttttagagtgttgggattataggtgtgagttattatatttggttagttgatttttattttatgattatttttaaagtatttttagatttatttttttgtgatgttatgatattatgaagtattaagttgagattaggagattaatagtagggtgttaaatggataggattgattataattttatatggtgaaggaagaattaattggatttagtgatatattaaatgtgattagatatgaattggaaattattttgaggtaatgttttttaggatgttttttttaaaatattagttgttgaggatgggaatagatgttaattgaaaaaaggtttttgaaaagtatttgggaaatgttaattttattaggttttttttttgtaggatttttttgattttttaatatgtttatatgtatgatgattttgaaattggggaatgtagttatagtaggaagtatttttaaagtttatttttttatggaattagaattatgttgtatttaagtagtattttataggattagtattttatggaaaatattttgtgaagtgttgttttatggttttaaattaagaatgaggtataatataggggtattgatttaatttagtgaatgtgttgagtattgatttcgtaagattttgtggagggcggaaatggataagattttatttttgtaataaggttggtaataagttattagtggtggtattgtttatatggttaatagtagggatgttttgggggagataatattttatcgaattattgatgtagatttagttgaggtagtatttttagggtgtaaagttttgatttttttttcggatgtgtttattttttgtttttttatgaagtttttataatggtattagtatttagtttattacggagaaattttgtagataaaatgaacgtaggagttaaattaatgggaagttttatttaggagaagattttataaaatggattttttggatttcgtttttgagtatatagttatttgattattatttttatatttggttttaaagttaaaatataatttaaggcgagaagtttaaaaattatgtagtagataattttgttttattgtgaaggatatggtattttaatgttggtagaatttgacgacgtagtttgtttttattttttattgatgaaagatgagttagaggtttgatggtagattttattgggaaggatttttttttatcggttagattcgtggattattttattattggatttttttgtttgttaggtttttggaaatattttggtagattgagtagttattttgtttatgttgtgagtagcgtttttttgattttttgttatttattgaaataatttagtttgtttttttttaagagaagcgtgaaatgaaggggagttagttagtatatgttgattttggtattagaaggttaatttttgggttgtttggtattatgtatgtttttaaagttatggggttattggtttttttgttttttatttttatgattttgaaggagttttttgggggaatttttttttttttgttaaagtagatgtatgtaaggttagtaattaaaaaaatatattttattatgtttataaatataattttttaagtttttttacgatattttgggtatggtagattatttgaagtttttttttttttaaatattgatgtgacgtgatggggaggttagtttggtattggaatggtggtttggtgatagggtattttttatttttgattttttatgattttgtgagtttagatagtggaggtgatgatattatttaggacgttttttattagtcgtaatagggaattttttttttttagtgttttgtttatttatgtttagaaaatttatttttttgatgtttttttggttttttttttagtagaagatttttattttttgtaggttgatttgtaaggataaaggaagtattaagattttattgtggtcgggcgcggtggtttatatttgtaatgttagtattttgggaggttaaggtgggtagattatttgagattaggagtttaagattagtttggttaatatggtaaaattttatttttattaaaaatataaaattagttgggggtggtggcgggcgtttataattttagttattcgggaggtttaggtaggagaattgtttgaatttgggagggggaggttgtagtgagtcgagattgtattattgtattttagtttgagtaatagaataaaatttcgttttaaaaaaaaaaaaaaaattttgttgtatttttaaagatgagaaaatgtgcgtgtgtatgtgtatttgagtatatgtttatttttatttttttatttatttatttgtttattgatttttttttagttcggttagaaaatttaataggaattatggttttttattgggattttttatagtatttgagtttagttgttagtgttgaagatattatttaaatttgttttgtttattttcgtagttaaatataaaaatgattattatttatataaattaatttagatgattattaattgaggttatttaataatgatttgtatgtttgataattattattgtttaagaatgggttatggttttaggaatgttttatttatttttttagttttttagttaataaataatatattgttttaggtgttggggatatagtgtgagtaaagggatataatttttatggtgttatatgggtaataagtaaaatcgaaaaataagaacgtggtagataataaaatggataacgtagggtgtaattggggaggatggtgatatggtttggttgtgtttttatttaaattttattttggatcgtagtttttataatttttatatgttatgggagggagcgggtaggatgtaattgaattatgggggcgggttttttttgtgttgttgtgataatgaataagttttatgagatttggtggttttataaaggggagtttgtttgtataagttttgttatttttttttgtttgtcgttatgtttttcgttttttattatgattgtgatttataattttttttataaattatatagttttgggtatatttttattagtagcgtgaatacggattaatatagggggaaggttagtttaaatatgagttttataggatttgtttttttggtttgaggtttgtgagatgaggagttagttttgagaagttttgaggaaaaatttggagatagaaggaagaataaacggattttttttttattgaatgattttatgtatatgtttgttatttgggattatgatttgatgtttttttaaatttttaggttattgggaatatttataaaatagttgaaagatgttgttttgttagaatgttcgttgtaatgtaggatgttggtgaatttagtgtgaattttttaaaaatttattgattttattttatttattttttagagtttttatattgataaaggatattttttatagattagaaagttagtagattttattttttagaggaaagttgtggaaaatatttaaaaatattgtgagtagaagaaagaagtagtttagagttttaaatttaatcgggttaagttgggtaagttattgttttataggtagtaatttttttatagaattttaaaaagttttattttgtaataattatagatttgtgggaagttgtaaaaatagtatagagagggtttatgtattttttattttgttttttgaatggtaacgttttgtataataatagtaaatggtattatgtatatagtattatattattaatattaggaaattgacgttagtattaggttttaaatagattttattatggtttatgtgtattgatttgtatgtgtgtgtgtattttattttatgtttagatttttgtaattattatcgttattaggatatagggttattttatttttattaagaaatttttttgtttttttgtatttttatgtatgagaaatggtagtagatgttgttttgtttttagtttgaattatattttggaaaaatttatagtgagagaaggtggatgagtttttgaaatttattggttgaaatgtattggtattgagaatttgtttaattgatatagaaatggagttttttggtttgatttatatgaagattatttataagtttagaattaaaaaatataggtttgaataagtaattttgattatattatgagagtttattagttgatgtttaattggtttaagaagttaatattagttatgtggtttgagtagtttatttttaagaagaaaattttttttggtattatataatttgggggattaataatatatatatggagcgtttggtatatttttcgaagatgatttaggaagtagatatattagtaatgggttaataggttattcgaagagtgggtgtattttttatggaaaatagaatatatgatagaaaaatagttttttgtgtgtggaggtaagaaatttttaggacgtgtagttagtagtgagaatttaaggaaggtgtaggttgaaatggaaatacgttataaatagattgagagagagataatagttttaagggaaaatatttgtttggtggatttgatatttaaaagttgtatttgtggtttaggattaattttgtaacgtttaaaaaaggaatttatagaggtttaaagcgggttttgaaagtttttttttttttttgagattttttgtttgttttgtttagaatattgtttaggacggatgaaatgaatttatttggttttgttttttaatgttgaagtagtacgttagagaagttaattttagaatagttggttgtagtaatattttatttggattattttagatatattgataaggggagtttatttattttgttaaacgaaatttttggaaatttttttttttaaagatagttttgttttgttatttaggttggagtgtagcggtgcgattttggtttattgtaattttcgttttttagatttaagtgatttttttgttttagttttttgagtagtaggaattataggtattcgttattatgtttggttaatttttgtatttgttgttgttgttgttgtttttgagatagagttttgttttgtcgtttaagttggagtgtagtggcgcgatttcggtttattgtaattttcgttttttaggtttaagtgatttttttgttttagtttttcgagtagttgggattataggtgtttgttattacgtttagttaatttttgtatttttggtagagatagggttttattattttggttaggttagttttgaatttttgattttataatttatttatttcggtttcgtaaaatgttgggattataagtatgagttattgtgtcgggtttaatttttgtatttttaatagagacgaggttttattatgttggataggttggtttcgaatttttgattttaagtgatttatttgttgtggttttttaaagtgttgggattataggcgtgagttattgtattcggtcgcgaaatttttagaaattttgagagtgatttttttaatattttgtattttaagtagaagtttttagtaataatgaagttgaaagttagaagagaggagtagataatgtttttatgaagttttagaagatattaggagtatttatttcgatattagattgaattgaaaatttgttatattagttttttgatttatttatatttttttttttgagttattggtttgtgttttgtaaatatagtttaagaggttattttaaaggaaatggagattaggtgttttttatagatttttatgttcgatttttcggagtgggagtaggagagaattatgagtaaagagttttagtttttattttgggatattattttttttttttgtatagattttatagtgggatgttggtgaattttttaatgttaatttttatttttaaatttaatttttattttaagtttagcggtatatgtgtaggtttgttatatagataaatttgtgttatggggttttgttgtatagattattttgttatttaggttttaagtttagtatttattagttattttttttgattttttttttttttttattttttattttttgataggttttagtgtgtgttgtttttttgtatatgtttatgtgtttttattagttagtttttattaataagtaagaatatgtagtatttggttttttgtttttgatgttagtttatttaggataatggtttttagttttatttatgtttttgtaaaagatatgatttaatttttttttatggttgtatagtaagtatttattttatggtgtatatgtattaaattttttttatttagtttattattgatgggtattgaggttgtttttgtgtttttgttattgtgagtagtgtagatgttgatgaatttgtattttatatttagtgattttcgttttgaagaatatattttatttaatttatgttatttgaagacgatcgtaattgaggtgtaggaatttgttttaaattattgtaaataattttttggggtattttataatattttagcgttttttcgtttttttttattgttttttttatttgattttttttttaaatttttgtttttatttttatatattttattttaaatttagattgtagtaagatttttatgtgtattgttatatgtatttttagtaatttgaaattttatttaatattaattaagttggtataaattatattattttatatacgtgaagttgtttgttatagttttgttttggagaacggtgagaatgttttttttgttttgtggtaggggtgaggggggatgttttaatgaggagagattggtaataagggattgtggtgaattggtaggggaggaaatttaataaatagaagagaggaatttaggatagttgggtattggagtgttgtaaataaagtaatatgtgatgttttttttatggaatgtttatttacgttatatttagaatttttgatagtcgttttgtattttttaatattggtatataatggggttttagggtttgttgaaataaattgggttttatattatgtgttttttgatttttttttaataatgtgtgttttttagttttgtattgaaaattaggatattaagtgatattgaagttagataatttgttttatgttatatgggttgaatgtggtagatgtgattttaggttttttgattgttttatggtattttttatttttaagtttttgtttttttatatttttaaggtatagaatttattttattatttggtttggtgttgaggagaagtttggtataatggaaagatttaaattttattttttttttttttttagaagaaatttgtagaattgttttattataatttgtggatagttgacgtagtttgaagatttatattttggagttatttattttataaaatgttagtcggggtgtttattggtatattgtttgttgtatatttttttatattttggaaaggattagttgaatttgttttaaattaagtaattgatttaggattttgtattttattagtgtcggttataatttaaatttaatttttttttaaagttgtattttttacgaaaggtgatttgatagcgagataagagtaatgacgggtgaggtatttttaaattaggttagggtggtaggtcgggatattttgtttttattagattttcgtagttatttttgatttttttgtgtgtttgttgaatttgtgagattttattgtgttttttttagttggatattttttagagggttattaagaaaaaggagtattttttgtattaataatttcgggaaggattttagtagtaaaattagagattagatgatttgttggatagtaggatgggggagtattttttttttttttttaggagagtgttaagtttagtatgatttagtattagattttttatttagtaattttgagattttattatattaagttattttagttatgatgacgtaaatggtaaaattattatttttattttttgggataagaatttttcgttttaaaggaatataatatataaaataggtgattatgaaatatgtttggtgggttagttaatttttatatgtgttttgtgattggtttttaagtgaatttattgttatagagttttaaaataattttttaatatttatgttttttgtattttgttttattattgaaaataataagcgttatgtaaaagcgtaaagaatatattgaggtttatagtaaggataattattaaagatcgggagttagaaagttatggtttgtgggttaaattttgtttattacgtgtttttgtaaataaagttttattggaatatagttatgtttatttgttatgtattgtttatgtttgtttttatattgtaatattagagttgagtaattatgatagagattatatggtttaagatatttgttatttggttttttattggaaatgttttttaatttatgttatagatatttttatggtatttatttattgattcgtttgtttatttttttagtggatattaattttgttaatgacgttggggaatgtaaagataagtatattagtttttaatttttaagagtttataatgtaatagagataagttatgtatttaaataatagagataagttatgtatttatttttatttttgattaggtagaatgtagtacgtattatagataagaaatagttaaattgttgtggtagtttagagatgatgagagttttcgataaaggtagggaattgggaaatgtataaagatattgtttttataattgtggtatatagtgattttttaatagggaattttatgagaaattaggttaattttttttatggaattttataaattgtagtatttaaaagagtggaagtgatttagaatattattttgtgtttagatttttttatttagaagtatattttttttgtaattatggggatgattatatttatagaaaatttttgaatatttgaaggaaggttttttttattagggtgggaagatagaaggaatttttttttttttttgttgattgtttattttatagtgtaatattaaatgttatgggttttaaagaaaggtttttgtggggaaatttttaaatattaagtggattataaaaataagataggttgggtgtagtggtttatagcggtaattttagtattttgggaggttaaggtggatggattatttgagtttaggagtttaagattagtttgggtaaggtggtaagatttcgtttttattaagaaatataaaaattaattaaacgtggtggtacgtttgtagttttagttatttgggagtttgaggtgggaggattgtttgagtttaggagggagagattgtagtgagttaagtttatgttattgtattttagtttgggagatatagcgagattttgttttaaaataaataaataaaaaattaagataaaattatagaattttaattatggaatagtaggatttagtgataattatattttttttttttttataatgtatgcgagtgtgaattgagattttggtaagtttttatttttttttggtttattgaatttttttaagggtttagtttttaattttgggaagattttatgtatgaaaattatttaaatttttttagttgggattaatgtgatttgataaagagttttgatttttttttttttttgagatagagtttttttttgttttttaggttggagtgtagtggcgcgattttagtttattgtaatttttatttttcgggtttaagtaatttttttgttttagttttttaagtagttgggattataggtatgtattgttatgttcggttaattttttatttttgtagagacggggttttattatgttggttaggttggttttaaatttttgattttaggtgattcgtttattttggttttttaaagggttgtgattataggtgtgagttattgcgtttggtttgatttttgtgttattagaattgttttgtttattatttgtgttttttaaatatttattgaattaattcgaattggatgtagatagatattgtgtatttaaaatttaggtgattgatttggaaaaagatttaagatttttaggttagtttaagagatgtttaggggaggttttttttattttgtttttagtagggtgttaaagttattggttaaattttagtttttttttttttatatttataataataaaggtattagtatgaatgtagtagagttttgttttagaatataattttgtgaagttttattagtcgaaagtataatatttggatggataaaatgtgtgtttggtgagaaagttattgaaggaatataatattggatttttaattaggtaatttaaatgttataggaagtattaagtttatttattttataggttttcgttttttttttattcggagtagtagggttttcgtagttagttattttatagttttttaggggttttgttttttcgttattaagaagtatatgttagttcgttttttagcgttttttggtttttttataatagatagatggggatgttttaggtagagataaaagagaatatataatttatacgtttattttgttggtattttttcgttttttgagtttaaagaggagaatttagttttttgcgtaggaagaatatattttaaggtatttattgataagtaggtatagttattgtatatatatgtggaggttgtattatattaaaattgtaaataaatatagattttgtatatttttttaggttttattatgtatttatgaatgggattgttttattatttttttttaatgttagtagtagggaagttagaaagtattatttttaaaacggggatagaatattgtaaatatatatatttttaattagttgtggtaataattagtaaataaaattattttatttcgttgttatgggttttatgtttatgggattttttttgagtttttgatttataataattatttttgaaggttttaaaatgtttaggtgagattaaattattgattatttaaaagttttgttttcgttggagtttttttggacggttgttgattcggttttatttaaagtattcggtggtatgaatttattcggtttttgtttatattattgtatttttgggatgtcgtttataggttttagtaagattatttgatagtcgtttgtgaggttaacgaattttatatataattaaatatttttagttaggagaatttatttttttttttttgagaagtagagaaagaatatatgttgtgttgttttttattacggagtaaaagttgtgtggagtaattaggttagttttatatgatttaatgttgaatcgaataagaaagtgattgtattttttattgggttttatagaaaagttattatttatattgtttatttagattgggattttggttatttggggtttaagttagaagaaagaggaaaaaaaaaaaatttaattttggaatgaacgtttttgaaattttgtatttttgatgaaatgcggttaagggtttttttaaaaaaaattatttaaaattaattattaagattatatttttatttataatgggttgttagtaatagttaattttttgtttttatttagatttggtgtttaagttttaatatgttggtattggaatttttgtcgtgttttgtttgggtattagatgttattattaaattatgtgtggggagttgggtaattttgatttttgattagttttttataaaataataaggaaaggtgtgaggaggttagggattgggtgaaaattagtttgagggatggtagtaagtgagttttattagggggatgaatatataaaggaggtattgaggatattgttaagggtaagagaaagtaaaagatagaattatatgttttgggaggagggttaggttcgttaaggtatttagttcgtttgtttttagttaggattgtaagaaattattttagatatgcgattttgtatcgtatttttaaagattttaagaggagatttcggaattttttttggttattcgttttattatttaataatttttatagttaggaaatttttttttatttttagtttaaaatgtgtatgtggtgtagttttaggggaggtgattgatcgaggttacgtttatttttttttcgtttgtttattttttggatgggatggtgtatatgttttgttttttttttaaaatgggtttttttcggtttttatattatagttttcgggttgggagaggggtcgtggtatagaggtggggtgggggtcgattagcggcgtttatggggattagtcgttattaggaattgttgttaggtattttatgtattttttagaggtaagagaatatagttgtgatgtggttaggagtgcgttttaaaattacgtgtaaataataaatgcggaagttttcgttttagattttaaaagaaaagaaaagaaaaaattttgaaaaatagaatgaagagtttagaattttattggtttcgagatggtagtttattttttaattttaaataagaagagtttagagtagaaaagggatttgtttcggataagattttagagttaatgtttttaaacgtagcgtagtgttttgtttttaatttagatagggtgttggaaaggcgaaattatgttggaacggaggttatcgattttatttttttcggtttttttttttttttcggtagatgcgtagtgaatggttaggtttttcgtgagtgaattatagatttattgaagagtcgttagatgattggagtagtttggttttttttttttttatcgagttttgttattgtgttttttaaattgtggtttgttttagaaaggaagaggttgttttttttattcgtttgttttaagttgcgttaagttttagttttttgtattaagtaaattattaaatgagtggaatgaatattataatgttaagggtagggcgttgatattatgggataatagattacgagtttattttgttagttttttgtttcgtatttttattatttgttaaatgattatattaatatttttttatttattttagggggtttttaaaaataaatatttattgataggttatgtattagtttgtttttatattgttatgaagaaatattcgagattgggtaatttgtaaagaaaaagttttaatggatttatagttttatatggttggggaggttttataatttgtggaaggtgaaggaggagtaaaggtacgttttatatgagggtaggtaagagagttatgtgtaggggaatttttatttataaaattattagattttgtgagatttatttaatatacgagaatttgggaaaaatttatttttatgatttagttgttttttattaggtgttttttatgatacgtggggattatgggagttataatttaaggtgagatttgggtggagatatagttaaattatattattttataaatgtagaatataaattttatgatattttttatataaagtttaaatatatttaaaaatatatatatatagtttaaggatatatatatgtgaaagataaaattatgtatggtgataatgagtattgagtattatatagtatttttttattgtgaaagatttcgagtaaatagaaaatgtagagaataagattgtgtataaatgtgtatttattattattttgttatgtttttgtttttttttgtaaaaaagagatagattttttttatttttattcgttttttttttttttgaacgttatagttattagtttaaatgtgatgtttaatgtttattataattatgtatggttttattttttatatgtgtgtatttttaaattatatatatatatttttaaatgtatttaaattttatataaaggatattatggagtttgtgttttatattgtatttgtaagatttgttcgttgtaaaatatggatttttatatattttttatgttgtgttgtagttattagatggaggatatggaagttatttttaattttaagatgttttttggaagaatgttataggtgtgtttagttttttgatatgttttttgtatattatgtttggtagttttttttggatatgtagttagtagtaaagtgatgaattagtatatcgttttttttggatgttgttaaattgttttttaaagtgtaagtttttttttagtagtagggtttgagaatttttaatgtttagtattttttttaatatttgttagagttatatttaaaaattttttttttttgttaatttgatagttgttttaggttttagttgtaattttttgattattagtgaggttgagtatatttttatttgtatatcgagtagttaggattttttttatgagttatttttttttttttttggttcgtttttttattggttcgttgtttttttattggtttattggagtatgtaatgtatgtttgatattatttttttgtttattatatgtatagtaaatatttttttttggttttgtaattttattttgttgatgatggtttgttaagagatttttattattttttttgttttatttttataagagatttgtgagttagatgttatttttgtttgtatttttagatgaggatagtatattttagagagtttaagtaaattgattaaggttttatagttggtaagtagtagagttgaggattaagtttagatcgaattttagagtttatgcgtttaattattgtttttaagttataattattatgagtatttttattttatagatgagtatatagataaggtttagagaggtttattgatttgtttagagttatttagcgtggtagtgttggaataaggattgttttttaggttttagattgttaatataattgtatatttagattgaaatgttggggaaatgatcggtgatagattagataaaggaaatgtgatatatatatattatggaatattacgtagttataaaaaggaatgagattatgttttttgtagggatatggatggaattggaagttattatttttagtaaattaatacgggaatagaaaattaaatattgtatgtttttatttataagtgggagttgaataatgaaaatatattgatgtagggagggagataatatatattggggtttattggagggggtaggaggagggagagtattagaataaatagttaatgtatacggagtttaatatttaggtgatgggttgataggtgtagtaaattattatggtatacgtttatttatgtaattaatttgtatattttataaatgtattttagtgtttaaaataaaataaaattaaattttaaaagaaaaagaaaatgttggggaaatgtgtagaaaaagattatgtatatttttttaaatagtaattttaaaaattatgaattatttaatatttaaaatataaaatttatagagaataatatagtaaataattaggtattttaatttagatttaataaatattgatattagttatattttaaaaatattttttaatagaaaatgttgtagtttaagttttttttgtgattttaaattgatagtatttttttatagtttttttagtagtaaatattttttagaagttgtattgttatatatttgttgtattttgttatgtgattatgtgttataagttaggggtttttagtttttaggttatggatcggtataggttcgtggtttgttaggaatttggtagtatcgtagaaggtgagttgtaggagagttagtatgattatttgagttttattttttgttagattagttacggtattagatttttataggagcgtaattttattgtgaattgtgtattcgagggattttggttgttcgttttttatgagaatttaatgataaatgtaatgtgtttgagttattttgaaattattttttattttcgtttatggaaaaattgttttttattaaattagtgttagaaaggttggggattattgttataaataataattagtattattttgtaagtttaaaaaacgaatggtaatgttattaataatttatttttttggaatttgttttattatttgaagttatgtttttgagatttattttaattaatgtatgtagagttaatttttttaattgttatattgttataaattgaatgtttttttttttgtaaaatttatatgttgaaattttaattttaaatacgatgttattaggaggtaggattttggaggtgattaggttataagggtagagtttttatgagtgggtttagtgtttttttaaaagagattttacggagtttttttatttttttattgtatgagggtatagtgggaaggttttttatgaattaggaagtgggtttatattattatatttgttggttttttgatttgggattttattttttagaattgaaagataaatgttatataagttatttagtttatggtatttgtgttatagtaatttgaaaagatttagatataaattaatttttttttataaatatattataatatatttattttttaattgatgtttttaggttgttattttataaatagttttattgtgattttttttggatttgtttttatgtggatttgttgaattttttaaagatatagaagaagtggaattattgggttttggggtataaatattataaaggttggtaggcgttgttaaattgtttttagtttgtttttagtaataatgtgtataatttttattattttgtatttttttttatttttgatattgttgggtttttaaaatttgttaatttgatgtattgaaaaggtatttaattgttttgatttgtatttttttgattatttatgaggttatgtgtttagtgttggttttttttacggttttttattatttgggatttttttttttttttttgtattatttgattttagattttgtttatttttttgtagtgggttgttttttttttatagagtattaagtgtttattaaatattatgaatatttatagaaattttttttttttaaggttatttattgtttttaaatattgttttttggtattttttattatagaatgtttaatattaaattttttaattttatttttttttttttttttttttttttattttatggtttgtatttttttttgttagttttttatttaagattataaaaatagtgtttaaaaaatatttttttttaaatgttttaaagttaattgtaatttttttggaatttatttttggatatagtgtgagttagtgatttattttttttttttatatgggtaatagttgtttgcgaattatttattagtttagtttttgttttttttatagtttgtaatgttatttttgttatatattaaatttttatatgtgtggggttttttttattgcgttagtttagttatttatatttatattaatattatagtgttttaattttatggtataattaagtatattgtatatgttttgatatttggtaggataagtttttatattatttttttttaaagttattttggttgtttttggattataattttaaaatcggttataaatatttatgaagaaaatttttttgggatttttatatgaattttatttaatttatgtattaattttaggggatttgatgttgaaattgtggaatttttttatttttgagtatgagatatatttttgtttatttaggttttatgagttttaatgaagttttataatttttttttttatataggttttgtatttttttttttagatttatttttaggtattttataggtgtaagatttttattgttaatgatattttatgaaaattatattttttaattggttgttattgatgttatggatgtttgtatattaattttgtttttagcgtttttgttaaatttttttattttttgtaattgtttatagttttttatggattatttatgtagataattttattatttgtaaataatgttatatattttttttttatttttaattttgatttttttattttttttttttgttttattatattagtaaggtattttatataataatgaatagagtggtgagagagaagatatatttatttagttgttgattttaaaggaaatgtttttaaagttttttgtaggtttttaggagaaatttttttttgtttttgttggttaggtattttattttatttttaaattgtgaatgggggttaaatttgttaaatgatttttttgtatttattgagatgattatatggttttttttttttaatttgttaatgtggggaattatattaagattttttaatgttgatttttatttgagtttttgggataaaatttattgggttattttatatatatttcgtatatttattgtgtgataaatatgatattttgatagatataattttaaatatgtatattaaagaaatattatatatttgtgtatatattatattgttggaatttttgttaatttttttttttagattttttgtattgatattttaattgagattgattaatatttgtttttttttgtattgttttagtgtttttttataatgtaggtttagattgaatttataaaaatatatttaggattttttgttttttttttatatttttatgtgttaattttggtaatatatttttttaaaaggttttttattttatttgtttttagatttattgttttaaaatatagaaaagaatttttatgttttaaaatttttattttatttagttatgatttattttatgtttaatagtgtttatttgtgttttttttttttttttgtttaattttgttaaatatttatttattttattagtttttttaaagaattagtttttattttgtttttattttttattgtttttgttttgattttattgatttgttgtttttattattgtttttttgttattttaattatgtgtggaaaaaggatttttttttattgtttttgagtttatattgttgttttttttttaatttttttaaaattttttttgtttattaatattaaatttaatgttaaatattttttttaattgaaatttagggttttagttgtttagttttaaatatgttttatttttattttgattttatattaataatttagtagtgtgtttttgaaattttaaaatgtatttgggtttagggattgtggttttatttattttaatttttttattgtattttggttgaagaatgtggtttgtatgataatagttttttgaaatttgttatttgttttgtggtttggaatttgtttaatttttatgaatattttatgtgtattttttatttattgggtagagaattttttttttatgttattagttgaagtttgtataatgttttattttaatattaaatttttttttttttttaaaaaaaaaatttgagttgttaattttatagagatgtgtattaaaaattttttattatatgtttttggtagattatgtgtgttaaggaattataaatgtggtaaatgaaatagtatatttaaggtatttatttttgtaggaggataaagaagatttttatggatgtgatattttagttgaataggagtaggttaagaaatttttgtattgttatagaggaatatcggagattgggtaatttataaataaaagaggtttaattgatttacggttttgtaggttgtatagttatggtgttagaatttgtttagtttttaggaaagttatagggagtttttattcgtagtagaaggtgaaatgggtgtaggtatattatatagttagagaaggagtaagagagaggagacggggaaggtgttaaatattttgaaataattagatgttatgagaatttattattataaagaagatattaaggggatagtgttaaattatttatgagaaatttagatttatgatttagttatttttttttttagtattggggattatattttaatatgagattcggggggataaatatttaaatatattagttaataatagaggattttattttaaatgtaaaggtatataattatattatttaaatattatttttttgtattttatttttttgtatatttttgatatttttattgaatattttaatttttaaaataataaattgaatatatgtaaaatgatttttttttatttttaatgtattaagtttaatagagatataaaaaataaaatataaataaataaataaataaaattttttattataattttgaattgttatttttttgtagttaatttaatttttgttgtaaatatttgatattgcgttatgaggtatataaaaggattttggtgaatatatttttatattaataagtgattttttttattttttaaaatgtttttggttgtaggtcgggcgtggtggtttatgtttgtaattttagtattttgggaggtagaggcgggtagattatttaaggttaggagttagagattattttcgttaatatggcgaaattttatttttattaaaaatataaaaaattagttgagtttggtggtatatgtttgtagttttagttattcgagaggttgaggtataagaattatttgagttcgggaggcggaggttgtagtaagcggagattatgttattgtattttagttgggcggtagaataagattttgttttaaaaaaaaaaaaaaattgtttttggttgtaaagtttgttttattagattcgtttatttatttatttattgatttaattaaaataaatatttattgaatatttattgtttttaaggaatgttttaaatattggagatatagtagtgaataaatgagaaagtttttatttttttggatttgagagattttatattttatttggagattatagataataaataaataaaatatataatttgttaggtggtatagtgttataaagaaaaataaggtaaggtgaggtagataaagttatgttggggggtataaagttatgttgttttatattatgtagtcgtgggtagtttttggattagttgatatttgagtagaggtttgaaggagttatttgatgtttatattgtttatataaattgaatgtttgtgttttattaaaatttatacgtagaagttttaatttttaatgtgataatatttggagatgaggtttttgggaagtaattaaagttatattttttattgtgtattttatgtttattgggtggagtgttttttttttatgttattaggttagaatagtagggtttttataatggtattagtgattttttaagaaaaagaaggaagagatttttttttttgtatgtatatttgaggaaagattatgtgaggatatagtaagaaggcggttatttgtaggttaaaaagagaggttttattagaaatgaaattagttagtattttgattttggatttattagtttttagaattgtgagaagtaaatttttgttgtttaagatatttggtttgtggtattttggtatgatagtttaagttgatttgtttaatgattatattaagtttttgtgagtatttttttatggtattgttttttttttttttatgttaatttttgtgttttaggttttttttttgtaaagagttggagttttaaaaaatttaatttgaggttttttgttttttaataggttaaagttatttatatttattatgattatttatatatttggaatttattaggagtttgaatgttttttatatattatgttatttttttatttgttttttttttttattttgttttatattaaattatttgatttttttttatattgttttttattgatttgtaatgtatatattttgttttattgttttgatagttgttatttttaaatattaaaaattatatttgagagttgggcgtggtggttaatatttgtaattttagtattttgagaggttgaggtaggtagattgtttgagtttaggagttttgagattagtttgggtaatacggtgaaattacgtttttattaaaaatataaaaaattagttaggtatggtatgtatttgtagttttagtttaaatttttttttattgaagtatatttttgaatagttattttattaaggatttgggaatattaaagtattttagtttttgattgaaagtatttttaatttatttttggttttgaataataatttttttaggtatagaattttatatagatatttttttttagtatttgagtatattattttattattttttgatttgtgtaattgataaggtgtagtttgttttaggttgttatttatttagagggtttttttttttttttttatattgttttaaaatttttttttgtttttatttttggtgatttgcggttttattataattttgtttgggatttaagattaagaatttttgatatttatcgattttgaaaaattttgttttagtttttgaatattttttttttttagttttttatttatttatttgagtttttttttatatgtatattggattttgttatttttttttttatgtttttgaatgtgttttttagattttttatgttttttttttttgtgttttatttttttttttaatatttttttattttttttatttttgtttttttaaggtaattaatgttaatatttggtatgtatttttttatatgtttttttaagtttttataaatatatgtatatatatatttatatatattttaaataagggtgttttgttattgttgtttgtaaaaaaaatttaattatatagtatgtatttttttataatttgttttttttttttgatagtatatgaaggataatttttagataaatggatataaatttaatttatttttaaaaatagttaagtaaaattttatgttatggttatattatagtttatttaattttttttttattaatgagtatttagattgtttttagttttatgttattgatagggataggagatagggaaattttgggtagaagagggtgggttttagtgagggttttatttttaagttgaaaagtttgatattatggtttaaagggagaatttatatttttgtttttttattcgaatgttgttttttttaaaattatttatggtttgttttgttttttattttgagtttataaaaaatttttggttttattggtagagagaagagaagtagttggatgttgaagattatagttggacgttggagagaagtggtttgagtttagagggatagtttgacggtgtagttttagataggagtttggttagggatggttggattttaggggaagattattttttattttcgttttttttttagtttttttttttattgaaagttatttttattggtagtaaaattttttgtatttattatttttagtttgtttgtgcgattttattttttttggacgtcggataagaatttgggtgttataatgtaggtgtaaaatgttgtgttatattgatcgtttttattgagttgttagtatttaaggcgtttatggatggtagagttaaaagagtattgtaatttgtttttttgggttttaggggttgtaggtattgttttagacgttgttgtggggttggtatggaattcgttttttttagtatttaaaaagtatttatttggtttttgtatttatttatttgcgtgttttattttcgtgaggggtggagtgtagtatgtttttatgagtggagtttatttttgttagtgttagagtggttggtaagttttagcgtttatgtattttagtttttatttatgaagcgtttagggaaataattttgttttattattataaatattgtggttataaatatttttgtgtatatttatttatgtgttggttttttaatttttgtggaagttaatttaatgttattttatttattttagtttttatttttaaagaatataattttgtatattttagtttttttttttagtatatatatgtttttgtatttttaaataatgtatatattgttattttttgttttattaattttatgtatattttaattttatattatagtagataaaaatttatttgtttgatatgattatatttatagttttttttttttttttttttttagtgtagttatattataatttgggggtaaattagtttttagtgtttttattattttgttaaaataaatggtattaatagttaaatttttaataatgaagttaatatttgttttttttttatgtttttaattgatttttgtatttggtatagattttttttttattttttataggtttatagtatttttttttataaagttgattatattagtaatttgttagttttttttttttttttggtgatatttttgttggagatttatattttttttttagttagatttttttttcggtttgttagatagttgatattttgagatttgtttttattgttattttagaatttttttttgtttttttttttgtgttggatttttttttttgttttattttattgtttgaggaagtatagtttttagtagttattagaattaaaatttggtgtagtggtaatagtttttatatgttttgtttttggtttgttggttttgtttggatgattggttttgtggttgagttagttattattttggggtattttattttagtgtcgttatttttttgttgtggttttgtgttagtttttataaaattttttttatatttttttatttttgtggtttttagtttatagtagtttatggaaaatggatttttgagagatatatttatattttatatgtttgaaattgtttttattttgttgtgttatatgatgatttgtttgttttgtacgggaaaatttaggttaaaaaatagttttttttagaagtttgaagatattgttttattgtacgtaattttttaatgttgttattagaaagttgttattgttttgatttttgatgttttgtgttttattttatttttttttttttttggaatttttgattttttttgtttttttatattttaaattttacgatgattgttttaattgtgggtttgtttttatttgttgtatttagtgattattgtggttttttaatttgttaagattgtgttttttttgtaagttgttttttttttttagaatttttattatttgggagttgaattttttggatagttttgtgatttttttatatttttttatttgttttttatttttttatttttttttattttttttgtataatttttttaattttaatttttaatttatttattgggtttatttttgttatcgttttaagttttttttttttatttataaatagttttttaagtattttgttttgtttttaggatgtgtgttatttttttagttttttgtatttttttttttttttagaaattgtttttgttttttttggtttttgttttttttatgttgttttttttagtttgtttgttttgaattttgttttttttgtagagattttttttgtatgtcgggtagttttgattgtttgattatatttaagaatgaataatagatgtattgaaagttttgaggatgcgtgagggatttgttaattttgagtattattgtagaataaaatgtttttgttataggttggagaatttttaatgttaataatttttaaagttttttaatgggaaaattagggaatggttagattttttagagaatatttttttagatttttggttgtaagatgtcgttttgtttgttttaggttgggagttgagatgaggaatgagattggagggtttagtttttagtatgtatatttttttttatttgatgtgtggtattttttaattttaaaatttttttttagagtttaaatttttagtattagtagttgtgataaaggttgttgtttagtagggtggatttaaggaaaggatttagggatttaattgatttttaaatagttttttttatatttttttttatttattttttttttttgaaacggagttttgttttgtcgtttaggttggagtgtagtgacgttattttggtttattgtaagtttcgtttttcgggtttatattatgtttttgttttagttttttaagtagttgggattataggtgttcgttattacgttcggttaattttttttatttttagtagagacggggttttatttgttagttaggatggttttaattttttgatttcgtgattcgtttacgttggttttttaaagtgttgggattataggcgtgagttattacgttttgttttgttttttttattttagtgatttatttttttttcgtatagttttagaggttatcggtgttatttgtttttgagtttttggaggatttattggttgtttttaatttttttgttttttattgaggatttagttttttttgtttgttaattttattattgtttttttatttgtttttcgttttttaaaattttattattgttatttttaaaattttgttatttgttaaatttataatatattaaataattttggaattggttgtaaaagggttatggattgttagagattaaaaggtatttaaaatttttttttttattgttttggtggttttatgttttttaaaaggttattttttttcgttatagtgacgttttaggtgaaagttatattagatatagtgtgtttaattttttatttttgtttggaagttttgtgttatattttggtttaatttttttaaggttgtttttcggtttattgatggtttgttttgtgttattttattgtttaatttttttattgagtgattattaggagttttattttatttttttaaatttgtttatttttttttttttatgtaattttaattttttttttatggtttttagtttttattattataatatttttaaataattttattttgtattttatttgagattgtatttttttagtttttaggatttaaagttttttttttttttttattattgttttttatggtagtttatttgtgtgtgtgttggggggtgatattggtagtttaattttagatatttttttttttttttgtttttttttttttttttttttttttttttttttttttttttttttttttttgaggtggagttttatttagttgtttaggttggagtgtagtggtgcgatttcggtttattgaaatttttgttttttaagtttagatattatttttgttttagtttttttagtagttgagattataggtatatgttagtatgtttggttaatttttgtattgaaatgggatttagttttgttggttaggttagttttgaatttttgattttaagtgatttgtttgttttagtttttaaaagtgttgggattataggtatgtgttgttatgttcggttttttttttataggaattttgtgagttttgagttgtgaaatcgtttttatatagtggatatatgtttgttttttttggagatttaaggatttttaatgattttagaattgtgtttgtattaatttattgttatgggatttttttatttagatatataggtagtataaatttcgattttataattgaaagtggtttatgtttaaggttttgattttttaaaggtgttttgagttagggatataagggaatgttttgttttttatttttgaggtagtgggtagagtgttttagtttatttttttatggttagggtgattttttgaggttttgagatttaggaaaggggtttagttttggtttcgttattttatgtaagattaaggttatgtttttgtatgggtattagaattttattattatttttagggtttcgggagtatttgcgagagtttgaaatttttttgagtattgtgtagttagttttatataaaagttttggttttaattttatttttatttttggggtttttgtttttttttttttttttatttttttttttttttttttttttttttttttttttttaaatttaattttgtgatatttttttgggaattttatatttttgtagtgggaagggatttatatgattaatttgttgtttgttattttgttgaaaatgaatatttatatttaattttgtgttaaatttggaatatattaaataaatttggaattggttgtaaagggttatgggttgttagagattaaaaggtatttaaagattcgttgtttaattttagtattttatttaaggaaattgagttttaatattgataaaattatttgtttatagatacgtggttagttagtggaaaaggtgggattgattttaaagagtggttatttttattttatagtattataaggaggaatatttgatagtatttgttaggttattaagatattaagatttaatgtttgttgagttttaagttattgagatattttggaaaagttatatatattatttgtgtttgttttgatttgttgttgtgtttttttttttttgaatatagagtagtaatgtttgttgaattatttaagtggtttattgttgtgttagtttgtttgtttttttatttttatttttttaaagaaaaacgtttttttttttttttttttgaagatattttttaggatttattatttatcggaaattttttttgaagtttgaagtttttagagggttttttattttttttagttttttttgaaattgttatttgaattatgttattagtattatatgatgaatttatttgattttttttaattgttgaatatgtatgtgttttatttttttaagattgtaagtgttagtttgtagaaattatggtttatatatttttattattttttaaagtgtttttttgtggatgagttgatgacgaaaaatttagaggaaatatgtttttttagatagagtttgagtttggtgttaggaagtttggattttgttttatttttttgttttttggtagatttatgtaaattatcgatgttgtatggagaaattattggtgtttgataatagtattgatatagtggttgtaaaattttttatgtaagttgggatagtttttagagtgaaagggggtaatggtaataattgtgtagggataataggtataaattgggattttttttaatatgttgggatagacggttaatttatgttttagattattttgagttcgttagaattatttgtatagttgtttttgatattagttttttaaataaaaaattattattttttataaaagtttttatttacgagtttaattttataggtaataaaatttttagtttttttagatatttttgtttttttagttatttttatggttttaaatgcgtattataattgaagttaaattagattgtagatttgaagattagtattgttgagtaataaatgtttttatttttttttattaattattttgttttttggaaggaaataaaggtttcgatttttggagttttgagtttattttttttgggtgtattttgaaatatacggattttatcgttagtatatttagtgaggaaggaaggtttttgaaggattgatgatttttaaattggattatgtgtttatgataatggtgtatttggtggtttagtatagtgaggtgaggtaggtttttaaaatggtttattataaatattattgtttttgagtttatttgtttttgtattttttgttagagtgttttgtatatagtaggtttttattaatgtttgtagattttaaattcggaggtatatttggaagataatggtggttggtaaattaattattagggttagtaattttatttttgtttacgtttaaaaagtgttgcgtgaggaggttgagataggagaattgtttgaattagggaggtagaggttgtagtgagttgagattgtgttattgtgttttattttgggcgatagagcgagaattcgttttaaaaaaaaaaaaaaaaaaaaaaagttttgttgtggttgatatatggtgttggaatgtaaagaaaaatagagaagatttttgttttttagaattttgtgatttagaggtaattttagaattataagttattaaaatttagaaagtttaggagaaaggataattatttttgatttggaggaatgaggtagtatttgagttaggtttgaaaaataagatttttttttaggattgaggtgagagaaggttgttttatatggtaggaatagtataaataaaaatttgtaagagtaaaattgtaagttatatttggagaattagaaaaagtttggtatgtttagaagataagatttaatgatgttggtttggggaagttagaagttttttaatgttaaatgatggaatttaggttatgttatatagaaaatggagttatataaagtgttggatgagtgtagtgatattaattaatttatgttttagaatgagaatttggttgtagggagattagttaagaagaggtttaggtgtttaggagagatataaaggtaggagaagaaaaaggagttagaaatgagatttagaattggtagttgattgaaggaagggttaaggtggagagaataattaaatataattttaagggatagagtggatggggatgagtggagggggatgagtagatggggatgagtggaggatggggatgagtagagggggatgagtggaggatggagatgagtggaggatggggaggagtggaggatggggatgagtggagaatgggatgagtggaggatggggatgattggaggatggggatgagtggaggatgggatgagtggatgggatgagtggagggggatgagtggatggtggtggagagatatagagaggattagaatttgattggttaagattttggatttttagggaggttgtggagagataagatgaaatagtatgtgaaagaattttgaataatgttttgtataaaggagatatttaatgaatattaaattgaaagaaaaagggaaggaacgaaagaaaaaaaagaaagggaagaaggagttttttttttttttttatttttttgttgtgttttagtagggagagatattgagggttttaggagatttggtgggtattttttttgggttgtttttattaatagatttgttgttggttttatgttagttaggtggtatattaagaggggatttagaaagaatagaagattagaatttgttggtgttagatagaaaagatatgagtttgagttatatttgaagaaagaaagagaattgggttgatgaaaaggttatattgagaattatgggagtagaagttgtgaaggtaagaaggaagacggaagaaaatatattatcgatgtagagaaagagaaggatgttgattgattttggaggtagtttttgtatgttttggggtttatttttttatttttttttttattttttttttttttttttttttttatttttttatttttttgaatttaattttgtgatatttttttgggaattttatattttcgtagtataaggaatttataggattaatttattgtttgttattttgtttaaagtgaatatttaacgtttaattttgtgttaaatttagaacgtagtaaataaaatttggaattgattgtaaagggttatggattgttagagattaaaaggtttttaaagattattttgtttaattttagtattttatttaaggaaattgaggtttaatattgataaagttatttgtttatagatacgtggttagttagtggaaaagttgggattgaatttaaaggatggttatttttattttataatattataaggaggaggtttgttatttggcggttagtatttgttaggttgttaagataagatttgatgtttttgggaaatgtgggtgaattattggggattattggaaggagaacgttgtttattttttgattagtttattttgaaattttgttaggaaaattttattattttatgaaaataaatttagtttttttttattttttttttgattattgggaataatagtaagatagtttttttagtgattagaaattaagttatattgattttttttgataagttattttaggataatttttaataaattattttattggaagtattggttggtattttgttttatagaatgtttttcggtttttttgttttgggttttgattatttggtaaatattttagttttatgatgacgtggtgtttagatggtaatgtatgaattgtattattaaaattgtttgtttttagttatattatatttgttttaggaatgttagagaatataaatatagtttatttattaaattattttagttggagtatttgagagagagaaagtataaaatttggtggttggtatggcgttttatttcgagttagagaattttgaagttgggaggtttttttggaagttttttgttgtcgttttttttaacgtgatgttattattttttttttgaatgtgtttaataaaaggtagtttttagaatgtgttaattgttagaagaaggaaaattataattgaatagaaatttttaaattaatttattttaatatggatcgtagatttgttatgttgattgtattgtaaaacgaattaagttagaattatattggaatttttttttggtgtgtaaaattttagtgtttttttgaggtagtgtttttagtggtgtacgttttttttgtgtagaggaaggttttttatattattttagtatagtgttttttatttttgtggtttttattatttttattgtttttttttttggtattgtatttttttttgatatgggttttaagatgtagttgtatttaaagatttgatggtaaaaataggttagtttttaaagtaattatagttttttgtaatttttggattttattaattagttttgatatttggttgaatgtgtttttgtagatattagtgtaaattttatagagggttattgagttttagtagttttttttaagtaaagttttatttattttttttttttttttttttagaaaatatttaaggttttttatgttttttttagtgttcgttgttttttttttatttggggtttttattgatttattttgacgttattgatttataaatggatttttattttttttgttgggggttagtattttgatgattatttatttttatttttattgtgttattttttatataatatttttgttttggttataaaagtaagatagaatttttgtagaaaaattcggaaaatagagaaaagtaaatagaagaaaaaaaaattatttataatttattattaaaaataaataaataaataaaattatagttttattgttaatatgttgataggtttttgtttttgtttagtatttagaatttttttagttaggttttaaattaattttataattttatttttttgtttgtattttttttggggatatatattgtttggtataagattttttatattttttttttaatgaattttttttgattatgtaaataatttatgtggttgtatatatttttaatagtatttataaggaaaataaagtaaaaattatttttaaaaatattttattttattaaaaaaaattttattattttgaaataaaagttattgatattttggggattattttattattatgtgtttatgttatttttatatatatgattttttataaatgagataggagtatttatgcggtttttattatggatatttgtttttattttttatttatttatttttttttttttatttttttttttttttttattttaattttttttttttagattgttagtggtattagttttgtttgtgtttttttatattttatgtttttataattttattaaatgttttgtagttataaatatatgttgtgattgttttttatataaattagattatattatatgtttttttatgtattttttttttttttatttaatagtgatagattgttgaaattttttttttgtttttttatgattgcgtattattttttgattgattgtagtatgaattattgaatgtagttatgataaataatattgtaataaatatttttgtgtttataggacgtgagatgatttgattaagaaaagaatagatttttagattggaatagatatttttagattgttttttaaatggtatggtgattcgtatttttattagtaagtttttttgtattttgttaagggacgatgtttttaaattgtaagaaagggtgggatgttttgtttatttgaaatttaaaatattaagataaatatggggtaataatatgattattataataatatatataaaagagaatttattaagggatgattatcgttttttagagttgggttttggggaagtattatttatagaaatgagttttaggaggttaggtatattggtttacgtttgtaattttagtattttgggaggtagaggtaggtgggttatttgaggttaggagtttgagattagtttggttaatatggtgaaattttatttattaaaaatataaaaattagttgggtatggtggtatatgtttgtagttttagttatttggggggttgaggtatgagaaatatttgaaattaggaggcggaggttgtagtgagttaagatcgtgttattttattttagtttgggtgatagagtgagcgtatgttttaaaaatagataaataaataaataaataaataaaaaagaaaagaaatgagttttagggttcgaaatgtaattttatttttagtatgatttttttttttattattcgatagtttttgattagtgtggtagttagaaattttttttttggtttaatttgtttttttatagtttttgttaaaagtttaaatggtataatatattataggtgattttttaatatttgagttaattttgaaaatatatagatggatggatgttagggtgagatttgattttaagtttttatgaatgtggtttatattttaaatattttaaaaataattgtgtatgtcgtggtgttaggagttaggtaggtggaagggttaggttttttaggttatttttcgagttgtatcggacgtttgttttattttttttatagagatggtggtatagtttaattttttttttttttttattgggtgtttttttttaatttatggattgtttgatattttttgtattcgtttttgttgttggtgtttgttggtattttttgttttttttgttttttattttttttgtttgttttgttttttttttttttatttttttcgtattttttagttttattataaaaaggtttgggtattatagttatggtttatttttgagattgtattttttggttagtaagtttatttggttttattattttggttgtaattttaaggttattagtttattttagttttgtttatttttaagttttttgtggataggttttttatttgatagagtgttttttttagtttttttttaatttttttatttgatattgttttttgggatttagaggtttttgagggtttggggtttttttgtgcgttgaggtgggttttgtagattttgtcgtcgagagaattttgattagttcgttttgagaaagaatgttaagtggttagggttttattaagtaaagggtttttatatgataatggtttatagagttgttaggagaataaatggggtaatttggagtgtgattttattattttttagtgtatttttagtgtcgggaaaagttatgagtagggttttcgttttaatttttaaattatgaatttatttatatttgtggattagataatgttttaatattatttttatagtgtgtgtgtgtgtgtgtgtgtgtgtgtgtgtttatgtgtgtgtgtgtgtgtggtttaatgtgtataatttatttgaatttagttgttttgtggtttattttttattgagaattgtttttttttttttttttttaagaaaatattagtttttaaagtatgaagttttttttgtgagtttattagtagtgaggggtgtggtgtgaggatttatattggtgataatgagatttaataattattgaatttaggcgattttgatataaattatattgattaaaataatattaagtacgtgatgttggtgatatttgaatatttgttaggaagaatatttgtatggtaataattggttgtaaatggaagagatttgtatgttttattgtttttatagttttaatatatatttttattggagaatttgaaattaatttatgtaggggaggttatgggagtaaaagtaatatagagaattagtaggaatcggtttatttgtttgtttttgtttttttttgtttttaagaatttgggttatttttggttttagtatttagttttaattatgaataatatatgagttaggggaaaggtgtatttataaatttgaaatttttttatgtttttttttttttatattttttttttgtagttttttttttatttttttattttttgtgtaaaggtagtaattttttttttgttttttgagatagagtttcgtttcgttgtttaggttggagtgtagtagtgtgatttcggtttattgtaattttcgttttttgggtttaagtgatttttttgttttagttttttgagtaattgggattataggtatgtgttattgtgattggttaattttttatatttttagtagagataggattttattatgttggttaggttgttttcgaatttttgatttcgtgattcgttcgtttggattttttaaagtgttgggattatagttgtgagttatcgtattcggttaaggtagtaatttttatttgagaaagtttggaattttgatttaagttttttgagtttttattgtggtttgtggttatttattgtgatatttattttttatttttggttttttgatttttaaaatgagattgtttattttacgtggttgttaaatgtattataatttttttttttattttttttttttaaaggaaatttggaatttttaaagttattaaatggagtttttttgtgttttttttgttgttgttgtttgtttgtttgtttgagatagagtttcgttttgtcgtttaggttggagtgtagtggtatgtttttggtttattgtaatttttgttttttgggtttaagtaattttgtttcgttttagtttttcgagtagttgggattataggcgttcgttattacgtttagttaatttttgtatttttagtagagacggggttttattatgttggttaggatggtttcgaatttttgattttgtgatttatttgttttagttttttaaagtgttgggattataggcgtgagttattatatttgatttaaatggagtatttttagggttatatggttaggggtaattaaaaatgttatatgttattattgtatttatgaatattatttttttttagagaagaaaggagttatatgattgtatttttggcgaaatttgattgtattttggtaaaatttgtgttaggattaggatagttattaatgacgtgttttttgatttttatgattgaagagttttaggttggtgttgtcgtaggggatttttgcgtggtatggtttttttgtattggcgttagttgtggtgagatatagtttgtagttatagtaggataatgttaagtttaatggtatttgttgtttaggagtaaaagaattatatagtaataatatatattatcgtcgagtatttatttattttattgtatgtgtttgaaggattaaatcgaagttagagtttttcgtttatgtattaaaataaaatgtagatagtgttgagttattaaaatgatagtgtatttgtaaagggaagttagtgaaggtttaaaggtgaagatttaaaaatatatagatagtttaaaattgtaaataaaaaaatgttatatagagatttttatgagtttagaaaattaggaggagatttgagtcgagagaaaataaggttagttttttttaagtggtagatttttgtagtttttggaaagatggaaataaatatggttaggcgcggtgggttatatttggaattttagtattttgggaggttgagataggtaggttatttgaggttaggagtttgagattagtttggttaatatagtgaaatttcgtttttattgaaaatataaaaattagttgggtgtggtgatgtttatttgtagttttagttattcgggagaatcgttggaatttaggaggtggtggttgtagtgagttaagatcgtattattgtattttagtttgggtgatagagtgagattttgttttaaaaaaaaaaaaaaaaaaaaaaaaagaaatgaaaagaaaaagatgggaagaaataaaagttgtaaaaggataaatggatagatttagggcggaaagtaaggatagagtaggatttgagcgtgagatttgttatttgggtttaggtgaaatgaaataaagaaaagggttggagaagttagaagtgggttatagaataatgagatggtgaatggggtttaaagtgtgggtcgttaggattgttaggaggagttatatttttagggtagggttaagttgtaagtaattagtattatttagtagagttttgtagaagtgaatggaaagatttttaaaaaatttatgaatggtagtggaaaaaaaagaattgaaaggaaagtagaaggtttatgggttagataaatttatttttagatatatgattgaattgaaatttagataaaatattatttttttatttagcgttttttattcgttagaagtttagtttttttatattttatttatataagagtaatgtagatttttaaattaatatatgtgtttatagatatgtggatagaaatttattgttgattagaatattatgaattaaggaaattttaataaaatatatttggaaagtataatatgggattgaaatttgaagttaatgataagattataaagatttagagttaattttttatgtattattttgtaaagaataaaatattatttttttttgggtttgaagtttatattagtttttttattaagatgataattataggggtgagttttgagattttttatttttaaggtttttattaatcgttatttggatatttgtttttcgttttttgtattgtttgttttttatttgaatagtttagatatttttagtatgtttattgtttataagtttatttaggatttcgaagttttagaaaaaagttgtttttagtttggttgtttttttggtttgtattgtgttttttttttatgtttttagtttttttaagttggatggtttttttttgattgtatagttttatttttaattgtttttattgttattttttattatattaggggtttttttttttttaggtttttaaggaaatattgtttttgaggggattatgtattaattttagtaggtgtttggagttataatattttatttttttgtagtagttggaaagatttttttttaaatattagatttttttgattttgttaaacggtttgatttttttttttgttttggtgattagttatttttgtttaatatgttagtttttttgtttttttttatttaggtaaatttagatatttgttttagtttaggttttagttttttcgttttgttttttttgtttcggagattttatttattttttttaatttttttaattttaatgtaggttgttttaaaatttatatttttaggtttgatacgttttttatttttattttgtatgtttatgttattttggagaattttttattattttaaattaagttttgttttttttttcgttattaatagtgtattgggtatagtgtattgggttgaggatttatatatttttttttagtattgttagttaggagattatttgttaatgggaattattagttttggttttttatattttagttatttttagttttattattttattttttttgtattcgtatatagattaatattttattttttttatttttaattttgtttttatggcgtttttagaaatgatataggcggatatttattaaatttttatttggtttgtataagtggaggagttttaggtgaagggaataaaagtttaatttgtattttgaaaatagagagttacggtttttcgattaatttatatatttgtattaatttatcgatttagaagtttttgaatgaagaggaggtcgggtttttttgacgaaggattttattatattgttaagaattaatattgttgtttttttttttagttttttttaaagggatttatagttttttgttagggtgattgtgtattggggaaaaggaattaattagattttttggggattattggtgattggttttgagttgatattaattttaggagattttaaatattattgtggtttagtagttagagtagtggtacgtggaggttaggtgatttttggagtttttattttatgtttgtgtttatttttatagtattttgtttaggataacgtggtagggtttatattgttgtagtggatttttggaggtttgtattttttaatttttaatttagagttgtttatagttatagtattatttagtttaaagtatttttgtgataattatatttttggttttaaatttttattggtgtttagttgttaggaataatgtagttttttttagttcgatagttaaaattttttataaagttttttttttttttatttttagtttttttggttataaatttttaatttaatatattgtattttattttttttagtttttagatatattattttttaatacgaaatatttattttttttttagttttgtttttatttacgttgttttttttgtttggtatttttttttggtttttttttttggatttgtgtggtgtttgttttagtataaatatattatgtttttttgtaaaatgttttttttttattttagttggtaatagttagggaaatgagtaaaaacgtgtggatagattaatttattagtatcggggagtcgggtgggcgggggtggggggtatagtgtggcgtagggtatgtttttttgtgggtaggtcgttaataatttttataaataaaagattgttttgtttatatttgtttattagagttagtattttttaaatttgtttaaggtgaaagtgagtgttttgtgttttaaaaattatatgggaagtatagaaataggaaatgtttattttgtttaatgtggaagtatattttataataggtggttttttaatttgtataaataaaataaaattggttggttaaaatttattagagaagaagaggaagtaatcgttaggtggtaggattaggagtagatggggattatttatttagatttttaattttttttgttgagtgtttttttaattaagtatttttttttagatgttaaataaatttttatatttttaaatagtattttttttagaaaagtgtatttttatgttagttttttttttttttaaagttaggggtagaataattatatagtattaatagagtttgtgtaagtttaaatagtttaattttttttttaggttttttatttgaagtttttaaattatatagttaaaataaaaatagtatagaatttaaattgagattattatatatcgtagggattttttttatttttatattaagtaaggtagtgttagttttggtggttcgtgtagatttagtgtattggaggtagaagttttaggtggattgatttttgtttttatttagatttttggtgtttttaggtagtttggaataattagattttggtgtttttaggtagtttggaataattagattttggtgtttttaggtagtttggaataattagagttgtttttggtttttcggaaatattgtaattttttgtgtaatgttagtttttgattatttttgaatttttttttttagatttataaggttttgtcgttggttttttttttatttttttgacgattatattttaattttttttaataaatatttatgaagtatttatatagtatttattgacggttatagttaggtgtagttttgtggatttgtatataaatgaattagatgagtcggtgtttatcggttttggggtttatagattaaggttcgttttgtcggtattttgggtttttttttgtcgtttgtatttggaacgtttggcggttttcgtgttttttttttagtttttttttttattgtgtttttttggaaaggtttttttgttacggttttaattataaaattgtatttttagttttatttttttatttgaggtgaagtatgaaatttttttttgtttatttcgaatttagttagtttattacgagttttttttgtatttgttagtttttgttagtagttgtaaaagttttttttttttttagatttttatatttggaaatcgtttttaagtcgtttttttttttttattgtgtgtttaggaatttatttttgggttttttttgatcggttttttttttttttttttttttttttttcgttttattgtttttatttattttagttttaaggtcgtgtttttgttttaatttttttattgtgttttttttatttatattagagtttttttttttaaattttgttcgattagtgttatttttattaagtgatagagatgatgtttttattttttatatttttaatagtatttaatttaatatttggtatttattagaggtattaacgatgtttgttgttttgtgtggcgaaggtatatttggattttggatggttagttttagttttttatttttgttgttttatagggattttaaatgtggagcgttttttattgtttttaattagggaaatttagtttcgtagaagatagtgaaattgatgaaagtattgggaaatggaatttaggaaagttaaagaattggtattatttgatgtgagaaagagaagcgaagatgatgagagattttagggaaaaggttatatgttttgttttttttgagataagcgtgtgtattttttttgtttttatttttatttgtgtttatttttggagggatttttaattatttaacgtttgggtattggttacggtgtttatcgtttgcgtgtgaatttggatatggtttttaagttgtgtggtgttgtttgttggtgcggtttaggatgtatagggttgagatggtgttgtatgtatatttatcgagtatatttttttgggagaggtgtggatattatcgtgaagggggtttagattttttttttaaatgtttgtatttttatagggattagatatggagataagaatttttagaagagggagaggtttgaggtatagtaggaaggtataagtttaaaggaagtgaagatttttagtgagagttattagatttttgaaatggattatagggaaagtttgtggtttttttttttttagaaatgttaaatttataatagaaaatttttttatcgtggtttgagtgttaaattttttggaggtttggggatggggtcgggagttttttgtttttatatttttatggtttatttattcgggtggtttagtttgttttgtaagtagggggtgggagcggggttgtttattttaattatagtagttaaatgtgttatttatgagaaataataaaagatttttttttttttttttttttagattttttttagttaaatgttgttgtttttttaaatagaggaggttgttttgtattttttttttcgtagtgttcgaatttagtttttgtatatattttttttagtagtttagagtatatttatgagtttagattatgaggaatgtttattatttttttgaaagatggtgtgtggaggatgtgtatagatagaagttaggttgttgaagattttattgaatttattagtattaataatagatattgttagtgaggttcgaatgtttttgtttatttttttgatttaataaatagttattgagtaaggtttttttttgtgttcggtaagatgtttgttatttgttgaagagataaagatgtatgagatatggtttttgtttttaaagtatttataatttagtagggaagatagttaggtgtataaataattatatgtgttataaagaaacgattatttcggtttaaaggaaggttgttgttgatgaaggatggttgtatagtagaattataatcgttagtttgaaatttaatttttttaagttttgttatttttattttgtattagttttattttttttttttttaaaatatttatttgtataggtattagttatatggtttttatattggaatagtttagaaaggtgtttattggaaagtttcgttagtattttcgtttttatttatttaatttattattcgtttttttattagaataaggaattattgtttattaattttttgagtatatatttagcgtttatttatgtaaaataatatatatatattttaaaatttttttttttttatataaaaggtagtttattgtttgttttgttaatttaatagtatattttgagattttattatgtaagattttattatggtatattttgagatgtattatgttagtatatagaatgtatgttttttttttttttttaggtagtataatattttttagtattgtatcgttttggagatattagagtgtgttagttattaattagttgtataatagattattttataatatagtggtttaaaataataatttttttattagttataattttatgggtgaattatttggtttgagatttgttaagggttttttattgttgtttttgtttggatttgtttatatggatgtgattatttggggttagatggtttaagatggttttattagtaggttgttgggagagtttgattttagttggaatatgtgttttgagtaaattagttttagttgttttatatggcgattgggttttataaaaatagagaggggttggtttcgttgtggaggttttattaagtttttatttgaattttattggttaatgttttattggtaaaagtaggttatggggttaagtttagagttaatgtggaagtaattttaggatgagaaatttattagatgttattatgtaattatttattatttatggagtaattaattagtttttgatgatggatatttgtttatttttagttttttggtattgtagataatgttttaatagataattttgtatattagttagtttatatgtgagtagggtaagtattagaagtagtattgattttgtgttggatagagggtagatgtttttttaattatttatttattttatttttgtggtgttgtttttttagatattttaagtttgtgtttttttgttattcgtgtaggagttttgaaaatgtgaaaagattttagataggaaatgtatataaattgaattaattagaaatttatttttaaaataataaaaaatatgaaagttagaatagaaattaaataattttgagtaaagtaatgtgtatattatttgaagaaatataagtatgtttgttataataatattttatatttttgttgtgtttatagtatagaaatatttagtttgtttttagtattttaatttttagaataattttatgagttgaaagtataattggttttattatgtgtgtgtatgtgtgtgtgtgtgtgcgtgtgtatatgtatgaatgtatttaaaggtttagagaagttatttaatttgttttaattaataagtaatagttagaatatatatttagttttgtgataataaatttgacgttgttttattaatcgtattttattagtagggatttgtattttgtatttggtttagtttttaaagatatatatgtgtttaatttgttaattgttttgttagtataattataattatatatgatattattttaggaggttttttttaaaaatatataagtagttaatttttaatttttgaataggtggggaatttttttgaagtttttttttgttttatatatgttattggtatttaggttgagagttttattttttgattatagtttttagtaaattttgacggaggaattttttttaagtttagggttttgtttttagattttagaaaagaggagtttttttaaataaaattttgtttggttttttcgtaatggatgtagaaggtagattgtttttttttttttaatttatatttagacgttttcgtaaggggtttggttttggtaaagtgggttttatatataaattatttatttttttgaagcgtgattgattagtaaagttgttttgtttaagggtagtttgttttttttagtttggatgttgataggttcgatatgtatagatttttaagtaggtcgttagtttttaggttgtaggttgtaggttaggacgtttgtttttgagggagaagagaggagaagaaatttatttcgggggtaagaattaagttatattatagaatttttaagatatagtagggtaggttaatatagtttttgtttagagagtttttgatggtgttgggtgttaagaaaattatggttgtataagatatatagagtgaaggtgaatataaagatgtttaggtaaagtttgtgtatatggtattgatttttatttgtttaagaatttttaaatattaaagagagttaaagaaagatagaaatttgatgtttaattaaagtagtttatgatggaagtttggaaatatagttaagtaataatattgtaaatagaacgaggtatagattatgtttttgtatgtttgtttttgtggtatttaatagcgtgttttttataagtagaatttgtataaatatatagttataaaatgttagagttgaaaattattttataaatcgttttgtttaggttttattattttaggaatgagttaatagaggtatagataggttaggtaagtggttttagttgttttgagttagattaggttttttaaattttagtgaagtagttgttataaaattgtgttgttagtattttaataaatgttatgtgaatgtaggaatattttattttttttgagattgagttttgttttgtcgtttaggttggagtgtagtggttcgatttcgttttattgtaattttcgttttttgagtttaagtgatttttttgttttaggtatttaagtatttgggattataggtatgtattattatgtttggttaatttttgtatttttagtagagatagggttttattatgttcgttaggttggttagaaatttttgattttaagtgattcgtttgtttcggtttttttaagtgttgggattataggtatgagatattgtgtttagttaaaggaatatatttatttttttttttttattgtagaatttattattattattatattttaatttttggggtatatgtgtagaacgtgtaggttttttatataggtatatacgtgttatggtggtttgttgtatttattattttgttatatatattaggtattttttttaatgttattttttttttagatttttattttttaataggttttagtgtgtgatgtttttttttttaggtttatgttgtttttattgtttaatttttatttacgagtgagaatatgtggtgttaggttttttgtttttgtgatagtttgttgagaatgatggtttttagttttatttatgtttttgtaaaggatatgaatttatttttttttagagttgtatagtattttatggtgtatatgtgttatagtttttttatttagtttattattgatggatatttgggttggttttaagtcgtcgttattgtgaatagtgttataataaatatatatgtgtataaatttttttattatgaagatatatttattttttttttaaagagatttatttaagagttattgatttcgtaaaattatggaaagttatttttttaatttatttatgtattaattaaaggagatttttttaaggtattttttattaggggcggtgggaaaagggagggttataaggatgaattgattagcgttttttgaaagatttttaggaatttgggttttaagatattttggttattttatagaaagttttaaatgttagaattgggtgaaaaaaatttaattttttttataatggtttgttatatgtttaaggtgtagatagtttggtagggataatttagtttgcggttaagagtggtttttatgtgtacgttagtaaattggttattagcgtagtagtaggagtagaaattattaagatcgtggattttttagtttgttatttgatttttgtttcgtaatgttgtttgtatattgtttatttggtgtaggttatgtttggtttgttttaaatatttcgtgtttgttggagttgaggatgtagcggatttattagttttataggaatggatttttttatttaaagtttaatttggtttaggcgtagtggtttatgtttgtattttagtattttggaaggttgaggtgggaggattatttgagtttaggagtttaagattagtttaggtaatttagcgagattttatttttataaaaatattaaaaaattaattaggcgtgttttagttatttgggaaattgaggtgggagaattatttttttttaggagttgatgagtttttttttattcgtgttgagttatgttgtattattgtattttagtttgagtgatagagtaagattttggttttaaaagaaaataaaataaaaaataaagtttgatttgtttttttattttatggtttattgttaattttattatttttggtttttgattgttttatacgcgggagtgtagggagaaatttttgttagtttttttaaagatggttttgataatttgttgttttgaataaatttgaatatttgataaaagagtgtttagaattttttttttttttataaagtgtaaggggttagatgtattgttttttttgggatataaattagttattgttttgttagttattgggaatattttagaagtttatttattattatttgtaatggtattttatatttggttttttgtgttataaagaaaaatttgtaaatatttaaaagtaaggattttagtgaaatgtgggttttgttttattttgtttggtgtgggaggttgtgtaagtttaattttaagaatatcggtagtggtatttatttttattttaagaattgagggaggcgaggtttgtgtagaattaaattattttgttatatttgtgagggttttttgtagaacgaaggtaagtaaatttaaataaataaaataggaatatgttggaaatagttagaggtatacgtttggaattaaggttacgagttgagttttgaaaagtttatgagagattggtttgtttgaaaatatttttcgtgtgtgtgtgtgtgcgtgtgtgtgtgtgtatgtgtgcgcgttgttttgtttgttacggttttggttcgtgttatcgtatttattttatgtgtggtggttggaaatgttagggttttttgattgaaaaaggaaataagagattatgttatttatagtatagaagtgggatgagttttattatggtgtatacgtgtgcgtttgtgtgtttatgtttgtgttatttttatgtgtttttgtgttagtgtttgtgtgtttgtgtatatgtagtgtgtttgcgtgtttgtatttgtgtgtatgtttgtgtatatgtgtttgcgtgtatgtgtgtgtttttgtgtatgtgtttgtgtatgtgttgtatgtgtgtttatgttgtgtttgtatttgtgtgtgtgttgtgtggtatttgtgtgtgtgggtttgtgtatgtgtttgtgtgttgtgtgtgtttttgtgtttgtgtatgtatgtgtttttgtgtgtgttgtttatgtgtatttgtttgcgtgtgtttttgtgtatgtgtttatgttgtgtagtgtttgtatgtttatggttgtgtgtgttgtgtgtgtttatgtatgtttgtgtgtgttgtgtgtgtttttgtgtttgtgtgtttgtgtgttttgtgtgtgtatgttgtgtagtatatgtgtgtgtttttgtgtttgtgtatgtgtttgtgtgtgttgtgtgtgtgtatttgtttgtgtgtttttgtgtgtatgtgttgtgtagtgtgtgtgttgtgtgtgtttgtgtgttgtgcgtgtttgtgtatgtgtttatgtgatgtgtgtggtgtgtgtgtttgcgtttttgtgtttgtgtttgtatatgggtttgtgtgtgtgttgtgtgtgtgtatttgtgtgtttttatgtgtgtatgtgttgtgtagtgtgtgtgttttttgtatgtttgtgtttgtatgttagtgtgtgtttgtgtgtgtttgtgtatgtttgtgggtgtttttgtgtttgtgtgttagtgtgtgtttgtgtgtgtttttgtgttagtgtgtgtttttgtgtttgtgtgtgtttgtatatgtttgtgtgtgtgtttttgtgtttgtgtgttattgtgtgtttttgtgtgtgtttttgtgtttatgtgtgtttgtgtatgtttgtgtgtttgtgtgtttttgtgttagtgtgtgtttgtgtttttgtgtttgtgtgtttttgtgttagtgtgtgtttgtgtgtgtttttgtgtttgtgtgtgtttgtgtgtgtgtgtttttgtgtgttagtgtgtgtgtttgtgtttgttgtgtttttgtgtttgtgtgtgtttgtgtatgtttgtgtgtgtgtttttgtgtttgtgtgttagtgtgtgtttgtgtgtgtgtttttgtgtttatgtgtttgtgtgttaatgtgtgtttgtgtttatgtgtgtttgtgtgttaatgtgtgtttgtgtttatgtgtgtttgtgtgttaatgtgtgtttgtgtgtgtttttgttagtgtgtgtttgtgtgtgtttttgtgtttgtgtgttagtgtgtgtttgtgtgtgtttttgtgtttatgtgtgtttgtgtgttaatgggtgtttgtgtgtgtttatgttagtgtgtgtttgtgtgtgtttttgtgtttgtgtgtgtgtttttgtgtttgtgttagtgtgtgtttgtgtgtgtttttgtgtttatgtgtgtttttgtgttagtgtgtgtttgtgtgtgtgtttttatgttagtgtgtgtttgtgtgtgtttgtgtgtgtttgtgtgtgtttttgtgtgtgtgtgtgtgtgtatgtttgtgtgtgtgtgtttttatatttttgcgtatataggggtatagtatagttatgtaaaatcgtttttttttaatttatagttttttttttttttaattagaagttattttgttttgttgtgaaaataaataaattatttttttataaaagaaagattaaataatttgaaaagtttaaataaaatttattttatgatataatattaagaaatagaaatttttaatggagaaaattttatattagattgaggaagatagattagtttaattggagtttttgtttgttttatattttttttttattttttatttttatttgttaataaaattatgtttttttataggggataggtttattttttaatgtttgattaatatgttttttatttgaatttaaaatatttggtgacgattggtaaagaatgaggatgggaaattgaatattatattattttatgaaagttttttttttttttattttttttttttttttttttttttttttttttttttttttttttttttttttttttttttttttttttttttgtttttgttgtgatcgtttttttgattgagtagacgtggatatgggggagttaattgtaggagtgattggcgttttatagatatcgttttttgaggtagttgttattagaggattgttattgaaaatgtaagaagagtttggtatttgattgtattttgtataatttaagtaggataaattgttgtagaagatgatattagaaatagttattatgtagtgggtttttattatatgatagatacggtgttgttataagtttgtgatttgtattgtttgagttttgaatatttgtagtaggtacgagtatttgttttatttttagattaggagatagtagtttaaagaaagtgaacgatttgttagtggttatatagttaggaagtggtagggggcgtttagtcgggttggattttgaaggttatgtagtatttttatatagatttaaattttttaaatcgatttttatttatgtgtgtttggtagttatatgttaataagttataatttttttatttatttcgggaaaatattatttttttttatttgtatttatcgttattttatttttgttgtaagaaattaaaacgtgaagaagatagatttgaagaagatttttttttggttatttttgatgatgagatgtagttaggaagatggagtttagatgttaaaatattggaatttttgattgatgtatatttatggttagagggaaagtaagttgtattgtggagttaagaaatttgagaaatataggaaatttaagttgagaaaaatttataattatgatgtttttatgtgtaggaaattttaggtttttttgcgtttaatttttttggaaagtttttatttaaaaaagtttttaaaatttttatttagttatttttaattgataaataaaaattgtatataaaggtttttgtattttatttcgtatgataaagggtcgtacggtttttttttgatgtttgagttaagtgagtatattaatagtatgtagcgtttagtttttattaatttttaataggtttatttatttttgatttttttattttaaagttaaaaaaaagattatatatagagagaaacgattgtattatagttttttttttaatatgagtcgtttaatttttaatggtttttttttatcgagaagaaggttttagtaattaagtgattaagttatttagttaaatttttttttttttttttattaatatttaattagtattgatgttttttttggttaaattttattttagagtttgtataattgaattttttttataaatgaattttttaaaatgtgtatttgaaatattttttagtttaagaaaatagtttttaataagttatgtattgatttttttttattttgaaatattttttaagtgattttttttgaaagattttttgtggtttattgaatataaaaaataaatcgtgtattaggtttggtagaggttatagggatatagataatttggtatttgtttttaaggagtttaggtttttaagaggaaataagatatttcgataaatagttataaggtaaaatagagaattgtttagtgttgtaatttaattgttgatttcgttgtatttaaaagttggttaaattatagttttattgaatgttaataaatttttattttttttttgtatggaattttaaaaattttttattttttttgggttataattatggtgattatattttttatggtaaaaattaagatacgtcgtttgataaaggatttttgtgttatttttaggtgtgagattatttatatttagattttttttaaagtaggtttttttaggtaggttttataaaaatagaggtttgttaaataggtgtgtttttagattttttattaaaagtttataatataaatagtattttattttgtatttgaattaatatgttatattttaaagtattattttatagtttaagggtgtgtgttagtttatttataaaaatatattgttgtatagagtaataatatttgttattatttaggtgtaataaaaaggttttaagtggttttttttaggtttttaattttttttttgaagataaagtttttttttttatttttatggtttaagatttttggattttgtaagtgattgttattgaagtgtgttagatgtgagtagttgtgagtatagtattttaaaagaaggtgaaggagtgatttttttttttttattgttttttttattattatttgtagtttttatatatgtaatttttttaaaatagtaaggtatgggaagggatattagttagggtcgttatagtttaggtatgggatttttgaagtgaggagatagagatgaaagcggtttgtattgataaatgatagatgatgaaattaaggtttgttggattaagatttaatgatttatttaaagttatatagtttgttggtggtagagttagtttttaatttttagttttgtgagtaagggaggtttttatttttattatgatgtttttttggtgttttggggttattttggtcgatttttatttattgtgatgttgggtatgttttttttatgtgattatataattttagaattataattttaaaatgatatattattgtattattatgggaaaataagttggaagagttggagaggcgatgtttgttattattggtttttttatagaggtgattttgtaggttattaggatttttttaggtcgatttttagattttgaagttgagtttaaggtaagttttatacgttatggtttttgtttttttgggtattattgatttattgttgatttaggaatttttgggattagattttttttattaatgttttgtttatggttaaaatattatagagtttagtgggattattgttgtttttattagatggtttttatatttaattattttgtaatatggttgtatttgtaagttatttgttgatttttttgtagtttataagtataatgattgggtatttatagttatatgtgagatgtgttaattttaatttttatgttatagtatagagtatattataataattattatattattatagtttggttaatatggtgaaatttcgtttttattaaaaatataaaaattagttgggcgtggtagcgtacgtttgtaattttagttattagggagattgaggtaggagaattgtttgaattttgtggggtagaggttgtagtgagtcgagattatgttattgtattttagtttggataatagagtgagattttattttaaaaaaaaaaaaagaaaaaagtttaaaaatgtattttttttattaaaaatatatttaataattttgttaagatatttgattgatttttatatttagttttattttagtgtaattttttatttatttattttatttaatggttatttattgagtatttattatttggtagatatttttttgttttagtattaaataaatagataaaaattttagtttgtttgtggtttatatgggattggatggtgttaataattgtatcgaaaaataaaaattattagtttgttaaaaatttggattattgtgggagtagagagttaaaggaaaagggaatttatatgtattgaatattagtgattatgttatatgttgtgttgtgtggtttattttatttaattattatagtagttttgtgaaagatgaatatgattatttttattttttatagatgaagaattaagatttaggaatataatatattttgtttaaggttatattagtgaggaaataaatttatattagtttttttaatattatgttagatgtgatgatattattttagaattatatgtttgatatatggattattatattgaaattttagggtatatttttgtttattaataatatatattaaggaatgttattttatagatgtatggatacggaaaatgtgtgtgtgtgtgtatatatatgtatgtgtatatatatgtgtgtgtgtatttgtatgtgtgtgtgtgtatatatatatatatatatatatatatatatatatatattatttcgttttaagaatatttttatatgtaattatatggatgatttttgaggatattatgtttagtgaaataaattagttatagaaggataaatattgtatgattttatttatatgagtatttatagtagttaaatttatagaagtcgagaatatagtggtggttgttagggtttaggggaagagagaaatggggagttgttttttaataggaataaagaataagtaaattttatgttaagagtttttaatatatatatttatatatagatatatataaatgttattttaatggatatgtttaaaatattatttgaaatgtagttgttaagtttatgttttttttattatttttgtagattgatttttatttttgaatagtagtaattattatagtatattttttttttataataggtattttttatggaatattttgttttagattagtaatttgatgattatagtaatatgtgttttttagataatatatgattttttatttggttgagaatttagcggttgattttgttaaaaataggtttttaatggttgagtgtgatattttattacggggtgttatttgggagtttttttttttatatatgaaataagtatggttgtagaattgattatttttgtttttttgatgaaacgtatttagaattttaaagatattgaaaatatttttggttaaaattagttatatagaagtatggaatttgttagtgtttggggataaaatttttttgtgtattgaaaatgtagaagtagatagggaagtatttttggggaggagtgagaagttgtattaagtttggatgttggggtaggggtgaaggaggaggttttgatgatgtaggttttgattaggttggagttgatgtaatggtaagtgttgtggtcgtggtattttttggtgatgttattttaaggagttagttgttattagtgtttttaagagtttggttttttgggtgaggggtattaagggatagacgtgtattttaggatatttgttattttgttggttatttttttagtttggggtttttgtggaaaagatgtatgggttatgttttttagtttgttttattattttaaatatttttcgttattttagaataatatttaggttttcgatttgatttttaaaattttatattgttttcgtattgatttttaagttttagtttttattaattgtatatttttttattgtttgtgggttattcgaattgattttttgattttttaaatatattaggttgttttttttttgggattttttattatttgtgatttttgtttatattgtattgtttttaatttttttagggttggtttttttttgttttttaaattttagtttaaatgttattttttttgagaggtttttttggaatatttaattatttttttttttattattttattttaattttttgaatatttttatatagttaatgttgtgtttgtttattttttgagatttatgaaagtagggattatgtttgttatagtttcgatagtgtttttaagttttaggtgagtattttgtatatagtagtttaatgagtagtttgttaaatgaaggaaggaggtatttaggttgtagatgatttaaatgtaataaacgtatttgtaggttattttttaataatgtaaaagaaatgaagattaggttaatttttttttttaattttatattttagttttaacgtttagttatttttgattggttagagattaattaattatatgtaatagtttgttttgagggggtttaaatgtattgttttttttagtgatttgtaaatgtatcggtttaaaatttattttttggtatagattttagaatttttatttaatatattagaaatttttagggtttattttgaattttaaggttggtttaatttttttagtaagtagttgtttatgtatggatgtttataatgagtgattttattagaaatttattttagttatttaaagtgtgatgtattttatatatataaagtgtttttttatatgagtaggttagtgatattattgaatataaattaattgtttttgaatatattggaattttataaagttttttttgttttagaagtggaatttagttgaagatgggtttgtttttagaagattaagttattatagttgttaaaataaaaataaataaaataaagattttaaaaaataatagatgttggtaaggttgtggagaaataggaatgtttttatattgttggtgggaatgtaaattagttgaattattgtggaagatagtatagcgattttttaaggatttagaattagaaatattatttgagttattaattttattattgggtatatatttaaaggaatataaattattttgttataaagatatatgtatatgtatgtttattgtagtattatttataatcgtaaagatatggagttaatttaaatgttttttaatgatagattggataaagaaaatgtggtatatgtatattatggaatattatgtagttataaaaaggaataagattatgttttttgtagggatatagatgaagttggaagttattatttttagtaaattaatataggaatagaaaattaaatattgtatgtttttatttataaatgggagttgaataatgagaatatatggatatagggaggggaataatatattggagtttgttgagggtgggcgaggagagggagagtattaggataaatagttaatgtatgtggggtttaatatttaggtgatggttgataggtgtagtaaattattatggtatacgtttatttatgttataagtttgtatatggtgtatatgtattttagaatttaaagtaaaattttaaaaaataaataaagtaaaataagatttttatttattggggtaggtttatggtttttagggttgagaataatttttaggggtttgatttttaggaagggagaattttttttttttttgtagggagtatgggttgggtggtagttgtgtttttgttatttgaaagtgaaaagtggattttaaatgttgatttatattttataatattattggtgtttagtttttgatattttatgggatatttttttgtatttgggatttaattttattaatttagagagaagatgtagattaagttttaaaaatttgattttagaaaagatgttttaaataaagaatgggttattatttgtattcgtaaattatagagaatgtttcgtggtatggaattattttgttaagttttgtattttaatttaattttttatttgtttttattttagggtggtaattgttaatttggagattattatttagggtggatttaatagttttatatgggattttttttagggagaatgatgggaaattatttttttttatatttttttattttgggagagggggtttttattttttcgtttagtgtgatagtgagagtgaagtgaagagaagatttatgatgttaagattagggttgagtaatatggtaaattttagtttattttaagtgtagtaaatttttaggtagttagaagagtgacgtattttggttagtttaatattttatttaatttgggaatatttaatagattatttttttataatagatttttatagaatttaaatataataaaatatatttgatattataattatattgaatatatatttattttttttaatgatttaaaagatatttaaatattttattaagttttagagttatacggagaatattagttattttagaaacggttgttaatagggatttttggttgatagtgggatggtttgtttttgttgattgaaagtagtattttattggatgcggtgggtggggggtgggatattagttttcgtttttttaggtataattcggtaatttggggggtttttttaaaaatacgtagaatttaaaatagataatgtatgaaaagttttttagtgttgagtttaacgtagaaaaatatttagtatatataagatgatttgatttagtttatttgtgattggtttggtttatttttgttttttttttttaggggtgggggagttttttttatatagttaagggatttttaattagaggaatttgatatatttaatttaggataagtaggaattttttgatttttagcgttgtttatggttttagattaagtaataatagaagataattataaggaattattatgaattatggttaaatgttgaatggtgattttttaaattagttattagtatgattggattgtattttttgttttgggataagtttagatagagagagttgggagaagtaagtgtaaaaaagtttaggttgttttttttttttttttttttttttttttatatgttgttaatgggagggtaaatttttgtaaagtttttggagagcgttttgattttaattttgaaaatgttaagtttatatagtttttgttttggtaattttatttttataagttttttttatttatgtgtaaggatgtttattatagtattatgtattttaattttgtagtaaaaaaaaaaaaaaaatttggggaaaaaaagaaatgtttgtgtagggtattggttaaattggtaaattgatatgaaataaaatgttgttattaagaaaggtgatggatatatatgaatttatattttaaaatgtttgagatttattgtagagggaaaaagtggaagtttgtatggataatattattttattgatgagaaaaaaattagatatatatataaatgtatgtatatttatagtattttttggaaggatatataatatattgtttagttaatatataatttaaggattatgagtattataaattgaaattaatattattataaattaatataaattaagatttgttgatgtatatatagtattatggtaaaatgagtataattaaattatttaaaagtttgtttttttatatttgttaaatattttttagtttatgttttaatttgtttattttaatttttatttttattatttatataattaaattttaatttagtttagggttatttataatttttaaattgattattttattgtttttttagtagtgttgaagataatgatgatggtattagttattttttattgaatttttatgatgtgttaaatatttgtatttatattttttttaaatttttaaaattgtaaaagttgatgaggaagtagaggttttgttattttaaggaatttgttaaagttatgtagttagtaagtaagttttagagttagtattgaaatttaggtttaacgttaaagattgtattatttttatatgttattttgttttagatatagagttggtgaatttattttttaggtagtgtttttgtgggtaagatagatagttgtttaaaaagagatagaaaatatgttttggattgttatggtttgttagtattttttatttattattgttattaattattttgtgttttttatttgttttaattttgatcgtatatttataaagtttatggaaattgtttaagtgtattcgattttgttgatatttttatggtttgaacgttagttttatgagtaggggttaaatggagtatgttatttgaagattgttttagtttttagagttggatttggtttaaatgggaatgttatattattgtttattttaatgagataaagagtaaagaaaaataaaaaagtaaaatttgtatttgaaaatatttaagtaacgtaatttgtattagtcgaattaattttaagtttggtttggttttgattttagagatttttatagttttacgtgtatttttagggtggttatgtagaggtaataataataatattaggaagattattttaagtttttgtttttattttttgtttttttgatattttttatttgttttttatttagttatttattggggtatggtttttatttgaagttttttttggtatttttaatttattaggataagtggggtgggtgtagggggttgtgtttataaaatagatatttaatttggttttaggaaaggttttttagaggaaatgataattatacggagttttgaaagagaaattatagaggtagaggtgtttatttatttaggtagagagaacggtatgtgtataagggagagataaaagggtatatagtatatttgtatagttgtgagtttttaagtatttgattttttttgaatgaggatattgattataggttatttagttgattttgttaaagttttattatattaggattattagggtataaaaatatttttaaaataaatggttttgttattaaatattttttttataatattattgttgatattgtgatttttaaaaattttttatatttggttatatttgttttatttttttaaagttatattgatagatgatatattagggtaagatgaaaattgtagggatttgtgtagaatgaaacgataattttttgtttttaaaagggattgttgatataatattttttttgtaaaaatagggaaatgtttaaggttggagtttttgtttttaataatgaagatggatatttatatgaaaagaagataaaagaaaatagaatgttttagttgtgggttaagtagttggttatttttatttgttaggataaaaatattaaatgataattttttttttatttttttttatgaatttagtattaaagaatgttattaaattttaagttttattaatttttgataatgtataaatttgggtttatagtttatatatattatagttagggatttttatatattttttagttagttaagaaaatttttgtttggagttttttattgattattgtattatttaaatttattttttgtttatgaaaattgaaaaggtgaagattaaatttggaaatttacgtgtgttaatgtagatattaatatgaataaaagaaaaatatatgtattggattttggaaagtaaaattatagatttattttggtttaaggttagttataagtggaattgtaaagaaaggttagaaaataatatatggtttatatttaagaataagaatggttatattatgtataaaatgaattgagttaaaagataaatagtaaaatgttatggtttttattgttagtagatttttattaattataaattaaaggtagttagtaatatttatagattaaaaagttagttgaaaattgagatttttgtagtaaatattaagcgttgtgtggtatattagttatatgtgtataataaagataataaatttatgtaagtatagtaatgatgaaatgtgtataaagtagtttgaattttatagaagtaagtaaagtataaatagatagtatgtttaggtatagagaaaagtaagtgttattttagtatttgagttagtgataatttattgtttaggttttttagttgagttaatgtttatatggtgttatatattaattgaaattaaaatagtttgtgtatattattgttttggatagattattgagtgattagtagaaattatattaaataattatttttttacgagtgagggatttataatatttaaaatatttattttaaagttttaagttgttttgatagttttgtttgtttataaatattttttaaagagaggtagtatggtatatgtaatggaaaaagatagtaaagtggttagtattttaaatttaggatttagattgtttgggtttaagttttggttttgttatttattagttgtgttgattttgggtaagttatttaatttttttgtgttttagttttttttttagtaagtggggttaaggatagtatttattttatagggttgtgaagtcgaaataattaatataaataaaatatttagaataatgtttgatatagagtgagggttattatttagattttgttatagattagtagaatgattttagataggttatttaattttgatttttggttttttttttgtaagatgtaaaggataataaatattttatagtgtgattgtgagaattaaatgagatattatatggaaagtagttagttttgaaggaaatattttagatttttttttttttgtttttttttatttttttttttgtagggatatttgtaaggatattttttttagtatttttgtatgttaagtattttgtttttattttatttatttagttttgattatattttgtgaaattataaatagttagacgttagaatttaaagaattgatttgaagatttgtttttttattacgatattgtttttttatagaaatattttttttagaaatttttttaagattaatgttatttaattttggtttatttattttttgattagtgtgggttgtatttttatttgtgatattgaatatgtttgattattttatgtatatgttatgtttttttaattaaagtttgtgttttgtgagagtaagtattttttataattttttttggttagttttttttgtttggtttttagtttgattggattagaattggataggattagaggatttagtaggttaggagtgattattagttgtgaagttggtagtgtcgttaaggagtggaattaagatgtttattgtttttggggttatattgattatatttagatatttagattttggaaaatttagggtcgtttttgagtttatagtttatatttaagaagaagggtagaaatttaagaagtggttaagaaagatttttaataatttattcggatgttattaggggaagattaagagtatggtttttaaggcgtttttaaggatggtattatttgttgaatttattatggtcggggggttttaatagtttatagaagtttttaaatattttaggaagtttttgtttttattttatttttttttgatgggttatagtttgtattatagtaggaatttttttgtaatgagttgtatttatttttaggtaaatgttttagatggggatatgaggttttatttatagtttgtaaaatttttttaaagagattggtgtaaagtagagttttatggatttttttttggtatgtttgaagatttgatttgtttattttttaaaggttagatttattttttaggggttgatatttattaaaagttaattatataggtgtttaaataagaatgttagtgtatttatttgtaatgagaatattttagattaatatttatgtttgtttggttagtttatgttttttttgtagggaagtttttttaggaagttagatatgttgtagaggtagtttggtgagtatagaatttgaatataggaagttagaagagtgggtcggtgttaagttgagtttatacgtgtatttttaaggtttttttaggtagttggttaaggttttttatttatggttaaggttagcgttggttttttaattagtagtcgatgagtttttgttttgattggtagttttgttttttgtaggtatttagttgagttgtaattaaatattttaggattgggattattttgtttttttgcggggttttttttttttttgttttgttatgcgtttgtgttattgtggttttggggatggtatgtttgagggtagggttttatgtaggttttttttatagtataatggagtgttgttttaagatatatttaaagaagggtggtgagagaggtgtgtggttatttttgttaatataaattgtattgtttaatgtatataagagatgggaaaaagaagagagtaaaagaattttttttaggtaaatgtttattatggaaattgtgtgattatagatgtttatatataatttttagatatttgtttaagtttttcgttttcgttttatgtagaaggcgatggcgtgtttttttttttttgaattttttttatatatggaatgatgttattgttagtttttgtttttagtcgttttttttagaattggtttattttttgttgtttttgaatttttttttatttagaggttgttttggttttttgaggtatttacgggtatagttgagttgatggttaagcgcggaggttttatttgtagttgttttttatgaggaatagttgttttatgtttatggggagagtaagttttgtgttttaaatagttttgtgttttattttatttttttcgttataatagtttaatttttatgaagtttgttgtgatgtgagttataatattaatttttgggtgggggtggggggtattttttttttttggagtaatagaggagtagatatttgttttttttttttttttttttattgttagtttatagttaagagggaggtgtttagaggggttattttttgttttttttggtggtttgttttttatgagttgttgttattttttttgtacgtttatttgttagttgattttatttcgggtggaaggttttgtgtttgttttttttttttagtatttttttgtttatagtaaggggtgggtttgagttttattattagtgtgatatgtatttgtttatttgtgtattgatagagattcgttagtgatttaggtatgtttagttcggtgttgagtgttttaggtagtatcgtggttttaatagtttgtagaattttttaagtattttaggaagtttttgtttttattttgtttttttttgatgggttatagtttgttttatagtaggaatttttttgtaatgagttgtttttatttttaggtaaatattttaggtagggatatgaggttttatttatcgtttgtaaaatttttttaaagagattagtgtaaagtagaattttatgtaaaatttttttgttttatatgtggtatgtatgtttgtgtgtgtaataaaattgtagagttgatttgtagaatgggttaatgaagtttgttttatggtttaatttatggtaggagaatggagtttgtatagttattttttgttttaggttgtttaatatgtagggtggttgtggtagttgtttttttttttttttgttatttattttgtggatatttttcggttttaagggagtagtatatgtttttttatagttttttttttgtagaggttagttaaggacgtattttgtttattaggtgttaggattttcgttttatgcggttagttggtggtagttttgtgtttttttagtatagatgtggttggattggtattgggattatttgatttttttttatagggttttgttttaaatcgtgggttggtggttagattttttttagtttgagtatgtttaggtgaattttttgattgtgtaggttgtggttgatagttttggatagggaatagtttttaattttggttgtttattagaattagtttggagtatttaaaagttttggtgtttaagttatattttaaattaattttgttatattttttaaggataagatttagtgttttttaagtgattttattgtgtttgtaagattgagattaattattttttgggaaaagagaaaggaggaaagaggaaggtagagtaagataaggggagaagattggaattagggagaaggaagaaattaagggttggttagaggtggtgaagtaaggaggtgttttttagtaggtgtttggagatttttagtaaaaggacgatgtgtttgttttatttttgattttgtatttggacgtgaggaattaagagaggtttagaagaggaggtagggttttttttgtggaatttgtatgtatttgttttttttattagatagattgttttttagtcgtggatttttagatttagagtttattggaatgttttttagtttttgtttttttatttataaaatagagacgttaaatcgtatttgtaggttgttatgtggatttgataggatgatggtgaagttggatatatgtttgatattttgtaagggaagtttaatgatgatagattttagaagaagtttataattttattttaagttaattttttttataatttcgttttttttgttgtgttgaaaggtagtggttttgaaatgttgttttaggagagttaaaaagaaatatagaggttcgggtttattgacgggtttaggtatttgtattttttttaagcgttttgggtgattttgacggttagtgtttgggattttttttataggtgaaggttttaatcgtaaagttaagagagagagattttgtgttgtttatagagttttattgttttttagggtttgttttgtattttttagttgttttttttaatgattttagtgattgttttattttaatataggaaagaggggtatgcgaggcgtgttagggttagtagttatataggggtaattttggttaggttttattttttatttataagttaaattgagatgaattttaaaattggtattttttaaattagtaatttgtagttaaataaggagaaaacgtttttttatttttggtggtagaggtaaaaatgattggtttgttttgtatgttgtatttgtttgttttgaaagttttatatttggggttttcgtcgtgagttatgagagtgtatggtgaaataaagtattttttttatattaatatttgtttttaaaggtatgaaaagttttttggattataatgaattaaagcgtttgtatattgatacgtttttattgggtattgtgggaatgttggtttgtgggagtttataggatttttggtggatttattgtttattgtttttgttgtaattataataggaaaagggatgtgtttgtttataggagtagttatcgtaggagttttgagaggttcgggagttggagggttaagggattttgatgatggagagttttattattagtagtttgagagttttattattagtagggggtttaggagtattggttggagattttttattttataatgtagttttagttttttttgttttttcgaggtagagtttttattaagggtagtatttagttggttggtagcgaagtatttacgttgtcgtggttagtttgggaaagtggaaaacgttatggagattaagtttggggtgggatgggcggtttggggtggggtgggcggatagtttttgtttttattttttttttttaggggaagtagtgttgtttagtagtttttatagagtcggggaatcggagtaagtcgtttgtttttcgttttataaaggaggagaagggatttttgttgtagtttttgttgaagagtaagattttttagtaatatttagagtttttgttttagtaaaggattttaatattttttttttttgtttttttttatttggttagggagttggtgtttgatttagaaaagtaatttggttataggatattagtgtttttatggttaaaatatattttttataagtcgttaggggttaataaaatattagttaggtatgtgtagtgggtttggaagggagaagaagggaggaaaatgaaagggaagaaggaatgatgtcgaaaggtaagggttttttaattaggtgaagtatagtgtttaattgatagattgcgtagatggttatgtgtttttgtaatttggggttttgaggttttttatgaaagggatagttataagatatttattataatattgtagaagttttattgagtgagaaaagagaaagttaaatgaatgattaattagagaataaggatatttataatagtaatgaaatcgagtatttgttgagttattgtgtgttatgttgtattttaaatattataatatttggtaatttattttatcgttataagaatttttatcggcgagttaggtattattattatttttatcgtaggaatgaggatgagagggtttgatcggaattttttgatttaattaatgtgagtgtttatttaaggattataggtaagatttaggttgggtaaagattgagttttttgttgagatatgtttttttttttaggtggagttgggaattttcgtttttttatttgtttttcgtatcgtaatatagggttttttgggaattaagtttataggattagaatttttttggtatcgttatttttttttatttttataaatagtattaggagaaaatatgggaaggggtttttgtgtattatagtaggtatagatagttttaaatatttgggatgagatgagagttttaggggttttagagggatttaggatggttttttcgggggttggaatgtacggtgtgtttgagaatttggtaatgttgttaatcggagtagtttttttttagtttgttttaaattttttttttttttgtttatgtttagagaatttagatatttttttttttttttttattttagtagttttattgagcgtatttttaatttataggaaatgtttaggggtgggtggattatttatttttattttttattgtagaatttttgtgtgtgaagggtaggaaaataggttaaaatagttattgggtatttatgttgtgttttaggaagtttgttttaagatttttaagtaggtttaagaatggaagtagagagtaagttagaaatatttttattgttttattttattattattttttaaattgtatgttggtgtttttttattaattttaattgatttaagttttatgatttttgtgatttttaaattttttataaatttattttaattgattttttttttttttttttgttttgaattttttttttttttttgtttgggaatttgttttttaaattggttatggttgggattttaattattttttaaaggcgtagtgataattttataataaagtagggaggttgggggtgggaaggggagggagttttgttttttatttcgattaagagagtaattgttttttgtttgttttttggggtttatttttggtattaggttggggagattttaaatttggtgttgtaatatttattagatttaagtgagtttggggttttttaaaggtgaattgtagttgtttggataaaattttaaaattttgtttgggagatttttagtttttgttttataatcgttttttttggtaaagaaattaggaagttttatttttttaggattttaggtaggtaattgtttttttaaattgtattttaatttgatggaaatggatattttttgttttgagaattttcgtttatatttataaatcgtttgtattcgttttgcgtatgggaggttcgattatatagcgtttcgtttttttttgagacgcgtttttatttttggttataatttagggttatttttatttttaaataatagttacgagttttttagttttttggtatttcggagtgtttttttgtttagcggcggattatagttaggtggtgggtgatttttcgaggttgggaattggtaaaattttttacgcggtgttatttttaagtaaagtagtataaacggtgacgagttggtagtttttgttataattaatgtttttatggtttttaggttttaattgatttattatgaggttttttgtttaggggatttggtttacgtttgaaatattagaggtttcgagtttgggttttgagtttatattgggattgtgagtttagggaagtggttgtattagtttttttggaggtgtgtacgtgttttttttatgtaggttgatttggcggggtttttatggggaggaggggggttgagttaattttttatttttgtattttttggagatgcggagagtttattatagggaggtagatttagttttttttagtgaattaagtgattgtaaatagagttagtttggaagttttaggtagggttttattttttattttcgttttttttttttgggggttgttttttgatttattattaaaaatgtaaaagttaaaacgttttaggggaaaagtttaatttgttagaataattttgttatttattaataaatattgatttattatattttgtgttaggtgtttttacgttggagaagtagttagtttatttaaaatgttagtaaagattttagttgtttaaacgcgttagggataggtaaggaggataagtggtgtgaggaggatgttgggatttagttgaagttggaaagtttatagtcggtatttagagaattgtaatagggttttttgggatattagtacgcggggaatttgttttagtattagaggttttgggttaggtttggttttttaggtgttttttgtgttattttttattttgtggagaggtatttttggtagaagtgaattttgtaaaatatgtaaaggtatggttgaatagtgaattttttttttgtttttaggaaaagtatatttggtattttttgttagaggggatttagtaatttattaaagattttttttttaatttattttttatttttgaaaaatgttggtagggtgtagtgatttatttttatggaagcgggtgaattatttgagtttaagagtttgagattagtttgattaatatgatgaaaattcgtttttattaaaaatagaaaaattatatgggcgtgggggtgtgtatttgtggttttagttattcgggaggttgaggtgagagaattatttgagtttaggaagtcgaggttgtagagagttgtgattgtattattgtattttagtttagaagatgggagtgagattttgttttaaaaaaaaaaaaagaaaagaagaaaaatattaagtttttcgggaagggttgggaggtgataaagagaggttgattaatgggtataaatatatagttagatgaaggaataagttattgtgtttaatagtatagtaagttggttatagttagtaatttattatatattttaaaatagttggaagagaagattttaaatgtttttaatataaagaaatgataagtgaggtgatgagtattttaaatattttgatttgttaggtattgtatgtatgtattaaaatattatatgtattttataaatatgtataattattatgtattaattgtaaaaaaaagaaagaaaagattattattgtttttgtttatttattcgttattattatttatttatttttttatttattgatttatttattgtttgatttatttatttttttttttattcgtttatttatttatttaattaataagtagtttttgaataaatgttgattttgtgtttgatacggtttaggtaggtaaatattttattgggagtcgataggaggagggttttggaattttggtttttaggtgtttgattatttatattggttttttaggttgttttttttaggtttattgggtttttagtgttagaaaggattggttagaggatgagagatagattaatttgttaggttaggttttattattatagaaaatattgaatagtttgttagtgattttattttaagtatttttaaaatatttatttttattttgttattgttttttatgttaataaaggaaaatttttttaatagattatgttaagttttgattagagcgaatagaatagttcgtttagggaagtaggtaattaaattacgttgtgggagtttaagttgagattattttttagatttttttttgtttgaaaattttatttataatttttatttatttttttattattttaagttatgtatttttttattataataagttatatttttagtgtgagtgttttttatgttataggtagtagagaagattatagtgaaattatttagagaggtgtgagtttcgtagaaagttggagattagaggatgttcgttttttaggtttttgatatttttaagaaggtgtttaaatagattgttttttgagtagttttaatagttttgttgtttgatgtggcgtggagttttagataattttgtttttttgagagtatttttgggtatttgtgtagtgggaggaggagagagtaagggttgggaaatttgattttgaattttttttttattatttattagttgattgatttaggttatttttttattttttgaagtttgaatttttatattttgggtttttttttaaatttattggtaaaataggtttagtattaatggggattttatatgaattaatagggttggaatttatttaggttgtttagttgtgttggttgtttatagttggttgaagtttagtttgattggtttaggtgtatattatgttggttgttagatgttttgaatatgatttttggaaataatatatgtgaaagtttttaggtagtataatagatggttagttaattcgattatagtatttggttagtattatttttacgtttaatttaaattatgttttataatttttttaattaattgataaatggaataatttttaaatttgtttgtattttttgagggttaataaagaagttatttagtgtttagggttgagtttttttttttagtatttttttatgaatgttagtgatttggttgtttaaagttttagggaatgaattttatttaagttttggagagtgattgaggaagtgtttgtggggggtttgcgaatgacgataatatttgaggaaggtggtttttgataaaatgtggtagattttaaataatgttaagatagatattttttaatttggatttgtgggttagtgtggtattttaggtgaaaacggtagatatgtgtttttaggagtatgttatatagtttttaatggaattttataaaatttagtgttttgggggagatgatagagagattgagggaagatcgtagaattttttaatgtttttttttttttttttttttgagataaagttttatttttgttttttatgttggagtgtagtggtatgatttcgattttttgtaattttcgttttttgggtttaagtaatttttttgttttagtttttcgagtagttgggattataggtgtttgttattacgttcggttagttttggtatttttagtagagacggggttttattatgttggttaggttggtttcgaatttttgattttaggtgatatattcgtttcggttttttaaagtgttgggattataggtatgagttattatgtttagtttttttatgttttttataatagaaaatgaatgtattattttttatttgggttttagaaaagataagtatgagttggtgtttaatattagattaggttgtaaattgataggagagttatttatatatattagaaaaagaggagtagagaagaaaaaaaaaataataataaaagatttgagatatttatttatttattcgtttatgcgtattagaaattttgagttttaattgtgttttttattgagttttgggtttatagttttggttgggttttttagtattaagtgaaataattgttaatttaggaagtaggtaatttttgtttatttattatttgtaaaatgaggaataaaagagtatttattttatagaggttttaagaattaaatgagtaaatatatatatgtgtatgtgtttatatatagttatatatatatatagtattatagatgtgtgtgtgtattttttgataattaaattatagttatgtattttttttttagaaaaatttataaatataagaaatttagtttaatatttttagagattttttaaagttatgggttttattttaattatttaagtgaggaaattttttttatattgaaatttttattatgttttttttatttaaaaggaaattgtaagttaaatttgattatagttagtattttataataaatatttttttgtggtttttatttttttaagatttttaagtttagttatgtttagaatatattaaatgataagaagtttgatataaataagaagttttgttttattagagtttatagtaatagtatttgatttataataatagaaaaaatattgtatggatatatattaatttatttttgagtttaattttagatgaggaattagtttttatattttatttgtatagggtggagagagatgggtttttttttttcgatttgtttttttacgtttatttagagtaattaaaataggaaaattgttgtataggttttaaaatttattttttttattcgtttttcgaattttgttttaggtttgatgattataattttttatatatgttatttatttttatttttattttagtttaaatgtttttttaaaaatattagggaaaaatatttttagttttattaagaaaataaatatgtttaaataatttttaaaatgtttaggtagagtcggtgtttttggtttgtgtgtattttaacggtgagtttagtaaaatatatgttggaaatagaatttttttttattttatatgtgttagtttttttttggaataaaataaaaaggagaattgattataatttttatattggagttaaattttttgtggttgtgaaaggttattttaagttaaataatatgatgtttttttttagtttttaattacgattatgtgttagtttttttttggaataaaataaaaaggagaattgattataatttttatattggagttaaattttttgtggttttgaaaggttattttaagttaaataatatgatgtttttttttagtttttaattattatttatagatattttgcgtagagttaattaatgggaatgtaggttatggtgtaagtgaagataaagttgatttaaaggaggaatgaatgcggagttgagattcgttggtgtattatgatttttttgtttttatgattttattgaatatttttatatttttaggtagagttggttatttagatgggaatttattgtttttgttttttgttttttgtttttgagatatagtttttttttgtcgtttaggttggagtgtagtggtacgatttcggtttattgttagttttattttttaggtttacgttatttttttgttttagtttttcgagtagttgggattataggcgttcgttattatatttggttaattttttatatttttagtagagatagggttttatcgtgttagttaggatggtttcgattttttgattttgtgatttattcgtttcggttttttaaagtgttgggattataggcgtgaattattacgttcggtcgggaatttattgtttattattttgatgtttatttttagggtatgattgttgagtttttaaagatttaagtgggaaaataataatattttgatgaaaaagttagatttattttattagttttttaggattaagtagtattagggtgtttagtgtttgcgttgtttttgtttaatagatagataagtgaggaataatatttacgagtgaggagatagtagttgtgtagtaagtgagtacgtgaatgaaaggatgtgaaaagtaattattaggtgaagtgttttgtttatttttagaaattgtttattaggattgtgtttatttattgtgtttttaaattattaatatataagattatgttaagtttaatatgttttgaattatgggagttagaattattttgtgttttataggtattagtttaattataggttagagttgaaatttaattttgatatataataaatgtatttgatattttatttaatttgtgtatatatttatgtatgtatttatttattagagatggggtttcgttttgttatttaggttggagtgtagtggtgtgattatagtttattgtagttttaaatttttggatttaagtaatttttttgtttgggttttatgagtatgtgggattataggtttgtgttattatttttagataattttttttttttaattttttgtagagataaggttttgttttgttatttaggttagttttaaattttaaggtttaaggaattttttagttttggttttttaagtgttgggattataggtatgagttatgtgtttggttatatttattatttttattttttatagtttgaagtatatttattatatatggattagtttttttttaaagttttattttatttgtggtattatatagttgttttgtgagtgtatttaattagattttattataattagatgttattaattagttggttattgttagtaatatttttttttattttatgattataagtgttttgtttttgtaagttttttgaatgtttttgggttattagttgttaagtattttttttatatgttatttgagtttattaggattttttaattttttttattttagtagtgaattaggtttatttatatcgtgttagtggaattgtagggtagatatattatgagatatattagtaggttatttaaatttttttattttttaaaaggttaaaaggttagattttagaaattaaggtgttggtttttgtttttttttttaaatttattaatttggtatagggattgatatttgaaaattatattagtaaattttggttattgttaaatgatggatacgtattatatatggtttatgaatatttaggtaaagtatggtttttagatattttaaaagtttattttgaatttagaatagaggaaaatattataatagtaagaaaattttataaaagttgaatttatatattttattagtattattttaaaaataaatcgttttttttttaatttgtttaaaaaagtttatttattaagaatatttaagaaaatattggcgtttatttgattttaagtttttggaagaagatattcgattggtgtaattttttattagtgtttagttaattgttgatagttatttatgtgcgatttgtagtttgtgagtttagtgatcgtttatgataagtttgattaattttatatttgttttgtatattatcgtttgtatttgtgtttttttatgtgtaaaatagaagtacgattgaatgaaagttttaaagagtgtagatggttttatgatttgaagttttgagtatatataaagggtagatataaggaaaatttgtagaaggataatgaaatgggagaagaattttaaagtgggatttaatttattggttatatatcgaatgtgatttgtattttatagtgttagtggaggattttttttgatttggggttgggtttttttcgtataaatattaaagatggaagaaaggaagtaaaatgtaatgtagttgagttttggatggattaagttaaggttatataaaatagttttaagtaaaagtggggtttaggtgtttatattacgagttgttaatattgaatattgattatgtataaggtattattttaagtttattgttatattattgtagtttattgaaaatttaagtttttagatgttgttttgtttgtttggtgttgtttagtttaatgagttatttatttattagtatgagagtttatatttattatgtgttcgttattgttttaagtatgtcgtatatagtaatatattttatatttttaagaatttaatgaggtatgtattattattagttttattttatagatgaaaaaaattgaggtatagaggtatttagtagtttgcgtaaggttatgtagtggtaagtgattgagttaggtttaaagttatgtgtgtgttgttagttattaagttaggtttttttttatatattgattattgattacggttataatatggttattgatgatatgagtttgtttgttatagttgtaaggaaaatattgaaaaatgtgtaaaagaatattaaaggattatttttattttttttaagagataagaattttaaatagtattagaattattttgatgacggttatcggtatttattttttaaagaaaacgcgttgggtacggtggtttatatttgtaattttagtattttgggaggtcgaggcgggtggattatgaggttaagagattaagattagtttggttaatatggtgaaatttttttttttattaaaaatataaaaattagttgggtatggtgttatatatattgtagttttagttattcgggtgattagagtaggagaattgtttgaatttaggaggtggaggttgtagtgagttaagattatgttattgtattttagtttgggtgatagagcgagattttattgaaaaggaaggaagaaaaaaaagagaagagaagagaaaagaaagagaggagggagggagggagggagggagatagggagggagagagagggagaaaggaaagaaagaaaaagaaagagagagagagagagagaaagaaaaagaaagaaagaaaaagaaagaaagaaagaaagagaaagaaagaaagaaagaaagaaagaaagaaaggaaggaaaggaaagaaggaaggaaggaagaaagaaagaaagaaagaaagaaagaaagaaagaaagaaagaaagaaagaaagaaagaaaaatacgaaggggaaaaattattttgtttgtatttaatttagaaaataagggtttgttgtttttgatcgtttaaaagaagttttttatggaatcgattaggaaataagtgttattagggatgattaggtgtttgtttgtgtttgtagtgttgggaagtttatgttagatttttagaattaaggttggagatattttaggagagttagttagaggttgggaattttgtttgtttatttaatgttgttaggttaataagtagtttttattaaatatagttaagattttaagataaagatagatgatcgttgagcgtgtttaattttgaggatttgggttgttgttagttagttgttgagaatggttttttattttggattttaatagggaaagtgtaatgtttttagattttatttttaggttattttttttttttttataatatgtagatcgtttaaaaagttttggtattttaggaggattttatattttatagaagatgagggaatttttggaaatttaggcgatagaggttagatatattaataaacggagtagtttatatttttttttagttggaaatagattagaagttttaggtattggaaaatgttagttatatagtattttgagtttgagtatttcgtggatgtttggttgtggacgttagttatggatgacgataagttttttgtgattttttatgtagagttattagttcgtgttagaattgtagttagtaaagaatgattttagagattatggatgtgtattttttagggttttagtttttattttaatatttggtttgggcgattagttttagtgttgataggtggtagttgttggtggtttaaggggatttaggatatttttaattgttttgtagatatggaggttttgttatgttgtttaggttggttttaagtttatgggtttaagtgatttttttgtttatgagttattatatttgattttagttttgtttttaaatgtgtttagggaaggaattttaaattttttttgttagattttattttggtaaaatgatttttggtatattggtaatggatggaataaggaggtatgggtatttttgatatattttttaataggtttttttgtttttaggtagaattatttgtttattttagttagatggtaataattatgttgttgttgttgtttagagaaagggttttatttttttgtttagtttggagtgtagtggtatgattataggttattgtagttataaattttcgggtttaagtgatttttttgttttagttttgttaatttttttatttatttttttttttttttgagacggagttttattttgttatttaggttggagtgtagtggtgtgatttttgtttattgtaatttttgtttttcgggtttaaatgatttttttattttagttttttgagtaggtgggattataggtatgtattattatatttagttaatttttgtatttttagtagagatagggttttattatgttggttaggatagttttgattttttgattttatgatttattcgttttggtttttttatatgttgggattatagataggagttattacgtttagttaatattcggttaatttttaattttttttgtagagatggaggttttgttatgttgtttaggttggttttaaatttttaggtttaagtgatttttttgtttcggttttttaaagtattaggatgatagttatgagttattatatttggttttagttttattttatttttaaatgtgtttaaagaaggaattttaaattttttttgttagtttttattttagtaaaatgatttttggtagttaggttttttttatagtaagaagagaaatttgatttagagagaaaagttatgtatttaaaatgttttagaaggttagatggatggatgatggatgttggatggagagaaagagaaaaagaagtagataaatgaatagatgatatttatgatagatgaatagatagatgaaagagaaagggaggtagatagatgaatgaaggaaggcgagaaagataggaaataggtgattgtaagagatagttaattttttagtaatgagatatatttattatagaattatatattaaaggaggttttttaaaatttatttaaaatagaagttattttttttcgtgtttttattattttttttatatttttttattttagtatttttttatgttgtaatattagaatttgttagttgttggtttttttggttggagtatgcgattataaagtagggattatattttattttgtcgtgtagttttagtatttagtttagtgtttagtatttggttagtgttttatggaaggaaagataaaaggaaagaaggaggggagggaagtatattagttaattaatatgataaagaaatttgtataagacgatagtgttttttgttaggaatgtattatttttaatgttgtaattattaatgttttattaattaaatttaatttatgtgatattttatatttcgtcggtaagttgttatattttaagttaatatagtgatagtatttgtttagtgttggaggggtgtgttaatgtttatttttgtttaatattgttttaagggatattagtttattattatattgtttgttttttaaataatttttaaaaaatgtattttattagggttttttgttaatatgtatacgttttttatgatttgattatgatatcgtatgggtttggttagtgagagttggcgtagttaattgtagggtgtttttttagttagtgatagtgtggtttttgtaggtatttcgttttttagttaggatatgcgtgttgtttagggtttagggacgtcgtttttgtttcgtttagggttttggagttggtttgatttttcgttttatattttttagtttaaattttttcgttttttaaggtttattttaaggttggttaagtttttttttttttatagcggatttttttttttattttgggagttgttttgtttttttttttagtattttttggtgttatatttttttttgttaattatttttttttggggtatgggattgggtagtttataaagtcgtgagtgttttttaagtttatagttttttttcgaggaagttagttagtagttggtttttatattgagggttaggttttgtgttttgtgggtttgtaattttggttataattagtattggatgaaggatttttgtttaataaaatgatagtggatttgttttaaggtagacggtatagttttaaagcgatttagtaaacgaattttgtttatttggggtatgtgatttttgataatgattgtttggtttaattagatttaatttgggagtgaattttgtttttaatattgttatatagtttgtttgttattcggatattttttcgggtttagattttattttttttttttgtaagttttttttagattttaaggtttttgaggatagagttttgtttaatttttttttgtttttcgttagtgtttgggttttttgtatttttttgtaaatgtttgttgtataggtgattgtaaaatatttaggttcgaggtttttatttttaaggagttagtttttttacggtttttttttcggttgtgtagttatttagtttgagagaggtttgggataggagaggtttttttaggatttttgatgagtgtggatgagtttgttgagtagggtatggaagtagaagtagttattggttagggatgtggttggagggataaatatagaagatgtttgcggttttttaagttagggaggtttgtagttaggggtttggaagatggagataaggtagttagagaataatgaagatagagttagagttatgaaaagtgatagtagtaaatttagagagagggatagagattaatagagttatatttaatgaggtttatttaaattaagatatttttttttatggttgttagttttgagtttttgtttttttttttgggttgtaaattttttttgagtagtggttgtgtttatttattttggtatttttagagttttgtagggtattatatgggggttggtatatggtaggcgtttaataataattttgaatttgaattgaattaataaaaatatttttttatttttatttatttatttatttattattatattttaagttttagggtatatgtgtataatgtgtaggttagttatatatgtatatatgtgttatgttggtgcgttgtattaattaattcgttatttagtatttatatttttttaatttagtttattattgttggatatttgggttggttttaagtttttgttattgtgaaaaatatttttttattaattgatttgaggattttatagttttttttgaaaatttatttatagggttattaaggtttttattattttgaacgttgacgtttacgttttaaatttaattgtgtttttttgttatggtttaagtttattttttttttagtggttttaaatgtatggaatgattttttagttatttaggaagaaggaatgttgtgtataaagtttggatttaataaagttagatttttgaaaaatagttttttagtattttttattatagatattggtttgggtagggttttttattttattgaatttagttgaagagtttgattatattaataatgggttttatttttaattattgttttttagtttttttttttaaaagttttatggtatttaagtaattgttaatataggaataattgttagtggtattattttttgtcgtgatttgattattaggatgaggttttttttttgtatttaatttggagtttttaggtatattatgtttggggttgttagattatatttaaaatttgtaagtaaatttaatggtagttgtgatttgagttgtattgagtttatgttgagaaagtaggatttgggaagatttttttgggtatgtagtaatatttttttggagtaagtttatttaaagattgtttagaggtttaaattttttatttttatagagtatggaagggtggtattatattatagggttttgagggcggattggaagattttattttatttattttaaagaaaattttatttgtttagtttttatattattattatatttttttttgaagtttttttggaagatgatattttattattagttttttttatattggatttgatttatgatggatttagtatatataattgtaatatggtatttatatagaagataagtttttttttgttttaatgaaaaaggttatataaaagtatatatttattaataggaatatagtatagttattaagagtatagattttgaagagtttgattgttagattgttagagtttgagtttagtttagttattatgtgattttggataatttttttttaatattttgatttttttatgtgtgaagtggggaatataatagtgtttattttttaaagttattatgaagtttaagatgaatggatatttgttaagtgtttagattagtgtttgtatatagtgttatataaatgattattgttgtgtgtttttttttattttattgaatatttaatatattatttttttttatataattttttattaggataaaaagtaaagttttttttttaggtaatatgtaattaaatttaatagttggttaaaagtttagtaagattttgtttattatatttttttggtaatattaaaataatatttgttttaatttaaaggttgttttatttgttgttatagggttaggtattgtggggttaataggagtgaaatatgtgatattttttttaaaagaatttgtaattaaataatattggaaaatataagaagtgatatattaggtagtaaaataaaattgaagagtagatgtgatgaattattggagaagtttaggagatgtagatattagtgatagtttgaatggttaggtgaggaaggtaaggagatttttaggtgggatgagttgagttggaagaatgggttaagatttgggtgatgaaggtaagagtgtttttagaaggtaaagatatagatagtggtaaggaagggtggttagttatggtgatttatatttgtaattttagtattttgggaggtcgaggtggattaatgatttgaatcgaggagtttaagattaattttggtaatatagttagattttatttttataaaaattagttagatatagtggtatatgtttatagttttagttatttaggaggttgaggtaagaggattatttgattttgggaatttaaggttgtagtgagttataattgcgattgtattttagtttgagtgatagagtaaaagttttttaatttaaaggaaggaaggagggaaggaaggagggatggaaagaaggaaggaaggagggaaggaaagaaggaaggagggtagagtttgggggtttgggagggtgaaggtatggaaatgaaggttttggtgttttttttggaggagtagtgaggatgttgttttagtggtagttaaggattaattgtgttaagagtatagatggtgttagaaaattaggcgatagtagttggattatgaaggtttttataaagtaggtaaatgagtttagatttggtttaatagaaaataggaagtgagaaagaggtaagaaatacgatttagaatgttggttagttgtgttattcgcgtgtttgtttgtattagtagtgttttcgagttgggtttgatattattttttggtgatggtggaataaaggtaagttgaagaaataaaaatatgtttatatatgtgagtttttaagataaattatagtagattttaggaatgtgtttttgattgagtaatgaagacgtgttggtggggttttggttggggtgggtgtgggtgttatttttgttttatgaggtttaaatttttattggtttagaaaaagaattttgagtagttttttgtttatatgggttattatcgtttttaatttttgtggagtttttttagagttttttgatggtttgttaatattaaaataaatatattaggttttttgtttgtttttttttttttgttattgggtgatggtttttgttttttttaatggatatattttagatttgagtgcggagcgggtagtttttggttgtttatgtttgatatcgttttttttttgtgtagtaaagggaaattaatagtacgtgggagggggaatttgtgttttaagaattgttttggtttatatatttatagataatatttaattagtattgtaggttatatggatcggttggtgaggttgaggatgagttatttttaaattatttatagagaaagaaatatgtttttgaaagttagagtggttggtttatatatggaggtaagagagaaagtaggtagttttataaagtatttagattttttgtgatagttgacgtggtgtgtagtgcgttaggtgggaagacggggttttgcgtttttagtaatgtatttggaggtgaggttttttgttgatgggaatttttgtgttgggatttgggggtatttaggatatatttttatttagttagatttttttttatagttttattttgtaaatggttttaggatttttgattaatttttagtaatatagtttagtggtgaatattaagttatttgaggttgaaatatggagaagtatgttagtttaatagaaggttagatggggaggggcgagggagtttttagaaagttttggagtataagggttttagttgagtttcgaaggtttttattcgttgtaaagaagaaggaattttgttttaagcgagatggaaagattatttgagtaaaaagaaagtattagtgatagaggttgtaattttattttattggttgagtttaaattttttttataggaaaaaatatatagaagataagagaataattattaaggaagtttaaggtattgtttattaaattggtttaagggggggattttattaaatgtaaatgaataaagaataatatatgtgatttaaaatattcgttatgtttttaatatttacgagagggtgtgaggtagggaggtgatttttttaagggttgaaagttgttaattttttaattatattgtttttattgttgggagattgaagataggattattttagggtattattttggaaaagtgatttaaaaaaaattaaaaatttttttttgtataatgttttgggatattttgaattgtttttgtcgtgaagatatagaatttaggtgtttaggaaatattgtaattttttatgagaaatgaatatttagaagtttagagttgtttggtatttattttggtaggttttttatttttggtttttttttagtagaagggttagtgagtagtttaggatttttggagtaggggtatttttatttttattttaaaggaagcgatgtggtttttttttcgtagtttcgtttttatttttttgataggttattagaataatagagtgtttaagtggagatagggaggaatgtgatggttggagggatttaaaaataattattttttttttattttgaatgtgttattttgggttagatattttttgaagggtttttttgaaatttgggaaataggaaatgttaagaaaatttttaatttgtttggttatgtgaatttttttcggtgttgaaatagaattttggaagaggggattttgtattgtggttgagtttttttaattagagaatatttgtttttatgagaatatggtggatgtgattatttagttttaatttttttttttttaaatatgtaaattttgatgtttaaagaataaaattagaaaagaaatttattcggttttagttgcgtatttgagtgtcgatagggcggttgagaggggtttacgtgtttgtcgttaaaaagtttttttggtattttataataggatttaatttcgtagatttgtttgtgtaggtttacgtattatttttaaaatttttattatttgtatttgtagtagatgattaatgattaggttttttttttatatatttggttttgataatttttatttaaaaatatttagatgtaaataatttaaaaataaagtggttttaagggttttttttgggaggatggaaatgttgtatattttgataggggagtgagttaaagggatgtatgtttttgttaatatttataaaattgtatatatgatatatttattttgttgtatgtaaatgatattgagaatgaaaatttttaagataataaagtgggttgagtttggaaattagaaaaagtggatacgatgtaaatgatttcgttgaaaacgattcgagttggttagtagaaattaagaaatgcgtacgcgtgggtagtttttattgtgcggggaaatttttgtaaggtgagtagatttagtttagtttatagaaattttagttgattttgtatatttatttgtgtttttgtaggtgtttttggtgtttttgtgtttatttttgtttggtttatttttttatttaattggattttgatttttattttttgaatataatattttcgtaatatttaatattttaggtttgtgaaaagtgaatgtttaataaatgtttatttatttattgagatggattgttttttttgtttttgttatattttattaaaattagttagtgtatttggttttaaatgtatttgtaaaaatggaaagtaaaaggagaaatatttatatttgtattagttttgagaaaatttttagttatttttgtttttaaaagaaattcgttttagaatttttatttgggaaaaattgtttttgtttaataggaaaaataaaatatagattttagacgtagtgatgttcgtgtgaaattaagaaaatagagttaatgttgatgttttagtggaggcgaaggtacgttttttttttttttttttttttttttttaaggtaaattagaagatcgggtgtggaaatttttgtaggtttgttttgtgtcggtttgtacgtttgtagatggagttttatgtttttttttattagttagtttttttgttattattttattttgaaattagagaggaagggaatggaagggtaaattgttaatattagagatttttggaaattttttttttatggtatatgagtatttaagaatagtttttttttagttgtgtttttgtgattttggtgatatttagtgggtttagttttgtttttagttagattttagtgttttttagtagttttttagggtatgggttggaggtagtgggatggggggttaacgtgaattgtattgttttggaaaaatagtttaagagagattttttttttaaagtagataatttgagtataaatttatatttatatgatttttaaaaattaatttatttagtattttttataaattgataaattttttatgaattaatgatttattagtgtttaaatggtgggtagataggcggcgttataaattttttttggtattttgtgtgttattatatatgataagttttagtaatggtttggttttattgaaggttattttaaaggaagaagttttttattttatatggttttaggtaatattttattgaagatgatttagattttggattttggggttggaataggtttgtgtttattgtttaaatagggttagtatagtttcgtggggggtttttggaggaaggggttttaggaaggagttaggtttttttgtttattggttgttaggttgtttgggggtttcggagggtttagagtaattgatggttggtgtggaggagagcgtgtgatagttagttttaaggttaggttatgagagattatgttaattagtgaagtttttggtagggttaggttattcggttattaggtaaaaagtattaggttatttttgttttggtagaaggagaaggtgtatgaatattatttattaatacgttttaaggaattattaggttagataataaaatattttttgtatttatttttttattatttttttattttttaaatatttttttagtttgtttttttagtttgagaaattaggagggtttttttatcgagtggtgtttttcgagtttttggggtatagtttgtgattttttttaattaaatgaattttagggttttaggttaggtgagtatagatggatttggagttttttttatgaaatgttttgagttgagttttttttttttgttacgtcgaattttgtatatgtttgtttttgttttaattttggttttagaaaaaaaaaagaagaaaagaaaagaaaaagaatgtttgggtatagtgtaaaagtttttttagatttagattggaaatttttttattattttgaaatcggataggtgttgagcggtatttgtttttttgttaataaatagtacgtatttggtttagatataaatttttgcgggagtagtggtgtatatgggtttattttagtgtttgggaaggattgaagggttttgaattaggaggaaggtttgttttttatttttttttttttgattttttgatagagattatatagtgttttttttatggtattttgatggtatatggcgtataaatataggtgtgatttttatatagtgtattgcgttataattataataagtgagaggagataaagttagttggagtttaaggttaacgttgaaaatagcgaacgttaatttttattgaaaataatgttatagagtaaggcgtaggtgtttttttttaattgtcgcgtgtatggttttatgaatagttttaggtgaagggtttttatgaaataagttattttttggggtatagaaatatttagtgatgtattttttgaggattttttttgggattatttttttgggcggtatattttaaatttttgtttggatgggaagggagtattaggtaattttatttggaataaggtattatgattatgtttggttttgtttttcgtgttgataggtagtttattttttcgggatttagtgtttttgattttaaaataagggattttgattatatttttttagttttttgttttttggttttttatataagaggtttagtttagaagtttaattttagatgtatatttaatttttcgggaaaataaaatatttgttagatttataattaatttaattgtttatttgtgtaaaggtttttttgtttagttttaggatttgttgttgaaatttgaaaaagggtggttttagatttatgtttatatgagtagttgcggtagttatttattagttagtttttgggagagaaaatggagaagaaagcgagggaagaaaacggagggtaaattttttaaggtttatttttttattagagagacgttttttgggtaagcgtttttatttggatttttggttgtttaggaaattggggaatgagggttttgggtgtggagtttttttggttattatgaagtttatggggttgtagttattgagtagagttagaggtatttttgtatttttatttttaatttataacgtttggatttgggaggagattttttggtttttgaaagaagtttttgtttttgtttacgtaaatattaggtggacgggggaggtggacgttagggtgggacgtttttgtagtgtttagatgagggtgagattggaggggttagtataggtgttgggtatttgggtagtatttaataataatttaaggtagtggttttttatggggatgattttgttttttaggggatatttggtacggtttggagatatttcgggtttttatattagataagggttttcgttggtatgtcgtgggtagaggttagagaagttgttaaatattttttagtgtatagggtagttcgttttttttataataaagaattatttgatttagaatgttaattgatttaagttttaaagtttattaatagtttgtaagttgaaagtattagattgatataaacgggaaaagttatttgtagtttatttttttgagggataatgggttgttatttttttttatgttattgttgggtaagattttatgttggtttttgttttttttttttttttgaatattttttttttttgttagttcgtttgatgtcgtttaagtttttttttttttttttttttggttttttagtaagttttatgaatattaattgggatatttagggttaaaatgatttttggttttatttgagaaatgtttttaagtaagaaaaagaataagagttttaagaatattaagtgttttttattttggttatattaatggtttatattggttggggaggcggggaagggttttgggagagggaggatgggtttttaatttttaaggagaatatgagtgagggttttaggaagggagagggtgcgataagtattttggagaaagaaaggagagggtttaaggtgattttgagttcggggtaagatttgtagggtttgtaattggtagagtgtttggtatttggttaagtagttttttttttttttttttcgttttattatttgtttttggtcgttgtattgtcggttttttttagtttttttttatttgttcgttttaacgttcgttttagttaatagttttattttttttttttaagttaatagggggaagtagagagtagtagaatagtttaaaggtaataacggtagtttttttatcgcgtttattttgtatttttgggtttttgtggtttttattttagtagttggatttttcgagatttttttttttttattaagtttatttttattaagggttttttttacgtaatgtatagtatattttacgtttattcgatattaattacgttttgtttcgtgatttattcgatattgttgatttgttgtatagttttttatttttgtaaatgagatttgtcgtttttttaagttgattgtttttggaggttaggagacgtgttgtggttttgttgtttcgagttttttttagagttttatgtttagtttagttttgttgattggggataaaggatattgttatttgttatttttgttcgttttgtgtcgatttttattagacgtttggtattatgagttcgtgtcgtttttattttagtttttgtggttgatgttgtagcgtttttttatttttatagatgaataagttgaggtttagagatgttagatattttgggtaaggtgaagttgtgacgatttgagaatataattgaacgttttaggttttttattttatacggtgttgttattttagttttagaaggttttgaggtttttttgagatgtgtaatgaatttattttttttgagtataatataatttttatggatttgtttaaatagttttaatttttatgtgtttatttatttattttgtaaatatgtatatagtttttataaggtgttaggtattattagaatttgggaaaattaagatgaagaaaatgtagttagtgtttttaaggaggagagagataggtggtagtgagtttattggtgagttttgagggggtagaataagaaaagggtatgatggggaggtgggggtttggttaagaaaggttttatagaggaggtggtatttgagttgagtgtggagaggtgtgtaaaaggtagagtggtattttagtttgaggatgtatgtgagttaggatttgtagaggaacgaggttgtagttgatgttgttagtaattatatggagtttaaggtaagtagtgggtgtggggagaggggagtttggaagcgtgggttagggttagttcgttttgtggataataggagttatttagggtatttggataagagagagggacgtaattgttttgtgggtttagtagatattttgggaatattttagagggaagttgaatggggtaagatgagggaagatcggttgggagttttttgttattgtttaggtaagttatgtagtggggtgaatagaagtggtttttgtaagattagaaagaggagatattttaagagatttttgtaaggtggagatgatagtgatggtgtgtttataggaaaagaagagggaggagttgaggattatttcggtttttttgttaggatataggttgagggttgttaagggggttgattagatttttagaggtagattttgggaaggtgtaattagttttttttgtgttgtgttgggtttgatgtatttgatggatatgtagatttgtttggtcgtaaattagggtttgaggtttaaaagagatttaagagttatgagtttaaaggttttataatagggttatagtttaattttttttgtattatgaagattttatgaatgttttaaaatttatatttaggtttgttttttttagagttattattgttttttagaagtttagtttgttttattttagttgtttttttttggatttattattggttttttggagtggttaggtttgtgtagagaattttgaatggattattttaggtggggattttatggtttagtataaggttcgatgtttttgttgttgggtaggaaattttgttttgatgagttttaggatttggttggtcgttttgttttgacgattttaagaaattatttttgttaattttagaattttatttttaggtttttagttgataatatataggtattgagttttatttgaattttttttttaagaatttattttgattaaagatgttagaaaataagattttaaaattaaaaattacggattttgtaaaaagagtttaattggttttaaaagttttatataattttttttatatatgtattttttgtaagttatttgtaaataaagaaggtatttaggaaaggaaaattgttatttttgatagtttaatgtaaaaatgagagaggaatgagagggagttatgattgaattttagtgtttttgttgttaggtattttatagaagttattttatttttttgattattcgataattatagttttttatttttttttgttttatgaatttataaatttaggtttagggaggttaaataatttatttaatatgagttagatttaagtattgtagagaacgagaggagaattgataatttatttaatttattgacgaatttagtaatttgtagagttgaggtttaagtatagatttgtttgattttaatgtgtgtgtttttttttttttaatgttattagtatgggtgagttgtgagtattttggagagggtgaaaagtgggaggtagaggtaaaagttgagttaaatagtttttttagatgagagagagtgggtaggtagtggatattcgtgtaagtaagttggacgtcgttagaaatttgagttgaagttatgtgggtatatttacgttttgtagttttcgttgaaggatttattattaaataggtggaaaatataaaaattgaagatatggtgaagtattattatttgattaatttagtattttgtttttataggtggtgtataattttatttagtttaagttattatgttttttaggagaaaaggaggttttagtaggtattgaggataagtatatgataagttattgttttgttttttgggaatatttggttggttttttattttttagtagtaagaagatttaggagtagtattttgtatgtatgttgattgtttggttttgtatataaatgttagaaaattaaagaatagatttggttattgttatgtttgtttgtttttattagatttgatttagatatggttttttaaagttttaggtattttagaataattttggggaaggtatttacgaattaatttttaaaaaaatttttttattttagaatttttttaaaagagatatgtttttaaaattttaaatatttagaattgggtaaacgaggtgttgttaagtagaggttttgttgagtaaataatgattatattaaaatattagttttaaggaagtaggtttcgattttgtttttagagtagtatattggtgtggtgttaaatgtatgtttttaaagaatttaaatattgtttttttttagttagataaataaattttttgatgtttatttatgattagttgttagtgagttttttggaagttatataaagtagtgagaataagaaggtgttttgtaggttggttttgagtaaagattttttgttttgattagggttttggatgttttgtttaattttttattcgaagttttgagggtatttttttgattgttttttaaaattgttttgttaattgttatagattaaataggtaaggagtagttattaagtttttttttttttttttatgaaggagttcggttatgagatttagttaatgagtttatttaattttttgttttttagtttatttatttaagggtttagtgtattattggaaatttttatataatagaaagttagtgtttggggggtatttggttttaatttgtttgtgtttgagtatttatatttataatagtgttaatttttaagggatttatatcgtattaagagttttattttaggttgttacggaaattagtatgtattaatatgattgagaattatgagaaattgggttgggtttatagaaaattaataagtttcgatttttatttaaattattttttttatgagattttgttttgaaatttataaagtcgggttaagttattagtattttttatgtatatatttattttttttttgtagtttatgttgtttttttttttcgtttttagttttttatttgttatcgttttttatttattatcgttttttttgtttgagtgaattcgtttttttttgaatcgttatggttattttttttgttattaggatatttttgtttgtattgtttgtttttgattttatagaaggaaaggagtagttgtattttttttttgaatttattttagggttttgattatgttagttatgttatagatgtttagtaatttttgttgggttagatgttagttagttgtagggtagattggtgttaggggaggtagttcggttataggtaaaaaagtagtttagggttatcgtagttagtgtggagaagggaattttggggggaaatttggatagacgaatttgattaatttatgaggttaattatagaaaaaaatataagaagggggaaaattttttttagtaattagagagatgatagagaagtagggaatgtttttgattgtattatagaagaggagattaagatgattttagaagttatttgttgaaggtataaagagagtttaaggtgaaaggagttttatttttttttttggtggaggcgtagtttagtaatttttgaggagtgttgtttgttttgttaggaaaaatatgataggagtagtttagtggaggttggagatttaatatttttttttatttttaaatttgataatttatttttaagtattaaattttatgttatagtttaatatttttggatatttttttgttataaggtttttagaatgtgttagtttagttttagttttataggaatttatatttaaatcgatttttttttttttatttggagattgttggaatattagattaaaatagtttacgggaaggttgagtagagtttaattttagaatttgtggtatgtttatgggatacggaaaatatatagaagtgatggttttatagagaaagggaaaagttattttagagaaaattggagggagttaagaaaatgcggagagaaagtggggaatggtaattttagacgtagagggaaagaaaaataagagaagacgtacgttagtaataaaagaaaaaaaattattataatgttcgttgggtaggaaagtgatttttttgttttttttttagtttttttgggtttatagtattgaagataggagtagagtgtatttattggtgtttattttttagttgggtgttgttgaagaagagagaaattttagttattttgttattaggttattttttttttttcgtttttaggttgatttaagtaaaataggggaaaattgtatttggataaaggaaatttttttttttgtatttaaaagttttatgttaggttgggcgcggtggtttacgtttgtaattttagtattatgggaggttgagttaggaggattatttgaggttaggagttttaggttagtttggttaatatggtgaaattttaattttataaaaaaattataaaaattagttaggtatggcggtgggtgtttgtaattttagttattcgggaagattgaggtaggagaattgtttgaatttgggaggtagaggttgtagtgagtcgagatcgtattattgtattttagtttgggtaattgatagagggagacgttgttttaaaataaataaataaataaataaataaataaataaataaataaataaatgttttatgttaggagaattttttttgtagagagttatataattaagtattgtgtttgttttaaataaaaattagagaaagggttaaaaattaatattattagtgatatttttttttttttttattgttaattatttgtcggttattgttataatagtgttattttttaggtttgaaatgaaaattggcgattatattaagtaaagagtttgaaaggaaggttgggttattgtatgattattcggattttttttgtaaatacgtgaatagttttagtttttttttatatgggttgagggtaatagaatgatatttttttgggttagaagagaaatagagatagaataagcgaaagtcgtttggtattagttaatagttgtaatttatatatatagttcgggatcggtatgggtttgtggtttgttaggaatagggtcgtatagtaggaggtgagtagttggcgagtattattgtttgagtttcggtttttgttagattagtggcgatattaggtttttttaggagtgtaaattttattgtgaattgtgtttataagggatttaggttgtgtgttttttatgggaatcgaatgtttgatgatttgtgttggaatagttttattttgaaatgattttttattttattcgtggaaaaattgttttttataaaatacgtttttggtgttaaaaaggttgtggattgttgatataaatgagtttgattttttttttataatgtaaacgttattaaagagatagaggtgttagtataagtacgtcgttgttttatgtatatttatgatttcgtggttttgggtaggttcgtttagttgggagttatagttatatttagggaggtcgcgtgattgagtggaaaggtaggatattttatgttagaattttgggtttgagttttggttttataattgattaattaggtgtttttggaaaagttacgtatttttggttatttttaaaagaggggtgatagtagtaataatttatttgtggtttgttgggaggattatattagatgatttatatggaagtatttttttaataatagcgtgttatgtgaatatttgtttttgtttgtaatagatatttttataataaggagaatgagaaggttattattttattttgtttgtttattgtttttatttaataatttttttttttttttttattatattttaggtagtaggttagaggttagggaaattcgttgttattttatagtattttattgtattattgagaggtttatttttgatttagtatcgaaagattatttttggtttttaaaaataaagttgaaagtttaagagttagaaagattaaggattaagttaatttttaaaataataaatgtttttttatattttttttttatttatatggtgttggtaattttttaaattagatttttatttgggtattttatattaaaaatgatatagttttttgttttttgtaattgtattttttttgatttttttttattatgattcgtatattattgatattttttttttggaatgttaaaagtatatattatttggttaaaaggaaaaaatattgatttaataaaaatggaaaagagagagagagagaaaatggatattttttttttttggttttaaataaggtaaagtttttatttttcgttttttatatatgttaaggttgatgttacggatttaaattagttttgagttatttgaaatgggggggagcggggaagcgtagtttaataattttttgaagtttgaaaaataaatttgttatagtttgataatttaaaaatgattgatggattttttttgtattttttaagtagggaggggtcgggtatggagaatgaaatattttgagaaaagatttaaatgtggaaatttttggtttaagagggtattttaggagatataagaaatattttttgggggtatttaaagggaataatattgtaattttgagtgatgtatggttttattgttcgaggaatagggatgaaaattataaatttttttggttggggtattaatttattattaaaagttattataaataatggatattgtttatggttgagaagtaggatatatttagagaagatattttttaattttttataaaattattttagtgttattggaatatgttttttatgttatttgagttgtcggagtattttttgggtagatttttaagtagaaatagttgggattttataaattttgtttgggattttaatgtttggtgttatgaagattttggtttgtgttttttttgatgtttagaatattaagaatatttttagtttttatattacggtaggttacgtttcggttttttttagtaaaattttttttaggatttaagtttttatttgtatcggtaataaatgtgatggtatattgcgattttgaatgtaagttagtagggttgtaggtatttgttttttttagtgttttaattgtattaaattttttttattttttttgtttttgatgtataaatataaaacggagttttagaatttaaaagtgatgttatttgagtgttattaaggatttttagaggattatggggtatttttttttgttataaatgaggtttttaaagtttggaaaggtgaatttttggattataagtggaggaattgagaaagggtgcgtcgatatttagattttatagtttgttattgtgtggtttgtgatagaattaagatattagaatagattagtttattcggttataaatttaggataatatgatgagttttagagttaggggttgagtttttttgggattttttttttttaaaggatgtgttttattgttaaatattaaaagtttcgaatttttgttttttcgttaaaaggtattgtagatatgatggtagtgaaattatttttttcgtatttaaagttatttttaataaaattattttttttaggtggtgtattaagttagtaaaatatatttgtttgaatttatattttattaattatgaatttatgtttggggattaaaaattttttaaaatttattaggcgtgattttaatattttttttatagtttttcggggtgttttagtaggttaggattatttttaaagatatttaaatgatgtttttggtttaaacggaaatgaaaagtatataaaattgtaagatataagaattttaagaatttggtagaggtgaaaatatataaagaaaagatgaaatttagacgtttttattttgtttttttatttaatataaatttttttttagttgttttataattataatgttagtatttaattttttaagggttaaaggaggtttgtagagcgggtttttggttgattttagcgtggatcgtaggtttggcgttttgttagatttttacggttaaatggtaattatattgtttttagttatttcgttttattttttggggggtttagggatagtcgttatttttttattagtgtttacgattagcgtttttttgttaggaggcgggttggaaggtttttcgtagttatggttaagttttggttgcggttgtagaagttttatttgttttattcggttaatatttaatttttttatgtatttgagggagtggggaattagtgttttttaggaaatttaggttttgagttttttgttttagattataataggtaaatggagaacgggttgtggggatcggagttgaggaatgaattttagttgataaaatgtaagataaggagggaataggaaagtaaaggataaagtgaaggagaaaaaaataaagggaattttggtagggaaaagggatttgggagataggacgggagttttgtttgggttatagtgaaggtaggggagagaggtttgggggattttggggatttgggtcgtgtttagttattttttgttttttattaatttttcgttgtttagttattttatagagtagggttttgggtattttgtgtgttgaggatagagttgagtttatagttattgtgtatgaaggatgttgtgattttgtttttttgtttgtttatttttaatttggtgtattagagatgttgtattgaatatatttttttttagtatgtaattgttaaaatgttgaaagaaagtgtttggtttgttgggtttgattgtaataattataaatttgttttgtaaatttttggttttttagtaatatatcgaatattaaaggattaaatgtttggtgagtagagttaggtttttgtaaaatatttggtaggtaggtttttaggaatttaaaggtatttgtttttgttaaattatgaagattttttaaatgtgagtagagaaaagttgtttttagttatgaggagttacgaggggtgtttttaggaggagagagattatgtaagaagtaggtgacggggtagtggggcgagcggtttagagaagtttttttattttttggattttttgggtagtggggcgagtggttagggaagttttttgtatttttttgggttttttttttgagggtttatgttttgttcgtggtgtggagttatttttgtttatgtacgttgtagatataattatttttggtttagtaagaatagttgagttgattatttgaaaggattaaaatttagttgttattgtggaagttttggggttatatattttaatattttaaattaggttttaagttggatttgtttttgtgatttaaggaaattttgtttttttttatattttagaattttttgtgaagtagttttgtaaataggagggttttttttgaataatatggaaagaatttttttttggggatttgagtttatattatataatattttaaaatatttttgagatggtacgtgtagttttagtaatagggttagattatagttaagggtttttagagtgtgtcgtatacgttttcgtgggatttagttttgtatagtgtttagggcggcgggggcgggggtgatggggaaggttttgtgattggtggtttttttatggttatagggttttttttttgttgatgtggttttattcgttttgatttatttttgacggtatatatcggtttgttttaggatttattagggtggttttaaatttttatgttatttttttgttttgaaatattatttttggtttttttgtttttatttgaagttttgaggttttagtttttgttttattttttgttcgttttttagtttattttaaatatttttggtatattttttgagcgttttttgttatttttcgggattttttgtttagttttttatatttattgtttcgggggagtcggagttggattttgtatgttttttttgttttttttgggagaagtaaaatatagttgaaaaggtatatgtttggtagttatatagttttggattcgaatttcggttttgttgtaatgagttgagtgattttgagtaagttgtgtgatttttttgatggtagttttttttgtttagagttgtttgtaaaagttattttaatgggttttggtattatagttaaatattttttgttattttagatttagtgtttagttagaagtagatgttaaataaatattttttaaagtggtttgtttatggttggattgttcgatttagatatgtttaaaagatagattaaagttagaggaaagaaagagttaaaacgagttatttaaagttagcgttaattatattatgaaaaatatgttgtttgtggatttaagattggttaaggggtttttttagtggaaatagtaatttgtttgatttaaaattttttttgaagtttttattagtttaaatttgagtttatttttacgattttaggtgtgtatatttttgagttattttattggaagagcgtttattgagtatttgatttgggtgatgagtatgatgttttgttttaaggagtttattgttatggagttaagtttattattttttttgtagtattttgtataatgttgtgtgtaatttaggcggttagtaaatgtttgtatttttgaatgtaatttgagttaattcgttttaaggtttttgtaatggtagtaaggttttgttagtgttatatatgtataggtatggttattgattatttagttgttagttttatttggaatattttggttttgttatttttgtttgaggaatagtcggtgtataaaggtttcgtagtatagtttaaattttatttgtaatgtagttagtatatatttgtattttttttgtaggtagggttttttaggttcgtcgttgtaagttgtaaaagtgtttgatcggttttgagcgtttgacgggaagtgatagttgttttggaagtggattttttaggggtacgatttttttcgtgttaagtgtttattgttgataatgttgataggttttgtatagtgggtacgtgtagtgttttgattttgtttttgtttttaggaggttagttttattggttttattgtgagagcgtgtttttgggttaggttagttagttgttaattgtgtttttgtaggttgtgttgatggaagatattttagtttttttatttatttaaaatttatttatgattgtttttagtttttttttttttttttttttttgtttttttgggtttttgggtttttcgtttttttttttgagtttttgtttttgtttttttttttagttttatatatagtagtattttttttgtaatagaaagtatattgttagaggtttttcgtcgtaaatagttatttagatgagaggttacgttagcgtattttgtttatatgttaatgagttaggatttagaattataggttgatttggtttattatttatttgttttggtattaatagttgttgttattgatagagattgtattttttttgtgatagagaggtttgttgttttttttgggtataggaagattgtttgatgaggaaggaagaggattgttaaagagttaagtagtgttttttgaaatgtatttggttttatttatgttgagtttttttaggtgaattgaattaaattataaattataaaatgaaagtagattttttttagtatgtttatatggagtttattgaggagtttattattattcgttagttttttttgttttttagagtatagaggatgtaattgtttttttttttttgatcggtagattgatggtgtggataagaagttttttttatgggttttttagaggattatcgtagttattttgacggttatagaatgatttattgagttgtagaattggggagttgggatttgagtaagattattatacgttggggtgtttttgagtgggatgtaagtaggttgtgaagttttagttatttgtgatttatttgttttaaattaagaataatagaattagtattattcggggtgtatttggttttcgatagatgtttgggtttgcggtaggttattagggttttttggagttaatgtagtgtggagtttttagaaaagatgtttaggttgattttttaattagttttaaaaagtaagtgttagataaggtagggttggaggttggtagtgtttagttggttgaggatgtcgtattttttagtttagtttgttttgtttttttttttttatatatttttttttaggtttgaggttatttttagtaaatttttattaggatatgtaggttttttgtattttttatattattagttttagttaatatttattgatttaaataagtgaaaattaaatatttggtttttaattttggttttttacgtttaataaatgaaggattttttttttttattgtttttagtagcgatgttttgatgatagcgattaggttaagttgtagaatttaataagtatttgtttttagtttttatttttggcgtatttttatgaattaatttttgtagtgataaaaatagagggaggtagtttgggttatgtttcgtgtttacgagttatatggtaggtataggagttacggtacgtttggtttaaattatgatcgataagtagagtatatttgtttgtcgttaatttttgtggagtatatagtgattatgttttatttatatacggagataggtatggatagtggcgtggggtggggaggagagttatatgtgtggttttagattttaagaaaaaagagttggtggatttattttaaacgttagtttgtttgtggaatttttagtttttgttaggtagtggagagttttgttcggtattgaatataattagagttttttatttgttttttattttaagttatattgatgttattagttttaattaaaattggtatgagaggtagagggttttgtgggtatatgggggttggggtttgggataaataatttggattatgtttataaaagtaaagagattggaagtatagaggtatattagaggttatagttttagtgttgtgttaagaaaggtttttttttaatttatagtaggagggtttgaggttaggtggggagaagagtagtggagaagtggcggatggaagagatggattatatagagaggaagtaggagattttttgtaatagttatagtaatatagttttggtacgtattaatagaatttaagttatatttttaaggatgtacgagaaagggtgaagaataaggttattaattaggtaagtttagatggtagagcggagagagattttttagaggttcgttacggcggagtttttagatgaggaaaattgaaggttttaggggtgaagtgagttgtttattttataagtaggagtgtttcgattgttgtttatgtattcgatttttaattttttatttagaatataaattatgttattttttattatagtttttttttttttttttttggagaatgatagtggtgtatattttttaattagtagcgttttattttttattatatttgtgagtcgaggatttattataagttagtatttttgtggaattttatatggtataaaaatagtttagtttttttttatgtcgtgtaaggaatataattaagtttttttattgggatatagtttacgtgttataaaattttatttaaagtgattagcgtattggtttttagtatatttaaaaggttatatagttattatttttagttaattttagaatttttttattattttaaaaagaagttttgtatttattagtaatgattttttagttttttcgtttttttattttttgggaatttttaatttattttttgttttgatggttttgtttattttggatattgtatgttaatggatttatagatagtgggtggtttttgtgtttggattttttatttggttttatgtttttgagggttatttatgttgttgtatgtgttaatgtttcgtttttttttttggttgagttgtaagattttattatgtgggtagattatattttgtttatttgtttattagttagtggatatttgggttatttttatttttggttattatgaataatgttgatgtgaatatttgtgtataagttttcgtgtgaacgtgtaattttaatttttttgggtgtattaggagttgaattgttgggttatgtggtgattttgtttaattttttgaggaattagtaaattgtttttttataatggttgtattagtttatatttttattagttatgtgtaggggttttaattttttaatatttttgttaatatttgttattatttatttttaaaattagagttattttagtggatgtgatttttttttgtggtttcgatttgtatttttttaatgattaatgatagtgaagtatttttttatgtatttattggttatttgtgtatttttattggtaaaatgtttattagaattttttggttttttttaaaatttagttatttacgtttttattgttgagttataataattaagttttttgttggatatatttttatgtttaatataatattataaaagtgttaagtttgttattttatgtttgatattttttttcgaaatagtgaaatagtataagtttaaaataagagagggttgagtattataataggtagggttttcggaagttttagttaaaagaaggtaatggaatgaggaaggtaggaagaaaaatgaagaaatttcgttttaaagttaaaatattggaaagtaggtgattgaggtttgtgtgtatataggttttttttttagggtttttttaggtgtgttttaaaatgaggataggagtatgggtttgtttttttttggtaaggttattgttgggtaaatgggtttgtagataagatataaagtgttttgaatttagtattaagaaaattattaggtttatggaagttattgggaatattattaagtagttattatagggtagggtatgtgttttatttagttttaagttaaatatttagtattttataaaaatagtttggttattgaatgaataagttcgttgaagatgagattttaaggttatatagatacggtttttagttttttttgttatggtttattatattaatttggtgaattaaatagtataattattaatatatttttagtattttttgttataaatgtatttttttatttattttagaagtacgttttttgaattattggattgattatatttttttgtaggagggatatgagtttataggtgttttgtagtatttgtatagttagtgcggtagtagggaatttggttttgtgtttttttttagatattattttttattttagtttagaaggtaattagattaaggaattttttgaggtttatttttggaatagttagtttcggttgaagtttttattagtaggtggttggggttaagttttttttgttttggtttatggtataagttatttttgtatattatttttaaattgtgaaaataatgttagagaaaggaagtatttatttgggttttttattttttagtttttttagtttttgagggtttttgtttgatttgtatttttagttaaatttgtataatagaatatattagaatttttttggattaattgtggtaagcgggtaagttttgtttttgttttgtttgggttttttattttttgttatgtttttagtaggttttttgttatatttaaatgatatggagattaggttttacgaatgttattggtttatgttttaattagtttttttttttggatttagagtttttttaagattaatttttaggtattggagatggttttggggagtagttttcgttagtttggaggaaggtaaatttttgtgttttttacgttttcgtgtttttttattattttcggtttaggtagttgtgtgttttttagttatatgtttaagggttattttttttttttttttttttttttaaattcggaaataatattttgggagtaaagggagggtgcgggaggaagagttataggggatagaagtaagtatgtagttgttaaagttatattgttttgtagacggaattttttagatttatttagtataatgtggttgtggaggaaattttgtcgagtcgatgataaggggggaaatggagttatttttttattagttgttttatttaggtagaaaaaagtttttatttttttgcgtgtgttttgtcggttattatttttagtcgttagtgcggtttgtttttttttttgttttgagttaattttggtgttaggagaattttgtttggttttatggagcgttttttttgtaagataagtgtttgtttattttatttttttttttatgtttttttttttttttttggcgtttttttttatttgacggttgtatgttatagattttgtgtggtcgtagtagttatagatagtattgttaatgagtttttagtttttttggtggaatttaggattaggatatatttagtggtttttacgtttgtatagatgtttagaaatagtttttgatttttggtcgttttttttgttttgtattataggtattaatgttgttttttttgttaatgttttgttattgtttttttatttttttaggtagtatttgttaaagtttgtttttttaatattttaaatatagtagtagtttttttgatagaggggttaggggttaaatgagtttggaaaatgttatttttttttttggagaattaagtatttgtgagtgggggtgataatatttattaattaatatagtagggatattgattagttagatttttttgtgtttttgggaatcggttaattattagtttttgggaggaggatattagaggttgttgttgaaagaaaaaaaaagtattgaattttatttaagttagttttttatttggtttttgaatattttttttttaaaaaaatattatttattaggatgtttgaaaaatttgttatatagtaaaataaattagtttgttttagttttataaatatttgttgagtttttaacgtatgatagatatatgttttagggatttaaagataaataaaatatggttttgtatttttaggtgttaatagttgaatggggaaggtagatatgtaaatagatgattttcgtataatattgtgaatagggaatagtcgaggattatttagtttaatttagggatttggagaaagttgtttgtagaaaatgattgagttgaatttttgaatgaattaaagttgatttaagagtgataagttgagtaggagaattaggttggagttagagtattgggaattttagatttaagtatggaagtaatagatttgattttgaatggattattttggttgtagtatatagaagagatttataggtaaagtataagatttagatagaggtagagagattagattggaaattatagtagtgattttggggagagaaggtaaagggagagagaagtgtttaggtggtaaaattggtagtgtatttattgttttgttttgttttgttttttggtttttattattttagtgtttattaattttatttttagttataagagatgtggtatttgtatttatttttttgattggtattttatttgtgatatggttagttaggagtgttggggtattgatattttataggagtaatttttaattaatgaatagtaggagttggtgtataaatattttagttttttagttttttagtgggttaataagagatgtatggtttatatcggtttttagatttttttggtaggagtaagttttgtttgtcggtagtaataatttgtttgatgaggtaatttatgtatgagttttttttttttttttttttttttttttgttttttttagagtttttagtattattttttaaataaattatttgtatttaaatttttgttttagggtttgtttttaagggagtttaatttatggttatgggatttattgttgaatgaatatggggtatgaggaagagaaaaatatttaggagattttgaggttgtaggtttatttgatgttatagttaggttgaagataggaagagagggaggtttgatggagggagtgatgatagtttgagtttggggtaggttgatcgaattttttaggggatgttttagaaagtaattggaataagtatttgttagttaggggagaaagtgagattggatataaagatgttaggaatattattataggggtggtatataagattaagagagtgaaagagattggttaaagagagaaaagaaaatgtttagatagaagtttgatgggtagtatcgagaatttattagaataggttagggaggaggtgtttttgagggagatagagaggaaattttttaggaggaaggaggtagtttaaagggagtagagttacggaagatttttagtggttttggtgttcggggtattagagtatttattaagatataattttatatttagtgaatttagttatatggagggtattggtggtttttgtgggggtggttttagaggtatagtataggaagaagttagattgaatgggtttaaatgtgggtgggaagtgagttaatgagtgtggtttggtagtttttttaggagggtagagatagagaagataatggttagggtggagtacgtattagtatagatattttgaggatatttgaggttagaaaggaaggatgcgattgaaattgtaattgagagtagggataattgacggaggaaggtttttgaagtaatgggagatggtggaattagggtgaagtgtggagaggagtagggaaggataggtagaaatggatatttgtgtatgggttagggtggaaagttgtggtaatttttgtttaatgattttagtttttttagagaagtaaaaggtagtgtttattgttaaaaggtgaggaagatgtgtgagataagtggtggttgttgggaatagttattaaaaggaatagaaaagatttgataaagaataaagaattgttaggtggtgttagaatttattgagtttagagattatgaatttttagtagtatttgtttgtaaggttgggtaattttttttagtattatttggaagtttagatgagatttgttttgggttggagtttaagttggggtagagaggaaggtcgggatgggaggaagtaagttgagggaggtagggaggaggttttttgggtagagagaagaattagttgtttgttagtattttaattagtgatatgtaggaggtaggtgaaatttagtttttacgtttttgtttattacgaatttttttatgaatatatattgtaaggaatttgttttatttgttaaagttttatttattttatttatttaaaaaaagagttaatatttttattagatattattaaattaatttagggaatttgaatatattttgaggttttttttagtttagagttttttgttatagtgattttttttttttttttttttttttaattttaaagttgttatgagagaagagatttttagaggtttttatggagataaaattataaatttatgaaaaatagaaaatattaaagttattcgatagttgtgtttgattttttattggtatggtttgattttttttttattttttttttattgtcgatgagattttgtagtttgtaggaataaaatggcggtatttattgatttagtttagtttaaatgtgtatatagaggtattatttttttttagagtgtaagttttttggggatagggtggttttttttttttagaatttttttcgattgtataacgtttgtatgtatagttagtttaaagattgtggaatgtagttgaatttcgaatttgtttatagttagttaagttatattaaatttttttagtatatagagagttgagaatatatattgagttcggggtttgaattttttattgtaggtattggtttgaggggtagagtttatgagagtttttttgggttagggtttaaggaggtttttatttaatcgggggtttgttgtatggttttaggttatggttgttgtttgggagtttatgtttttttattattagatattattttttagtatttttgtttgttaaattatggagtttggattttttttagattaagtaagtatttagaatgtaatattattttatgtagtatatattgaaatatattttataaatagtaatatatatgtttgtattgaattagaaaagatagttaaggaaaaaaattagaatagttttttaaatgttatgtttttatgtttatttttgtttttaacgataattattgttaatatttttgcgtttttttttatattatttttttttgtttgtaaacgcgtatatgtatatgttaggtttttatagaagtggaatcgtgttttgttgatcgttttgttttgttttatttaatatgattttaggaatataattttttgttaataattatagggtatgatttttaatgttgaatagtattttattatgtggacgcgttgttagttatttatttttagatatttgtttttaggtttatgttattatatataatttgtgtattttattatttttttaaaataaataattggaagtgaaattattaataaaagttttttaaaagttttttgatatgtattattaaatttaaaaggtttttatgtttatttttatttgggtataagggttattttgggattttcgtttatatttttaatcgtatgttattttttttagtatttagaattaatttttttttttatttttgataatttgattttttttaaaaaaaatttttattttaggtttacgtgaaatttttcgaagtggattaggggtggtggtttatgtttgtaattttagtattttgggaggttaaggtgggaggattatttgaggttaggagtttgaatttagtttggttaatatgaaattttttttttattaaaaatataaaaattagtcgggcgtagtagagggtatttgtagttttagttatacgggaggttgaggtagaagaattgtttgaatttgggagttattgtattttagtttgagtgatagtggttttattttaaaaaaaaaaaaaaaaaaaaatttttgaaggttttgaacggaaaaggaaaatgttggaggatggttgttttttaggtgggagtgttttatggttcggaggggtgaggatatttttgttgagtttaggagttttgattttggtttgttttcgtttatatttatttggtttggttttaaatttgtagtaaggttgcggttgggagtttagttattttgtttttttgggttagttttgggtggaatttagattttttgtggtttttgaattggaaatttatggggaagttattgtggatagagttattagagttgaggttttgtttattttttttttataggaggagtcggtgttagttttttcgtgtgaatttgtgattcgtgaagtcgggtaagtttttgttagttttgatatgagtaagggatatagagttttttaaatatatagattgggattttgttcgaattatatgacgatttaggttttttttttttttttttgttgtttttaatatataaaatgagtatgtgtttatttaaaatagtttttaaatttaaataaataatgatagattgtttaaatagatttcggaaatcgttttaattaggatgtttgaaaaattaggaagattttttacgaaagaagtttttaggttattttagtttcgaagtcgtagggttttttttgtattttggaattgtagaagggtaaagtttagaggttagttttaatttttagggggttaaatgatttgttttttagttttatattttaataatgtgtaaagaaggatagataggtaggtattgtattattattttttatttttgattagaatacgggatgtatatattttaatttataatttttatagaaattacggattatttttagattagaaagttaagagaggaaattgtttttgtaaaacggtaggtttagtagaattttttgggggaagggtaggttgagtaggtgcggagtaggtttgtaagaggatagataagagtaaggtgtttgttttgttacgagtttattttttgtatttaatttataaatggttttgagtgatttacgttaatttttataataatgaattttatggttatggatgaagtaaatgaggttcggggttgggttatttgttgaaggttataaattaataaaatattaaagttagggtttatttatattttttttttaagttttatgttttttttagttttttgggatggtaatagtatttttatgttgaggttttgggttaagagttgttagtttagtttattttattttagaaatgatattgttttacgtaatgtatattagaaatggtttgttaggtttatgagaagtattgttatttgtgtgggggtgagggtggtgagagggaattattttagttttgaggaggtggggatatttgggatagtattttttttgttttttagtattgtgtgttagattaattgggagaaaatgttagttggagtatgtttttgtatttttcggttttttaggatggttttaggtttagataggataaatgattaggggtttagtttggtttagattttgttatataaaattttgttgattattaaagggatttagagttcggttattgatttttttaatgttaagttaaattgtagataatttattgttagtgttttgataaatttggggtgttttttggttgggttattgggggttttagtttatttattttttagagagagaagtatggatgggaggattagttgatatttgtagtcgtgtttgtgatgttttgggttgttttttggaagaggtagagttttggtttgtggagaagttttgatttttttttgttttattgatttttgtttatatggagaggggtgtgtattttggtagataattatgattgtgttttagttttgtgttaagagtattaaatatatattttatgtacgtttattgtttcgtttttttaatattgaaatttagaaatgtttaataatagatatttaaaaagaagaagaaagtttttgcgtttttttttggtaaaagttaattaaggatttttaaagatgtagaaggtttattgggttagtagtcgttggtttgggttagttgattgtgttgatttgattaatgttgttgatatataggatgggttatttgtttttttatggtttgtgattatagagtattttataaattagagttttttagtttcggttttgttagtattggggggttgttttgtgtattgtgggatgttgaatagtattcgcggtttttgtttattagatattagtagtatttttattttaaattatgattattaaaaatgtttttaaatattgttaaatgttttttgggggataggattatttttagtgtgattttcgttttaaatttttgtttgttttttgtaaaaggtggtattggttggagggtaatttatgagaatgtgaggatggtttaaggtaagttttttatgatgtttggaagtaatattgatgattggttaattgaggttatttttaggagtttgttttaaaaaagtaattgaataaatagataagaatttatatataaaaatatattatgatattgtttataatagtaaaagttttaaatattataaatatgaattttttaaagtatggtatattttatatattatgaaaataattgtataaatttatatttaataatgtggaaagttattttaataatgttttaaatttttattaagattattttaggatttttagaggttgttatatatagaaggagtaattttaaatagatttataagtatttgggtaaagtattaagttaaagattaatgattgtatttagaaagtttaagtgaataaatatttattacgtatttatagtgtattataattatgtttagtatgagggagataaagagaatttttggttttattgttatagtttttgttttagagaaagggaatttttttgtgtattgttggagttttttttaatagcgatgtttagggttatggtatgttattgttttttgtaataaaattgtgtgttttgagttagggttgttgggaataatgtgaaattatttttgtttttttttttattttgaataaattagaagtaaaaagaatttatttattgatttatatatttaaatatttatttagaaagttgtttaaatatttattggatttaaatgtgaaatataatttttttaaaatttaggaaatgagtaattggtgatttgtttaatttaagtttatttagagggtagattttgttataatatattatagattcgatttgagatggagagataggaatggaagggagatattttttgttttttagggatttgtatatttagtgatatatttttgattttttgttttgtgagatttataatttgagtaaatgtagagttgtggtcgtttagtttagttatttttaagagaaattttttgatagttttttttttttaggagaattttgattttagaggttggtattgtattagttaaggtcgtttttggtttttttattgattgagtttttgattgattaaatgtttttatagagttgtcgttagttacgttagggtattagtagagagaagggtgttggtttttatttgggtttaaagtttggttttgttatttgttaaaaagttttttattttttgcgatttttagtttttttatttttagaatagaaataaataaaataattttataagattggtataaagaattagttggatgagaaagcgtatgtttttaattttagaattttgggaggttgaggtaggagatttatttgagtttaggagtttaagattagtttggaaagtatagtaagattttatttttataaaaaatttaaaaattagttaagtatggtaattttaggtatttaggaggcggaggtaggaggattatttttgagtttaatagttcgaggttgtagtgggttatgattgtattattgtattgtagtttgggtaatagagtaagatttttgtttttaaaaaaaaaaaaagaaagaaaaagtttggtataaagattaaaataatgtatgttagatatttgataagatgttaatatttaatcgaggagtgtgacggttattattattgttagattttattatttttatggatgggtatgttagttaaaattgtaaaatttttaatattttttaattgtttttgttgttttttttttcggtttttagtatttttttttatattatgtgataatttatattgattgttgtttatattgttttatttaatggaagtttcgtgaagtaggaatttttagtttattttatgtattgttgtatttttaagatggttggtacgtaaagagggttttaataaatatgttttgaattaatgaaaatagtggtttttgaattatggtttttaaagagtatttgttttttttttttttatttttttgaaggtgtttaggttgttttggtaggatgtttttttttttgtggggtggtattttttgttttttttttaatatttttttttttttttttttttttttttttaattgtaggatgtttttgtggaattgtacggttttagtatgcggtttttgtttgattttttttggttgtttttgaagattttgtttagtttggttttggtgggagtttgtattattttgggtgtttatttgggttataagtgaagttaatatgtttgttttaaataaatatgtaaaaggtttattaaagtagtagaaataatatgtattgttagtgatgtattatgaaataaagttgtaggttgtttaagaaaaaataatatatatataaatattatatatatagatagatatatatatatataataattaatagtttttaggtaaaacgtcgaattagttatttattgttaaagggaaatattatttattttttatattattaagaaaaaaagatttatttatttaagatagttttattaaaatttttgtttttggaaattcgattattaattgttaagtatcgtttcgtgtggttttatttggatgttttgtgtttgtaaatatagattcgttttttatgttgttggtcggattattatttgaagagtagacggatggaaaaaggatttgattattggggaagttggttttttggttgttggaggttggggagaaggtgtttatttatttgtatttttttgttttgggggttgtgatattaatagagggagggtttttgtggggggaagtttatgtttttttggtttgaagaagagattttttgtatatgatttatatgatgtatatttggtgggaggaaaagagttgggaattttagatggatttagtatttattgagatttttacgtcgaaggatagcgatgggaaaaatgtttttaaattataggaaagtatttttttaagttattaattgtgtcgagaaaagtattttagtaatttatataatattatttagtattttaagttttgattgtgtatatttatatattttggatacgtattttttaatttttaatattggttttgtttgagtaagaaatagaattttttggaatttgaggaagtgaatatttcggtgattttcgtattaggaaggttagagttatttagagtattaggtcgttataagtgtttgtttttaggagatcgaagttcgtagaatttgtttgtgttttagtttggaggtttggttttggaattgagtcggggtttttattggttttttttagggatgattaatagggtagtgtggttttcgaatgtttggaagttgatggagtttagaattttattgttaagaaagagtagtagaggggtgtggttgggtttgttattttggggttttttaggtaggttcgtttttacgtggagtatgggagttacgattttttttaagatatgtattattgtagagggaaggaatagaggttttgggttttttttattagaaggatatggtgaaggttgggaacgtgaggagaggtaatggttacggtttattttggttgtagtatatggtacgttggttgtgtggttttggtttatttgtgagtttaaagtaaggttttaaatgattttggagagggttataaattttaaaagaagtattgaagtgaggtgttatggattaattgatttttgtttatggaattatatgtaaaatattattttgttattgtagtttggttttatttgaaaatttgataaaaaaaaagttttaggtgtggaatatgggggttatttgtatattttggggtattaaaaaaaaaattaatggtggggaattataaagaagtaataaaagaagtgatatttttagtaaataaattaggaaattttttttttttttagtttagaattagttttgaaatattgatggaataattttgtggtattattgtattatatattatttatttgtattaattttggaatgtattttgtttaatgtttaatgttgtggttgatatttcgaaagttgttttaaaaaaatatatgtattttagcgtttttttgtttttaattgtatttagttatggtttatatattatttgtgagtaaaggtgatcgttttttgtttgagatttttattttttgattttttaaaagtattttgagaaggtgagataagttttgagttttagttatttaagaaaaatttggatgttattggttattgaggagttttgttttaattaagttatgtgtatttttacgttaatagaattgtttattgtgatagttatatttgttgtttttttgattttgttttttgaaggttttttcgtttttgggtaatttcgtatttaatttatggtatttaggattatatgtatgtttggttaaatttatgagatttatttagttaaaaatttagatggtaaatgattagtagatttaaatttatggtggtttgatttttagagagttgttttacgtggtttgttttaatatagatttatttagagtttttttgtttttttttcgcgggggtttttttatggttgttttttagggtttttttgaaatgtagtggtgtttacgttttattaagaaagtaggaaatttgtggtatgaagttagattttttcggcgggttttagggaatagaatgattagatttttgaatgattttaatttttaagtaaaatattattttatgaaaggtttatattgttaaagtgatgaatatggaatatttaattttgtgttgttattttgttaaaattattttaatggagttagtttgtagtatgttttacgtggtaagattttttaagttgttttagaagtaataatgaagaacgtggacgtttttaatataaagtttgttttgttttttgttgttgtttaaacgggatttatagagtatttgaaaaatgtatatatattaagaggttacgggggttaattgttggttggttgttttttgttgtggggttttgttatttggttttaataatagtaaatgtgtttagttttttggttttagaattgtatagtattgtggttgtatttgttttaagagtagttgatgttgtattttttttattgttaaaaatatgttagaagtaatgaatgtatataaaagttttaattagttatttttttttttttttttttttttttattatatttaattattttgtagttgggtaatagagaattatttttattttgtattgaagagggatttatatttgtattttaattgttttttatgaatgaaaaaatagttttttgtatgtatttttttttatattggttagggttagagttaaatagagtatatgtattttttaaattggggataagggttttaaaaaaagttttaaaaggagaagaatatttgagaattttttcggtttttttagtttttcgttgtataaatatttcgtaagagaggttagaatgatagttgatagggtttatggttatcgggtcgttttcgaagatttggtaggggtagaaaattttggtaggtttaagatttggaataaagttatagaattaaggaagtattttaatttagtttaaataagacgttaatattttttttatagtttatttatttttttgtgtttagatgtggttttttatttatatgtgatttttgttttattagtaaatgtttattatttaaagatgtagttttggtttagtgggaaaaattaggaagtgattataaatcgagaggagttataataattaagattaaatgtaaataattagggtaattttaatatatgtttagtttttatttttaggatttattgagtgaatagaattgtaaatagtttttatttgtaattgaatttattttaaaataaatagtttataaatgtgaatttaaattttaattaattttaattgtatttttaaggtagtggttgtttttagatttttttattatttatagttagtaatgtatatttattttattagagaaaaataggaaaggttcgaaatataagttattttaaggaaattagggagttagttgaaattttattttgattttattttgtggtgttttttgtagtttagataaatgtggttatatattttttaagaaatataattttatattgttaagtttatgaaggttttaattagatttttattgttatttaatttggattttttagggattttttttttaaattattatgggataaaggatatttgttggaggggtgggagggaggaagaatttttaaatgtaaaatatttttaagtttggattagggagttggaagtttttagaataattagaattaagggtatgaaggatttgtattggggtcgatgtgatgtttttgcgaagaattttgtgtgataaatgagaaatattttgaagtttgtggtacgatttttagattttagagatattagtatggtttaaagtgtagtttcgtttggtagtgtaatggtataaattttaagttggatatgtttaatgggtatttaaataataaatgtgtagttttaattaataggatatttaatgataattttttggttggtagggatatttgtttttaaatgtttattatgtataatatagaaaaaaattttataaaattaagtaatgtgaaattgaattggagagtgataatataagttttttagttttatttagtgaattattttgttttatgtttttggataattatgattttggataattatgaaatatgtattttattggatgtaaagaaaattagatggagtatgaatggtattgtatcggtttatttggattgttttagaaaaataattttaagtaaatattttattaataataaggttgttttgtatattaagttgagtatagaagatgggaatattggtggaggatggaaaggttcgtttaattaagaaaattttgagattattaataaataagattgtagtgtagatattgagtaaatttatgtatttaaattttttggaaaatttgtcgtgggttttttagatagtttattttattaagtttttttttttaaggtagaatttgtaagagtgatagtggattgtattttttttggggaagtttttttttggtggttttgtttattatatttttttaagtttttaattaaggtttgtttttgttttgagttattggggttatttttgttttaaataaaaataagtgtataataagtgtttttgtattgaaagtttttgttattaagatttttatatttttattttttatggttttttttaagattgatatttttaagaggtggttgatattttgtaatattgtatatataaaaaatacggtaaggatattttatatggttaaggtaaagtaagtttttagttggttattattagttataatggtattttgtttgtgttgttggaaaaagttatattgttattaaattttttttgtttgtttagttaatattgtgaagaaaaataaagtatagtgtgagatattggttgtgtttggaattgtttataatgtgttaatatgattttgttttgttatttattattattatataagattttgaaaagtttttttaataagttagtaaaattattaggattttattttaatgaagtttttagggattaggttaagggattgttttataggtgaaattattttagaaggagatttttgttttttggtaat

SEQ ID NO: 172 - DNA, 68851 bp, Artificial Sequence
  Chemically-Treated DNA
gtattttgaaaatatatttaaaaatattaaaaattttatatttaaaatatatattatatgttaattagtatatttaaatagaatttgtatttataataggtttttgatgcggttaagttttaatgttaattttttttaataatataattatataaatatattaaaatataataaatattgttttttgttttatatggtgaataatatttttattatagagagaataaggttatagatatttatttatatttttaatgggaatcgttataaaaaagtaataggtttgttgttatgtatgaaatatttttgttataaagagattatagtaagattttaaaaaataaaataaaatagaataagaacgaatataatagagagagattttaataaaataaattttaggttaatataaattattaagtatgtgattgtgatgtattttattgggtaaaagagttattgattatataattgttggatgtgttttttatgaaattatttaatagatttggtttttgtaattttttaagtttgtgatggggggttgtttgttttaaatttgttttttaaaaggaagttgtataaagttgatatatagtagatattttaagtattttttatatattaaaaataattataaagataatatttttaaataatataaaataaatttatattacgtaaagtttttttttttttaaagaggtatttagatggtattgtgaaagattagttttaaatgaaagattgaataaattgaaattttttgttgatggtatttttatttttgggttatggtgaatatttttttttgtttattttttattttattaagatgtagtaattgtttggggttttttgatatttaaggatgttggtttaagtggtgattattaatatttttaggtgtgaaatgggttgaatgggtttagagttttagtttttattggggatttatttttttaagaattattattttaggtttttaatttgattttttttaatttaaaatggtagaggtgaggtagggattttttttatgaatagataggatgggtagaaggttgttgtggtttttattggggagtaaaattttgttagttttgttttggttttttttattgagtaaggtatttttaagttttggtgttttgaatgtttagatattttttcgaagttttgtttttggataagattttttatgggtttttttgattattcggtttgagtttggggtttttttttttgttttttttttttttattaaaagtttttaaaagataaattttggtttttttaagtttagttttaaagtaataagtgtttaggtagtaaatattttttattttattgtattaattttatgattataaatgttatatttggtttttaatttgttttaggttaatttaattttatgtaaaattatttagaggtgggatggtgggtataagtcggtttgagtgtggttttttagtcgagaattttttgagtatagttagataatgtaggtatttaaagtacgaggtttaagtagtttgatatatgttattttagagttatttttgaagggttttttagaggttttcgttttggaatgttttaaatattatgttttatttttatttagattttgggatggttatttagaaatttttttcgtattgtcggtaaatgtaatgttaattttatatagtttttatttggttgtttagttttatgttattggtaatgtggatttttgttttgatttaggtgtttttgggttgatatagggttttattttttgtttataagatattgttaagttttattatgagttttttttaagtttagttatgatttatttaaatgtttattttttataaaaaataatttttattttggggttattttttgttgttttttgttttaaaaaaaaattattgttttttatgtttatacgagtgttatgatgtgatataatgtgtttatttgtttatagtagtggtaaaatattttagaacgcgtaattgattttttttttttaaaataaaataaagaggagattagagggggagggggggaaagaatgtgttttgagtaaatataggttttttcgttaaaagtagtttattttgattaacgtttaaagaatgagcggggtttgggaggtgtattacgggatgtggagtgtgagtatttttttgtttagttgttttaatttttatttattttttagttatttgatcgatattgtaaatatttttataatatataaatgtattttttattagttagaatatatattgtaggaattttttttttatttttattttttgtgggaattaaaaaataaaataaataaacgaaaaaaaaatataaaataaataaaaatatattttttattttttattttttaagttagtaaagtaatgataatagtattttgatattgttttaattttaacgttattagaagttaaaagtagtaaaatagatatagtattaataagaacgaagatatttattgtttaaaatgtaaacggaatgttttggtttaaatttttgttgtgtgtgtgtgtgttttttttttgttttttgaaagaggatagtttattattaatttataattaaagtagtatgtaatttattattttttttaattttttatgtttttagtttttggtaacggtaataaattataatattattaaggaatgtaatgtagattttttaagttgtgcgtaaatgattgttttttttttggttatggatatgtttaataaatagattgtagaattattgtattgtataaattttatttatatatgtagtttataaaattattttttttttaattgaataatttattttgttatgtatatatataaatagataatttttgttttaatataatttaatttatataatataaatttattattttttttttttaatggttaatgtatatatataagaagtgtttatttttatgaatcgttagttaattttttttttgttatttatggtaagggttcgtacgtacgattgggtagttcggtattgggagttttaatgttttttgtttatgtttttgtagtttttttttgtgtaatttatgggattgtatttggtttcgtagaagtattgttttagttggttttttgatatagggatttttttaaggattgtgatcgtttcgttcgatatgtttattgtagtttttttgtttgttgtcgttatttatttattaatattgttatatacgtttagtttttttcggcgggtagggttagagtggcgtcggatttttatggatatgtttgtagtatttaggtaatttttgtatttttttagtagaaagagaagaggaggttttaaaggtatttgattattgagtattattttggacgtgtataagtttgcgtttttattgttttttttattgggtcgaattttttggtttttatttaatagtttttttattacgtgttcgaaagtgttagttaatgatgttaagttttttgaatttgttttgggtttatttacgttttttagagttttatgggttcgtatatttgggtaggttaagttattttgttttcggatgtttgttttttttatgggggtagtttttatgtaattaaagtatgaaataattatagtaaggaaaaggatggttattattttttttatttggtggaattgtagggagaaagtagaaataagatagaaaattggttagggtttttttttatcgggatgttatgtggtttatttgattgtaattttaggttattttgtagggttaaggtttttttatgttttggtgataaattttagttgtattagatataaattagtgttagtagtgtgttgtatgtggtttaatataaattagagatatgtagtgttttttttaagatttagtatataaatttgagattagatggtttttaagtaagtgtaaaaattgtggttttaagttttttttttttttattttagtagttttgtaagtttaatttttaatgatttttgtttatgttgttacgagaaatataaaattataaatgttattaagtaataattgtaagtgtaattaatagtaattttttttaagttagtaatatggttttttgtaggaatgtgtgataggaatagtagtggtttgaggggtttgatgggtttttttagttatgtgatgtttaggtatgaatagtataataaaatagtagttggggaattataaggagtttttaaattgatttttttttttttttttttatagagatattttattatagtaaagaagaaagataattttattgagttattttgttttataggtaaggaaattaaaggttatagaagatttgttttatgttatgaagaaagtttatgttagaatttagggtttttaattttattgttttttattttatatttgggtggttataattgaaaatgttttgtttatttttaaatagaaattattttttgatatgtttattttaatgatgtgtttatgtttggggttaatgttatgaaaataatgtgtttggtaaggagaaaattgaaaaagttagtattaaaaagatatttaagtttattttaaatgttttttatatgtagattttattttattttttttagttttttaaaattttttattttttggttttttttggttaatatatatatttagttaagaaagtttaatttttttttttattagagatgttttttttgtgtgtgtgtgtgtgtgtgcgcgcgcgcgtgtgcgcgcgttttgagtttattttatttttaaaaagttgagtggtgttttatatattttggaataggtagttagtgtttttttttttgtttttgaagttttttgggaagttttttaaaagtatattataaaattaatttttttttgtttgttagagggttgttttattttaaatttggttttatatttataagtatgttttaggaagttaattaaaatggatgaataagtaaaatgaaaatatatttatggattaatttaaggttatcgttaggtggtgaaggattttagaattatttatttgaagtattgtgttttttagtagtaaagagtagtatttttagttttgattttaattttatttttattttttagttttgaggtatggatttataaaaagatatatatatgtaatggttattatgatatttaaataagtaggaaaaggaattgtgtttttgtttatgaagttttattgaatttaaaggtaatttatttttagttaataggttagaatgtagaaatggttgaaaattttggtattgaaaagtaaatgttttttatttttgtaagaaataatatttttaattattaagagattttattattatttttaaatatataaaaaaattttttttagatttatttttattttgtacgaatagtaaatatgtttagaattgtttagattgtataatgtttttagattaggaagggaaaattggtttgaataaaatatagatgtttatttcgttaataattaaatttttgtgaatgttttgagttttgtattattaaagaaatagatcgtttatgggggtttttatttttggtagattgtatttatatattgaatgaaaaagtttttttttaatatttttagtttaaataaaaataatttaaggggtattttttatttaggttaataaaagtttgtaaatgtggaatattttagttatttatattatattggtagagattttttgtgattagttattttttaatattatatttaattaaatttaagatattattattgtgaaattcgatattttatatattattaagaaagtaaaaatgtagtttgggtgattagagtgaaattttattttaaaaaaaaaaaaaaaagaattaatgaattatagtttaatatatatttattaagtgtttatattaattatttaaaaatggtttaaaatattgaggtattttaagttgttggaaaattgttttgtttttattattatagtaatgagtttttgaatgatattattttttatatttggtttttagtttattttgttttttattgattttatttttttattaataattttatgagaaaaataattaatgttttatatattgtttttttagttttatgagtaaatattttagagggaaaattggtatttgagtaaatattatttggtttttattttgaagtttaaatatgggtattttttaagttgagtatttgtatagaattaggaattaatataatggtgataaagtttaattttatattgtaagttttgttttttgagtggtatttttgtaattttaattaattgtttatttatttgtaaggttttgaagttaagtgggtgtaatattaaatttaatattttttgttggaatagtggtattttttattttttttaataatggttttttgatattttgggtaatttaggtataggatagaaattttggaattaagtttgataatatattttttgtatagttttttaatttagttagtaaagatgttttgttaattttttttttaaaatatttgttttggttatttttttttatttattttattgttattattttggtttagtttttattattttattttgtgattataacgtttcgatgttgtattagatattttttttgttttatttaattttgatgattattttttgggtaattattttaatattatttttttatataaaaattggtaatggtatttttgttttatttgtttaaatttaatgttttttttttgatatttaattttttttaatatttgtttttattttttttagttaatttttttaaattatttaatgttttattatttttgtttcgattaggatagagtttttggagtgtcgtatatattattgttttttgatttgttttatttttttgataaattttttttttttttttatttgttgttaaaattttgtttattttttatgatttagtttaagtattaaattatgtatgtttttttttttaattattttagtatatattgttttttttttttaaaattttatattatattttacgtagtatttgattttttttttatttgttttgttttgttttttttttaagatagagttttgttttgtcgtttaggttggagtgtaatggtgtaatttcggtttattgtaatttttattttttgggtttaagtaatttttttgttttagtaggaggtagttgggattataggcgtttattattatgttcggttaatttttgtatttttagtagagatagggttttattatgttggtcgagttggtttatttatttgttaattgttaatcgtatttgtttattttagttagtttttagttgaaaggtaagttttttgagggaatggattatgtttgagtttttataatgtttaatagagaaaaatgtaatagtagtatttagtaaaaatttattgataggtttattaaattaagagaaaagatagtttggatataattttcgtaagaagtttttttatttggaaagattagtgaatttattgaaatttttaggtaaatataggttgtgttaattttaaattataaattttaaggtagtggttttaatttttttggtagtaggaattagttttgtggaagataatttttttacggtttgggagtagtagggtggatggttttgggatgaaatggttttattttagattattagttaaattattataaggaattggatttttataaggagtatataatttagattttttgtatgtgtagtttataatagggtttatgtttttatgagaatttaatgttgttgttgatttgaaaggagatagagtttagatggtaatgtttgtttattcgtcgtttattttttattgtgtagtttggtttttaataggttagggattggtaataatttatggtttgggtgttgcggatttttgttttaaggaatttgatagatagtaattattagttatgattaattttttgagtttttttaatggaataaaattttatttgaataattaaaaagtagataatattattatatattaattgttttataattttttgtgtagttttatttttaatagattaataagagatttgggaagtaataataataataatagtaaaatttgtagtttttagttttttaattttttgttttttattttgttaagtttttaatgagtaattttatatattgtattaggaaataataaaagattaagtaagagtttttaggataattttttatttttaattttcggatgattttttattatatataagataaagaggttgtgtaatattgttaagtagattatatatttatttatatttaataaatttattgatgttgtttaattttgttttaaggtttatagttattaatttaattatatttataaaatgttaggaaggtttttatagttttattgttaggaaatttaatatagtatatagaattaaaaagaaaattaatgaagtagatattaagtttagttttaagtgtgatttataagttttagatattttattgaaagaatgtttataataatatgtttttttatttttgttgtagttataatttatatttgtttaagagattatagaatatttataggcgttatttaatttgatttttataaggagataggatgggtattattatttttattatatagatgaggtaattatgcgttagagaggttaggtaatttgttaaatgttataaagttagtaggttatttgttttttgaattaagtttttattattaggatgtgttgttagttttagaatattagttatagagaagagagtggttgtgataacgaaggagtttataaaatgtggatattgtagttatgtgtgttttggaatttaattttttaaaaggagtgttattaagatattattttgtaggtttagattaattatgattaagattttttaattttaaggtttgattatttaaatggatgaaattttagataatgtggtttttttttaagagaaagaattgtaaaaattgtagtatgttagaattaagtttttatggttaaaggtgggaaaataagtaatagtatagataatttaggtatatagaaaaaaaaaaaagttttgtttgtttttagtttttttgggttttatttgtgagcgtgtaattagagaaaatatagtttaaagatatggttgtttattttagatagttttataaagataatggtaatgttgaagaagttattaatatttggtttttaatatatatgatataaattattaagagttgattttaatgaaattttgtaaattaatatttaaaaatttttaatttgtatttagttgattatatttatatgttagatttttttttgtttatttatttattatatatgaagtttattttttagttttatttatttttttttttaggagggaggtaggatatacgtaattagaatataaaggtagaaatgatttagaaaaggtatagatataattttataaagagaaagaagttatttttagttagggaataaaggaatgtattgttaagaaggttgtaaagggttaggtgtagtggtttatatttgtaattttaatattttgggaggtcgaggcgggaggattattagagtttaggaattcgagattaatttgggtaatatagtgagattatgtttttataaaaatttaaaaattaaaaaaattaggtgtggtggtgtatatttgtagttttagttatttgggaggttgaggtgggaggattatttgagtttaagaagttgaggttatagtgagcgattgattatgttattgaattttagtttgggtgatagagatattattgttttaggaaagtaattgttttgttgtaattaatgaaggttttcgatagttagagttatttagaatttatagttatatcgaattttgtttttattttttgtttttttgttatagagtaatattgttttagtagtatatatttttagtttgtaataaagaagttttagtattaagtatatttaagttatttggatagtaaatgaggttatttgaaaatatttttaaagtttatttttttaaaaaatagttttttgtttataggatttaaatggtagttgatattttttgtaaaagtttaatttttttaattagaattttgttttttttagaattttaggtgggatttgttataatttattgaagtttagatttgataatgttttatttattatgttattgaaattatataatatttattaaatttttatatatggtagatagtgatattaattaagaagataatttttaatttgttttatgaagttttagtgatttattttgtaataaagaatttggaaagggaggttttaagatggttaaatatgaatagttttagtttatagtttttagcgtgagtgatgtagaagacgggtgatttttgtatttttaattgaggtatcgggtttattttattggggtttgttagatagtgggtataatttacggagtatgagttaaagtagggtggggtattattttatttaggaagtataaggggttggggaatttttttttttagttaagggaagttatgattgacggtatttggaaaattaggatattttttattttaatattgtgtttttttaatggttttagtaaacggtatattaggagattatgttttaggtttggttcggagggttttatgtttacggagtttggtttattgttagtatagtagtttgagatcgaattgtaaagtagtagcgaggttgggggaggggtgtttattattgttgagatttgagtaggtaaataaagtagttaggaagttcgaaatgggtggagtttatcgtagtttaaggaggtttgtttgtttttgtagattttatttttaggggtagggtatagttgaataaaagatagtagaaatttttgtagatttaaatgtttttgtttgatagttttgaaaagagtaggggtttttttagtatggaatatgatatttgagaatggatagtttgtttttttaagtgggtttttgatttttgagtagtttaattgggaggtattttttagtaggggtcgattgatattttatacggttaggtgtttttttgagacgaagtttttagaggaataattagggagtaatatttgtcgttttgtaatatttgttgttttgtagtttttgttggtgatatttaagtaaatagggtttggagtggatttttagtaaattttaatagatttgtagttgagggttttgattgttagaaggaaaattaataaagagaaagaatatttatattaaaattttatttgtacgttattattattaaagattaaaggtagataaaattaataagatggggagaaattagagtagagaagttgaaaattttaaaaattagagtacgtttttttttttaaaggaatgtagtttttcgttagtaatggaataaagttggatagagaatgatttttataagttgagagaagaaggttttagatgattagtaataataaattttttcgagttaaaggaggatgtttgaattttttagtaaagaagttaaaaattttgaaaaaatattagacgaatggttaattagaaaaaatagtatagagaagattttaaatgatttgatggagttgaaaattatggtacgagaattatgtgatatatgtataagttttagtagttgatttaattaagtggaagaaagggattgaagattaaatgaatgaaatgaagtaagaagagaagtttagagaaaaaagagtaaaaagaaatgaataaagtttttaagaaatatgggattatgtgaaaagattaaatttatatttgattggtgtatttgaaagtgatggggagaatggaattaagttggaaaacgttttgtaggatattatttaggagaatttttttaatttagtgaggtaggttagtatttaaatttaggaaatatagagaatgtcgtaaagatattttttaagaagagtaatttaaagatatataattgttagatttattaaagttgaaatgaaggaaaaaatattaagtgtagcgagagagaaagggtaggttatttataaagggaagtttattagattaatagtatttttcggtagaaattttataagttagaagagagtgggggttaatatttaatatttttaaagaaaagaatttttaatttagaattttatatttagttaaattaagttttataagtgaaggagaaataaaattttttatagataagtaaatgttgagagattttgttattattaggtttgttttataagagtttttgaaggaagtattaaatatggaaaggaataattagtattagttattgtaaaaatatgttaaattgtaaagattattgaggttaggaagaaattgtattaattaacgagtaaaataattagttaatattataatgataggattaaatttatatataataatattaattttaaatgtaaatgggttaaatgttttagttaaaagatatggattggtaaattggataaagagttaagatttattagtgtgttgtatttagtagatttattttatgtgtagagacgtatataggtttaaaataaagggatggaggaagatttattaaggaaatggaaagtaaaaaaaagtaggagttgtaattttagtttttgataaaatagattttaaattaataaagattaaaagagataaagaaggttattatataatgataaagggattaatttaataagaagagttaattattttaaaaatatatgtatttaatataggagtattagatttataaagtaagtttttagagatttataaagagatttagatttttatataataataatgggagattttattattttacggttaatattagatagattaataagatagaaaattaataaagatatttagaaattgaatttagttttgtattaagcggatttaatagatatttatagaattttttattttaaattaatagaatatatatttttttcggtattatattatatttattttaaaaattgattatatagttggaagtaaagtattttttagtaaatgtaaaagaatagaaattataataaattgttttttagattatagtgtttttaaattagaatttaggattaagaaatttatttagaattatttaattatatggaaattgagtaatttgtttttgagtgattattgggtatttaacgaagtgaaggtagaaataaagatgttttttgaaattaatgagaataaagatataatatattagaatttttgggatatatttaaagtagtgtgtagagggaaatttatagtattaaatgtttataagagaaagtaggaaagatttaaaattgatattttaatattataatttagagaagtaagagtaaatatatttaaaagttagtagaagataagaaataattaagattagagtagaattgaaggagatagagatagaaaaatttttttaaaaaattaatgaatttaggagttggttttttaaaaagattaataaaattgatagattattagtaagattaataaagaagaaaagagaaaagaattaaatagatgtaataaaaggtgataaaggggatattattattaattttatagaaatataaattattattagagaatattataaatatttttatgtaaataaattagaaaatttaaaagaaatttataaatttttggatatatatatttttttaggattaaattaggaagaagttgaattttttaatagattaataataggttttgaaattgaggtaataattaatagtttattaattaaaaaaatttattaggattagatggatttatagttgaattttattagaggtataaggaggagttggtattattttgaaattattttaattaatagaaaaagagggaattttttttaatttattttatgaggttagtattattttgatattatagtttgatagagatataataaaaaaagagaattttaggttaatatttttgatgaagatcgatggaaaaatttttagtaaaatattggtaaatcgaatttagtagaatattaaaaagtttatttattatgattaagttggttttatttttgggatgtaaggttggtttaatatatgtaaattaataaatataatttattatataaatagaattaaagataaaaattatgattattttaatagatgtagaaaaggtttttgataaaatttaatagtttttgtgttaaaaattttaaataaattaggtattgatgggatatattttaaaataataagagttatttacgataaatttatagttaatgttatattgaatgggtaaaagttggaagtattttttttgaaaattggtataaaataaggatgttttttgttattatttttatttaatatagtattggacgttttagttagggtaattaggtaatagaaagaaataaaggatatttaaataggaagagaggaagttaaattgtttttgtttgtagatgatatgattgtatatttagaaaattttattattttagtttaaaatttttttaagttgataagtaattttagtaaagttttaggatataaaattaatgtgtaaaaattataagtatttttatatattaataatagataaatagagagttaaattatgagtgaatttttatttataattgttttaaagagaataaaatatttaggaatttaatttataagggatgtggaagatttttttaaggagaattataaattattgtttaaggaaataaaagaggacgtaaataaatggaagaatattttatttttatgggtaggaagaattaatattatgaaaatggttatattatttaaggtaatttatagatttaatgttatttttattaagttattaatgattttttttatagaattggaaaaaaattattttaaagtttatatggaattaaaaaagagttcgtatcgttaagataattttaaattaaaagaataaagttggaggtattacgttatttgattttaaattatattataaggttatagtaattaaaatagtatggtattggtattaaaatagagatatagattaatggaatagaatagagtttttagaaataatattatatatttataattatttgatttttgataaatttgataaaaataagaaatggggaaaggattttttatttaataaatggtgttgggaaaattggttagttatatgtagaaagttgaaattggattttttttttatattttatataaaaattaatttaagatgaattaaagatttatacgttagatttaaaattataaaaattttagaagaaaatttaggtaatattatttaggatataggtatggataaggattttatgattaaaatattaaaagtaatggtaataaaagttaaaattgataaatgggatttaattaaattaaagagtttttgtatagtaaaagaaattattattagagtgaataggaaatttacggaatgggagaaaatttttataatttatttatttgataaagggttaatatttagaatttaaaagaatttaaataaatttataagaaaaaattaaatgattttattaaaaagtgggtgaaggatatgaatagatattttttaaaagaagatatttatgtagttaaaagatatatgaaaaaatgtttattattattggttattagagaaatgtaaattaaaattataatgagatattattttatattagttagaatggcgattattaaagttcggaaataataggtgttggaaaggatgtagagaaataggaatatttttatattgttgatgggattgtaaattagtttaaatattgtggaagatagtgtggcgatttttttaggatttagaattagaaatattatttgagttagttattttattattgggtatatatttagaggattataaattatgttattataaagatatatgtatacgtatgtttattgcggtattatttataatagtaaatatttggagttaattaaatgtttattagtgagtaaggatattattttgagtaaattatcgtaaggatagaaaattaaatatcgtatgtttttatttataggtgggaattgaataatgagaatatttggatatagggtggggaatattatatattgggatttgttatggagtaggggtaggggggagggatagtattaggagatatatttaatgtaaatgacgagttaatgggtgtagtatattaatatggtatatgtatatatatgtaataaatttgtaggttgtgtatatgtattttagaatttaaagtataattaaaaaaaaaaagaatttggagaaattattaagtaagtattatatttaatgaatttatggtgaaattatgtgggaaaaatttttttgtatagggatgatgattttggaaatggtggagagagagatagaaaaataaatgttattgtaatataggtatttaaattgtatttaaatatatagatttttgaatttatagaaaatttttaagtatgaaattgattttatgtaatttaaagttttaaattttaaataattttttgtgttaaatttataaattgtgtattaatgtaatttaaatttatttttaaaaatattttaattaaaggagaaatttttggggtttgagattagagttttaggaaatgtatatatgggataaatttatataggttgaaattaagtgaaattttattttttaatgttgagatggattagttattttaatataaagtagaaatttttaagaaatgtagaattttaatttttttatttttattttatttattttatttatttaattagattttgtattttaataagatttatttagtgtaataatttttttatttattaaagttgagaagtataggattaaatgataaagagaaaagaggttgtttaggataaggaaataaaaggttgaagttaatttaagtattatgatatttttttagcgtgttatacggttatttgttattttttttttttggtttaatttgttttatggggatatttatgtgggaaaatatttttgtttttgtaatttatgtgggaaaatatttttgtttttgtgtttttatttaagtaaaatttgggttttttttatgttaattagtttttttattattgttattatgatagaaagtataggttatttataaatatgattagtttaatgagaatttttagaatattgttgatttaaatttggatatttatataattattaatttttattaaaatgttataaggtaatataagtataattagtttttttgatttttgaatatagtttaatattatttatttaattagaattatattggaaacgatatgattaattatggtaggtagtagatgtttagttatattagtattgtttttagttagatgtttttggtttttgtgagtttttttcgtttttaatggtgaaatagtaatagagggaattaatttatttatttaaggtagattttttatttttagatttgttttgaaattaatagatttagtttttttttattaaatattatgaaatttaaataaacgaaattcgtaaaataatatagtagtagtagtaataataataatgaaatattaaaatagtaaatataagtattaaatattaaaattttttttttaattaaaatttttttttttcgataaagtttttaggaggtaatttaatttttaggttggtgtttaatatttgggattatttgatttaagattgaagtatttaaaatggtttttaaaaaaggaaaaaaggttagatttttagagaaaagtgtaatattttttaagttgaatattatgagggatttgatgggggtagttttgtaagtagaattggagattggtttattgtttaggttttttacgaaagattgtaaaggttgtttgtttttaaatattaagaagttattaagtttattagtttaaatgtaaatgatttatattaggaattttaatagtgttgttgttaagttatttgtaaatgggtggggttgagatgatatagaattttatttttttaggtggtattttaagtatggttgattttatttttagttttatatttaaaagtatagtgtaaatatagttaagggatcgttttttttaaattatatataaggtatatttattaataggagatgttgtgaaagttaggtggggttttgttttttaagtttttgtatttaagaataagtatgttgtgtataaaaaaaaaaaaaaaagtaagggtgatgtaattgtatttattgtttttaaagggagaatatgtaataatttttagatttaaggataaagggaatttttttttaagaaaagatgttggtattatgtggggattgggaatatgttagaataattatatatttttataagagagagaaagagaaaaaaagttaagatttatttgttttattttagtttttttttttagaattgacgattttaattaataggttatttttagagtattgttggatattttgattttttgttatgaaatgttatgggaattttggtagttgagagttaatattttattagatattagtgttgtataattatatttttaatagattttagagttgtggtgatagtatgttttttttagtttttttatagacggtgtttttgaaattttttatagatagtgtatttttgtggttaattagttatttgagtaatttttattatagaaagagtatttgtatataattaaatttattttaggattaaattgtcgggttttaatgttattaatttagaagggttaaaatgaaaatgagatgaataatttttatttgatgaagggatcgtattagattagattttattttttgaaatatatatagtattaaatttaaaaaaataagagagatgaaaataggtgatggaagaaattggaaaggtaagttgtttttagagattaaagaataatatttttttttaaattattattaagaaattttgggggaaagataaaattagtaagagaaggttattagttttttgttatttatttttatgaaattatttttagggattagtttgttaaattttattgaaacgtggaggtatatagtatagttttttttttgggatgtatagttatgttatatagaagcgtgtgggtagacgttaaaatatgtgtggatttgtaattttttttgtagaaatttagtattttgagtagtaataaggattaattttgtgtatttatggagaaaattggtggttttatatatttagttgtttttcgggttatttttgtattttattttataattttttttaattatttaattgtaaagtataggaaagtgtttattatttgtagtttaatgtaggaggaaatataattgaatatgtttttttagttattgttttattttagtttttagtttttttgaagtgttacggtttattttaatagtacgagtaaggtagtttttaggttttgtgtataatgagttatgtggattttatttaagaaattggttgtattttagaattattataaaatataaggaaaatattaatattttagatgataaaagatttatatggttggttagaaaatatttgtattatttaagttattagaatgtatttatatggaaatatttaatttggcggtattgtgaataataggattgtgaaaatatttgtttatttttattcgtttttattaaatattgatttttatagaagatatgtaaatttaaatattaatatattttatttaagtataggatagggattttatttttatatagttgttataataaatataatatagtatttgttggtgataggattttggaagatgttttggatagttggaaaaataagtaaaatgtttttttttgtattaaatttgataaaaaataatagttaatatttattaatggtgaggtaaataatttgattatttattatttatagttgaggaaattgaggtttagagagtttcggtggattttttaagattatatatttattatgtggtggagagggaatatgaattagtgttggtttgttatgtttttttttatatggggttagatatagatgtggtgttttataatgtgagggaggtttatttggtagaaatattttgtagattttatatgttagttttttatttatttaaataaagttttatatgagtatttttgataagtagtttgtttatatattaattttatagaggttaaatataattttaatgtttttttgttgttattttgtttttagtattgaattattattataaggtattaattatatatgtatatttaatagggtattttgttaaaattatgtatgaaggttatttgtttgagatgttagaatattttttcgtgagaagattttattgggtattgaaatagaattatatgttttttagattagtaatcgcgattattaaatatttttttgttaattttatttgagtaagaacgtttttaattaaggtttaagtgttaatatgtttttaaaaaaaatcgtggtgatataaaatttttttttttagtatttaatagaatttttttaaagtttcgtggtttgatattttatgttacgtgatttgtgatttatttatttgttatgtttttcgggaatgtggttaaggggttaagatgtgatttgaaaagaaaggtagaataagattattttaaatttattattaaggaatagtttagaaaacgattttagattatagagatagtagaatagatggttcggtatggatagagtattagatatttatagattgtgttaataagagttatcgagttaaaatagttaaaggaaggagggttatggaatgggtttttttatattaaattgatgtttagaggtttttagtatgaataataaaggtaattagatttataagttatattgagtggatataaaatttatatttaggttgatattttaaatgtgtgtggtaagttagatgatgatggtataaaagatagaatattttgtttttggttattgttagtttttggaagagagtatatttttagaggagtagttgtaaggagtttgagaataaaattggaaatgtttgttatgaaagtttttataggtattattaataaaagaaaatgtttatttgttaatggtgttttagttagattttggtagtttatttttatgtttaggaatgattttttgtgtagattggatatagttattaatgtaattgtttaggtgtaatttttttataaaggggaagaggagtgatttttttttatatagtggttttgttaaaattttataaaaaatattgtttatttaaattaaataattattgtgttcggttttatttattatatttttttatgtagtggaattgaaggggatttttttttttgttgtttttagagaaaaataagattaagaattaatttttttaatgagaatggtaaggagttatgtggggatgatttggaatatatgttgtttaaatggtggagatgttatttaggtcgtaaattatggtatttttatatgattttttatttgtttaatgtaggaaattatttggtaattttaaggaaaaagtttagtaataatgtattatagtttaatgtttatattgtatttggatagtttaaatttattttataaagtattaattatttaattataaatgttgagtaagtgtaaaattattttttaaaaaagtattttttgagtatgaaagttttaagtttagtaagatatttttgtgatttgggatatattttttgaatttagttttgaaaataatgttaatagttgagaaaagagtattgaaagttttatatatagtgtgttgtagtgaaataattttttttttggttttaaaaaatattgttgtgttttttagatttagtatggttagttagatgaataatgaatgtatgtttaattttttgttataggaaattttgtaagtggtaacgtgggtttatttcgtgtgtgttattagagttggcgtaagtttatggttatggtgaggtagcgtttttattggaattaatttgatatttgtattagtttttgtaattgtgtagtgtttttattgtaaattacggatggggtaaaagattgtttattttttattttttatttaattttatatattttgtttgatgaggttatggagaaataggtttttttatatattaaaggtgggagtataaataatttaagttttgtgtaggataattaggtaatatttattaaaattatatatgattttttttgttgatttagtaattttatttttgggaataattgatagatataggtgtatatgtataaaatgatggaaagttttttggtatatattagtaagtgataaaataaggtgtaaaatagtgtatatatggttattattttttgttttaaaaatgggggaaaatggtggagtttgcggtgagtcgagatcgtgttattgtattttagtttgggcgatagagcgagatttcgttttaaaaaaaaaatagggtggggtgggggggaaataatagtatatatttatatttatttgtatttatataaaatatattattaaggatttataagaaattaatataaatgattattttatagatggtatgtattgggggatattgaggtgagtagggtataagtggggtaagattttttagtgtaaattttttttaaattttattttgatttttgaataatgtaaattaattgttaaataattaaattaaaaataattaatttattaataaaatatttaatttagtggttttatttttgatataagataatttttaaatttttattaattattaaaaatagagatttatattagtttttttgtttgttttttttggtaatgattataattaagaagttttgtgggtgttattttagttttggagatatttttttagaagaaattgatttaaggtgggataattgggtatagagaatagtttttgggatcgggggttgaagttttgaattttggttttgtttaatttttattttttattaagttgattttgtgaaacggttgatatatgattattttttattaataaattagataaatttatgggtgattaaatttaaaaattttgttgttttattattgtaatatgatgaggatacgtatatatattttgtttaatttatagtattatattagggattgttaatatatgggaaagagttttgtatattgtaaaggttaattttataaatagtagttgtgaaatataatataattttgagggggtggttatggttaaatataggaggggaaaaggatttagttttaaaagtatttgagatattgagatagtgtagaggaatgaaattttttaaaagatggaatttaaatataaatagatattaagagcgggttgatttgtagtggaagatgtggttaaatgattttatatgtggttatttgttattgtatatattgtaaattttgtgaagtttattaagggaaattagggagatgtaattgggagcgtattgtaaagatattgatacgaatacgaatgtgagattaatgttgaatgatggatttaaaaggatggtttttagtttttgtgaatatatagttgttggagatatgtgtttgttatatatagataggtttttaatttatttttgaaattagatgtaaattttaaatatttttgaaaagtttttttagaggattttttatttttaaatgtagagattaaatgaaaaattattttttaaaaggggttaaaaaaaatatttaaaaaattttttttttttatatgtatagttatttggaaaatagattttttattaaacggatggttaaagttgtattataatattaaattaagtataaaaatttaagattttttttttttatttttttaaaacgaaatattttaataggttagaaataattttatgaggaagtttattgaaggtatttttatttggtattattatttagatattgggttaggaaattagttatttggaatttagaaaaaataagaattattttgattaggtaaggtttttgtgtaaggtgtttagttttagttgggttttagtagtttgatgggtgttatgtatttttggatttttttttaatgaaataagggattttgattttgggttttatgttgagaagttttgaagttaaatataatggttaaatataatgtttttttatttttagttttatagtagattatgtttttatatagaaatttttttaggaggtttattattttatgttattttaagtcgaggtttttttttatataagaggtttaaattgttcgtaagtaagaattaaagatatgttatattttttatgaattagttatttatttatttagtaaaggttattaagaaggtattgagtttggatgtattttgttttaggaaaattatttttaaggttgttttatgtaaagtgggaataattaatttggtaatttaatagatttgttaagtgattgttttaagtttaaattgttattgatttgtaagtatgatatgaaaattagagatttaaggaggtgggtatatttttatttgttaatagtttttaagagaagtgttttagtattattttaaatggttaattttgtatggttaattatttagttagaggtttataagattaaaaataatttttaaaaaattatttatgtgaataaagggataatgagttgatatttttaaggtgtacgttaggggtataatataagtttttgttttattagtagagttttggtcgtttagttgaagttgaaagttagaattagttgtgtttttgttatttttttatatgaaaagaatttagttgtagatttttattttatgagaaaatattttttaaaaatttataaataatttttaggttttatttttgtttttgttttttttagagttataaaggttatttaaatttttgtggcgaggttatttaggagagttttttttttggatgttaatttgttaaatttgtagtttagatgagtgtgatgtagttttttaaaatttatttttgtattatttttttaaataatagatattttttgagtataggtattgaggatattaaaatgaatgagattgaatttttgtttttggggattgtagtgttaagggtgggttagatttaaaaattaataatatagtgtaatgtggtatatgttgtaattaatatgtataaagggtatttttaaaaaagagaatgaaaagagggaggaaggtggtaaaggagaaaggtttttggtttaagtttttgtttaataaagattatattttgtagattaaaagattatatgatttgttaattttttagtatgtatagtttatgaagtaagataaagtatttatgaagagtttaatattagcgagtttttggggtaagtaagttggaaattataatttatttatggatatttgtttagaattgattttttatttagagtgtttttttagttgataagaataatattgaaattttttttttttatgagggaaaaatatgttgaattatttagtaagtatttatagagttatttattatgtatgtgtttagtagtttattgtgtgttattaggagtaagaaaatgtagaaatatttttgtttttaaagggtttataatttaattgtagaaataatattaaaatatatgagaggaaagaaaagtaaatttagtttttttgggataaggattatattttatgtaatttttaaaaagttattatttatttaattttttattattattatatatttttggtaattaattattttttttttttttttgggattttgaattgggaatagaatagaaataagttgttaaataagaattaaaatatagggttagttttaattttagtgtaagtggtttattgttttggtttataggttttatagtttagaagatgaaagattaaggattttatttattagattaattttttttttttttatagaaagaataagtaatggggataagagaagggtttagaatatttttttgaaagtgttatttattaggaagtaagtttttttgtggaaatataaggatgggggaaagggattttttttaatattgttttatttatatatagagaatttaagtaatttgtttaaaattatagagttagtaagtggtgaggtttaaattaaatttgattattaggtttaggaatataggtataggttggggttgttttatgaagtgtttgtttaggaaatgtgtttttaaagttaatagattgttttgagtaggatattttagaatatttttttagataaaaatattatatttataatttttagtttagaatttgatatagtaaagatatataataatgttttgttatataagtgtatatataattaattattaaattatgaggtatagattatttaggaatttagatagggtaggtttattattatgggtaagagtttttttagaaataggattttagttaggttttgaagaatgagtagaatttagatgaataaatagtagaaaaaattattaataaatatatgagatttagagaattataataaaatagttttagttttgtaaattttgttataaagtgaagtatatttaggtatgaagtatgttgattaaattttttattgttttaatataagtttaaaaaaagtatttttttgggggagttggaaagtattaaaaataaaaatagtggttgaaatttattaagtatttattatgttaagtattgttttaagtattttatagatattaatatatttaatttttattaatattttgttgagaggttgagatatagagaatttaaattattgatttaaggttatagatttagtaagtgttaggtttggagttaaattcgatttttttttggtttaggaatattgttttaggtttttgtttttatttggaagtttttaattagaaaatttattttaagttagaataaaatttttagtagtttttttattttaaaatgtttgaatttttgattatttataaggttgtaaattttttttagttacgttttaatgtaagtatttggatagtgaaataaacgataagtttttttaaattataggatatttagtttatttgattttagtttagcgatttttaaattgttttatatatttaaattatttgtagaagtttttaaatttaatataggtttagggatttaatattaaatttataaattttggagattaagattttatatgtatatatattttaaagatttaagggtaattttgatgttgaatgtgtttgagaattattgttgtatgttgtattttattttattgtattttttttattattattattataataataataataatatttttaagttttggggtatatgtgtagaacgtgtaggtttgttatttaggtatatagatgttatggtggtttgttgtatttattaatttgttatttatattaggtattttttttaatgttattttttttttagttttttatattttgataggttttagtgtgtgatgttttttttttagtgtttatgtgtttttattgtttaatttttatttatgagtgagaatatgtggtgtttggttttttgtttttgtgttattttgttaagaatgatggtttttagttttatttatgtttttgtaaaggatatgaatttatttttttttatggttgtatagtattttatggtgtatgtgtgttatattttttttatttagtttattattgatgggtattcggattggttttaagtttttgttattgtgaatagtgttataataaatatatatgtgtatgtgtttttatagtagtatgatttataattttttgagtatatatttagtaatgggatggttgggttaaaagatatttttggttttagatttttgaggaattattatattgttttttataatggttgaattaatttatatttttattaatagtgtaaaagtgtttttatttttttatatttttttttgtatttgttgttttttgattttttaatgatcgttattttaattggtataagatggtattttattgtggttttgatttgtatttttttaatgattagtgatgatgagttttttttcgtatgtttgttggtagtataaatttttttttttgagaagtatttgtttatatttttcgtttattttttgatggggttgtttttttttttgtaaatttgtttaggttttttgtagattttggatattagttttttgttagatggatacgttgtaaaaaattttatttattttgtcggttgtttgtttattttgatgttagttttttttgttgtgtagaagttttttagtttaattagattttatttgttaattttggtttttgttgttattgtttttggtattttagttatgaagtttttgttatgtttatgttttgaatggtattgtttaggtttttttttagggtttttatggttttatgttttatgtttaagtttttaatttattttgagttaatttttgtataacgtgtaaggaaggggtttagttttagttttttgtaaatggttagttagttttttcgatattatttattaaatagggaattttttttgtattgtttgtttttgttatgtttgttaaagattagatggttgtagatgtgtggcgttatttttgaggtttttgttttgttttattggtttatttatttgtttatgtattagtattatgatgttttggttattgtagttttgtagtatagtttgaagttaggtagtatgatgtttttagtttgtttattttgtttaggattgttttggttatacgggttgttttttggttttatatgaaatttaaagtagttttttttaattttatgaagaaagttaatggtagtttgatggggatagtattggatttataaattattttgggtagtatggttatttttacgatattgattttttttatttatgagaatggaatgtttttttatttgtttgtgtttttttttattttattgagtagtggtttgtagttttttttaaagaggttttttatattttttgtaagttgtatttttaggtattttattttttttgtagtaattgtgaatgggagtttatttatgatttggttgtttgttattattggtgtataggaatgttcgtgatttttgtatattgattttgtattttgagattttgttgaagttgtttattagtttaaggagattttgggttgagatgatggggttttttaaatatataattatgttatttgtaaatagagataatttgattttttttttttttatttgaatatgttttatttttttttattgtttgattgttttggttagaacgtttaatattatgttgaataggagtggtgatagagggtatttttgttttgtgtcggtttttaaatgaatgtttttagtttttgtttatttagtatgatattggttgtgggttttttataaatagtttttattattttgagatatgttttattaatatttagtttattgagagtttttagtatgaagggttgttgaattttatgaaaggttttttttgtatttattgaaataattatgtggtttttgttattggttttttttatgtgatggattatttttattgatttgtatatgttgaattagttttgtattttagggatgaagttaaattattatggtagataagttttttgatgtgttgttggatttagtttattagttttttattgaagatttttgtattaatgtttattagggatattggtttataattttatttttttgttgtgtttttgttaggtttttgtattaggatgatgtcggatttataaaatgagttagggaggattttttttttttttattgattggaatagttttagaaggaatggtattagtttttttttgtatttttggtagaatttagttgtgaattcgtttggttttgggttttttttggttggtaggttgttaattattgtttcgattttagaatttattattggtttatttaggaatttgatttttttttttagttttaggagggtgtatgtgtttaggaatttatttattttttttagattttttagtttatttgtatagaggtgtttatagtgttttttgatggtagattgtatttttgtgggattagtggtgatattttttttattattttttattgcgtttatttgatttttttttttttttttttttattaatttggttagtattttatttattttgttaatttttttaaaaaattagtttttggatttattgatttttttgaagggttttttgtgtttttaattttttttagttttgttttgattttagttattttttgttttttgttagtttttgaatgtgtttgtttttgtttttttagtttttttaattgtgatgttagagtgttgattttagtttttttttgtttttttttgtgggtatttattgttatgaattttttttaaatattgttttagttgtgttttagagattttggtatgttgtatttttatttttattggttttaaataatgtatttatttttgttttttttttgttatttatttagtagttatttaggagtaggttgtttagtttttattgtagttgtatggttttgagttagttttttaattttgagttttaatttaattgtattttggtttgagagattgtttgttatgatttttatttttttgtatttgttgaggagtgttttatttttaattatgtggttaattttagaataagtgtgatgtggtgttgagaagaatgtatattttgttgatatggggtggagagttttgtagatgtttattagttttattgggtttagagttgagtttaaattttgaatatgtttgttaattttttgtttcgttgatttaatattgatattggggtgttaaagttttatattattattgtgtgggagttttggtttttttgtgggtttttaagaatttgttttatgaatttgggtgtttttgtattgggtgtatatatgtttaggatagttagttttttttgttgaattgatttttttattattatgtaatggttttttttgttttttttgatttttgttggtttaaagtttgttttattagagattaggattgtaatttttgttttttttttgttttttatttgtttggtagatttttttttatttttttatttttagtttatgtgtgtttttgtatgtgagatgggtttttagaatatagtatattgatgggttttgattttttatttaatttgttagtttgtggttttttaattggggtatttagtttatttatatttaaggttaatattgttatgtgtgaatttgattttgttattatgatgttagttggttattttgtttattagttgatgtagtttttttatagttttaatggtttttataatttggtatgtttttgtagtggttggtatcggttttttttttttttatttagtattttttttaggagtttttgtaaggtatgtttggtggtgataaaattttttagtatttgttcgtttgtaaaggattttatttttattttatttttgaagtttagttggttggatatgaaattttgggttgaaaatttttttttttaagaatgttgaatattggtttttatttttttttggtttgtaggtttgtagggtttttgttgagagatttattgttagtttgatgggtttttttttttgggtaattcgatttttttttttcgttgtttttaatttttttttttgtattttaattttggtgaatttgataattatatgttttgggtttgttttttttgaggggtatttttgtggtgttttttgtattttttgaatttgaatgttggtttgttttgttagtttggggaagtttttttggataatattttaaggagtgttttttaatttggttttattgttttcgttatttttaggtatattaatgaaatgtaggtttggtttttttatatagttttatattttttggaggttttgtttttttttttttattttttttttttttaattttgtttttatgttttattttattaaattgatttttaatttttgatatttttttttttgttttatcgatttagttattgaagtttgtgtatgttttatagagttttcgtgttgtgttttttagttttattaggttatttatgtttttttttaaattagttattttagttagtaatttttttaatttttttttaaggtttttagtttttttgtattgggttagagtatgtttttttagtttggaggagtttgtttttatttattttttgaagtatatttttgttaatttattaaatttattttttatttagttttgtttttttgttggtaaagagttgtgtttttttggaggagaagaggtattttggtttttggaatttttagtttttttgtgttggattttttttatttttgtggatttatttatgtttgatttttgatgttggcgatttttgtacggggttttcgtgtggatattttttttgttgatgttgatgttatttttgtttgttagttttttttttaatagttaggtttttttgttgtaggtttgttggaatttggtggaggtttattttagattttgtttgtttgggtattattagtagaagttgtagaatagtaaagattgttgtttgtttttttttttggaaggtttgttttagaggggtatttattagatgttagttagagtttttttgtatgaagtgtttgtcgatttttgttgggaggtgttttttatttaggaattacgagggttagggatttgtttaagaaggtagtttgttttttagtagagtttaagtgttgtgttgggagatttattgttttttttatagttaataggtaaagaatatttaagtttgttgaagttgggtttatagttatttttttttttaggtgttttgttttatgagatgggagttttatttataagtttttgattggggttgttgttttttttttttagatgttttgtttagagagggagaatttagagaggtaatttggttataggggttttgttgagttgtggtaggttttatttagtttaaattttttagtggttttgtttatattgtgagaggaaaatagtttatttaagttttagtaatggcggatgtttttttttcgattaagttggagtattttaggttgattttaggtagttgtgttggtagtgagaattttaaattagtagattttattttgtcgtgttttatgggggtgggatttgttgagttagattatttggttgtttggtttttagttttttttcgggggagtgaatggttttgttttattggaattttaggtgttattggggtatgagaaaaaatttttgtagttaattgggtgtttgtttaaatggttatttagttttgtatttgaaatttagggttttggtggtgtaggtatttaagggaattttttggtttgtcggttgtaaagattgtaggaaatgtgtagtatttgggttagatagtattgttttttatggtatagttttttagggttttttttggttaggggagggagtttttttgattttttgcgttttttgagtgaggtaatgttttattttgttttggtttattttttatgggttgtatttattgtttaattagttttaatgagatgagttcggtattttagttggaaatgtagaaattatttattttttgtattgatttttttgggagttgtagattgtagttgtttttatttgttatttggttagttatttaatatttttaattatttatttagtaagagttttaggtttaagtaaaattataattaagttattaaggaataatatattaaaagttatatatttatttttttttttaagagtttttttttttttaaaaaaattaaattaaaaaattttttggaaaaaatatttttaatttttttattattattttattttttggtatatagaagggtattagtttttgttggagataaaggtggatagtaggttagggtgataatattagtttgtttttgttttaggttttatattaatgtattaagggtaagatatggttttttatttgaatattgtaggttttggttatagatagttggagtggtggtaaggggattaggttaggtgaagttattgggttattatttttgttttggttttatagttgtgtattttggattgttatttagtttttttaagttttagtttttttttttgttatatagaaataatgtttgttaattttttttatagagttatttgtaggattaaatggaatgagatatgtgaatgtattttaaaaatgtatggaatattatatatttggataagattattattgaagtgtgtaattttgtttatatgataagtgaaattacgtaggaatcgtagtaataataaattagttgaattttggttttagtattaatgtttattggggtattgtagtagagtaagtttttttaatattttatggaatagtgatagtgaaggtttttttaggtttttatgtgagattgtttgaagagtaattataggttttggaataatagatgttattaagtttattttattttattattattttttattttattttaagtttcgggatatatgtgtagaatgtgtaggtttgttatataggtaaatatgtgttatggtggtttgttgtatttattaatttattatttaggtattaaggttcgtatgtattagttatttgtttgtttgttttgacgtattttttttttttttttgttttttgttttaggttttagtgtgtgtggtttttttttttgagtttatgtgttttttttgtttagtttttatttatgagtgagaatatgtagtgttaggttttttgtttttggttattaagtttaagaaagttattgttagggatgtgaaaattagaaaaataatttggtattttaggaaaagtatttaaaataaattgtattaatgatattatattttaatgattaataaaatatttgataaggtaattttgtattaatatttaattatttatatatgattatttttaaatattatataatgtaaaaaaatttatatgtttaaagaagtatttattttattaggtattatttgtgaatatttttaataagtaggtgaatataatttttaatgtaagtgaatatatatagaaatgggtagtaggatggttatttgtttgtttgttttgtttgggagtaaaagagaaggttaggaatatggttgtaggtttggtattagaagaaaagtgggatttatttcgattttttgattttgtgatttttttttttttttgagatttatatatatatatatatataaattatgtataagtttgtttttatgttgtatagtaagagtttaaatatttttgagttaatgatgttaaattgtgtttcgattatattagtatatttatatgatttttgaatattatatatagatttttatattatatatttaagtaaaattattttttgattttataatgaaagagatttattggattaaaaagtggtttttagtaaattttaaagagatattgttattaaattattaaatttaaaggtaaaatagtatttattaaattgatttttttgttttattttttttatttggtataattattaattaatttttagtaaatggaagtatttttataatttaagtttttttagggggaaatatataatttataaatattgttaagtgaagaatagatttttgaatattaaaagatttatgtatatttttgtatgtaaaaaaaaaaaaaatttattataaaattatagatttaaatattatttttgatttagtagttttttttttattgtggtttttgttatagagttattgttaaaaagagttttttatgaaagatttttatatagtaaaatgttttaagaaaatgtttaataaatatttttattgttttaatttgtatataaattgatatttgaaaattagagaggataaagaattttaatttttaaaaaagagaggtaagttattttaaaatgttattagttaataattaaaaatatagtttgggggtaagaagttttgaaataatttagagaatttgtttaagattttatttttggattagttttttttgggagggagtatgtgaataggtaatgaaagttttatatgagagagttaatggagagttatattaaggagtatttgaagatatatggattaatatagggaaaagaaatttaagtagtttagtgtttgatatttattgggtatttaattaatgtacggtgaattaataaatgaattaatgaaagaattatttgttatatataatatttttattttaagaaaaaagaatttgaaatagaagaaaatatatacgtaagaatatatataaattataaattatatgatattttaaaggagatgtaaatattaaattgtttgttttgttgattgatattattaatatttaaaagtagtatgagagattataaagaataagtatttatttatatttggagtgggttgtttattttatggtttaatttgtattttatgttatggttatgttgtttaatttttagttgttttatagaagagtaaaataagttataaataaattattaaagaaaaaaagtaattttatttatgttgaggtttgagggagttgggggaggagttaattttttttagtttatatttaaaaagagaaattttttggaaaattgtaatatttgaagattttgtggtttttaaaagtgaaggtgaacggtgagaagtttttttagtttagttattgaattttaaaaaaatataattttaaaagttaattttttaagtaatttgggtatttgaatttgataagaatttttttttttagatattttgttttgtttaatttaaaggaaaaatagttaattttgagaatttgtatataaataaggaaaagtaaaatatagcgttttgtaaagaaatgggagggatttttgatatttaatttatgatgttaaatattttaagtagatgatttaaaggtagaaatatataattgtttttattaggattgtttatggattataaataaggagtagatttatggttaatgtattagaaaaaaataagtataaaggtattttagaaaatattttattttaattttttattttagtgttatttttaaaagggttttattttagtttttttatttttttttttttttttttttttttttttttaacggggttttattttgttatttaggttgaagagtagtgggataattacggtttattgtagttttaattttttgggtttaaacgattttattgttttagttttttaagtagttgggattataagtgtttgttattaggtttggataattttttttgttttttgtaaagatggggttttgttatgttgtttagattcgtaatgattttttgggtttaagtgatttttttattttagttttttagagtgttgggattataggtatgagttattatattagattttttttttttttattatatatttttttaataaagtgttttgtatgtagtgagtatttaatatttgttaaattaaattaatggaaagttttttaattattatgtagagtatttaaatttatattattggttttagaattgttgtttgaagtaatataaattatatttatgatagttcgttaaatttttgaagtttatttttaaaataaggatgttaaaaatatattatatatgttgatattttaattttttagttatagtaggtattagtaatttgaatgttatttttattaattttttatagttttagaattttttttaatttaatatttaaaaattatttgttattttagtttaagtttttttgtttttaagttatgtattttaagtttttttaattattgtttatatgtaatgtttttaaattttttatgtattttggttatagtgatttgaatgtatattaatttatcgatgatgtatttaaaataatttattttatttttttgaattgatgataatattttagatatagtttatttaaaaagtgaagaattattagtttttttattttagtattatatttttagtagtgtagtttaaaattttagtagttatgataatagttttttgttatattattggtttatattgaatttgtagttaatttaaaatatttaagttttttttttataatttgttgataagttattttttaaaatcgtgttcgtaattttttatttttttttaaattgatttttttgtatttaattatagtattttatatttaagtaaatgtaaatgatttagattttattatttaatagaatgtttgtaatatttgttggttttatgttttatatgataagtatatcgtttgtgtttttagatatattattagttaatatgtcggtgttggatgtatttttttaatgttgtataagaggaatattttcgagagtttggtttaggaatgtggtttgggatttcgttaagtatttttttttagtaaaatgattgtaaatttttcgatttttagattttatatgatgtaaaagaagtttgtttgtgtttaaaaatatatttaagaaataagtgaatatgtgaaaagatagaaaaatttgttttaatttgggtatagttttagtttttaaaggtatatgaaggtagaaagaaagaattataaaatggaattattgatgatagtaattttaaaattaagattgattagattaaattttatgtggtaaaaattttatttagtaagtttttttttttttttttttttttagatatatgtgtatatatatatacgtatttttattttagtaattttttttttttgaaaaagaaagttttttgtatttgattgtttttatgaataatataaagtataaataatatgattttttttggttattatgtaattttttttttgtttattagaaattggtataaatttaagatatattatattttattttttgaagtatagtcgttggtatttttattggtatttaaaaatttgaagatatttaaaagaaaatttataagtttatagttgttgtttaaattaattttaatattttatatatttataattttataagtgaattaaattatatataagaaattatagaattaagttaattaaatgatttttataataggtattggggaaaaatattattaaatttttttttttaatttttgttttttttttagtaagataaattatttttatgaagtttttgtttatattattagtgataatttgaagtagttattaattaatttattagtgtatttagtaatatttattaaagtgtttttttagaattgttttggatgttgttgtgggcgtatgtaaaaatgaattaaatatagatttttgttatttaagaattttaagttaatttgtaattattggtttttggttttataattttttttttttttttttttggtgttggtttagatgtatatttttatttattttaaggttaaggtaatttttataatttttttttttttttttgtttgtttgttttttgtgtgtgtgtttaaaattttgtttatatttgattttattttatttttatattttttgagtatattaaagttaaaggtagattataaatcgaaaatatttttaaaggtttttttatttaaattatttggtgttattgtattttagaaagtataatgaattgtttgtagtaaataaataaaattagaatttttatatttaatggttcggtttggtatatatttatgaaaataataaatgttaaaaaggatgttagtcgttgatttttggtatgttattttatatttggttatattataacgttaaaaggatttagtgtatatattaaattgtggatttgtttgttttaaaattttatttgtaattttatatgtaatttttatttttatatatatttataagatttgaatatggtaataaggaaattttagtaattgtagcgttggaaaaatggtttatatggaaataagttatttggttagtaaagttggtgattttgttttttaggtggtattattattttaatttttggtgagttgtttaaattatttggaattgttcgtttattttttttgaatttttattttataaattttaattttatataagttagttgtaattaaacgataggttgttttttaggttttattttagtaagttaatttgaagtttagtgattttttattatataattttatgtttttttattatattgttttagttttaagaaatttttttttgtttgattttttttttttaaaaatgtagaggtatgttaaaaatatagagggtcgttataaagttttcgttagattaaaggaattaagatgaaagtatgtttaagagttattaggttttgggagattttaaaattaggatattattattatgataattaatgaaaagtttttttaagtgaatttttggggaaaattatataacgttttttattttttaggttttttggaaataaatttttattttattatggttgttattaaagtttgtaaatttattttgtttttttttaatcgtttttttgttttatatttagttttttaatttatttaatgtaatttatttttaaatattaatttataaatgagatattagggtaatgagttattttttagtatttagtatatttgataagatttgttttattaagaggataagtgttttagagtttttatttgaatttaaatatttaatttaaatgaaagtttttatatttatttgattagatatttaaatttttttatagaaaagagaatatttttttgttttatttaaagaatatatatatttattattttttttttttttttttgtaaaaggtttttaatgttagtatattagtgagttttattttgtatttgttattaataatgattttatatagttaataattgggtttatgatttttttaaatttttatagtgtaaatattttggaaatttagtgaggtatttaagtataaaattatttaggattaaataattttatgttttaagtagaagtttaagaggacgtttaggatatatatgattaagtttataaatattaaagttattttatgttttttaggtttaaatattatatgtaaataatatacggattttatttgttagtattatttattgtttaatattattttatattaaatagagtaaatggatgtagagtgtaattagtaagtttgtttatttatttttgaagtttatttgtgtatgttatttattttaataaagaaaatttattataatataatttgatgcgatttttgtttaaatgatttttttttttattgaataatagttagtatttaaaatttagaattttatagaatttttttttcgatttttttttaaaatgtaatttatagtttgagattatagagtttgttagtggttgaatggttgtattagatggttgagagttttttaattaagtaataattttgtaattagtggaaattgagtgttttataataattgtttgaaaataagttgagataagttagtaattattttataaaagggatatatttatttttgttggataggcgagattttttatataaattgaatttttttatatagggagatgtaagttgaaaattaatgttttaattattaaaattaaatttatattatgggtatttgaaatgggagtgtttttttttttaaaagatatttagagtttagttattatttattttttatgttgtttgtttttatttaggaagtttgaaattgtttttttgtatttcgggattaattttttatattttaaaatgttaataaattatttgaatatgatttttttattttgtaaatttttttaagagtaagtttacgattgagatttaaagttgttggttgtgttatattttatagtttatagttttttttttttttttttttttttttatatatacgcgtacgtgtacgtatatatatatatatatatatagagagagagagagagagagagagagagagagtattttaggttttagaagatgaatgtaaaaagaatgtaaataagttttttgttatattattaggtgggcgtgtttagtttattgtgcgtgttgaattataaattagtgttatttatataagaaatgatattaattatttatattttgattattgaaaagttgggatttttaaagattttaggaaaaagggaatagtttatatttttatggcgttttttttaaataggaaatttacggattttgagttaggattttagaaatttgtatttttttttttataggatttttttttttggtgagttaaaatgaataagaaatattttaggattttttttttttttttggttattaatgagatgaaggtaattaatttatatagtataaatgaattatttgaggtgatgattgtattttaggtaaatgatgatttttttggttttattggtttgtaagtaaaagttatatatattgaaaagatattgaaatagattttttaaatgttttattttttggatgtattaatgttgatttattatatatgttaaatggttttaaaatattattttaaaataaaggaaatttttagttattaatttagttttgaatgggttatgaaaggttttaaaggtatgtgaaaaattattgttattttgttttaaaaaatgtgatgtttaagagtgtttgtaatgttttaatgttttaaaatatgtacgtaagttttgtttatttggaaattatttttttttgtttatattatttataaatagaaaatgttttgtaataatttaaaatagttttatatatataatgtttttagtgttataatatttattattggtttatatttattaatatttattatattttataaaatgaagtagaagaaaaaaaagataacgattttatggttttggaattttagtaatggtgattaatatgttttaaattttagtaaaggttatggttatattttaataagtgtttttttttttttttttattttttttgttaatttagaggtaaattttttaaaaaaaaaaaaaaaaaaaaaaaaaaaaaagttttaagtaaggtatttgtaaaattagaaaataggaataggagtttagtgattgtttttaaaaggtgttgtttttagggttaaaattttgtggtgtaattttaatatgttatgttatttattatgtgtaatgttttgaaacgttatatgttataatattagaaatttttaatttaaaaattatgttgtatgagataagtattgaaggtatatacgtttatataaattaaatttgtaattatgttttaataagttaaaatgtaaagatatattaaattgtaagattaaaatggtttttgattttataataaatttatataaaaatagatttttttataataataaaggggagagagagattttgtaggatattgagttagtagggaggggttttatttaatattatgtcgttttttatatgtagttagaaaattaacgtttttaattatatattattttgttttaaaagattattaggaggattaataaatatttagaaatatgtttttttttgtttttggttaagaatatttttgcgtgtttgtcggaaaatgttttttggttgttattgatattaaggagtaagtgtaggataattagaggattttaaaataagatttaagaagttttaatatatcgttaatcgaggtttattaaagtttttttagcgcgaggaaaatttgtatagaagttaaataagaacgaggagttaaaatttatcgacgacgagtcgtacgttttatcgagttggagttagtagtattatttaataagttttttttattagttttttaagggatttcgtaaaatttttttttattatttttttatttttagtttttcgtttttagtagttgtttttggtagtatggtcggtagagggtattttttattttttttagtttcgttttttgggtttttttttttttttcgttttttttttatttcggttttttattttcgttttatttttaatatataaatattgtattttttagtttattttcgtagtttcgaggttttttttttagggatgtttttagtttgtaatttttttttttttttgttcgttaggtatagagtttttaatttttagttatttttttttaggagtaatttatttatttattttttttttcggttttgtatttttagagattaattcgagttaagaattttttacgtatattttaattatttttcgaaagttaaaatttttaatttttttggagggcgttttagaagaggggcgtaggatgggtagagatgtgggttcggtttgttcgagagtgtcgtagatttttttagtttttagcggtaggaatttcgttttttaagttttttaagttatattggtttcggatttgtaagtttattttagttttaatttttggggagtaggtagtcgtgtgtagtttcggggaagggatgcgggttgaaggcgtaagttttttttttatttttttcgtaagtcggcgcggggattatttattttttggaaggatttttagtttagttttagtattttttttttagttaggattttcgatagttttggttttttaagtttttttcgattatttttgggttgggggagggttgcgagggattttcgggtcgtcgtttttgtttttattacgtagttttgggttttttttaggtttttttttttttatttcgtgattttttcgggtttttttttttttggtggtgtcggttgattttttgggttgtgggatgggggagaaaattttttaagagtaattttaaatcgttttttttatcggaggggaggaaagaaggagattggtttcgttttataattttggggtgggggattttttagttaattttttttcgcggacgggtagtttttgtattaagttttatttttagcgtttgtttatttcggggtttatataaattttacgggttttcggcggcggagttatatcgtggtttcgattttggttttagcgtttagtttcggttttcgtcgcggtgttgtttttcgtcggttttatagtagcggtgggtgttttattaaagtttttcgagtaggaggtggaggggcgtatcgggttggtttttttgttcggttcgggagttcgaggcgttacggggtgcgcgggatagcgagcgggcgggtgcgttcgggcgcggcggcggtagcgtcggggattcggagttttaggttgcgttttgcgttcgggttagatattatttagtttttcggttgagtttcgattggttaaacggcgtcgttttttttttttcgtttttcgtttttcgtttttcgttcgttcgcgttatcgatattcgttcgaggcggtcgtttaaagggaacgtcgcgtttttttttcgcgcggggaatcgaggggcgttcggaatttttcgttttttcggggtttgtttttatttttttttttagggtttcgcgatatcgttttgcgagttttgcgtttttttggggcgttttggataggacgttcgcggtttcgaggggtgttttagttttagttttagtttcggggaatttcgcgtttcgcgttttttgtagaaatttcggttgtgggcgttggggcgggagggagcgagtgagaatcgtacgtttcgaggtttcgtttttttagtttttaatttttttttttttttttattttagtatttaagttttttgggagagggcgtgcgtttttcgggttatagatatattttttcgtatttttttgtattacggagtttgcgaacgcgagtatataatgaaatcgtatagagtatgggggttattggtttattttgttgttttaaatacgtcggtttaaatagagttcgcgtattgatttttttagagtttgtttaataggaatttaattaagataataatagtattttttattgatgaacgtttttagataacgttatattaagttatttgttttagttaggaagtttaggtaatgatagatttcgttaaagttatacgttttttagtcgattaaatagaaaaacggaaagagaaagaaagaaaataaatttatttttttagttattatttgttaaagtaattattaaggtagttgtttcgggaaagatttcggttttaaaatttttatattttattatttttttacgtttttttcgtttaattaaaggggggagggggcgcgagtttttggtgttcggtatgtattttttttgttttgtagtaaagaagttaaattattgatagtggaaattgtatggcggaggtaatattcgtattttattagcgagaagttttatttgatttcggtagaggtagggagattttatgttagttcgtcggggggagcggtagcgagagtagtttttttcgcggtgaatgggaaagtgggtgggagtttacgagagggttttacggtgttttgacgtgcgttgttatatgatattttcgttgtttcgaaatagatattttagtgtacgaattattagaattaaaatttagcgtatttaaaatgatatattttttattagaagagtttcgttttagggtattgtatgtttttgtagatgtttttatttttagttttagtaaatatacgtataagttaatttttttaataacgaattagggtagttaagataaataaaaagttttttgttttaattagagtgggggtaggtgattcgagggtgggggtagaattggtttagttaattttttttcgttttttatttttattattgttcgtagtaaaagagtaaatagtttttcgggtttttatttgtttgtagttaagatttttgaagagaatttatatggttagggtttagaggatatttttaattatttatttgatgaattttgttaatcgtttatttgtgtttttgttttaaagttgaattttttttttattagtttaattaatttgtgtagattttaaaatttagaataaagaataagatagtagtatcgtatttaatttggagtttttggattttttcggagtataaaaattatttgggtgagtgttaaaatgaaggtttttttttttgaaattgtgatttagtaggggtggggtagggtttaggagttataattttaataaatattataagtaattcgaatgtagataatttgaagttatattttgagaaatatttttttgggggtataatattgggtattagaggaattttttattaagtttatatttaaattttgtaggtagttttttgtgtgtgtgcgtttttttgtaattttaaaggggtttgatttaataattgcgaagattattgttgtaagaatttttttaaagattttaatattaattttgttaaagggaaagatttataaatagtttttttttttggatttttttgtggttattaagaatgtgttgttgaattgaatatataatattattatatatttagtttaatttatttaagggtttatagttagtaaaatgaatttattaatattagttattttagaatttttaaagattagtgatagaaattatttattcgttttataaaagaagaattcgattttttgttaggaaataatttatttacgtttatatagtgaagtattagggataagattttagtgaatttaagaatttttgttagaaataattttgtttttattttttttattttttaagtgaagttatttgttttttggaagtgttattagaatgtgtgattatttagagcgtttttgtaaattgttggattaaatagttaaattatttaaatatatgtatatttttcgagtgttatatatttagttttgtatttttgttaatttgatagagtatatgattaatataaattattttatagtatagatggtagagtttattgtggaatatttaatgtatgtgaaatacgtaggttaattagaaagtaataaaggatagagggtatgaagttggatatcgttattttatagattttttgcgttggtttttaggttgtaagatgaatgtaggtataattttttttagtagtataatataatttaaaaggttagtgttatatatttaaaaaaaatatttgtattatattataaaggattggaggaattttattttaaattttaattttgttaattttaaattgatgttttatatttgtttgaaaatgagttttatttttaggtttttaagtttaattgtaatttattttttttttgaaaaaatatttggtaagttaatgttaggaatttaagttagtattttgaaggttgtttatttagaagttatggtaaattttttttttgttaaatttatattggtacgttagtatttttgttgaaggaaaaagtgtttttattttttagattttgattgggtgggtttatggttaatttttttatttttatttttttttgatattatataaataaatgtgtgtattttcgttttttagtgtgtggtgtagttttattgaggaaaagatagaggagttagaaatgttagggatatttagaaagaaaagaagattagatgttaatttagataattatgatgaattatattttttaatatttgtaagtatttttaaattttttgatttgtgattatagtattgttaatattgtatgcgattagtttaaaatatgtatttatttgttttaaaagtatattttatatttaaaaataatgaagttaagataaataaaattgtattagtgttttgtatggaattttaaatattattttttatttgtttaatttaggtagtatatagagataattttggaggtttaaaattaaatattttataaaattatttttttattgtgggtaaggatgatgttgagaatatagagtatgtattttttttttttttaaaaattggtttttggtataattgatatgttaggagtaaagtttttaagtttataatttgaatattttttttattattaaaatgagggaaagttttatagtttgaaaaaataatgttatttattttatttttgtggggtttaaaaattaattgtgaattcgtttgaatttttatttttttttggttatgttttaatatgattttaatttaatgttttagggggaataaaggttaggaagaaatttgaatttttatttatttttgtcgggaaatataaattaatttttattatttaagtgagaatagaggtagtaggtttgatattgatatgttttttttattaataattttaattggttgaggttaattttattattataagtattttatatttatgtttatttaagttttttagttatttttatttttagtattttttgtaagaaaaaaaaaataagttgtttagtttagtattaaataagttggtttaaaaaaattgttgaaatttttcgtaattagtatagggaaaatatttagtaaatagaaaattttgttgttgagtagagtggtataggtgtttttaaatttattttggataatttgaaaggtttggtttaatgttaaattatgttattcgtaatttttgaaatttttgtatgaggtttgttttgagaaaaattttaagggagaagtaatttttttatttatgagatgttacgtttttattaagttttttatgaattataagaatagtttaatattatattaaaatgtgtttaaattggttaatatttgttataggagttatgtaattaggtatagttattagtggtagataaaagaaaggaattatagtaagaaatttttagaagggttaagattaggagagtagaataagagggttaaaagttgattttatttgggaataatatttagttggattaagaaaaacggtatagaaattattaagaaattgttgagattaaatttttaaatatatgagaaatattaatttgtagttttttaagttattagatttgtgttgagaatatttaaaaattaataatgaagaataaatttggtttatttgttgtaatagttttataagcgtggttaaaagggatgtgagattgtgggtataagttagagttgatagtaataaatagttgtggtattagttggttttgttaggagaaaagttatgagaagaattaataaatttaaattaaagggttttaggatattgaattagatgaaagatgaatattagtttatttttgagatttatttatttaggttgtgtgatgtttggagtgagagattttttatagttaaattttaaattttttatgaaaaaaatgaaaaagaagaatatgtaaaaataatttagaaaaaaataagtgaattttttaaagttttattttaaaaatatatattaagaatttggtttatttttatgtgattttgatatatgaatttataaagtattttttagtggtttttttgattaaggatttgagtaggatgtgtaattggttttttttttatttttagatagtataggtatggtgagaatgaaatttttaatagtgtatggttgtgaagaatgggttaggttttagattagtttggtatatagaattatttggaaatattcgaaatttttgatttttttaattttagttgttttttattttatagttatagttatttagttgatgaaagattgttgagtatttattatttgttaggaggttattttatgggttgatataggtagatgtataaaatatattttagttttttatatgtttatattttaggatataagagttgtattttaatttatggtgatatttgtaaatttgttaagtttaggaagttttgttttgttttatttttttttgtcgtaggtttggtgtgtagaaagatgatggtaaatatgtttttagtggttagggggtggtagtgatggataagaaatttgtttttaaagttggagtggtatttagaggcgggggagggtttattacggttaattagtttttagttatttcggttagtagtgttttataaaaggtagataaaagagaaggagtggatagggtgagagggaggaaattagataatttttgtttgaggtaaataatttttttaaatatgatagatagatttataaaagataggtttagaagggattttaagagattattttattttttttattatttataggtttgttattgtagattagggaagtagattatatattttttttttggggagttatttagaatttagtaatgttggtgtttggaagtttttatttgtaatgtatttttgtttttgttgtaatttatattttattttattttatttaattttagtgaagatggagaatagttgtttattaatttttttatgttattaagttattatttagatttttttcgtagtaaaagattagattttataatttttttttataaattttaatttttaatttattaattattttttttggtttattttggattttttttaagatttttatatttttttgaaaatgtggagttttaaattagatatgtgtgtgaaattatttagggtttaggaaatataggagttatgaattatttggatatagttgttgggaaaaattaaagggaagatttaattagattgataaattttttttttgtaatttggagataaagtagtggttgtttaataaaaagatgagtttttataataaagttacgttttttgtttttagtttttaaatgaagtattatttttaaaagaaataatttttgaatagaatatttagtttttattgtttttttttttaataaaattgtttaagaaatagtggtttttttgtattttatttaaaattttaagttgtagattttttatatttaaattggatttgtgtttttatatttttaggtgtttattatatattgatataattttttttaaaggtaaggtttatgaaatattatattatttttgaagttttattttttatttaaattgaattatttttttttatttggtttgtatataaaatttagttagaataaagtgaataaaattaagttgaatttagtaaaagagaattatgttaatttatatgatatttagaattaagtttttataaatttattaagtatgtttttattatggtttaataatttaatgagattaaattatgggattagtagaaatattgtttttattatttaggagatattttatggtgtttgtaaaattagtttaattggtttaagaagatattaaattagatatagaataaagttagtattttaaaaagaaatggggtagtagaggagaatgtttattttttttttataatatcgttttgagaaattgtttagggattttgtaattaaaaagagattgttgtaagtgtttgttgtaagtaggtatttttgaaattttagttagttagtgagaggtattaagaagttataagtttagttggatataggaaaggttgatgttgatatagaagaataggataaatataatgttttataaaagttgaagatagagagatggggtggaatggggaatgaattggtgagagtatagttattaatttaaattttagtttttataattgttttttgtttggttggttgttattgttatgtatgtattttgggaaattatttttttttttgttgtttggatagtagttatgatttgggaatggggggtggtgtgtgtgggaggtgaggtattatacggttagatatttaattttggaagttagatgtcgacgttatgatttagattaaatatatttttgagatataaattaagattatagttagttttttttaagatagtttttatgttgaattagaaaaatgaagattaatattttttttattattagattttatgtgttttttaaatgtagtaaaatgtttaatattgaggattttttattttataggtatgtttttttgaaggttttgagaagaatgagttaaatatatgattatttattggtttttttaatttaaataagttttaagtgtaaataatttaagttagttttgtattgtttgtttttttatgtttatattaaatattgatttgaattattatttttatataatatttttatagtattataattagattgtggatgtagattatgttagaattattttgtaagttaaatttttattattttttattttgttcgtatataaaaattaattagagtaaagtgagtaaaaataagttgaattttataaagaagaattatgttaatttatatgatgttaatttattttaaaagtatgtataagtttgatatatttttgattattttttagattaatttttttttaatttttttttattattgtatttttggaaatttatattgttatttatatgattttgttttttgtttttagaaagaatttataaaatattagatttatttttaattaattgatgtttataagagtataattttagaagagtagtaataaaagttaattataaaagtagaattatatgtatggatattatatgaggaataaagaaattgttttaaagagtatttagttggaatataaggtggttttaaaaataaaaattttaaatgagtaaatattttttaacgttttaagagtagggatattaatagatataattaattttagaatttttttttttttttttttttttttttgatatagagttttattttgttatttagattggagtgtaatggcgtaattttggtttattgtaatttttgttttttgggtttaagtaatttttttgttttagttttttaagtagttgggattataggtatgcgttattatatttggtttattttttaagttttagtagagacggagttttattatgttggttaggttggtttcgaatttttgattttaggtgatttattcgttttagttttttaaagagttgggattataggtatgagttatcgcgtttggttagaattttttttttattttttgattattttagggaaaatatattagtagttgttgtttttttggggtggaggattaggagtgaaaagaattttgtcgttgaaaattaaataaagttgttgtttaattttagataaaagaattaaatgaagtaattttgaaataagtaataatataggaattaatgaaaatttgaagttttaagttttagttagtgttttaatagttataaagtaattataggatatttaagaagtataaagtataattagttttgttttattattttgaaattaataatatttgattagaatgttattaaagtgttgttatgtttatgttttagtaataatttgtttttaattttattttgaatattaaagtaattaaaattttgtataaattgtttattgtttttttttgatgtgattattaggaaatagaagaaatatttttgttatatgatattattttaaggtttagatagtagttaaaagaattttggttttaatttaaaattgttagtttttggttatgtaatttgggtaagtaattttattagtttaagattgtttagatagatatcgtaagggttatataattgtttattgaataaattgagagatttattattgtgtattttagttgtttaattaattaaatgaggttagtgggttataaattgagtttgttaaagttggtaatatatttagattttattttagaaagaagagatgatttaggtgattttaatgtatgaagggaattagtgaattagattatttgtaaggtattttttttatttaaatttgaacgataagtttagtttattaaatgatatatagtttttgagttaaggtaaggatttatagtttattagttattatattatttagttatttttgataaagttttaggtggatttttttatatattaaaatgttttttaagattatttttttttgttaggttgtttttagagttttgggacgtattaaatttattatgtgtttatggggtttttttttgaataaattagagtggaggtgggatgaagtttttttatagattttcgtatttttgattatttatatgtttttggtagttttgtaaagattattgatttgtgtgttaagatatattagtatgtatttaattttttatttaaaattatatttttttaggaggtgttttttaggaggaagatggatgaaataaatgtattaggaagatgtttaagtagatatgttatttttttatttagaatatattttagtttagtttttagagttagtatttagagttttgagttggtgtaaagatataaaggatttagatattaatttttggtatgtttttaaatgagatgttatttttaggaaagttttaagtttggagtggattttttggaggaagagtattgaattgtataaggaaagttaataaatattttagtttttaatagggattataagttttgtaattacgttttagattgtgtttgtttattttttttttttttatatttgtaaataatatgttagttttggaggtttgttatttattgtgtgtttttggagagggtgttttttattatagtatttgtagtattatagttagtaatagttcgtaaaggtaaatttatgaaatagtttttaaatatattaaattttaatttaaataatttataatattttttatttaataatttttagaagttaattaatttggaattgttttaaataagttaagaaaggagttagatattatttattgggttaataaattaaagtggaaggaagaatatgtaggtgaaaagttttagattttaatttttttagtgattatatatttatgtttggattattttgtattttgatagtgttttaagtgtgatgataattataataataaaagttaagattgaatagtgatttgtagattagtgattaaaaaaagggttttgatattagatagatttaggtttgaatttagttttgttatttattggttttgttaatttaagatagttaattaattattgatgttttagtttttttatttttaaaagaaaaataatcgttttagtttagaaagattgttgtgaggatttaatgaattaaggaaatgtagaatgtttattatagtgagtttaataaagttagattttattattaatgtatatgattttaataaaatattgtaatattgtttttattttatgattatgaaaattgggttttaaaaagggtaggtgataattagttatttgaaaattttttatcggttagtaaagattaaaatgattttaaagtagtatttttggaaatgaattgtgagatttatggttattttaaagagttgtggttaagattttgtaagaaaatgtgtatgtaaattatttgataatgggagatttagattaaatttgggtggtagttataagatggggaggtataattttataatggattttggaattagaaaattttgggtttgaagtttagtttttttattttagattttttgtgttagtttgggtaagttatttaaattttttgagttttagtttttttaatttatttttgagagttattttaagagttaagtaatatatgttaaatataaaataaataatagtattggatgaatgtagagtaaatgttattttatattattataattttttatggtgtagtaatgataaataggaagagttttagtaattttttgggttagtgaggttagaataggtattttaagtaatgttgagttaatgattagaatttgaattttttattttttttaatggagtgatggattgttagggtaatggggttgtgttggtgatgttaaagataaacgttagagtaatagtaagtttagttaatagaaatatgtttattatattttggtttttttagtatttggttttttttttatttgatagtttgtttaatggtaaatgtgaattttaaaagtttttttttaatgttgatttttttttgttaggaaggaaataataatggttaatgttgatatttattaaattaatatttttgaatttatgttgtgttaataagtgttttttaagtgttttgttgttaaatatgtgtgggaaatgttatatagtagtatttgtatgtttttttattagtatatattatagatatttttatattacgttagttttatagatattttaaaatatattgatatttattattattttaaaattataatatttattttgttgttagattttatttaatgtattaaaaagtatatatattattatattatataatatattattttaaatgtttttataattgtatattaatgttattggttttttttgtaattttatatatttattttatttatttagaatttttttttttttttgagataaagttttattgtgttatttaggttggagtgtagtggttaatttcggtttattgtaatttttattttttagatttaagtgattttcgtgttttagttttttaagtagttgggattaaaggtatatgttattacgtttagttaattttttttttttggtaaagatagggttttgttatgttggttaggttggtttggaatttttgattttaagtgatttattcgttttggttttttaaagtgttgagattataggtgtgagtcgtcgcgtttggttttatttagatatttttatgagaagggtttatataagttttattagattgttaagagagttgagtttatggtatgaaagttattatagtgagtaatttttttttttttttttttttttttttttttttttttttgttaggttggagtgtaatggtatgatttcggtttattatagtttttgtttttatggtttaagttagttttttattttagttttttaagtagttgagattataggtatgaattattaattttttgtatttttagtagagatagggttttgttatgttggttaggttggtttggaatttttgattttaagtgatttatttatttcggttttttaaagtgttgggattataggcgttagttattatattgggtattagagtaatttttaaatattgattatggaagttattggtaagtaagaagtttttagcggaggaggaaggtgaaagtagaagaaattattgttttttattaaagtagttagaataataatgagtatggaaggtagagaatagttaatttaagagtttttgtataattagaattttattgtgatttttttttttattttttaatttttttttatatttttttttttttttttatttatttatattgtaatgttttattttaaaggttttggatgtttgtgatatttttttgtaattatttaatttgtgtattttttttttatagtaattttgttatttagagataggaggtggttgatatatttttttgaagcgggaggaattaattttaattttttttggtattgatgagtatggtgttataaggaaatttttagatagtataatattataatatttattttgggaataaagattttagagtattttttgtcgttatttaggaaaattgttggattattttttttaggttgcgaagattttggagtggatttaatatttatttaaaggttaaaaattttgataaagtatattttattttttgtagtggtttgggaaatgtttagagtggattaaaatgttttatataagttatagtttttttttagttttaggttgaatttttaaatttagaggttgtatgttattaaattgttggtttttagatattagattttaaagattttttatttttaaattaatattttgtaatatattttgttatttgtttaaaatagaatttaagaatgatgtttgttatgtttagtgtattagaagttattttaaatatgatatttttataaaagttaatagttgttttattaaagggtaattatgtttagtgtgggtggttgtgttaattgtttttgaattattgtagtaatttagttaattttagggaatggtttgtagtttttttatatttatatttttttttttaattatttttattaggttgagttagttaaggatagatttatagtattttttggatgttaaaatgtttatatattttttgtaatttttgggttatttgtttttttttatgttttttttggtttgtttatttaattatttattattatgtgtatataatgtattatttatgagatttaggtaattttaggatgtaatatttttgattttaaaaggaaatgatttgaaaaattataatttttgtttgtataaagaaaataagtagtaaatttgatagtaggttttttatcgtattatttgtttttaaaaataattcgtagaaatttgagattattttttaaattaaaatttttttagttattattttataaatgaataggtttaatatttagattttttttattttgggtttaaatatgttattttgattttttttatgatatattttttaataagttaaaaatttgcggtatttatttagaattgtaaattattaaaggttagggtaatttaggttttaattttttttatattgtaagaaatagttatagattatattttttatattatttaaatttggaacggaagtggaatttagagtttattttgagaatattttttttgttttatgtgtgaggaagtagagattaagagtgattgattgatttttttgggtattgataagcggttggaagtaaagtttaaatttaggtttttaattttatttattgtgtttttttgaaaaaaggaattttatgagtttagaggtttgtttttttttaaggattggagtaaataaagagattagtttttgtttttaggttataagatttattaagatagggattatttggttttgtttgtttttgaatttttagattgtaatatagtttttggtatataatggtaaattatgtgttgttaattaatatttataaaataaaattatgaatgttagagtttttatagaaagtatattttttgggtaaaatgggaaatgattagttaagtttatgatttatataagtattagaatatttattaagataaataagtatttagtgtttaagattgggatgaaattttagaggattgaaataaaataagttagtatgaatttatgtattagatatgagttgggttaagtgatttttgagaatttttttagaatttagattttatgatttataagtaaaggtaatgtatattttggttttggttttttttattttttgtatttgttttttggggaattagtaattatgatttagatggtatgttaattagaggaagagttttgttttttttgagtgtttaattgtgggagagggaaatattgttttaggaagattagttaaaattttttattaggtttgaaattttgaaaattatttgtaaaaaatgtttttaatttaattaaataaattaaaataggagaaaataatgtttatagttttttttgatgttttagtggagtttaaggtagtatggtttagagaggaataaatataaatttttttaaaatttgaagaaagattttgagttagtttttatattttattggtagtgtagtgttagataattttgtattttattttttttatttgtaaaaggtgattggtgatttttattttatatgattgataaggaaattaaatgaaatttatagagagttgttaaagtattatatgaatttaaagtgttattattaggaaatataaataaagtttgtattatagtagaaaaattttttataggattgttttataatgttggaaagaaagtagaaaaaaaatttatttgaatttttaaaaagttagaatgaatattttaaaaattgttaaatgagattagaggtagggttaaagaatttatttttttttttttgtattatagtgttttaagggtattaatttttatgaaatacgtgtattttttttaaaagatatttgttaaagtagtagttttatattttaaagtaaaagaggaaagatgttatatttttgaaattataattatttttaagttaaaaaggggaaaaatttttttgttgaaaaatttaatttttttttaagatttttatttttatagtatttaatgatggtaagtttttattagatgttaatgtttatttttattgttaagtagtacgtaatgtttttgatatagattatggtatgtaaatttaagagatttattgtttgttaaatttttattagaaaatatatatagagatatatacgtttatatatatatatatatagatatatatatatatatatatatatatatagtagtagtagattagtagagaaagatattagttaaagaaagataatttgagatatttttgaggtagtagttgtaaaattaaaataagtaatttattaaattatttatagagtgaaaagaaagttgtaaaaatagatatttttttggtaagttagtgttttttagaataaatttagtttttagtagagtttttaaatttgatgatattagtttatatttattagagttatttaagtggttagattagtttgtttaattaaaattaaagagtagttttattggtttttgagagaagtatatttaataaaaaatatgtttagttagatattattttaattgatagattgtaagtaatatgatcgagtgaatgttatttgagtaagtttgagtttggttttaaaattatagaattataaaataaaaattttttgtaagttatgttttaatgttggtttttttttatttttgttttttggttgattatttattttgtggttatttagttttttgttttttttttcgtttattgtttgattttggaatgttgttttttattaaagttttttttagaggataggttaggaaaaggaaagaaattaaatttattagtttttttttttattaagaatttagattagaaatttgatagggaaagagtttggtaaatgaaaggggaagtttatttatgttgattttagatttttaaaagttttttttttaatgtatattaatagataattgaaaaataatattttataagttaattaattatttgtttttaaaatttttatttattattttgagtatatatattagattatgttttaaaataattagtattttggtttagtgaaatgaaaatgatatgtgtaaagagaatgttataatgatattttttatttatggagtgtttgttttttagtttgtaaagtttttatatatatttttttttattttttaaaaattgttgtgttgtaggttttattattaatgatattgaaaaagttattggtaggatgtttatatttttatttgaattaatattggtatattttattgggggagttagattaagttaaaattttatatatagaaatattaatatgtaagattaaggggtataaaagtaggttaggttattgttaatttaatagtatttaggttaaaattttttttttttttttttttttttttttttttttttattattttttagttttttgattgattttaaataggataattgaaatgttttgtttttatgttgaagagttttttgtaaatatatataaatagtgaatattaggtgtattatttttaaagtgttatttatttttataatagtttaggtgaaattatgttattttataagttgagtgtgtgtgtgtgtgtgtgtgtgtgtgtgtgtagaggatgacgtgatatttttgaggtttatttaagttgttaaagattttaaggttataagatttagattgttaagtatttttttttttagagatacgaaatttataattttttcgatttaattgttaattaaattggtaagttaattaaaaggataatatttttttaacgatgtatttatttgaagttttagtaattgtattaggtagtagcgagtattcgttagtaagggatggcgcggggagagggaattttgtaatttagagtgatagatgattttttttttatttattaagttgttttaaaatgttataatatttatattttttttttggtgaattagaatttagagataagtagatagaaagaaaaaaataataatttcggtcggttgtcgtttgattggaaaaagtaagcgttgtatttttaaattttgtttttttatttttcgtttcgtatattattttttttcgtttttttcgggattttgtaataaattttttagttttgcgtttagttttgtagattcgtatttaaaatagtattatttgggaagggtgggtggcgatggtgatgcgggcgttttggagtttttttgtagtacgtttggaattgtattagattgattagaaattttttcgtttttaagtttagtttttttcgttacgtttttttgttcgttttttttttttttttttttcgcgtagatttgattgagaaaacgattggatttcggaataatttgtgttttattcgttgtaggtttgtttcgtaaattttgttttacgttttttttgtgtgtcgagtagtttattatcgttatttgattttagcgtttgttttttattttttttttttgaatttttataatattttcgtttcgtttatgaatttatttgcgtagagttgggattttttttttcgttcgttaaaatagtggttttgagtttcggaaatagattttttttacgttttttttatttttattttaagtttttgttttttaattaagaagagttgatcgggggaggagtttagaacgattaaattttggggcgaaaattgttatcgggtttggttttgtggtcggaataaaaggtttgagaagggggtgggggtgagggttataggagtgtggagagtttggtggttttcgtttaggggcgtttaagtttttgagttttttgaagagtggtaagaggataacgtagtcgcgcgtttcggtagttcgttgtttttcgggggtgtaggcgggggcgggagaggtagaatataggtttgggcggtttcgcgtcgtttttattttattcgttaagttttttatttttatttatcgttagttttttgtttattcgggtggcggcggcggtttagcgattagtcggtcgttttttatcggcgttttcggacgtaatttcgttttggtagggcggtttgcgcgtttagttgattggtggttttgtttagtcgtcgtacggagttaaaagtgtttttttttatcgtttttagtcgtttaggttttttcgttcggttcgttttttggtttttcggttcggaaaggattttttatttttaggcggaggtttttttttttttgagttatttcgattgattcggatttgggtttagtgaggtattcggttcggttggggagcggagcgcggtttcggtagtttttttttttttgagaaagcgggaattttttaagttagcgttcgaaattcgcggggagggaggatagaagggaaaaaaaaaagaaaatttagaaagaagtatttagcgaggagcgagggcgacggagaggaagagatagaatgagggagggatggaggttggaggagggggcggggtggaagaaggggggcgggaaggagggagggagggggaaagagagggagggagggatatagagagaatgaattttttttattagaagagttgaaattattttgatttatttttttgtgttggaggtttagttttatttttttttttttttttaatttttattttttttttttatcgtatattatttttatcgtttgattttaaatgttataaagttaaattttaggaattcgaatgttttgtaaaagttttataattagtaatgaatttattgtatatatatatatatatattagtaaagagaacggaaaagagggaggtgaagaggagaaaaagagagataaattttatatttgaattagatatttgtaggtttaagttaattaaatttattatattcgtaggaagattgagttttttttttttttttttttttttgttttagggtttttatttagggtaatttaaattgggtaaatattaagaaataatttttttttatgttttttttttatttttttttttttattacgcgtttttttcggaagatagtattaaaatagtttaagaattggggatgtaaggggttttcgttttggtgtttattttttttgcggtttatattatttcggtggttagattttggagataaatatttgtattttttaaagttaatttagtatattaattcggagtttgttaagagtttattttagtttatatcgttaggaagttaattttagcgagtttaatgaggggattaaattggggttcgttttttaaacgtttcgttttaaaatttgattttttttttagtttcgattttagtgtgagtcgaattttagaaaagacgttttttaagggcgatatagggttggttttatagcggggttaagaagattatttgggggtatcgttatttcggataaattcgttggttttgtttaaggtgttgaatggatttttatcgttcggattatatattcggtatagtaggaggaaaaggtttaaaaatttttaattaagtgatatttgatattgttttagacggttttttttatttttttacggtttgttacgtgcggatggttttgttaaagttattttgttaatagttgattatatgttgatgagaatttttttttttacgagaggattatttattatcggtgatatgtatttttgatttatttttttttttttaattttattttttatttatatttaaatttttagtttttattttatttttatttttattttattttttaattttaatttttaatagtattattgtttttagatggaaattaatttttttgtaaatgttaattatatgtttatatataaattatagaatatgattatatattatatatattaaggaaaagaatagaatgtaagattgttgagagataagtattagttttgaataattaatataatatatatttttttatttagttttaagtttgttttacgtagttttatatagttgtgttaaattttaaatgattttaattaaagttgtattgtgtaaaaattcgatttttttggtttgagtagttgttgttttttggcgtgtgaagtgttaggaagagtcgtgatatgttcgttgttaagtaatatgttaagattttttaattataatgtaggttttattgttatttattattgtgtttttgttgttttggagatttaagtgttttaaaatttcgtttttttaatagatgttggaaggtaatgtgttttgtttgaagttattatgtgagaagttcggttttgtttagtggatcgtttattatttggtgtgatttatgaatttaataattttttgtaatattcgtaagtttaaatttttaattattttggcgattatagaagataaagtaattggtatcgatgtcgaaaaatttatagatttacgtaaacgtttttatttcgagagatacgtttttttttgagtttttacgtgattttaatgaatgagcgaggttattaatgattgtttaattgttttgttatgtagtaggtgttttttagggttgttttttaatcgttcgttattgggttttggtattgaaagtttttagagaaagtgaggagttttagggtatttttgtaaaaaaaaaaatttagtttgtatatcgtttttttgtttattacgtaggttatatttggggtttcggcgaagttgaattcggttcgggagatttttttgtcgttaggtaagaaaattttcgttttgttaggttagggcgggaagatcgttggggaatttgttgtttattagcgtcggtagattatcgttttaataataatattagaaaagcgtagtagggagggggtggggggcggtaacggcgacgattaatttcgttgtttacgtgatcgatttattgtgattttttgggtaaaaaaaggaaattttttagaaaagttcgtgttttttttttttttttattatgattaagggtttttagtcgatgaggtcgtgagtgatgattaaatggggattggggggaggggggcgagtaagtgatttgtttttgggaatatttgtatgcgtcgaagcgcgaattagtttaataatttttttttttttttttaggtattgatgattaggcgagaggtattaaggcgagttattagttgtttataggaatttgtgtaagtcgagttttcgagcggttgagttgaatgaagttatgattgcgtttgttttaatgggttatggttttttaaatgtgagttaatagtttcggtgcgtagttaggtcggaaggcgagtcgcggagagcggagtcgcgggttaaggtagggacgggaggggaggcggtaggttgggcgtttcgttgttgttcggtgttgttttttcggagtcgtttttttattttgcgggggttgtttcgtcgtcggggtgtcggggtgagcgcggcgggagttagggttggggtggcgaatttcggagggggtttttttaggaagttttgcggttagcgttcgcgtttttttattagtggttgcgtaagttgggaagcgaagaggttacgtgttggcggaaagtaatttggaggcgaaaggatgaattttgagaagaggaaaaaaagtataatgaaataaattatttttttggagtgtttaatagagggggaggcgggagggggggcggaggggcgtcgtttttcgcgggagatgtggggacgatttcggaaatttcgggaaataggtaataattcgagttttggtaacgttttttagtttagggaggcgttaacgtaaggtatttttttattgaagttgttttttgtttatttttagttatcgttagtatagtagagtagaagaattagggatgaatgtagattagttgttatggagatgttcgtcgttttgaggagcgttagtgttttgggaagtttttagacgtattttaggtttcgtcgttttggtattgatattatgattttattcgttttgagtttttattaaggggagtttattaacggcgttataggttttggtcgtggcgttattgattgtagggatgaggtatagcgatgttgtagaagatggtggatagtttttaagttttagattatttagttttttttaatttttagtttttttattttagttaaaagtgttttgtttgaatattatttttgtttgtttatgtagaaaaattttatttatacgataggatgattagaagtaatagaatataagtatttagtggttgttttaaggtttttttttttttattttagaaatgttttttttatggaaaataagttttattttttaattatgtgtatggatttttgtttattgtagtttttattggtattgggttattattattagtagtaagtttagtgttgagtttatgtttttttagaaatgtttttaaagttaaataggtttattttaggttttagataaaatatttgtatataaaagttttttggtttttattaggagtagttttagatttgttaggtttttgga

SEQ ID NO: 173 - DNA, 68851 bp, Artificial Sequence
  Chemically-Treated DNA
tttaggagtttggtaaatttagaattatttttaatgagaattaggaagtttttgtatatagatattttatttggagtttaagataagtttgtttgattttggaaatatttttagagaagtatgaatttaatattagatttattgttaataataataatttagtattaatgggggttgtaatgaatagaggtttatgtatataattgggaagtaaaatttattttttataaggaaggtatttttgggatgggagagggaggattttgaagtagttattgaatgtttatgttttgttgtttttaattattttatcgtgtaagtaagatttttttatataagtaagtaagaatgatatttaaataaagtatttttgattggaataaagaaattggaaattggaaagggttgggtggtttgaaatttaagagttatttattattttttgtagtatcgttgtgttttatttttgtagttaatagcgttacggttagggtttgtgacgtcgttggtgggttttttttggtgggaatttagagcgagtaaaattatggtgttagtgttaaaacgacgaaatttgaaatgcgtttggggattttttagggtattagcgttttttagagcgacggatatttttataataattggtttatatttatttttggtttttttgttttgttgtgttagcgatggttgagggtaggtaaagggtagttttagtggaaagatattttgcgttagcgtttttttaggttgggggacgttgttaaagttcgagttattgtttatttttcgagattttcggagtcgtttttatatttttcgcggagagcggcgttttttcgttttttttttcgtttttttttttattagatattttaagggggtagtttgttttattgtgtttttttttttttttttaaagtttattttttcgtttttaagttatttttcgttaatacgtgattttttcgttttttagtttgcgtagttattggtggggaagcgcgggcgttaatcgtagggttttttgggagagtttttttcgaggttcgttattttagttttggttttcgtcgcgtttatttcggtatttcggcggcggggtagttttcgtaggatgaggaagcggtttcggggaagtagtatcgagtagtagcggagcgtttaatttgtcgttttttttttcgtttttgttttggttcgcggtttcgtttttcgcggttcgtttttcgatttagttgcgtatcggggttgttaatttatatttgggaagttataatttattagagtaaacgtagttataattttatttaatttagtcgttcgagagttcggtttatataggtttttgtgggtaattagtggttcgttttggtgtttttcgtttagttattagtatttaagaggaaaagggaaagttgttgggttggttcgcgtttcgacgtatgtagatgtttttaaggataagttatttattcgtttttttttttttagtttttatttgattattatttacgattttatcggttggagatttttagttatgatgggggagggggaggggtacgaatttttttaagaagttttttttttttatttagagagttatagtgagtcggttacgtaaatagcgaggttagtcgtcgtcgttgtcgttttttattttttttttgttgcgtttttttggtattattattaaagcggtagtttgtcggcgttgataagtaataagttttttagcggttttttcgttttagtttgataaggcgaaggtttttttatttggcgatagggaaatttttcgagtcgaatttagtttcgtcggagttttaggtgtgatttgcgtagtgggtaagggagcggtgtgtaggttgagtttttttttttataggggtattttgaaattttttattttttttgggaatttttagtgttaggatttagtaacgggcggttagaaggtagttttaggaaatatttgttatatagtagggtagttgggtaattattggtaatttcgtttatttattagaattacgtaagaatttaaaaggaaacgtgtttttcggagtgagggcgtttgcgtaaatttataggtttttcgatatcgatgttagttgttttgttttttgtagtcgttaaggtggttgagagtttaagtttgcggatattgtaaagggttattagatttataagttatattaagtggtgggcgatttattgagtaaagtcgaattttttatatgatgattttaaataagatatattattttttagtatttgttggggagacgagattttaagatatttgagtttttaggatagtaaaggtataatggtgagtagtaataaaatttgtattataattgaaaaattttgatatgttgtttaataacgggtatattacggttttttttagtattttatacgttaaagaatagtagttatttaggttaggggaatcgggtttttatatagtgtaattttaattggaattatttgagatttgatatagttatgtggaattgcgtggaataaatttggagttgggtgggggggtgtgtgttatattggttgtttaaggttgatgtttgttttttagtagttttgtattttatttttttttttaatgtgtatggtgtatgattatattttatgatttatatgtgggtatgtaattgatatttgtaagggggttaatttttatttaaaaataataatgttgttagaggttggggttagggggtggagtgggggtaagggtggggtaaagattgggagtttaggtgtagatggggggtggggttggggggagagaaataagttagaagtgtatattatcggtaatgggtaattttttcgtagaagaaaaggtttttattaatatgtgattaattattaataggatggttttggtaaagttattcgtacgtgataaatcgtaaggaagtggaagaaatcgtttagagtaatattaagtattatttaattagagatttttaagttttttttttttgttgtgtcgggtgtgtaattcgggcgataggagtttatttagtattttggatagagttaacggatttgttcgaggtggcggtatttttaggtagtttttttggtttcgttgtaaagttaattttgtgtcgtttttaaaaagcgttttttttgaggttcggtttatattgagatcggggttggagagagagttagattttggagcggagcgtttggaaagcgagttttagtttggtttttttattgagttcgttgaagttggttttttagcggtgtaggttggaatagatttttggtaagtttcgggttggtatattgggttaattttgggaaatgtaagtgtttatttttaggatttagttatcggggtggtgtaagtcgtaaagaaggtaagtattagggcggggattttttgtatttttaatttttgagttattttgatattgtttttcggagaggacgcgtggtggaggggaggaggtagagggagagtatgagagggggttgttttttggtatttgtttagtttgaattgttttaggtgagaattttggggtaaagggagaaagaaaaaaaagaaatttagtttttttgcggatataatgagtttagttaatttggatttgtaaatgtttgatttaaatgtaagatttattttttttttttttttttttatttttttttttttcgttttttttgttggtgtgtgtgtgtgtgtgtatagtagatttattattaattatgaagtttttgtaaaatattcgaatttttaaaatttgattttgtagtatttagaattaggcggtggaggtggtgtgcggtggggagaggaggtggaggttgggaagagggaaggaggtaaagttaaatttttaatataaaaaaatgaattaaggtaattttagtttttttagtgagaaggatttattttttttgtatttttttttttttttttttttttttttttttttttttttcgtttttttttttttatttcgtttttttttttagtttttattttttttttattttattttttttttttcgtcgttttcgtttttcgttggatgtttttttttgggttttttttttttttttttttttgtttttttttttcgcgagtttcgggcgttggtttagagggttttcgtttttttaagggaaggggagttgtcgagatcgcgtttcgttttttagtcgggtcggatgttttattgagtttaggttcgagttagtcggggtaatttagggaaaggggagttttcgtttgggagtagaaggtttttttcggatcgaagagttagagagcgggtcgggcgagggggtttgggcggttggaggcggtggagaagaatatttttagtttcgtgcggcggttggatagagttattaattagttggacgcgtagatcgttttgttagggcgaggttgcgttcggaggcgtcggtggagggcggtcggttagtcgttgagtcgtcgtcgttattcgggtgggtaggggattggcggtgggtggaggtgaggggtttggcgggtgagatagaagcggcgcggagtcgtttagatttgtgttttatttttttcgttttcgtttgtattttcgggggatagcgaattgtcggaacgcgcggttgcgttatttttttgttattttttagggagtttagggatttaggcgtttttgggcgggggttattaggttttttatatttttataatttttatttttattttttttttaggttttttgtttcggttatagagttaagttcggtggtagttttcgttttagggtttggtcgttttggatttttttttcgattagttttttttaattaaaaggtaagagtttggggtaggggtgaggggaacgtaggaaaaatttgttttcgaaatttaagattattgttttaacgaacgaaagaaagaattttaattttgcgtaggtggatttataggcgaagcgaggatattgtggaaatttagaaggaaaagataaaaaataggcgttaggattagatgacggtgataggttgttcggtatataaagggagcgtagggtagggtttacggagtaagtttgtagcgaatggggtatagattgtttcgagatttagtcgtttttttagttagatttacgcgaagggaggggaggggaggggcgggtaggggagcgtggcgggaggggttgagtttgggggcggggggatttttgattagtttgatgtaattttaagcgtgttgtaaaggaattttaaggcgttcgtattattatcgttatttattttttttagatggtgttgttttaaatacggatttgtagggttgaacgtagaattgggagatttattgtaaaatttcgggaggggcgggggggggtggtgtgcggaacggggaatggaggagtagaatttaaaggtgtaacgtttgttttttttaattaggcggtaatcggtcggaattattatttttttttttttgtttgtttgtttttggattttaatttattaagaaagaggtgtaaatattgtgatattttgaggtagtttgatggatgggaaagaaattatttgttattttaaattgtagagtttttttttttcgcgttattttttgttagcgaatattcgttgttgtttaatatagttgttagggttttaaatgaatgtatcgttaagggaatattatttttttagttgatttgttaatttagttgatagttgaatcgagaaaattgtagatttcgtgtttttgggaggaaaaatgtttaatagtttaagttttgtaattttgaggtttttaataatttaaataaattttaaaagtgttacgttattttttatatatatatatatatatatatatatatatatttaatttgtaagatgatatggttttatttaaattgttgtggaaatgaatagtattttaaaaatggtgtatttgatatttattgtttatgtgtatttataaagagttttttagtatgaaggtaagatattttaattgttttgtttggaattagttagaagattagaaggtgatggagagaagaagggaagaaagaggaaagagagagaattttaatttagatgttattaaattaatagtaatttagtttatttttatattttttggttttgtatattaatatttttgtatgtgagattttagtttggtttagtttttttaatggagtatattagtattgatttagatgagaatatgagtattttgttagtagtttttttagtgttattgatagtaagatttataatatagtaatttttggaggatagaagagaatatatataagggttttgtaaattgggaagtaggtattttataaatgggaggtattattatgatattttttttgtatatattatttttattttattgaattagagtattagttattttaaaatataatttaatgtatatgtttaaggtagtaagtggggattttaaaagtaagtgattagttggtttataaaatattattttttaattgtttattaatgtatattggaaagaaggtttttaaagatttaaaattaatataaataagtttttttttttatttgttagattttttttttattagatttttgatttaaatttttaataagaagagaagttggtgaatttagttttttttttttttttggtttgttttttaggggaagttttagtaagaaataatattttaaaattaggtagtgagcgagagagaaggtaagggattggatgattataaaatagataattagttaagaaatagaaatgagggaaaattagtattaaagtatgatttataaagggtttttattttgtaattttgtaattttgggattaggtttaaatttgtttaagtaatatttattcgattatattgtttataatttgttagttaaaatgatgtttaattgagtatattttttattaaatatattttttttaaaggttagtaaagttattttttggttttaattagataaattagtttaattatttaaataattttaatgaatatgaattgatattattagatttaaaagttttgttgaaaattaaatttattttgaaaagtattgatttgttagaaaaatatttatttttgtagttttttttttattttatggataatttaatgagttgtttattttaattttataattgttattttagaagtattttaaattatttttttttggttggtgtttttttttgttgatttgttattgttgtgtgtgtgtgtgtgtgtgtgtgtgtgtttgtgtgtgtgtgtgtatgggcgtgtgtgtttttgtgtgtgttttttagtgggaatttaataagtagtgagttttttaaatttatatgttataatttatgttaagaatattgcgtattatttagtaataaaaataaatattagtatttagtgaaagtttattattattgagtgttatggaaatagaggttttaaagaaagattaaattttttaataaaaaaattttttttttttttggtttaaaggtgattataattttaaaaatatgatatttttttttttttattttggaatgtagagttgttgttttaataagtgttttttgagaaagatatacgtgttttataaagattaatatttttaaaatattatggtgtagagagggaaggatgaattttttaattttgtttttaattttatttggtaatttttggagtatttattttgattttttaaaaatttaggtggattttttttttgttttttttttaatattataaaataattttataagagatttttttgttatagtgtagattttatttgtattttttagtaataatattttagatttatatagtattttgatagttttttataggttttatttgatttttttattagttatgtaaggtaggaattattaattattttttatagatgaggaaagtaaggtgtagaattatttaatattatattgttagtaagatgtaaagattaatttagagtttttttttaaattttaaggaaatttgtgtttgtttttttttagattatgttgttttaaattttattagggtattagagggagttgtaggtattatttttttttattttgatttatttaattaaattaaaaatattttttataaatagtttttaaaattttaggtttaatggaaagttttaattagtttttttaagatagtattttttttttttatagttagatatttaaagaaagtaggattttttttttagttgatatattatttaagttatagttgttaattttttaaaaaataaatataaagaataagaagaattaaagttaagatgtatattatttttatttgtgaattatagaatttgggttttgggaaggtttttagaggttatttagtttagtttatatttgatatatgaatttatgttggtttgttttgttttaattttttggaattttattttagttttggatattgggtatttgtttattttggtagatgttttgatatttatgtggattatgagtttggttgattattttttattttgtttaaaaggtatattttttatagagattttagtatttataattttattttgtaagtattaattggtaatatataatttgttattatgtgttaggaattgtattataatttggagatttaagaataagtaagattaaatggtttttattttggtggattttgtggtttagagataaagattggtttttttatttgttttaatttttagaaggggatagatttttggatttataagatttttttttttaagagaatatagtgaataagattaaaagtttgagtttaggttttatttttaatcgtttgttagtatttaaaaaagttaattagttatttttgatttttgtttttttatatataaaataaaagagatgtttttagaataaattttaaattttattttcgttttaagtttgagtgatataaaagatatagtttataattattttttgtagtgtaggggaaattaaggtttaagttattttaatttttggtgatttataattttgggtgggtatcgtaaatttttaatttgttaagaagtatattatgaaaaaaattaaagtaatatatttgaatttagaatagaaggaatttaggtgttgaatttgtttatttatggaatgatggttaggaaagttttaatttagagaatgattttaaatttttgcggattatttttaaaagtaggtggtgcgatggaagatttgttattaaatttattgtttattttttttgtgtaagtagaagttataattttttaggttatttttttttaaaattaaaaatattatattttgaaattgtttgggttttatgaataatgtattatatatatatgataatagataattagatggataagttaaaagaaatatgaaaggaagtaggtagtttaaggattgtagaaggtgtgtgggtattttgatatttaggaaatgttatagatttgtttttaattaatttagtttggtggagataattaagaaaaaaaatgtgggtgtagaaagattgtaagttattttttgggattggttagattgttgtagtagtttaaaaataattggtatagttatttatattagatatgattgttttttgatgaggtagttattgatttttataaagatgttatatttaaaataatttttgatgtattaggtataatagatattatttttgaattttattttagataaatggtaaaatgtattataaagtattaatttaaaaataaaaaatttttaaagtttagtgtttaaaaattagtagtttagtaatatgtaatttttggatttaagaatttagtttgaagttgggagaaagttgtagtttgtataggatattttgatttattttgggtattttttagattattataggaagtaaaatgtattttgttaaagtttttaatttttgagtgaatgttaaatttattttaaaattttcgtaatttgggaaaggtgatttaataatttttttaaatagcggtagaaaatgttttgagatttttgtttttagagtgaatgttataatgttatgttatttagaaatttttttgtagtattatgtttattagtattaaaaggagttagaattgatttttttcgttttaaggaaatatattaattattttttgtttttaagtaataaggttattgtggggaaaaaatatataaattaggtgattgtagaaaggtgttataaatatttaaagtttttgggatagggtattgtagtgtgagtgaatagagaaaagaaagagaatgtgggaaaaaattgagaaataaaaagggaagttatagtggagttttaattatataggggtttttgaattgattgttttttattttttatgtttattgttgttttggttattttagtaggaaataatgattttttttgtttttatttttttttttcgttaaggattttttatttgttaataatttttataattaatgtttaagaattgttttgatgtttagtgtggtggttaacgtttgtaattttaatattttgggaggtcgaggtgagtggattatttgaggttaggagttttagattagtttggttaatatggtaaaattttgtttttattaaaaatataaaaaattagtggtttatgtttgtaattttagttatttgggaggttgaggtaggagattaatttgaattatggagatagaggttgtagtaagtcgagattatgttattgtattttagtttggtaaaaaaaaaaaaaaaaaaaagaaagaaagaaagaaagaattgtttattgtaatgatttttatgttatggatttaatttttttggtagtttggtaaagtttatgtaaattttttttataaaaatgtttaaatggggttaggcgcgacggtttatatttgtaattttagtattttgggaggttaaggcgggtggattatttgaggttaggagttttagattagtttggttaatatggtaaaattttgtttttattaaaaaaaaaaaattagttgggcgtggtggtatgtatttttaattttagttatttggaaggttgaggtacgagaattatttgaatttgggaggtggaggttgtagtgagtcgagattagttattgtattttagtttggatgatatagtgagattttgttttaaaaaaaaaaaaaaattttaagtgaatgaaataaatgtataagattataaaggaagttagtggtattgatgtatagttataaaaatatttaaaataatatattgtgtgatatagtaatatatatgttttttaatatattaaataagatttaatagtaaggtaaatattataattttgaaataatgataagtattaatgtattttgaaatatttataaaattgacgtgatatgaaggtgtttgtgatgtatattggtgagaaagtatgtaagtattattgtgtaatattttttatatatatttaataatagaatatttgagaagtatttattaatatagtatagatttagaaatattaatttagtaaatgttaatattagttattgttgttttttttttggtaaaaggaaattagtattgggagaaaatttttaaaatttatatttgttattagataagttgttaagtggggaaaggattaaatattgagaaggttagggtatggtaagtatgtttttattgattgagtttgttattattttaacgtttatttttagtattattagtataattttattattttagtaatttattattttattgaaaaagataaaaagtttagattttggttattaatttagtattgtttaagatatttgttttgattttattaatttaagagattattgaaattttttttgtttgttattattatattatgggaaattataatgatgtgggatgatatttattttgtatttatttagtgttgttatttgttttgtatttggtatatattatttaatttttaaagtaatttttagagatagattaagaaaattagagtttagagaatttaagtaatttgtttaaattaatatagaaaatttgaagtggagaagttaaattttaaatttaaagttttttggttttaaagtttattatgaagttgtgtttttttattttatagttattatttagatttaatttgggttttttattattagatggtttatatatatatttttttataagattttgattataattttttgagatggttatgagttttataatttatttttaggagtgttattttagaattattttgatttttgttaatcgatgagagatttttaaatagttaattgttatttattttttttgaagtttagtttttataattataaaatggaaatagtattataatgttttgttaggattatatatattaataataaaatttaattttgttgagtttattatggtgagtattttgtatttttttagtttattgaatttttataataatttttttaggttaagacgattattttttttttaaagataaggaaattgaggtattagtaattaattaattattttaaattagtagagttaataagtggtaaagttgggtttaaatttaggtttgtttaatgttaaagttttttttttaattattaatttgtaaattattatttaattttagtttttattattataattattattatatttaaaatattattaagatatagaatgatttagatataagtatatagttattgaagagattagaatttgaaattttttatttgtatgtttttttttttattttagtttattaatttaatggatgatgtttgattttttttttaatttgtttagggtagttttaagttagttgatttttgagagttattgagtaagaaatgttataaattgtttggattaggatttagtatgtttagaagttattttataagtttgtttttgcgaattgttattggttataatattgtagatgttgtgatgaggaatattttttttaaagatatatagtggatgataaatttttaaagttaatatgttgtttatagatatggagaagaagaggatggataagtatagtttaaaacgtaattataaggtttatagtttttgttggggattagaatgtttattggttttttttgtgtaatttaatgttttttttttaaaggatttattttaaatttggaatttttttgaaaatagtattttatttgggagtatgttaggaattggtgtttgggttttttgtgtttttgtattaatttagaattttggatattagttttagaaattaagttgggatatattttgggtaagggagtagtatatttatttgggtatttttttgatatatttattttatttattttttttttagagagtattttttagaaagatgtggttttaaatgagggattggatgtatattggtatgttttagtatataagttagtggtttttgtagagttgttaaaggtatataagtaattaaagatgcggaagtttatgaagagattttattttatttttattttgatttatttagggaaggattttatgaatatataatggatttgatacgttttagagttttgaaagtagtttagtaaaaaaggataattttgaaggatattttgatgtatgaaaaagtttatttaaagttttgttagagataattaagtaatatgatggttggtagattgtaagtttttattttggtttaggaattgtatattatttggtaaattaaatttgtcgtttaaatttagatagaaaaagtattttataaatgatttagtttattgattttttttatgtattgaaattatttaaattattttttttttttgagataaggtttgaatgtgttgttagttttagtaaatttagtttgtagtttattgattttatttgattgattgggtaattgaggtgtatagtggtagattttttaatttatttaataaataattatatggtttttacgatatttatttgaataattttgggttagtgaagttgtttgtttaggttatatggttagaaattgatagttttaaattaggattaaagtttttttgattattatttgggttttaaaataatattatatgataaagatattttttttgttttttaatagttatattaaaaggaaataatggatagtttgtgtaagattttagttattttaatgtttaaaataaaattaaaaatagattattattaaaatataagtataataatattttaatagtattttaattagatattattaattttaaaatggtaggataaaattaattatattttatattttttaaatattttatagttattttatgattattgagatattagttaaaatttgaaattttaagtttttattgatttttatattattatttattttagagttattttatttggtttttttatttgagattggataatagttttatttgatttttagcgataaaattttttttatttttgattttttattttaagaaaataatagttattaatatattttttttaaagtgattaagaaataaaagaggaattttagttaggcgcggtggtttatgtttgtaattttagttttttgggaggttgaggcgggtggattatttgaggttaggagttcgagattagtttggttaatatggtgaaatttcgtttttattaaaatttaaaaaatgagttaagtgtggtggcgtatgtttgtaattttagttatttgggaggttgaggtaggagaattgtttgaatttaggaggtagaggttgtagtgagttaagattgcgttattgtattttagtttgggtgatagagtgagattttgtattaaaaaaaaaaaaaaaaaaaaagaggaattttaaaattaattatatttattaatatttttatttttaaaacgttagaaaatgtttgtttatttaaaatttttatttttaaaattattttatattttaattaaatattttttggagtaatttttttgttttttatataatatttatatatataattttgtttttgtgattaatttttattattatttttttaaaattgtgtttttataaatattagttaattaagagtaaatttgatgttttataaattttttttagaaatagagagtaaaattatataaataataatatgaatttttaaaagtataataataaaaaaaaattagaaaaaaattaatttaggaaatagttaagaatatgttaaatttgtatatatttttgagataaattggtattatgtagattagtatgatttttttttatggaatttaatttatttttatttattttgttttaattagtttttgtgtgcggataagatggaaggtaatggaaatttggtttgtaaagtagttttaatatgatttatatttataatttggttataatgttataagaatattatgtgggaatagtagtttaaattagtatttagtatgaatataaagggataaataatgtaaagttaatttaagttgtttatatttggaatttatttaaattaaaaaggttagtggatggttatatgtttggtttattttttttaaggtttttaggaaaatatgtttatgaaataaaagatttttaatattaaatattttattgtatttgggggatatatgaaatttggtaataaaggaagtgttggtttttatttttttaatttagtatggaaattattttgaggaaaattgattatggttttagtttgtgttttagaaatatatttagtttgaattatggcgtcgatatttgatttttaaaattggatatttagtcgtatagtattttattttttatatatattattttttatttttaggttatgattattgtttaagtagtaaaaaaagaagtaattttttagagtatatatatggtagtgataattaattaaataaaaaataattataggggttggaatttaaattaatggttgtatttttattaatttattttttattttattttatttttttgtttttaatttttatgaaatattatatttgttttatttttttgtattagtattagttttttttatatttaattagatttataattttttggtgttttttattggttgattaaggttttagaagtatttatttatagtaaatatttgtagtagtttttttttggttataaagtttttggataattttttaaggcgatattatgaagaggaagtaaatatttttttttgttattttatttttttttagagtgttaattttattttatatttggtttaatgtttttttaggttaattggattgattttatagatattatagaatattttttgagtaatgggaataatatttttgttgattttatgatttggttttattgggttgttaggttataatggagatatatttgatgaatttatgaagatttgattttaggtattatgtaggttagtataatttttttttattgaatttaatttagttttatttattttattttaattggattttgtgtgtagattaaatgaaaagaaatggtttaatttaggtgaaaggtaaagttttaaaagtagtgtagtattttatagattttatttttgagagaaattatattagtatataataagtatttgagaatatgaaagtataaatttaatttaaatgtgaaaggtttataatttgggattttaaatggagtatagaaaagttattgttttttaaataattttgttgagggggaaaatagtgaaagttaaatgttttatttaagagttgttttttttgaaaataatgttttatttaaaagttaaggatagaagacgtagttttgttatgaaggtttatttttttattaaataattattattttgtttttaagttgtaaagggaagatttgttaatttgattgaattttttttttagttttttttaatagttgtgtttagataatttatgatttttgtgttttttgagttttggataattttatatatatgtttggtttggggttttatatttttagaaaaatatagaaattttggaggaggtttagggtagattaagggaaatgattaatgggttgaaagttggagtttatgaagaaaggttgtgagatttgattttttgttacgagaaaagtttgagtggtgatttaataatataaggaggttagtaagtagttgttttttatttttattaaggttgaatgaaatgaaataagatataaattgtaataggaataaaaatgtattataagtgaggatttttaagtattagtattgttggattttagatagttttttaaaagaaggatgtgtagtttatttttttggtttgtaatgataggtttataaatagtgagaaagatgagataattttttaagattttttttggatttattttttataggtttatttattatatttagaaaaattatttgttttaaataaaaattatttgatttttttttttttattttatttatttttttttttttgtttattttttgtaaaatattgttaatcgaaataattggggattgattaatcgtggtgggttttttttcgtttttaagtgttattttagttttgggagtaagttttttgtttattattattattttttggttattaggggtatgtttattattatttttttatatattaaatttacggtaagggaaaataaaataaaataaaattttttagatttaataaatttgtaagtgttattatggattaaaatataatttttatgttttagaatatgagtatgtaaagggttaaaatgtattttatgtatttgtttgtattagtttatagaatagttttttgatagatagtagatatttagtaattttttattaattgaatgattgtaattatgaagtgaaaggtaattaaagttgagaaagttaggagtttcggatgtttttaaatgattttgtatgttagattaatttaaagtttaatttattttttataattatgtattattaaggattttatttttattatgtttgtgttatttggaggtagaaagagggttagttgtatattttgtttaagtttttggttaaaaagattattaaagagtgttttgtagatttatgtattagaattatatgaaagtaggttaaatttttagtgtgtgtttttaaaataagattttaggaagtttatttatttttttttaaattatttttgtatattttttttttttattttttttatgaagaatttaaaatttggttgtagaaaattttttattttaaatattatatagtttaaataggtgagttttaaaaataagttaatgtttattttttatttgatttaatgttttgaaattttttggtttaaatttgttaattttttttatggttttttttttagtaaaattaattaatattatagttatttattattgttagttttaatttatgtttataattttatattttttttgattacgtttatagaattattataataagtaaattaaatttattttttattattaatttttaaatgtttttagtataaatttggtaatttggagggttataagttgatattttttatatgtttgggggtttagttttaatagttttttaatggtttttatgtcgttttttttgatttaattaaatattatttttagatgggattagtttttgatttttttgttttatttttttagttttggtttttttaaaagttttttgttgtggttttttttttttgtttgttattaatggttatgtttggttatataatttttgtaataggtgttgattaatttgaatatattttggtatggtattgagttatttttatggtttataaaaagtttagtgagaacgtaatattttatgaatagggaaattattttttttttaaggttttttttaggataggttttatataagaattttaaggattgcgagtgatatagtttaatattggattaggttttttaaattatttaggatgagtttgaaaatatttgtgttattttgtttaatagtagagttttttgtttattaagtattttttttatgttaattacggaaagttttaatagtttttttaggttaatttatttgatgttagattagataatttatttttttttttttgtaaggaatattgaaggtaggagtaattaggaagtttaaataaatataaatataaaatgtttatagtgatagaattgattttagttaattaaaattattaatagaaaaaatatgttaatgttaagtttattatttttgtttttatttgagtaatgaggattagtttatatttttcgataagaatagatgggaatttaaatttttttttgatttttgttttttttggaatattgggttaggattatattagaatataattaaaaagaaataaagatttagacgaatttataattaatttttaagttttataaaagtgaaataggtagtattatttttttaagttgtgaaatttttttttattttagtaatagagaaaatgtttagattataaatttggaaattttgtttttaatatattaattatgttagaggttaatttttaagaagaagagaaatgtatgttttatatttttagtattatttttgtttataatagggaaataattttgtaaaatgtttgattttagatttttaaaattatttttatatgttatttgaattaagtaaataaaaaataatatttagaattttatgtaaggtattggtataattttgtttattttggttttattgtttttgaatgtaagatgtatttttaaggtaaataagtatatgttttaagttggtcgtatatagtattggtaatgttataattataaattagaaagtttggaaatgtttataagtgttaagaggtgtgatttattatggttatttgaattggtatttgatttttttttttttttaaatatttttgatatttttgatttttttgttttttttttagtaaaattgtattatatattggaaagcgaagatatatatatttatttatataatgttaagggagagtaggaataagaagattggttatagatttatttaattagagtttgggaaatgagaatatttttttttttagtagaaatgttgacgtgttaatgtgaatttagtagaaaaaagatttgttataatttttaagtgagtagtttttagaatgttagtttagatttttggtattaatttgttaggtatttttttaggaaggaaataaattataattgagtttaaaaatttgagggtagaatttatttttaagtaaatgtgaagtattagtttgaagttaataaagttaaagtttggagtagggtttttttagttttttataatgtagtataagtattttttttaaatgtataatattagttttttaaattgtattgtgttattaaaagaaattgtgtttgtatttattttataatttgggaattaacgtagagggtttgtggggtagcggtatttagttttatgttttttgttttttattgttttttggttagtttgcgtattttatatatattaaatattttataataaattttgttatttgtgttgtagggtagtttgtattggttatgtgttttgttaagttgatagaggtgtaaagttaaatgtgtgatattcgaagaatatgtatatatttgaataatttgattatttagtttaataatttgtaaaggcgttttgaatgattatatattttgataatatttttaaggaatagatagttttatttagggggtgggggagatggaagtagggttatttttagtaggaatttttgagtttattgaagttttgtttttggtattttattgtgtgaacgtgggtaaattattttttggtagaggatcggattttttttttataaaacgggtaaataatttttgttattagtttttagaagttttaaaatagttaatgttagtgaatttattttgttaattgtaaatttttaggtaaattgaattgagtatgtaataatattatatatttagtttaatagtatatttttggtaattataagagggtttaggaaaggaaattgtttataaatttttttttttagtaaaattaatgttggagtttttagggaaatttttatagtaatagttttcgtaattattaggttaaatttttttgagattatagaaaaacgtatatatatagaaagttgtttgtagaatttgggtgtgggtttggtgggagatttttttgatatttagtgttgtatttttaagagagtgttttttaaagtgtgattttagattgtttgtattcgaattgtttgtggtatttattaaaattataatttttgggttttgttttatttttattaaattataattttaggaggagggatttttattttaatatttatttaggtgatttttatgtttcgaggaggtttagggattttaagttaagtacggtattgttgttttattttttattttaaattttaaggtttgtataaattggttgaattaatgagaagaaaatttagttttaaagtagaaatataggtagacggttgatagagtttattaaatggataattgaaaatgttttttggattttagttatataagttttttttaagggttttggttataggtaaatgagaattcgaaaggttatttgtttttttgttgcgggtagtggtgggggtggagggcgggggaggattaattgagttagttttgtttttattttcgaattatttatttttattttggttaaagtagaagattttttatttattttggttgttttggttcgttattaaaagggttagtttatacgtgtgtttgttggggttggaagtgaaaatatttgtaaaagtatgtaatgttttggaacggaatttttttaataaaagatgtattattttaaatgcgttgaattttgattttggtaattcgtgtattagagtgtttatttcgaggtagcggaggtattatatgatagcgtacgttaaggtatcgtggagttttttcgtggatttttatttatttttttatttatcgcggagagggttgttttcgttgtcgtttttttcggcgaattagtatgaaatttttttgtttttgtcgagattaaatggagtttttcgttgatggggtgcgagtattattttcgttatgtaatttttattattaataatttaatttttttgttgtagaatagaaggagtatatatcgggtattaaagattcgcgtttttttttttttttaattaagcgaagggaacgtgaaaaaataatagagtgtgggagttttggggtcgaagtttttttcggagtagttgttttgatggttattttgataagtagtgattgaaaaggtgggtttgtttttttttttttttttttcgtttttttgtttggtcggttagaaagcgtgtggttttagcgaggtttgttattgtttgggttttttggttggaataagtaatttggtgtaacgttatttgggggcgtttattaataaaaaatgttgttattattttgattgaatttttattaggtaaattttagagaggttagtgcgcgaattttgtttaagtcggcgtgtttaaggtagtagagtaaattaatagtttttatgttttgtgcgattttattgtgtgttcgcgttcgtaagtttcgtagtgtaggaaggtgcgggaaggtgtgtttgtggttcgggaaacgtacgtttttttttagagaatttgggtgttgggatggggaggaaggggagagttgaaagttaggggagcgagatttcggggcgtgcgatttttattcgttttttttcgttttagcgtttatagtcggggtttttgtagagggcgcgggacgcggggtttttcggggttgaggttggggttggaatatttttcgaagtcgcgggcgttttgtttaaggcgttttaggagggcgtaggattcgtagggcgatgtcgcggggttttaggggaggaggtgaggataggtttcgggggagcggggagtttcgggcgtttttcggtttttcgcgcgaggaaaagacgcggcgttttttttaagcggtcgtttcgaacgggtatcggtagcgcgggcgagcggggagcggggggcggggggcgggggggggggggcggcgtcgtttgattaatcgaagtttaatcgaagagttaaataatgtttgattcgggcgtaaggcgtagtttggagtttcgggttttcgacgttgtcgtcgtcgcgttcgggcgtattcgttcgttcgttgtttcgcgtatttcgtagcgtttcgggttttcgggtcggatagaggagttagttcggtgcgtttttttattttttgttcggggggttttaatgagatatttatcgttgttgtggggtcggcggggagtagtatcgcgacggggatcggggttgggcgttggagttagaatcggaattacgatgtgatttcgtcgtcggggattcgtgaggtttgtgtggatttcgaggtaggtaagcgttgggaatggggtttggtgtaggagttgttcgttcgcgggagagagttgattgggggattttttattttaaagttgtgggacgaggttagttttttttttttttttttttcggtagaagggacgatttggagttatttttggggagtttttttttttattttataatttagaaggttagtcggtattattagggaaaaagggattcggggaagttacgaagtagaggagggaaggtttggaggagatttagagttgcgtgatgggagtaaagacggcgattcggggatttttcgtagtttttttttagtttaggagtagtcgagagagatttagggggttagagttgtcgagggttttgattgaggggagggtgttggggttaggttaggaatttttttagggggtgggtggttttcgcgtcgatttgcggggggagtgggagggaagtttgcgtttttagttcgtatttttttttcggagttgtatacggttatttgttttttaggaattgagattgaagtggatttataagttcgaagttaatgtagtttggaaaatttgggaggcggaatttttatcgttgggaattgaaagggtttgcgatattttcgggtaggtcgaatttatatttttatttattttgcgttttttttttgaagcgttttttagggaagttaagagttttgattttcggggagtggttgggatgtacgtgggggatttttgattcgggttagtttttggggatgtagagtcgggaagaggaatgggtgagtgagttatttttggaaagaaatagttgaggattgggggttttgtgtttgacgggtaagaagaaggggagattatagattaggggtatttttaaggaagaagtttcggggttgcgagggtgaattggaggatgtagtgtttgtgtgttgggggtagagcggggatgagggatcggggtggaggggaggcgaggaggaggaggggatttagagaacgaagttagggaaggtagagggtgttttttgtcggttatgttgttaagagtagttattgggggcgggaggttgggggtggggaagtggtaaaggaaggttttgcgggattttttagagagttggtaggagggatttgttgaatggtgttgttgattttagttcggtggggcgtgcgattcgtcgtcggtggattttgatttttcgtttttgtttggtttttatgtaagtttttttcgcgttgggggagttttgataagtttcgattggcggtgtgttagggttttttggattttattttagggttttttagttattttgtatttattttttaatgttagtagtaattaaagaatatttttcgataagtacgtaggaatgtttttggttagaagtaaagaaaggtatatttttgagtgtttattaatttttttagtaattttttaaagtaaagtaatatgtaattgggaacgttgattttttaattgtatataaaaggcgatatgatattaaatgagatttttttttattgatttaatattttgtaaaattttttttttttttttattattatggaaaaatttatttttatatgagtttgttgtaaggttaaaagttattttggttttataatttgatatgtttttatattttaatttattgaggtataattatagatttaatttgtatgaacgtgtgtgtttttaatgtttattttatgtaatataatttttaggttggagatttttgatgttatggtatgtagcgttttaaggtattatatataataggtaatatagtatgttgaaattatattataaagttttgattttgggaatagtattttttaaaaataattattaaatttttgtttttgttttttgattttgtaaatgttttgtttaagatttttttttttttttttttttttttttttttgggaaatttatttttgggttagtaggagaggtaaaaaaaaggaaagagatatttgttgaaatgtaattataatttttattggaatttaaaatatgttggttattattattggaattttagggttataaagtcgttgtttttttttttttttattttattttgtaaaatgtgataaatgttggtaaatatagattagtagtaagtattatgatattaaaagtattatgtatgtggaattattttaagttattatagaatattttttatttataaatgatataagtagaaagaaatgatttttagataaataaggtttacgtatatgttttgaagtattagaatattgtagatatttttagatattatattttttaaagtaaaataatagtaattttttatatatttttggagttttttatagtttatttagagttgagttagtagttggaagttttttttattttaaggtgatattttaaaattatttaatatgtatagtaggttaatattggtgtatttagaaaatgaagtatttaggaaatttgttttagtgtttttttaatgtgtgtaatttttatttgtaaattaatggaattaagaaagttattatttgtttaaaatgtagttattattttaaatgatttatttatattatgtgagttaattgtttttattttattaatggttaaggagggaagggaggttttggggtattttttgtttattttgatttattaggagggaaaattttgtaaaaaaagaaatgtaaatttttaaaattttggtttaaagttcgtgggttttttgtttaaaaggggcgttatgaaaatgtaagttatttttttttttttggaatttttaagagttttagttttttaatagttaaaatgtagatgattgatattattttttatatgaatagtattggtttgtagtttagtacgtatagtgagttgggtacgtttatttgatagtatagtagagaatttgtttatattttttttatatttattttttaaaatttggggtgttttttttttttttttttttttttttttttttgtgtgtgtgtgtgtgtgtgtgcgtgtacgtgcgcgtgtgtgtagagggggagagagagagagagagaattgtgaattgtgaaatataatatagttagtagttttgggttttaatcgtagatttatttttaaggaaatttatagaatggaaaggttatgtttaagtagtttattaatattttgagatgtaggaaattaatttcggagtatagaagaataattttagattttttgaataaaaatagatagtatagagagtggatgatagttaaattttgaatattttttgagaagaaaggtatttttattttaggtgtttataatatggatttgattttagtgattaaaatattaatttttaatttgtatttttttgtgtggaagagtttaatttgtgtgaggggtttcgtttatttaataaaagtgaatatgttttttttatagggtaattgttaatttgttttaatttgtttttaaataattgttatagagtatttagtttttattaattgtaaaattgttgtttaattgaaggatttttagttatttagtgtagttatttagttattggtaggttttgtgattttaaattgtgaattgtattttaaagaggaatcgaggagagaattttgtggaattttaggttttaagtgttggttgttgtttaatggaagaggaaattatttgaataagaatcgtattaagttgtgttgtgataaattttttttattaggatgaataatatgtatagatgagttttaaaagtgaatgagtaaatttattggttatattttgtatttatttattttgtttagtatggagtaatgttaggtaataaatgatgttggtaaatgaaattcgtatgttatttgtatgtggtatttaaatttaggaaatatagagtggttttggtatttgtaggtttagttatgtgtgttttaaacgtttttttaaatttttatttaaggtatagaattatttaattttaaataattttatatttaagtgttttattggatttttagaatatttatattgtaaagatttagaaaggttatgaatttaattattgattatatggaattattattgatggtagatgtaaaatggagtttattaatgtattgatattgaaaattttttgtaggggagaggagggggagtggtaaatgtgtgtgttttttaagtggaataggaaggtatttttttttttgtagaaaaatttgagtatttggttagataagtgtggaagtttttatttaaattaagtatttaagtttaagtagaagttttagggtatttatttttttgatgagataaattttattaaatatattagatgttaagaagtggtttattgttttgatgttttatttatagattgatgtttgaggatgggttgtattaagtgagttagggggttgagtgtgggataggagaacgattggaaggaagtaaagtaaatttataagttttagtgatagttataataaagtaaaagtttatttttagagagtttagagagtaaggaacgttatatagttttttttaaaggtttatttgaaagaattttttattggttgttatggtagtaatgttttgattttgaaattttttagaatttagtagtttttaaatatgtttttattttggtttttttggtttgacggaaattttatgacgattttttgtgtttttgatatgtttttgtatttttggagagaggaggttaggtaagggaggattttttaaaattaagatagtatagtaaggaaatataaaattatatgataaaaaattattgaattttaaattgatttattgaaataaaatttagaaggtaatttgtcgtttaattataattagtttgtataaaattaaaatttataaaatgggaatttaaagaaaataaacgggtagttttaagtaatttaagtaatttattaaaaattgaagtaatagtgttatttagagaataaaattattagttttattagttaaatggtttatttttatatgaattatttttttaacgttatagttattaggatttttttgttattatatttagattttgtgagtgtgtatgggggtgggggttgtatgtggaattatagatgaaattttaaaataagtagatttataatttgatatatgtattaaatttttttaacgttgtaatgtagttaaatgtagaatagtatgttaggaattaacggttagtattttttttaatatttattatttttatggatatgtattaaatcgaattattgagtataaaggttttgattttatttatttgttataggtaatttattatattttttgagatataataatattaaataatttgagtagagagatttttaagaatgttttcgatttatgatttatttttaattttaatgtatttagaagatgtgagaataaaataaagttaaatataagtaagattttaaatatatatataaaaaataaataaataagaaaaaggaagaaaattataaggattgttttaattttagaatagatgaaggtatatatttgagttagtattaaaaaaaaaaaaaaaaaaagttatggaattaggaattaataattataaattgatttaaaatttttggatgataaaaatttatatttagtttatttttgtatgcgtttataatagtatttaaaatagttttggggaggtattttgataaatgttgttgaatgtattaatagattgattaatggttgttttagattattattagtgatgtagatagaaattttatgaaaatggtttgttttgttggaagaaaggtagaaattggaggaaaaggtttaataatatttttttttagtatttattataaaagttatttagttggtttagttttataattttttatgtgtaatttgatttatttatgaaattgtgaatatatgaaatgttaaagttgatttagatagtaattataagtttgtggatttttttttaaatgtttttaaatttttaaatgttagtggagatgttagcgattgtgttttagggagtagaatatagtatattttaaatttgtgttaatttttggtaagtagagaaaaaattgtatgataattaaagaaagttatattgtttgtgttttgtgttatttatggaagtaattaggtgtagaaaatttttttttttagaaaaaaaaaattattaaaataaaggtgcgtgtgtgtgtatgtatatatatttaaagggagagagggagaaggaaatttattaaataaaatttttgttatatgggatttagtttaattagttttggttttggagttgttattattagtagttttattttgtgattttttttttttgtttttatgtgtttttgaaaattgaaattatgtttaaattaaaataagtttttttgtttttttatatgtttatttattttttgaatgtgtttttaaatatagataaattttttttatattatgtagaatttgaaggtcgagaaatttgtagttattttgttggagagagatgtttggcggagttttaggttatatttttaggttaaattttcgaaggtattttttttatgtaatattgggaaaatatatttagtatcgatatgttggttgataatgtgtttgaaggtatagacgatatgtttattatatgaaatataaagttagtagatattgtagatattttgttgaatgatagaatttggattatttatatttatttaaatgtaaaatattatgattaagtataaaaaaattaatttaggagagaatagagagttgcgggtacggttttaggggatgatttattagtagattgtagaaaggaagtttgaatgttttaaattaattgtaagtttagtataagttagtggtgtgataagaggttgttattatagttattgaaattttgggttgtattgttagaaatataatattgaaatggagaagttaataattttttattttttaaatagattgtatttagaatattattattagtttaaggaaatgaaataagttgttttaggtatattatcgataaattagtgtatatttaaattattgtgattaggatgtatagggaatttgaaagtattgtatgtgagtaatggttgaggggatttggaatgtatgatttagggataagaaaatttaggttggaatggtaagtggtttttgaatgttgggttgagaagaattttaaaattgtgaaggattagtaaaaataatatttagattgttaatgtttattgtggttgggagattagagtgttaatatgtgtgatgtatttttgatatttttattttgaggatgggttttaaagatttgacgaattgttataagtgtaatttgtgttgttttagatagtagttttagaattaatgatgtaaatttagatattttatatggtagttagaaaattttttattaatttaatttagtaaatattgaatgtttattgtatatagagtattttattagaggaatatataataaagaaaaaagaggtttggtgtggtggtttatgtttgtaattttagtattttgggaggttgaggtgggaggattatttgagtttaggagattattacgagtttggataatatagtaagattttatttttataaaagataaaaaaaattatttaagtttggtgataggtatttgtagttttagttatttgggaggttgaggtagtaggatcgtttgagtttaggaggttggggttgtagtgagtcgtgattgttttattgttttttagtttgggtgatagagtgagatttcgttggagggaaggaagggaaggaaggaagaaaggtaggaaggttgaaatgaaatttttttagaaatgatattaaaatgggaggttggagtaaggtattttttgaagtgtttttgtatttgtttttttttaatgtattggttataagtttgttttttatttatagtttataaataattttaatgagaatagttatatatttttgtttttgaattatttatttgaagtgtttagtattatgaattgagtattagaaattttttttatttttttgtaaagcgttgtattttatttttttttatttgtatatagatttttaaaattggttattttttttttgggttagatagaatagaatgtttggaaaaaaaagtttttattaaatttaggtgtttaaattgtttaagaaattaatttttgaggttatatttttttagggtttagtagttaaattaagaaaattttttatcgtttatttttatttttggaaattataaaatttttagatattatagttttttaaagagtttttttttttaaatataaattaaaaggaattgattttttttttaatttttttaggttttagtatggatagagttattttttttttttaataatttatttataatttattttgtttttttgtagaatagttggagattaagtaatatggttatgatataaaatgtaagttagattataagatgagtagtttattttaagtatgaatgagtatttattttttgtgattttttatattgtttttaggtattaatagtgttagttagtaaagtaaatagtttaatatttatattttttttaggatattatatagtttatagtttgtatgtgtttttgcgtgtatgtttttttttgttttaaattttttttttttaaagtaagaatgttatatgtagtaaatggtttttttattaatttatttgttaatttatcgtgtattaattgagtgtttagtgagtgttaggtattgggttatttggattttttttttttgtattgatttatatatttttaggtgttttttgatatggttttttattgatttttttatataaggtttttattatttatttatatatttttttttaaagaggattggtttaaaagtaaaattttgagtaagttttttgagttattttagaattttttgtttttaaattgtatttttaattattgattggtagtattttggaataatttattttttttttttaaagattgaagttttttattttttttgatttttaggtgttagtttgtgtataaattgagataataaaaatgtttgttagatatttttttaaagtattttgttatgtgagaattttttatgaagaattttttttaataatgattttatagtagaagttatagtagagggagaattattgaattaaagatggtgtttgagtttatgattttatgatggattttttttttttttatatataaggatatgtatgggttttttagtatttaggaatttgttttttatttgatagtatttataaattgtgtgtttttttttaaaaaaatttaaattgtgagaatgtttttatttattagaagttggttaatgattatgttaaataaggaaaataagatagaaaaattagtttagtgaatattattttgtttttaaatttagtaatttagtaatagtatttttttggggtttattagaaattattttttaatttaataggttttttttattgtgaagttaggaggtgattttgtttaaatgtgtagtataggaatttatatgtggtgtttaaggattatgtaaatatgttgatataatcggagtatagtttggtattattaatttagaaatatttaaatttttgttatataatatggaagtaaatttgtgtatagtttgtgtgtgtgtgtgtgtgtgaattttaaaaaaagaaaaaaattataggattaggaagtcggaataggttttattttttttttagtattaaatttatagttatgtttttagtttttttttttatttttaagtaagatagataggtaaatgattattttgttgtttatttttgtgtatatttatttgtattgagagttgtatttatttgtttgttgagagtatttataaatggtatttgataaagtagatatttttttaaatatgtgaatttttttgtattgtataatgtttagaaataattatgtataaatggttgaatattaatataggattgttttattaagtattttattaattattaaaatgtggtgttattaatataatttattttaagtgttttttttaaaatattagattatttttttgatttttatatttttgataatgatttttttaaatttggtagttaggaatagaaaatttaatattgtatgtttttatttataagtgggagttgaatagagagaatatatggatttagggaggggaattatatatattggggtttggagtagggggtaggggaagggagagagtgcgttaggataaatagataaatagttaatgtatgcgagttttaatatttaggtgatgggttgataggtgtagtaaattattatgatatatatttatttatgtaataaatttgtatattttgtatatgtatttcggaatttaaagtaaaataaaaaataataataaaataaaataaatttagtagtatttattgttttagagtttgtaattgttttttaggtagttttatataaaaatttaggagaatttttattgttattgttttatgaggtgttaggaaaatttgttttattgtagtgttttagtaggtattggtattgagattaaaatttagttggtttgttgttattacgatttttacgtgattttatttgttatgtagataagattgtatattttaataataattttgtttaaatgtgtggtattttatatatttttaaaatgtatttatatattttattttatttgattttataaataattttataaaaaagattggtagatattatttttatataatagaggaggaaattggagtttagagaagttaaatagtaatttaaaatgtatagttgtagaattagagtaaggatgatagtttagtgattttatttaatttagtttttttattattattttagttgtttataattaaaatttgtagtatttaagtaagaaattatattttgtttttgatgtattaatgtgagatttggagtaggaataggttgatattgttattttggtttattgtttatttttgtttttagtagagattggtatttttttgtgtgttaaggaataaagtggtaatgggaagattaaaaatgttttttttaaggagttttttaatttaatttttttaaaaaagaaaaaatttttagagggaaaaatgaatatatgatttttgatgtattgttttttagtaatttagttataattttatttaaatttgagatttttgttaagtgaatgattagaaatattaggtggttggttagatggtaaataggaatagttgtagtttgtagtttttagagagattaatgtagaaggtgggtgatttttgtatttttaattgaggtatcgggtttattttattgggattggttagatagtgggtgtagtttatggagggtgagttaaagtagggtggagtattgttttatttaggaagcgtaaggggttaggggaatttttttttttagttaagggaagttttgagggattgtgttatgagggatagtgttatttggtttagatattatatattttttatagtttttgtagtcggtagattaggagatttttttgggtgtttatattattagggttttgggttttaagtataaaattgggtggttatttgggtagatatttagttagttgtaggagtttttttttatattttagtggtatttgaaattttagtgagatagaattatttattttttcggaaaggggttgaaggttaggtagttaagtgatttagtttagtagattttatttttatggagtacggtaaggtaagatttgttggtttgaaatttttattgttagtatagttgtttgaagttaatttgggatgttttagtttggtcgggggaggggtattcgttattattgaggtttgagtaggttgttttttttttataatgtaaataaagttattgggaagtttgaattgggtggagtttattatagtttagtaaagtttttgtagttagattgtttttttagattttttttttttgggtagggtatttgggaaagaaaggtagtagttttagttaggggtttatagataaaatttttattttatgggatagagtatttgggagagggggtggttgtgggtttagttttagtagatttaaatgttttttgtttgttggttgtgaagagagtagtggattttttagtatagtatttgagttttgttaagggatagattgtttttttaagtaggtttttgattttcgtgatttttgagtgggagatattttttagtaggggtcgatagatattttatataggagagttttggttggtatttggtgggtgtttttttgggataaattttttagaggaaggaataggtagtagtttttgttgttttgtagtttttgttggtgatatttaggtaaatagggtttggagtggatttttattaaattttagtagatttgtagtagaggggtttgattgttagaaggaaaattaataaataggaatagtattaatattaataaaaaggatgtttatacgaaaatttcgtataaaggtcgttaatattaaagattaaatatagataaatttataaggatgaggaaaatttagtataaaaaggttgaaaattttaaaaattagaatgtttttttttttttaagggagtataattttttgttagtaagggaataaaattggatggagaatgagtttgatgaattgatagaagtatgttttagaaagtgggtaaaaatagatttttttaagttaaaggagtatgttttaatttaatgtaaagaagttaagaattttgaaaaaaggttggaggaattgttaattagaataattagtttagagaagaatataaatgatttaatggagttgaaaaatatagtacgagaattttgtgaagtatatataagttttaataattgaatcgataaagtagaggaaaggatattagagattgaagattaatttaatgaaataaagtatgaagataagattagagaaaaaaagaatgaaaaggaaggaataaagtttttaagaaatgtgggattatgtgaaaagattaaatttatattttattggtgtatttgaaagtggcggggataatggaattaagttggaaaatattttttaggatattatttaggagaatttttttaaattagtaagataagttaatatttaaatttaggaaatatagagaatattataaagatattttttaagaagagtaaatttaagatatgtaattgttagatttattaaggttgaaatgtaggaaaaaaagttaagggtagcgagagagaaaggtcgggttatttaaaaagggaagtttattagattaatagtggattttttagtagaaattttataagtttataagttagaagagagtgggggttaatatttaatatttttaaagaaaagaatttttaatttagaattttatatttagttaattaagttttagaagtgaagtagaaataaaattttttatagacgagtaaatgttgagagattttgttattattaggtatgttttataagagtttttgaaggaagtattaaataaggaaaggaaaaatcggtattagttattgtagaaatatattaaattgtaaagattattgaaattatgaagaaattgtattaattaatgggtaaaataattagttaatattataatgataggattaaatttatatataataatattaattttaaatataaatgggttaaatgttttaattaaaagattatagattggtaaattggataaagagttaagatttattagtgtgttgtgttttggagatttattttatatgtaaagatatatataggttgaaaataaagggatggaggaagatttattaagtaaatggaaagtaaaaaaaaagtaggggttgtaattttagtttttgataaaatagattttaaattaataaagattaaaagagataaagaaggttattatataatgataaagggattaatttaataagaagagttaattattttaaatatatatgtatttaatataggagtatttagatttataaagtaagtttttagagatttataaagagattaagatttttatataataatagtgtgagattttaatattttaatgttaatattaggttaacgagatagaaaattaataagtatatttaggatttgaatttagttttggatttagtggaattaatagatatttatagaattttttattttatattaatagaatatatattttttttagtattatattatatttattttaaaattgattatataattggaagtaaaatattttttagtaaatgtaaaagaatggaaattataataaatagttttttagattaaagtgtaattaaattagaatttaggattaagaaattaatttaaaattatataattatagtggaaattgaataatttgtttttgaatgattattgagtaaataataaaaagaaggtagaaataaatatattatttgagattaatgagaataaagatataatatattagaatttttgggatatagttaaaatagtgtttaggggaaatttatagtaataaatgtttataggagaaagtaggaaagagttaaaattaatattttaatattataattaaaggaattagagaagtaagagtaaatatatttaaaagttagtagaagataagaaataattaagattagagtagaattgaaggagattagagatataaaaaattttttaaaaaaattagtgaatttagaagttggttttttgaaaagattaataaaatagatagaatgttagttagattgataaagaagaaaagagagaagaattaaatagacgtaataaaagatgataaagaggatattattattgattttataaaaatataatttattattagagaatattataaatatttttatgtaaataaattagaaaatttagaagaaatgaataaatttttggatatatatatttttttaagattaaaggaagaagttaaatttttgaatagattaataataagttttgaaatcgaggtagtaattaatagtttattaattaaaaaaagtttaggattagacggatttatagttgaattttattagaagtataaagaagagttggtattattttttttgaaattattttaattaatagaaaaggagggaattttttttaatttattttatgagttcggtattattttgatataaaaatttggtagagatatagtaaaaaaataaaattgtaggttaatatttttgatgaatattgatgtaaaaatttttaataaaaaattggtaaattgaatttagtagtatattaaaaagtttatttattatgataatttggttttatttttgggatgtaaggttggtttaatatatgtaaattaataaagataatttattatataaagagaattaatgataaaaattatatgattattttaatagatgtagaaaaggttttttataaaatttaatagttttttatgttaaaaatttttaataaattaggtattgatggaatatattttaaaataataagagttatttatgagaaatttatagttaatattatattgaatgggtaaaagttggaagtatttatttgaaaatcggtataaaataaggatgttttttgttattatttttatttaatatagtattggacgttttagttagggtaattaggtaatagaaagaaataaagtatatttaaataggaagagaggaagttaaattgtttttgtttgtagatgatatgattgtatatttagaaaattttattattttagtttaaaatttttttaagttgataagtaattttagtaaagttttaggatataaaattaatgtgtaaaaattacgagtatttttatatattaataatgataaatagttaagttatgagtgaatttttatttataattgttataaagagaataaaatgtttaggaatataatttataagggatgtgaaggatttttttaaagagaattataaattattgtttaatgaaataagagaggatataaataaatggaagaatattttatttttatggataggaagaattaatatcgtgaaaatggttatattgtttaaagtaatttatagatttaatgttatttttattaagttattattgattttttttatagaattagaaaaaattattttaaattttatatggaattaaaaaatagttcgtatagttaagataattttaagtaaaatgaataagttggaggtattatgttatttgattttaaattatattataaggttatagtaattaaaatattatggtattggtatataaatagatagatagattaatggaatagaatagaggttttagaaataacgttatatatttataattatttgatttttgataaatatgataaaaataagtaatgtagaaaggattttttatttaataaatggtgtcgggaaaattggttagttatttgtagaaaattgaaattggattttttttttatacgttatataaaaattaatttaagatggattaaagatttaaatataaaatataaaattataaaaattttagaagaaaatttaggtaatattatttaggatataggtatggtaaagattttatgattaaaatattaaaagtaatggtaataaaagttaaaattgataaatgggatttaattaaattaaagagtttttgtatagtaaaagaaattaatattagagtgaataggtaatcgatagaatgggtgaaattttttgtaacgtatttatttgataaaaggttaatatttagaatttataaggaatttaaataagtttataagaaaaaaaataattttattaaaaagtgggcgaagggtatgaatagatgttttttaaaagaagaaatttatgttgttaataaatatacgaagaaaagtttattattattggttattagagaaatgtaaattaaaattatagtgagatattattttatgttagttagaatggcgattattaaaaagttaggaaataatagatgtaggagaggatgtagagaaataggaatatttttatattgttggtgggagtgtaaattagtttaattattgtggaagatagtgtggtgattttttaaggatttagaattagaaatattttttgatttagttattttattattgggtatatatttaaaggattataaattatgttattataaagatatatgtatatgtatgtttattgtggtattatttataatagtaaagatttggaattaattcgaatgtttattaatgatagattggataaagaaaatgtgatatatatatattatggaatattatgtagttataaaaaaggatgagtttatgttttttgtagggatatggatgaagttggaaattattatttttggtaaggtaatataggaatagaaaattaaatattatatgtttttatttataagtgggagttgaatagtgagaatatatggatattgggaggagaatattatatattggggtttgttagggtgtaggaggttaggggagggatagtattaggagaaatatttaatgtagatgataagttgatgagtgtagtaaattattatggtatttgtatatttaggtaataaatttgtacgttttgtatatgtattttagaatttaaaagtattattattattattataataataataataaaagaaatataataaaatagaatgtagtatatagtagtgatttttaaatatatttagtattagaattatttttgaatttttaaaatatatatatatatgagattttagtttttaagatttgtaagtttggtattgggtttttgggtttatgttgggtttagaaatttttatagatggtttggatgtatgggatagtttaagaatcgttgaattaaaattaaataaattgaatattttgtgatttagagagatttatcgtttattttattatttaagtatttgtattagagcgtggttagaagggatttgtagttttgtaaataattagaaatttagatattttgagatgagagaattgttgaagattttattttgatttgaaataaattttttaattagaaatttttaggtgagagtaaaggtttggaataatatttttgagttagaggaggatcgagtttgattttaggtttaatatttattaggtttatgattttgggttagtaatttaaattttttgtattttaattttttaatagggtattggtagggattaaatgtgttagtgtttgtgaagtgtttagagtagtgtttggtatagtaaatgtttaatgaattttagttattgtttttatttttagtattttttagtttttttaaaaagatattttttttagatttgtattaagataataaaaagtttaattagtatgttttatatttaaatatgttttattttatagtaaagtttataagattaaaattgttttgttgtaattttttgagttttatgtgtttattaatgattttttttgttgtttatttatttgaattttatttattttttaagatttagttggaattttgtttttagaaagatttttgtttataataataaatttgttttatttgagtttttaggtggtttgtattttataatttggtaattaattgtatatgtatttatataataaaatattattgtgtgtttttgttgtattagattttaggttggaagttgtagatatgatgtttttgtttagaaaaatgttttagaatgttttatttaggatagtttgttgattttaaagatatattttttaaatagatattttatgaggtagttttagtttgtatttgtgtttttggatttgatgattaagtttgatttaagttttattatttattagttttgtgattttgggtaagttatttgaattttttgtgtgtagatagaataatgttgagggaaattttttttttttatttttgtgtttttataagggaatttgttttttaataagtaatatttttaggggaatattttaggttttttttttatttttattatttgttttttttgtgaaaagaggagaggttaatttgatggatgaaatttttaattttttattttttggattgtagagtttgtgaattaaagtaatggattatttgtattgaaattgaggttgattttgtattttgatttttatttggtaatttatttttattttgtttttaatttaaaattttaaggggagaaggaagataattgattattagaagtatgtaatggtggtaggaagttgaataaatggtaattttttaaaagttgtatgagatatagtttttattttagagaagttaagtttgtttttttttttttttatgtattttagtattatttttataattagattgtaaattttttaaaagtaagaatatttttatatttttttatttttgatagtatatagtagattgttgggtatatatatagtaggtggttttgtaggtatttgttaaatgatttaatatgttttttttttatggaaaagaaagattttagtattgtttttattagttaggaaggtattttgaataggaaattagttttaggtaggtatttataaatgggttatgatttttaatttatttgttttagaggttcgttaatgttgaattttttatgggtattttgttttgttttatgagttatatatgttaaggggttagtagattatataattttttgatttataaaatatgatttttattgaataaaaatttgggttaaaggttttttttttttgttatttttttttttttttttatttttttttttgggaatgttttttgtgtatgttagttatagtatgtattatattgtattgtattgttggtttttgggtttaatttatttttaatattgtagtttttaagggtagaaatttagttttatttattttgatgtttttagtgtttgtgtttagagaatatttattatttgaaaaaatagtgtaaaagtaaattttaggagattatattatatttatttaaattgtaagtttgataagttgatatttaaaagaaaggtttttttaaataatttcgttatagaaatttgggtgatttttgtagttttggagaaagtagaggtaaaaatgaaatttaaaaattatttgtgggtttttaaaaaatgtttttttatggagtaaaggtttatagttgagttttttttatatgagggaatgatagaaatatagttggttttgatttttagttttaattgagcgattagagttttgttggtgaaataggaatttgtattgtgtttttgacgtgtattttgaaggtgttagtttattgtttttttgtttatataaatagttttttaagaattgtttttgattttgtgagtttttaattaaatgattaattatgtaaagttggttatttggggtaatattgaagtattttttttgagggttattgataggtgggaatgtgtttatttttttgggtttttggtttttatgttatatttgtaaattagtgatagtttaaatttggggtaattatttagtaagtttattgagttattaagttaattatttttattttgtatgaagtaattttgaaaatgatttttttaaagtaaagtatatttaaatttagtatttttttaataatttttgttgaatgaataaatgattaatttataaaaaatgtaatatatttttaatttttatttacgggtagtttaagttttttgtgtaagaggaggtttcggtttgagataatataggatagtaagttttttagagaaatttttatatggaaatatggtttgttatgaagttagaagtgagaggatattatatttgattattatatttggttttagagttttttaatatggggtttaaagttaaggttttttgttttattaagaggaggtttaggagtgtatgatatttattagattattgagatttagttggaattaggtattttgtataggggttttgtttaattaaaatagtttttattttttttgagttttaagtaattagttttttaatttagtgtttggatagtagtgttaagtgggagtatttttaatgaatttttttatgaggttatttttagtttattggaatgtttcgttttaggagggtgaggaagggaagttttgaatttttgtgtttagtttaatgttgtgatatagttttgattattcgtttaatgggagatttgttttttagatgattatatatgtggaaaggagaagttttttgagtgttttttttaattttttttaaagaatggttttttatttagtttttatatttgggggtaaaaggttttttagggagattttttaaaagtatttgaagtttgtatttgattttagaggtgagttggaggtttatttgtgtatgatagatatatgtttttaataattatatgtttataaggattaagagttatttttttgggtttattatttaatattgattttatattcgtgttcgtattagtatttttatagtgcgtttttagttatatttttttaattttttttagtaggttttatagaatttgtagtgtatgtaatggtagatgattatatgtggagttatttaattatattttttattgtaagttagttcgtttttgatgtttgtttatgtttagattttattttttggaagattttatttttttgtattattttagtattttagatgtttttgagattgggtttttttttttttttatgtttggttatggttatttttttagggttgtgttgtgttttatagttgttgtttgtagggttgatttttataatgtataaagtttttttttatatgttgataatttttggtgtgatgttgtgagttaggtagggtgtgtatacgtgtttttattatattatagtggtaaggtaatagggtttttgaatttgattatttatgaatttgtttaatttgttggtaaaaaatggttatgtattagtcgttttatagggttagtttaatagaaagtgggagttaggtaggattagaatttaggattttagttttcggttttagggattattttttatatttaattgttttattttgaattagttttttttagggaaatatttttaaaattgagatggtatttataggattttttaattgtagttattattaggaaaaataagtaaaggaattggtgtaaatttttgtttttggtgattggtggagatttggagattgttttgtgttaaaagtaaagttattagattaaatgttttgttaataaattggttatttttaatttaattatttgatagttaatttatattatttaaaaattaaaataaaatttaaaagaagtttatattgaaaagttttgttttatttatattttgtttattttagtattttttaatatatattatttataaggtgattatttgtattagttttttgtgaatttttgatagtgtgttttatatagatataggtaaatatgagtatgtattattattttttttttattttattttgttttttttttgagacggagtttcgttttgtcgtttaggttggagtgtagtggtacgatttcggtttatcgtaagttttattatttttttttatttttaaaataaaaggtagtagttatatatatattattttatattttgttttattatttattaatatatattagagagttttttattattttgtatatatgtatttatatttgttaattatttttagaagtggaattgttgggttagtaggaaaaattatgtataattttgataggtattgtttaattgttttgtatagggtttgaattgtttgtatttttatttttagtgtatgagaagatttgtttttttatagttttattaaatagagtgtgtgagattagatgagaaataggaggtgagtagttttttattttattcgtagtttgtagtgggaatattgtatagttgtaagagttggtgtaggtattagattagttttagtggaaacgttgttttattatggttatgggtttgcgttagttttagtgatatatacggaatggatttacgttgttatttgtagaattttttgtagtagaaagttgaatatgtatttattatttatttaattagttatgttggatttaaagagtataatagtgttttttagaattaaaaagaaaattgttttattataatatattgtgtataaggtttttaatgttttttttttagttattaatattatttttaggattgagtttaagagatgtattttaaattatagggatgttttgttaagtttggaatttttatatttaagggatgtttttttgaggaatgattttatatttatttaatatttgtaattaaataattagtattttataagataaatttaaattgtttaagtataatataaatattgaattatgatgtattattgttagattttttttttaaagttgttaagtggttttttgtattaggtaaataggggattatataaaaatgttatgatttacggtttagataatatttttattatttgagtagtatatattttaggttatttttatataattttttattatttttattagaaaggttgatttttagttttatttttttttgaggatagtaaaaaaaaaaattttttttagttttattgtatagaaaagtgtggtaaatggagtcgggtatagtggttatttaatttaaatggataatattttttatagaattttgatagggttattgtataggggaaagttatttttttttttttttatagaagagttgtatttggatagttgtattgatgattgtatttagtttatataagaggttatttttgggtataagaatggattgttaaaatttagttgaaatattattgataaatagatatttttttttgttaataatatttgtgaaggtttttataatagatatttttagttttgtttttaggttttttgtagttgtttttttaaaagtgtgtttttttttaagagttgataatggttagaagtaaggtgttttgttttttgtgttattattatttaatttgttatatatatttgggatgttagtttaggtataggttttgtatttatttagtatggtttgtgggtttggttgtttttgttatttatgttgagggtttttgggtattagtttggtgtgagagaatttattttatgatttttttttttttggttgttttgattcgatggtttttgttggtatagtttgtgagtgtttgatgttttatttatgtcggattatttgttttgttgtttttgtggtttgaagtcgttttttgaattattttttgataataaatttgagatgattttgttttatttttttttttaagttatattttagttttttagttatattttcgaagaatatgataaatggatgggttataagttacgtagtatagggtgttagattacgaggttttgaagggattttgttgggtgttaaaaagaaagattttgtgttattacgattttttttaaaggtatgttgatatttaggttttaattgaaagcgtttttatttaagtagagttgatagaggagtatttggtagtcgcggttgttggtttgaagagtatgtggttttgttttaatgtttaatgagatttttttacgggaaaatgttttgatattttaaataaatgatttttatgtatagttttgataaaatattttattaagtatgtatatatggttggtattttgtggtaataatttaatattggaaatagagtagtaataaagaaatattagggttatatttaatttttgtggaattagtgtgtaaataaattgtttattagaaatgtttatatggggttttgtttaaataaataagaaattggtatatagggtttgtaggatatttttgttaagtagattttttttatattataagatattatatttatgtttgattttatatggaaagaggtatagtaagttagtattggtttatattttttttttattatataatgggtatgtgattttagggaatttatcgaaattttttgggttttagtttttttagttataaatggtggataattaaattatttattttattattaataaatgttagttattattttttattaagtttaatataaagagaaatattttatttatttttttagttatttagagtattttttaaaattttattattaataaatattgtattgtatttattatagtaattatgtaaaaatggagtttttgttttatgtttagatgaaatatgttggtatttgagtttgtatgttttttataggaattagtgtttagtgaaaacgggtggagataaatagatgtttttatagttttgttgtttatagtatcgttaaattgaatgtttttatataggtgtattttaatggtttaaatgatgtagatattttttggttagttatatggattttttgttatttaagatgttaatattttttttatattttatagtagttttggagtatagttagttttttgaatagggtttatatggtttattatgtatagggtttggaaattgttttattcgtgttgttgaaatgaatcgtgatattttagaagagttgggagttggggtagagtagtggttaggagaatatatttaattatatttttttttgtattaagttataagtaatgagtatttttttgtgttttatagttaagtaattaaaagaaattatagagtgggatgtaaaaataattcgaaggataattggatgtgtggagttattagttttttttatgagtgtataaggttaatttttgttattatttagaatgttgagtttttatagaaagggttgtaggtttatatatgttttggcgtttatttatacgtttttgtatggtatgattgtgtattttagaagaagggttgtgttgtgtatttttacgttttagtggaatttaataaattgatttttgaaaatggttttataaaggtgagtaatagagagttaatagtttttttttgttaattttattttttttttaagattttttgataatagtttgaaaaggagtgttattttttggtttttagaggtaatttatttttttagttttttttattatttgtttttattttttttgtttttttaaatttaatgttgtatgtattttagaggataggatttaatttagtgcggtttttttattaggtgagaattatttattttatttttattttagtttttttgaattaatgatattgaagttcggtagtttggttttaagatgggtttaattatgtatagatattttttttataatggaaattgtttagataattaattaattataagaatatattgtttatggaaaattttaggagtatcgtttgtggaaaaattgggaagggtatgttgttattatagttttggggtttattaaaagtgtggttatgtagtattggtgtttagtggggtgttggtttttaattgttagaatttttatagtattttatggtagaaagttaaggtgtttagtaatattttgaaagtgatttgttgattaaagtcgttaattttgaagaaagagattgaaataagataaatgggttttaatttttttttttttttttttttttgtaaaaatgtgtgattgttttggtatgtttttaatttttatataatgttaatatttttttttaaagggggattttttttatttttggatttgagaattattgtatgttttttttttagggataatgaatgtagttgtattatttttgtttttttttttttttttgtatatagtatgtttatttttggatgtagggatttgaaagataaagttttatttggtttttataatattttttattagtaggtgtgttttgtgtgtaatttgaaggaggcggttttttagttgtgtttatattgtatttttaaatgtggggttgaaggtagaattaattatatttaagatgttatttgggaaaatagggttttgtgttattttagttttatttatttgtaaatgatttaatagtagtattattagggtttttagtgtgagttatttgtatttggattggtgaatttggtgattttttggtgtttggaaataaataatttttgtagtttttcgtaaaaagtttgaatagtggattagtttttagttttatttgtaaagttgtttttattaaattttttataatgtttaatttaaaaaatgttatatttttttttggaaatttaattttttttttttttttaaaagttattttaagtattttagttttgaattaaatgattttaaatattggatattaatttagaaattgggttattttttgggaattttatcgaagaagagagattttggttggagagggggttttgatgtttgatatttatatttattattttaatattttattgttgttgttgttgttgttgttgtattattttgcgagtttcgtttgtttaaattttatggtatttggtaggagagagttggatttgttggttttaggataagtttagaaataagaaatttgttttgagtgagtgagttggttttttttgttgttattttattattaaggacgaaaggaatttataaggattagagatatttggttgaaagtaatattagtgtgattggatatttattatttgttatagttggttatatcgtttttagtatgattttgattgagtgagtgatattaggttatgtttagggattagggaggttaattatgtttatattgttttgtagtattttggtaagaattaatgattgtgtagatgtttagatttaggttagtaatattttaaaagtttttattgaattaattatgtttataagtagtttgtattttttattataataataatagtggaaaagttagttgatataaaaggagtttagattttatttaagtaaaaatataaaagtaaagatatttttttatataaattataaaagtaaagatatttttttatataaatgtttttataaaataagttgaattaaagaggaaagatgataggtaatcgtatgatacgttaagaaagtattataatatttaagttaattttaattttttatttttttattttaagtagttttttttttttttattatttagttttgtgttttttaattttgataagtaaaaaagttattgtattaaataaattttattgaaatgtaggatttgattgagtgggtggggtaggtggaatgagggtggggaagttgagattttgtattttttagaagtttttattttatgttaaaatggttaatttattttaatattgagaagtaaggttttatttaattttagtttgtgtaagtttattttatatgtatattttttaaaattttaattttaggttttaggaattttttttttagttaaaatatttttaggaataaatttgaattgtattaatatataatttataaatttaatataaaaaattatttgaagtttgagattttaggttgtatgaaattaattttatatttgaaaattttttataaatttaaaagtttgtgtatttaaatataatttaaatatttgtgttatagtgatatttgtttttttgtttttttttttattatttttagagttattatttttgtatagaaaaattttttttatatgattttattataaatttattaaatatgatgtttatttgataatttttttaggttttttttttttttaattatattttaagttttagggtatatgtgtataatttgtaggtttgttatatatgtatatatgtgttatgttggtgtgttgtatttattaattcgttatttatattaggtatattttttaatgttattttttttttttatttttattttatgataggttttagtgtgtgatgttttttattttgtgtttaagtgtttttattgtttagtttttatttatgagtgagaatatgcggtgtttggttttttgtttttgcgatagtttgtttagaatgatgtttttgtttattgatggatatttggttggttttaagtatttgttattgtaaatagtgtcgtaataaatatacgtgtgtatgtgtttttatagtagtatgatttataattttttgggtatatatttagtaatgggatggttggtttaaatggtatttttagttttagattttagaggaatcgttatattgttttttataatgtttgaattagtttatagttttattaatagtgtaaaagtgtttttatttttttatattttttttagtatttgttgttttcggattttaatgatcgttattttaattggtgtgagatggtattttattgtggttttgatttgtatttttttgatggttagtgatgatgagtatttttttatgtgttttttggttatataaatgtttttttttgagaagtgtttgtttatattttttatttattttttgatggggttatttgatttttttttgtaaatttgtttaagtttttttagattttggatattagttttttgttagatgggtagattgtaaaaatttttttttatttcgtaggttttttatttattttgatggtagttttttttgttgtgtagaagttttttagtttaattagattttatttgttaattttggtttttgttgttattgtttttggtgttttagttatgaagtttttgtttatgtttatgttttgaatggtattgtttaggtttttttttagggtttttatggttttaggtttaacgtgtaagtttttaatttattttgaattaatttttgtataaggtgtaaagaagggatttagttttagttttttatatatggttagttagtttttttagtattatttattaaatagagaattttttttttattttttgtttttgttaggtttgttaaagattagatggttgtagatgtgtggtattgtttttgagggttttgttttgttttattggtttatatttttgttttggtattagtattatgttgttttggttattgtagttttgtaatatagtttgaagttaggtagcgtgatgtttttagttttgtttttttggtttaggattgttttggcgatgcgggtttttttttggttttatatgaattttaaagtagtttttttttaattttgtggagaaagttattggtagtttgatggggatggtattgaatttataaattattttgggtagtatggttatttttatgatattgattttttttatttatgagaatggaatgtttttttatttgtttgcgtttttttttatttttttgagtagtggtttgtagttttttttgaagaggttttttatattttttgtaagttggatttttaagtattttattttttttgaaataattgtgaatgggagtttatttatgatttggttttttgtttgtttgttattggtgtataggaatgtttgtgatttttgtatattgattttgtattttgagattttgttgaagttgtttattagtttaaggagattttgggttgagatgatggggttttttaaatatataattatgttatttgtaaatagagataatttgattttttttttttttatttgaatattttttatttttttttattgtttgattgttttggttagaacgtttaatattatgttgaataggagtggtgatagaggatatttttgttttgtgttagtttttaaagggaatgtttttagtttttgtttatttagtatgatattggttgtgggtttgtcgtgaatagtttttattattttgagatatgttttattaatatttagtttatttagagtttttagtataaaggttgttgaattttgttaaaggttttttttgtatttattgagataattatggtttttgtttttgattttgtttatatgatggattatatttattgatttgtatatgttgaattagttttgtattttagggatgaagttaatttgattatggtggataagttttttgatgttttgttggattcggtttgttagtattttattgaggatttttttatcgatttttattagggatattggtttgaaattttttttttttgttgtgtttttgttaggttgtggtattaggatgatgttggttttataaaatgagttagggaggattttttttttttttattgattagaatagttttagaatggtattagtttttttttatatttttggtagaatttagttgtgaatttatttggttttgatggatttttttggttggtaggttattaattattgttttaattttagagtttgttattggtttattaagagatttaatttttttttggtttagttttgggagggtgtgtgtgtttaggaatttataaattttttttaggttttttagtttatttgtatagaagtgtttatagtgttttttgatggtagtttgtatttttgtgggattggtggtgatattttttttattattttttattgtatttatttgatttttttttttttttttttttattagttttgttagtgatttattaattttgttgatttttttaaaaaattagtttttgggtttattgattttttgaaggagtttttttgtttttattttttttagttttattttgattttagttattttttgttttttgttagtttttgaatgtgtttgtttttgtttttttaaattgtgatgttagggtgttaattttagattttttttgtttttttttgtgggtatttagtgttataaatttttttttatatattgttttaaatgtgttttagagattttggtatgttgtgtttttgtttttattggttttaaagaatatttttatttttgtttttatttcgttaagtatttagtagttatttaggagtaggttgtttagtttttatgtagttgagtggttttgagtgagttttttaattttgagttttagtttgaaagtattgtagtttgagaggtagtttgttataatttttgtttttttatatttgttgaggagtgttttatttttaattatgtagttaatttttggaataagtgtgatgtggtgtcgagaagaatgtatattttgttgatttggagtggagagttttgtagatgtttattaggttcgtttggtgtagagttgagtttaatttttggatatttttgttaattttttgttttgttgatttgtttaatattgatcgtggggtgataaagttttttattattattgtgtgggagtttaagtttttttgtaggtttttaaggatttgttttgtgaatttggtgtttttgtattaggtgtatatatttttaggatagttagttttttttgttgaattgatttttttattattatgtaatggttttttttgttttttttgatttttgttggtttaaagtttgttttattagagattaggattgtaatttttgtttttttttgttttttatttttttggtagatttttttttatttttttattttgagtttatgtgcgtttttgtatatgagatgggtttgttgaatatagtatattgatgggttttgattttttatttaatttgttagtttatgttttttaattggagtatttagtttatttatatttaaggttaatattgttatgtgtgaatttgattttgttattatgatgttagttggttattttgttcgttagttgatgtagtttttttttagttttaatgatttttataatttggtatgtttttgtagtggttggtattggttgtttttttttatgtttagtgttttttttaggagtttttgtaaggtaggtttggtggtgataaaattttttagtatttgtttgtttgtaaaggattttattttttttttatttatgaagtttagtttggttggatatgaaattttgggttgaaaatttttttttttaagaatgttgaatattggtttttatttttttttggtttgtagagtttttgtcgaaagatgttgttagtttgatggatttttttttgtgggtaatttgttttttttttttcgttgtatttaatgtttttttttttattttaattttggtgaatttgataattatgtgtttttgagttattttttttgaggagtatttttgcggtattttttgtattttttgaatttgaatgttggtttgttttattagattggggaagtttttttggataatattttgtagagcgttttttaatttggttttattttttttattatttttaggtatattaattagatgtagatttggtttttttatatagttttatattttttggaggttttgtttatttttttttatttttttttttttaaatttttttttttgttttattttatttatttgatttttaattttttttttttatttgattgaattagttattgaagtttgtgtatgtgttatatagttttcgtgttatggtttttagttttattaggttatttaaggttttttttatgttgttttttttagttagttattcgtttaatgtttttttaaggtttttagtttttttgttaaaaggtttaaatatttttttttagttcggaggagtttgttattattgattatttgaagttttttttttttaatttgtgaaagttattttttgtttagttttgttttattgttggcgaggagttgtatttttttggaggagaagacgtgttttgatttttagaatttttagtttttttgttttggtttttttttattttattggttttatttatttttggtttttgatgatggtgacgtatagatggggttttggtgtggatgttttttttttttgttagttttttttttaatagttaggatttttagttgtaggtttgttggagtttgttggaggtttattttagattttgtttgtttgggtattattagtagaggttgtagaatagtaaatattgtagaacggtaaatgttgttttttgattgtttttttggaagtttcgttttagaggggtatttggtcgtatgaggtgttagtcggtttttattgggaggtgttttttagttaggttatttaggggttaggaatttatttgaagaggtagattgtttatttttagatattatattttatgttgggaggatttttattttttttaaagttgttagatagggatatttaagtttgtagaagtttttgttgttttttgtttagttgtgttttgtttttagaggtggagtttatagaggtaggtaggtttttttgagttgcggtgggttttatttatttcgagttttttggttgttttgtttatttatttaagttttagtaatggtggatattttttttttagtttcgttgttgttttgtagttcgattttagattgttgtgttagtagtgagttaggtttcgtgggtatgggatttttcgagttaggtttgggatataattttttggtgtgtcgtttgttaagattattggaaaagtatagtattagggtggggagtgttttgattttttaggtatcgttagttatggttttttttggttaggaaagggaattttttaattttttgtgttttttgggtgaggtgatgttttattttgttttggtttatgtttcgtgggttgtatttattgtttgataagttttagtgagatgaattcggtattttagttggaaatgtagaaattattcgttttttgtattatttacgttgggggttgtagattggagttgtttatatttggttattttggaatttttttttttaagttttttattatagagtgggttattgaaattttatggaataaattggaaattatttttttaattaatgttattgtttattatgtatgggaatttggtaaatattatatggttttaataatatagtagatagaatattgttaaatttaaattttagtgaattgtaatagattttatttgaaattttaaagaaaatagaattttaattgaagaggttaaatttttatagggaatgttaattgttatttgggttttgtaaataaaaaattgttttttaaaaaagtaaattttaaaagtatttttagatgattttatttgttatttaagtggtttgagtatgtttgatgttaagatttttttgttatagattggagatgtgtgttattggggtagtgttgttttgtgataaggaggtagaggatgagggtaaggttcgatgtgattgtgaattttgggtggttttggttatcgggagtttttattgattatagtaaaatagttgtttttttagggtaatagtgtttttgttatttaggttggagtttagtggtatgattaatcgtttattgtagttttaattttttagatttaagtaatttttttattttagttttttaagtagttgaaattataggtgtgtattattatatttaatttttttaatttttaagtttttgtagagatatggttttattgtgttgtttaggttgatttcgaatttttgggttttagtgattttttcgtttcggttttttaaagtgttgggattataaatgtgagttattgtatttggttttttgtaatttttttgataatgtatttttttattttttaattggaagtaatttttttttttttataaaattgtatttgtattttttttgggttatttttatttttatattttagttacgtatgttttattttttttttagggagggaggtaagtaagattggaaagtagattttatgtgtgatgaatgaatgaataaaaggaagtttaatatatggatatagttaattggatgtaaattaaaaatttttaaatattgatttgtaagattttattaaggttaatttttaatagtttgtattatatatgttaggaattaaatattaataatttttttagtattattattatttttataggattgtttaaaatgagtagttatatttttaaattgtgttttttttgattatacgtttataggtaaaatttaaaggggttgggaataaataagatttttttttttttttgtatgtttgaattatttgtattgttgtttgtttttttatttttggttatagaaatttagttttaatatgttataatttttgtagtttttttttttagaaaaagattatattgtttgaaattttatttatttaagtaattaagttttaaagttgaaggattttggttatgattaatttagatttataaagtagtattttaatggtattttttttagaaagttaggttttaggatatatatagttgtagtgtttatattttgtaagttttttcgttgttatagttatttttttttttgtggttgatattttaaaattggtaatatattttgatggtaaaagtttggtttaggagataggtgatttattagttttatggtatttgataggttatttaatttttttgacgtataattgttttatttatataatggggataataatatttattttgtttttttgtaaaaattaaattagatgacgtttgtgaatgttttatagttttttagataaatgtaagttatgattatagtaagagtaaaagagtatgttgttatggatatttttttagtgaaatgtttaagatttgtgagttatatttaaagttaaatttgatatttattttattgattttttttttagttttatgtattatattgaattttttgatagtggggttatgaaagtttttttagtattttatagatgtggttgaattaatggttgtaagttttaaagtagaattagatagtattaatgaatttattaagtataaataaatatataatttgtttagtaatattatatagtttttttattttatgtgtgataaagagttattcgaaggttgaaaatgaagaattgttttggaagtttttatttaattttttattattttttaatatagtatataaaattatttattgaaagtttagtagaataagaaataagaagttaaaaggttgaaaattataaattttgttattattattgttattattttttaagttttttattgatttgttagaaatagagttatataggaaattgtaggatagttagtatgtggtagtgttatttgttttttaattatttaagtaaggttttattttattagaggaatttaagaagttggttatggttgataattgttatttgttaaattttttagagtagggattcgtaatatttaggttatggattgttattagtttttggtttgttaggaattaggttgtatagtaggaagtgagcggcgggtgagtaaatattgttatttgagttttgtttttttttagattagtagtagtattagatttttatagaagtatgagttttgttgtgaattgtatatgtaagggatttaggttgtgtgttttttatgagaatttaattttttatgataatttaattgatgatttaaggtggaattattttattttaaaattatttattttgttatttttagatcgtggaaaaattgttttttataaaattggtttttgttgttaaaaaggttgggattattgttttagagtttataatttggggttagtatagtttatatttatttgagaattttaatgggtttattgatttttttaaatgaaaaggttttttacgaaaattatatttaaattgtttttttttttagtttaataaatttattagtaagtttttattgagtattgttattatatttttttttgttaagtattatgggggtttagatatgatttatttttttaaagaatttattttttagttgaagattgattagaatgagtaaatacggttaataattaataagtgagtaggttagttcggttaatatggtgaaattttgtttttattaaaaatataaaaattagtcgggtatggtggtgggcgtttgtaattttagttattttttgttgaggtaggagaattgtttgaatttaggaggtggagattgtagtgagtcgagattgtattattgtattttagtttgggcgatagagtaagattttgttttgggaaaaaaataaaataaaataagtgagaagggaattaagtattacgtaagatgtaatgtggaattttagggaaggaaggtagtgtatgttggagtaattagagaaaggggtatgtatgatttgatgtttgaattggattatgaaggataagtaagattttggtagtaagtgagagggagagaggagtttgttagaggaatggaataagttaggaggtagtaatgtgtacggtattttaaggattttgttttgatcggagtagaagtgatgaagtattgagtagtttgagaaagttagttaagaagggtgagggtagatgttggagagagttgagtattagagagaagatattagatttgagtagatagaataaaaatgttattgttagtttttgtgtaagagaatagtattagggtggttatttaggaagtggttattagagttgaatggagtagaaagagtgtttgatatagtatcgggacgttgtggttataaaatgaggtggtgagggttgagttaagatggtggtagtgggatggataaaaagggatggttaggataaatattttaaaggaaaaattaataggatatttttattgattggattggaaggttatgtaggaaatatattgttaaatttgattttaggatttttattttatgtttgggttgtttaaaatattagggaattattgttagaaaaggtaggagatattattgttttaataaaaagtattgagtttggtgttgtatttatttaattttaaggttttataagtgagtagatagttagttagaattgtagaagtgttatttagagagtagggtttgtaatgtggggttggattttgttattattgtgttaatttttaattttatgtagatgtttagtttgaggaatatttatgtttgggttttagaatgaaagttaagtaatatttatttagatgttaattttttttttgaaatatttgtttatggaattgagagaataatatataaagtattaattattttttttataaagttattaataaaaagataagattagtgaaaggtagagtaaattagaagttaagtatagaaaatggtattatttaaagatttattattgtagtggtgaaaataaaataattttttaatagtttaagatgttttagtattttggattatttttaagtagttagtgtgggtatttagtaaatatgtattaaattatagtttattaatttttttttttttttttttgagatggagttttattttggttatttaggttgtatttttgtttttttagtgatatataaaatgtcgagttttataatgatggtattttagatttgattaaatatggtattaaaaaatagttgattatagaaagtttttattagtgtgatgtagatggttaaagtattttatatttgtaaatttttattgatttaaataagaggtgttttttgggttgtttttatttggattgggaatattaggagaaagtttttttatttagtgtgtaagtataatttattagaaatagaaatttttatggacgatttatttttttgatggtataggatttagaatatttataaagatttagttgttagcggaatagatatttgtattttatttaaattaattttttttttttaatttgagaatattgtgtaatttaagtagttttaagtatgtttgttattcgtgtaaagtgagagtaaatttaaaagaaatttttttgtgtgtttagggatggtaataaagttttttagtggttgaaaatgttattttttataaaagtggagaatatttgttttttaatattagagtttttagttatttttgtattttgatttattgattggaggtaggttgtttttgaatttagtaaaattttatgggtagaaatatagtttttttttttatttatttggatattatgatggttattgtatgtatgtgtttttttgtaagtttatgttttagaattgagaagtaggaataaaattagggttagggttggggatgttattttttgttgttgagaaatataatgttttaggtaagtgattttgaagttttttattatttgacggtaattttgggttggtttataggtatgtttttattttgtttgtttatttattttaattggttttttagagtatgtttgtagatgtagagttaaatttagagtagagtaattttttggtaaataggaagagattaattttgtggtatgtttttaagggattttttaggaaattttaaaagtagaaaaagaagtattagttgtttattttaaaatgtgtaaaatattatttagttttttaaaagtaggataaatttagagcgcgcgtatacgcgcgcgcgtatatatatatatatatatagagagaatatttttagtaaaaagaaaagttgagtttttttagttagatgtgtgtattagttagaaaaagttaaggagtgaagggttttagagaattggaggagataaagtggagtttgtatatgggaggtatttgaaatggatttaaatgtttttttaatgttgatttttttagttttttttttattagatatattgtttttatgatattagttttaggtatagatatattattaaaatgaatatgttaaaaaatgatttttgtttagaaataagtaaaatatttttagttgtgattatttaggtgtagaataaagaatagtggaattgggagttttgagttttaatataaattttttttatgatataaggtaagttttttatggtttttggtttttttatttgtaaaataggatggtttaatgaaattattttttttttttgttataatagagtatttttgtgggaagaggaaaaaaaaagttaatttaaaggttttttatagttttttaattgttgttttattgtgttatttatgtttagatattatatagttagaaaggtttattagattttttaggttattgttgtttttgttatatatttttgtaaaggattatgttgttaatttgaaaaaaattattattaattatatttgtagttgttgtttagtaatatttatgattttgtgtttttcgtgatagtatgagtagagattattaaaaattaaatttataaagttgttaaagtgggaagaaggagaatttgaagttataatttttgtatttgtttagaagttatttaattttaggtttatatgttagattttgggggaaatattgtatgtttttggtttatattaaattatatatagtatattattgatattgatttgtgtttggtgtagttggagtttattattaagatataaaaaaattttgattttgtagaatggtttggaattataattagatgggttatatggtatttcggtgaaagaaagttttaattagttttttgttttgtttttgttttttttttatagttttattaggtgagaagagtgatgattatttttttttttattatggttattttatattttggttgtatgaaggttgtttttatgaaagaagtaaatattcgaggataaggtggtttggtttatttaggtgtgcggatttatgggattttggagagcgtgaatgggtttaaggtaggtttaagaggtttgatattattggttgatattttcgaatacgtgatagaagagttgttggatgaggattagaaagttcggtttaatgaagaaaataataaggacgtagatttgtatacgtttagggtgatgtttagtagttaagtgtttttggagtttttttttttttttttgttggaggaatataaaaattatttagatgttgtaaatatgtttatgagggttcggcgttattttgattttgttcgtcgaggggagttgagcgtgtgtgatagtattagtgagtgggtaacggtagtagataaaaagattgtagtggatatgtcgggcgggacggttatagtttttgaaaaggtttttgtattaaaaggttaattgaagtaatatttttacgagattaagtgtaattttatgggttatataaaagaaggttgtaggggtatagataaaaggtattggaatttttagtgtcgaattatttagtcgtacgtgcgggtttttattatggatagtaaaaagagaattggttggcgatttataaggatagatattttttgtgtatgtatattgattattaaaaggggaagatagtggatttatgttgtatagattagattatattgagataaaaattatttatttgtatatatatataatagggtaaattatttagttaagaaaaaaataattttatgaattgtatgtataaatgaagtttatatagtatagtggttttataatttatttattggatatgtttatgattagaagggaaatagttatttgcgtataatttaaaaagtttgtattatattttttgataatgttgtggtttgttgtcgttgttaagaattgaaaatataaaaagttaaaaaaaataataaattgtatgttgttttaattgtgaattgataataaattgtttttttttagaaaatagaaaaaaaatatatatatatataataaaaatttgaattaaaatatttcgtttatattttagatagtaagtattttcgtttttgttagtattatatttgttttattgtttttaatttttgatagcgttggaattaaaataatgttaaggtgttgttgttattgttttattggtttaggggatgggggatggggggtatatttttgtttgttttgtgtttttttttcgtttgtttgttttgttttttagtttttatagggagtagagatggggaaagaatttttataatatatattttggttgataaaagatatatttgtatgttgtgaagatgtttgtaatatcgattagatgattagaaagtgaataaaaattaaggtaattgaataaaaaaatgtttatattttatatttcgtgatgtattttttaggtttcgtttattttttgggcgttggttagagtaagttgtttttgacggaaggatttatgtttgtttagaatatattttttttttttttttttttttggttttttttttgttttgttttaaggaagaaaaattagttgcgcgttttgaaatattttattattgttgtgaataagtgaatatattgtgttatattatgatattcgtataagtatggagaatagtgatttttttttagaatagaaaataataaaaaataattttaaaatgaagattattttttatgaggagtgaatatttgggtaaattatggttaagtttaaaaaaaatttatggtgaggtttaataatgttttgtaagtaaaaggtagagttttgtattaatttagaaatatttagattagaataggaatttatattgttagtgatatgagattgaatagttaaatggaggttatgtggagttggtattgtatttatcggtagtgcgggaggaatttttgagtggttattttaaggtttaggtggaggtggggtatggtatttgagatattttaaaacgaaggtttttgaaggattttttagaggtggttttggaatgatatgtgttaagttgtttggatttcgtgttttaagtgtttatattatttaattgtgtttaagaggttttcgattggaggattatatttaagtcgatttatgtttattattttatttttggataattttgtataaaattggattagtttggagtaggttgggagttaaatgtggtatttgtgattatgagattgatgtaatgagatagaagatgtttgttatttgaatatttattgttttgaaattagatttgaggaaattagggtttattttttgagaatttttggtaagggaaaagggaataggaaaagaaattttaaatttaggtcgaatgattaaggggatttataggaaattttgtttagagataagatttcgggaaggtgtttggatatttagaatattaagatttgaaggtgttttgtttaatggaagaggttaggatagagttgataaaattttgttttttagtgaaggttatagtaattttttgtttattttgtttgtttatggagagggtttttgttttatttttgttattttgggttaggagaagttaagttgggagtttgaaatagtggtttttggaaaaatggatttttagtgaaaattagagttttaagtttatttagtttattttatatttgaaaatgttagtgattattatttggattagtatttttaagtattagaaagttttaagtaattgttgtattttagtagggtgagggataagtaaaagaggatgtttattataatttaggaatgaagatattattagtaaagaattttaatttgtttagttttttatttagagttagttttttatagtattatttgaatatttttttgaaagaaggaagattttacgtagtgtagatttgttttgtgttgtttgaaaatattatttttgtaattatttttaatatgtaaggaatgtttggaatatttgttgtatgttaattttatgtagtttttttttgagggataaatttaaaataaataattttttattataaatttaaaggattgtaagggttagatttgttaagtggttttataggagatatatttagtaattgtgtggttagtggtttttttatttaataagatatattatagttatatgtttgatggtttatgttgatttaagatttattttgttaaaatttttttttgttgtgttcgtttttgttttgttttgttttgttttttaaagttttgttgtggtttttttgtggtagaagtgttttatgtatggtagtaggtttgttgtttttttatggcgatttttattgaaaatgtaagtaaatgtttgtggttttgttttttttatggtaaagatattatttattatgtaaaataaaaaataatatttattgtattttagtatatttatataattatgttattgaaaaaaattggtattaaaatttaatcgtattagaagtttattgtaaatataagttttatttaagtgtattaattaatatataatatatgttttaaatatagaatttttaatgtttttaaatatatttttaaagtat

SEQ ID NO: 174 - DNA, 67922 bp, Artificial Sequence
  Chemically-Treated DNA
gagagttagagtcgattgagttttagaattcggggaggtaggcggggtaagggtcggggtttgcgcgtgcgtgtgtacgcgtggaaagtataaatttacgagggttcgttgtcggtagggttaaggtgagtgagtgaaggcggtagattcgcgaagttttagtttcgcggatattttttttttaagttatatagggatttaagagaaattgaggtacgaagttggggggtggcggtggtggggattttgaaggtcgagtcgataaagtttagttttgtgttttcgtttttttttatatattcgagatttttataggtttttttttaggggttttcgttttgtttcgtagttttttttggggattcgggttttgcggtttagcgcgatttgtttggggttacgtgtttaagtacgaagtttttgcgtggagtttacgttttttaaaaggtttttaggggtaaagggatgaagtttaggagcgttaatgtgaggttaggtttagcgggttagggttacgaggttagggtcgaagttttagaattgattcgggagtatgattaataagtttaagagatttgtggaggttacgtttagattatgtttattttagtttttttcgagtttcgttcgtttttttaagattgggtttttttagtttgaagttttatttttaggatatttagtttcgtttttttttttttttagtttcgtagttaagtttaattttagggtgggagattaattaggtggagatttgggatttcgttttgggattttttggtgataatttttattttcgtgtcgtttgtttttttttttttttaggttcgtttagagttgagtttcgtttttcggttgttgtttaaattaggggtcgtggataaaggatgtttggggtttgcggttttacgttaggatttcgcgtcgaatattttgatttttcgggttttttttaagggagttttaaagattttaatggttaataggaaagtgggttcggtttgggtagtagtttgattggttttagttttcgggagcggatttaggggtaaggggaggggagaggggcggttttgggttttggggtgggaatcggattttagttgtggttttttttttgcgttttcgttcgtattgttacggcggacggttaatgggcgcgcggttcggggtcggcggcgttcggcgattggttgcggggttgtttgggggcggggtcgaggtttgaagttgaagtgagggatttagttgtggtgtgcgcggggtttttcgtcgtcgttttcgttcgttcgtttcgcgtttcggtcggaggaggaggttgtggcgtcggcgatagttacggtagcggtagttatcgcggcggttgcggcggcggtattttcgtttttattttcgttcgggattgttttttattgttttttcgtttttttcggatagtgagttcgcggcggggcgggggaaggagtcgtttttattttttttaagtttatttttaaagagatttttttttttttttttcgtcgtttggcgcggagtcgggacgatgttgattttttagattcggttttagttgcgtcgcgggaagagggggcgttttttttcggattttcgtttttcgtcgttgttttttttttcgttcgttttttcggggcggtttcgtcgaaggtagcgtcgaattcggtaatcggagtttgggcgcgaagcgaagaagtcggaataaagtgagggggagtcggtcggttggttcgggaagttttaggggcgtaggggaagcgggattcgcgtcgggcggggtttttttgcgtttcggcgtttcgcgggtagtatgtttttgcgggtagggggagttgggttgaattggttttttcgggggtttagtttgcgttttagagtttattagatgtgttttcgtcggggttttcgggttgcgtgaggatattttttttgaggggcgtcgtttgttttttttcggatcgttcggggtttcggttggttagaggatggacgaggaggaggatggagcgggcgtcgaggagtcgggatagtttcggagttttatgcggtttaacgatttgtcgggggtcgggggtcggtcggggtcggggttagtagaaaaggattcgggtagcgcggatttcgaggcggaggggttgtcgtattcggcgttggtttcggtggtttttttttatttgagttaggatagtcgttcgcggagttggtgttttcgtacggtttgtaatttatatttttcggggtacgacggttaggcgcggggttagaagggggacgggtcgtatcgtcgggggtcgggggggaagaagatttatcgttaggtgagtcgaagtgagttcggagggtaggcggatggggggggggttgttagggaggggagggggtattagagtgggagcggagacgcgagtaggtttcgtcggtaattcgggtttattttatttgcgtatatatattttagtttttttgggttgggggggtggggatttaggttaggagaagagagttgtgtttcgttggttcgtagttggacgttttttagatgtggttaggggagggtcgttattttttagatgtgggaagtttcgggagtttgggagttgtattttgttcgcgtcggttagcgagttgggtttggttttcgagtttggtggggggtgggtgggggcggtggggaggaagttgcggggacggaggaggggggatcgtaattttttgggtttttttttttttttcgttttaaagtttgcggcggattttagggtttgattttttaatttggtttttgaggttgaggtttttattgatttagaaggagatgttggggggcggggattaggttttggtttattttattttttatttcgcgggttggaggtataataaggagatttcggcggcggttgatgttaggggcgtagaatgagaataagatgtggtggaggggagttgtttgttttcggagttgggagtggagttttttttcgttagagtttagtgtcgcgggtgttttttattcgatttttattcgatgtagggtgtttaagattgggttggggagttttatgttggattttttttgtggagggaaagattgtgttaagagtttttttagtaagtgggggatggggttaagttggtttaggttatttttttttttttataaataaagagtgtttttgtagattaggtatgggggattgtaggttcgcgaaagttttgaggggatagtaatattgttagtgtgtttattaaggaggattcgggtttattattttagcgtagatttcgtagataggtttggggaatgtaagttttatattttagggagatggatttagtattgttttttgtttgtttaggttggagtggtaggggagattttagtttagttagattttagtttaaagcgttatttgatagacgtttggttttaagttttttggcgggttttgttatcgggggaaggaaaggtggaggggaggtgttgttgttattttaggtttggatagtttttttgggttttttttttttagtttagaggtttttatagatttagggtgggagattttaggttttttttgtagtttttgtgagtttagtagggattttgttttggggaaggggggtggaaggttggtgtcgtttttattttttgtagttttgttgtttttagtgcgtaaagtagggatgagtttgtggtttttttatttttattttttatattttgtgggtttttaggaagttttttttattatattttttttttatttattgttttttttttttttttttttgagttgtagaaagagaggtgtaggttttagaggtttgtgtttttgttgaataggtataattttgaggtttgagtttttagttttaggttttttttttttaggtagggatggagatggagaattgatatggttggaaaggatgggtttcgagtaatttttttttttgtttttaattatttattttttttacgaatgggaaaaagtattaatttttatgtttttttttttaagggttttaggggaggtagagagagttttttttttttttttttttgaaaatagatttttaggttagtattttttttcgtttgttttatttttaggtgttagtggagggtttggaggtagatttttttattgagtggtttggacgggggtaagtgttgaggtttggtatgggggaggagaggtgggaggatagtatttattttgggagttggggagtagttttttttaggggagtggtagttgggtgtgtggtattagtattattaggtttggagaagtttgggttggttgaggatgggttgagaataattttttggtaggggattgtttaagttgtgttttttattattgttattttatttaagtattaagagatatttgtatttttgttgttagaggggttttgaattgtttttagggtttttttttttttttttgtggtatttgtgattttttataggttttaggagggtttttgtacgtttttgagtcggagggatataaggatatttttttttatttttaattaattgaagttagttaggttttttttggtatattttgttttttggttttttttttttaagggattaggttttttagagaggagatttagatttaggtaggaagtgtgtgtgtgtgtgtgtgtgtgtgtgtgtgtgtgtgttgtaagggaggatagtaaaaggtttagaagtgtaagttttggtgtggagagtaggggtattggtagatagttatttttgttttagattagaggggagtatgttggtttttttagtatgtgtttttgtaagtgtgagggagcgcgtttttttttcggggaggagttttttcgtattttttttttggttgttgtgttatatttggaagtttgtgtaggagtttttttaagtttagagtttagtatagtttttttttatttggaaattataggttggtatttgggatgtcgagagagggggagtgggaggggggttagagggggagaggggagtttgttaggagtcgggggaggagaggggggggaggtttgaacggtaggagttttaatggtttttagaagtgagtgtgagtgagtgattgtgcgttattttgtgtgtttgagtgtgtttttttagaggggtgggggtataggagtttttggagttttttttgttatattgttttaatgttttaagtttgtttattttttttatttagggagaattttttatttttgtttttagaggaaatggtggggggagtgttttttttgtttttttattaatttttttttttaatttaatttttaaattttaagtttattagaggagattttggggagaagggttggggttggagaattgaatgggattgagggggggttagattattttttggtatgttttttgttttaggtttattttttttttgggttatatatatatttttttttattcgttttgttttatcgttttgttgggggattttttattattcgtagtgttagttggagttatttttgggattatttttattatatagttttttttattttcgtttgttttcgtttagtatttatttcgttttgtttgttttagttaggatggcgatagatataattgtttatacgtagatatgcgtacgcgcgcgtatatatatacgcgtatatatatatatagagttatagacgtttgaattagatttttggtttatttttttttttaaagattttagcgggtcgttttttttgtgtttttgtgttttatgtttttgtttttgggtggagtcggttgtttttttgtgagttttagtttttaatttagttggaagtttttttttttttatatttacgtattgaagcgtggtgaggggggaattatagggaaataggtttgtggggtggggcggggggttttgttgggggaatttttttttgagttttggagtagggcggagtttttatattttatgttattttaggggttgtcgaattcgatagatattaggagtttttttgtgggatgggtgaggtaaggatttatttttttatttttttatttattagaaggttaggatttttgggtttaggtttattttttttttaacgttttttagttttatatttttaggtttttaggtgggaatggggtcgttggagggtttgtttgtttttttagtttatgtttagagtttttgtgtttttagaggtgttttagttattttttttttttttttattttttttatttttgcggttgttaggttaagtaagggttttatttagataaagttttatatagaggatttatttgtggagataatatgttttagtttttttttttaggagggaggaaaggaggagggatggaagtggggtttttttttttgtcgttttttttttttttgtttttgatggtgggttgtggggagaagaaagattttttttttttttattttttttttgggatttattttagttcggatagttattatagtaatagtagatatgtgattgtataggttttttatagttattatggtaattagtgtttttcgtttttttggttattatggggatttgttatatggtttttttttaatttgataatttgtgggtttttttgattttttttttttgtataaggataagataatagttttagttaggggagattatgtgagaggggtttttttaattattatgataataaatttatattatttggtgatatatttttttgtcgttatggtaatagaagaatattatatagtgatatattgttatgtttttaaggaaataagttttattttgagaagggtgaaagattttttttttattaattatttttttatttagagtgttttaaattgtcgtgtgttttggttttttttttgttcgtttatgtttacgtgtcgtggaaggagagttgtatagggtgggtaggatgttatttggaagtaggttgaattgttaagggatttttaagaaggggttgatatgattaagagttgtgtatgaggttattcgggggtaggttttgtttgtaagaggtttttagtttgagtttgggtaaggtggggatagaaagaggggtaatttttttgtgaggttatttttgtatttttttttagttataagtagtttatttttgttaagggaaataaggtaggaagatttgaatggggatatatatttggtttttaggtagggagatttattgattggttgattcgtttatttatttatttagtttttttaggtattgattatttgtttcgtgttaggtattatagtaagtttcgtaggggatttaaagacgtattagaatgtttttgtttgttaggagttttagtttagtaggggaggtcgataagtgtatagattattaatacggtggaattttgttattagaggggtttaagtagatgttttgggagttttttttttttagagatttattgtttttatatagagatatttatttattggggttttttttagatttttttttttttgtagaggagaggaggggatttgtatggggaaagtagattagtttttgagggtaattgtgtttttttttttttaaatgatggttttttttttgtttttttttttttagggtgatttttggttgatttttattttggggagagatttattgtatttcggttttatttagaaaaataatttcgtggaaatagagtattttttattttttttttgttatttgtttatttttaaaaatttagaattttttttttaaatttttttatttttgtgagggggtgggggttagggaaattgtagtgtattaggattttcggggtattacggataggtggcgagtaggtatgtgagtttaggggagaagggtttgggtggtggagaagagataggggagggttgttaggggtttgagggatttatgggttatgggggagggtatgtggtttgggagttagaatagagatgggttatggttgggattagttgggaggaaggtttataggtttttgaatatttttgttggtttttttatgtttggttaaagtttttttattttagaagtaagattttatttgttttgggttttatagagtttggtttggtgggttatgttaggagttgttataatattttttttatttttattttttagggggtttttggttttttttttttaattttttgttttttgattttttttagtttttttatttttttttattttttttatattttttttaaagaaaataggatatttggttatttaatcgtgagtttagtgtttggaattttttaaggttcggaggtcgttttgtatatttttttgttgatgggttggaaatgagttattttatagaatttattgtatggaaagatttagggtttagaaagaattttttttttttgtttgttgttttggttggtttgggttggaagttataagtaggtgtgatggcggtaatggttttttgggggagggggtagatattgtttattttgtacggtttgggagttatgtttagtatggtgtttgatatataatgggtttttaatatttaaatgtgtgaatatgtttagtggttatttgagggtgttgagaggttgggaggttggtggtggaagagggagtttcgggttttggtgttgtagtagcggggattgtagttgtggacgtttgttttatatttagtgttagggcggttatgataggtagttttgtttgtttgagtagttatggtgtgtagaggaaattattatagattaggagtttggaaattatcgttttattttgttttttcgggtgatttttagtatatgatttcggtatttttgggttttaattttttcgagttttggggaagaaaatgatttattttagatattttatagggttgttgtgagtattaattgtggtattgtgtgaaagtgtttggtaaattgtaaggtaggtataattcgattttaggtttgtataatatatttatatatagtattttatttgttttttatatttattttgtgaggtagggagaataggatttagattttgtagtaaatttatggtgtttggtatttttataggtatgatcgatttattttttaaatggtttgtgtaaatagttagggtatttgtggtttgtttttttttatagatgaggaagttgggtttagagaggtgagatgattaaggtgggattttttttttttgatgaggagtttggggttgggggttggtttgcgtgtatgttagggttttggtattatatttgtttagttttagatggagttaggaggtaaacgaggaggaggtgttagggcggggtcggggggtcggttttagttttagttttggttagttgtttttttgattgttagtatttggtttgagcgtattagtatgttggttattttttttaattgcgtgattttgggtatgtttcggttatgcgaggatatcgtttgtgatttttagcgttgtcggattttgtaggtgagtgtgtgtgtgtgtgtgtgtgtgtgtgtgttgtgtgtgttgggggttggttttttttaattttaatattttttatttttttgtaagaggttttgatttaattggtggggattagggtgggattagagggtatttttttatttacgttttagttttagttattttttgtttttatattaggtttttgatgattttatttttgttttttttgtcgtggagatggtggtgaagatggtggttttgggtatttttgggaaaaagtgttatttgggagatatttggaatcggtttgatttttttatcgttatcgtagggtgaggatttgggttggggtgggagagtaatggattagatcggtttttttttcggggttagggttttgggtttgtgattttttagttttagtttagttatagtattattttttttttggttattttttgagggtttgaggttgttttgtttttagtattgtagtttatattttaaattttaaggttttatttttaattttgtttttttttttgatgggtaatttgtttttgtttcggggtagttttgttttttagatagagagtcggatttttagggttttttggtgaagaagaagaaggagttagaggttattttgttgtttttaaagtaggattttttattgattttttttgattttattgtggttttagatttaaagggtttttttttgggtttttttttgtaggatgttggagtattcgttggatttgtagaacgttagttttttagttgttaggatagttcgtgtgttgcgatcgtttagggttattaatcgggtgtttagtgagtgattttttagtttttagtttttgaagagagttttaggaggaaatgtggaatttttagattttatttttattattgtgtttttatttgattttttataggtttcgttagagaagggtttagtggggagttgggattgttggaataaaatggaatttttgaatgtggtattatgggagttatttgggaaaattttattttattttagtttggttttaggttagagttttagaaatattttagatgattttttttttttagttagatgattattttttttaggaggataggggtgtggggattggagaggttgataggtaaggagtggacgtaaagtgttaatggttttttttagttagaatagttttttatgtaatttggtttttgttggtgagatacgttggttacgttgaacgtgattttttttaagataaggttattttatgttttatttttcgtttttgttttttttttttttttcgtttttttttaatttattgtagtaattgtcgggtttattatttaaattaaattgtattggtttttggagttagcgaggttttggtagttttagttttttttatatattgttttttttttttgtttaggttttttttgtaattttttaatttatataagttgtagatggtttttgttgtggttttaggagtggggtggttggcgaggaatgtatgtttttggggtttagtgtttgtttgtgtatttgatgtagtagtagttttttgcgttttgtgtgtgtgtgtgtgtgtgtgtgtgtgtgtgatgttgttgttgtttttgggagggtagagttgttgaatgtgttttttggggttcggggtgtgttggtgttaataggagttttagaagaggggtatgtttcgttttttttttcgttttaggtgatggttggtagatttataggtttttgtttaattatcggtgtaatttttttaatgtaaattttgaggaattgattttagttggagtatagagaagttgaagggggatggggtaggaggagggggagggagattgagtgagaaaattgggttggtaggggcgaggttgggcgttgtagttattaagagggttaattagttgttgtttagtagtttttgttttggaggggttagggggttatagatggtattttgggggtgaagttagttattagagatttgtttgtttgacgagggtttggcggattgggggttggtttagattatttgggtcggttgggttttagatttggagtacggagagagggaagtaattttaatagggtttttgaggagggggttttagtggttttttttatggagggggttgtaaattgatggatttttgagaagatagtattgtatttttttaggttttgatttggggatttggattaagtagggaatagttttagggaagtagggtttagagttatagtgaagtatagggtattttggtttttgtttaggagttggtttttaaaatgagatttttgtttgttgttattttttttggagttcgttgttttagtttttttaatgattttggtggtgataatttagaaaggttaagtgattgtgtttgttgagagaaggaagtaggtagggagtgtgcgtgtgaatgtgtgcgggtgtgggtgtgtgttggagagggattcggaagttaaagtttgggttcgagtttcggtatttatatttagtagttgtgtgatattgggtgagttaagttatttttttaagttttagattttttatttgtgaattgggagtgatattatttatatgtgatgatgttgggagagttaggaggggttatagtttttttagtttattgttggtggtattgtgtagattatcgtgggtaagttataaggggaagtgggtcggggtaaggggttgtagaggttatttggggagttagaggtgtttgttggttttttttttagtttgagtcgggtcgttttagttttagagtttttggtggggttttttcgggagtgttgtcgggtcgtggtagttagtttagttcggttagtttggtgtttttagcgtggtttttgtttttataggtatgcgtatttttgttacgttgttgttggatacgttgtttatgttgggtaacgttttgttgttttgttttttcgttttttttattttcggtatcgtcggcgtttagttgtgggtagggttgtttcggaatcgatgttttttatttgagaattttagtttgtgagtggtggatagggtttagggaggatttgggagtggttatggggttgggtatttttttaagttttttattttcggttgttattgatatatttgttttaatatttgagatatatttggtttttaaatttggttatttattggaattatttggggagttttaaaaagtattgatgtttgggtgttatttttagagattttgattttattgttttggggtttagtttggatgtaaggatttttttaatttttttagtgattttaatttgtagtgaaatttgaaaattattattttaggatgtgattttttaatattttgagtttggagtttttttatttaggttttatgtttttggtgtttataaatttttgttttgtttagttttttttttatttttggttttgttttgtttattttatatgtttcgagtattcgtgttatttttttttttttgggttttttttttggagagtttattttttagttttatttttgtttttttttttattttgtagttttttgagcgtggatttggagcgttattattagatagagaacgaggatgagagtttttttatttgtttttagttacgcgagaacggtatgcggttttgtagaagcgtgtttacgttgcgcggggacgggggcggtggtttattttgcggtttggattatgaggtttataatagttttagtaatattatttgtgttaattggaattagtattatattaattgtttagcgggggagtataatttttttaagggcgttattaattttgataatattggttatgtttggatcgttattttttaggtggggtagtttgggtttcgggagtttttttagaatattagttttaggatatagtttaggatcggagtggtcgtttttagggttggggtgggggttaaggtttttggaggagattgaaggaggatttggtgggtttatagttagtttgtttttttgtattttttaggttattacgttggagggttgggtcgatattatgtattttgtgatggatgtttattttttttataattttatttattttattttttttattatcgtgagtgattttttagattttcgtggggatgggcgattttggggatatttgtgggggtagtttagagaggggatagtttgttttgtttgaagtttttagtttttaggataagttttgtagagagggtatttattatatagtaggagggatattagatgtagagttaggaggaaatttaaggttaaggcgggatttaattgttattgggattttgggtaagttattttttatgaggtttttagtattgttttgggtttttgtttttttatgggtaaaatgaatggtttttaatttgagatgatattattttttttagagggtatttggaaatgggaaagggtgattttggttttgattttttttaatagttttattgagatataatttatatattatttaatttatttttttgaatgaatttagtggttttttaagtatgtttatagagttttgtttttttgtaaggataaggggagtgtaattggtaatttgttattgggggaggggagagaagttaaatattttgaaatgtttgtaaataaagaattattttatttaaaattttgattagtgattaattggtgttaaatgttgtttgattttttatttttgttagtttagaaattgttagattttaagaaggtagaagacggaggtaaaagtagtaatatttaatagttttaattattattatttatagttaataattttatcgttattattttgagttaatatttattgagtatttattatgcgttagtttttgatttaagtatttttaatgtgttggtgtatttaatttttatcgtgattttttttattttatagatgaggaaattgatatttttttatttatttgattttattagacgttttgtttatgttgtgtattaatttttaagagtggggtattattgttgacgtatgttgtaatatttgttgtttgtttaattttcgtcgttttttgtgaggtgttagggtagggattgtggtttttattttttaaatgagaatttagcgttttagagggtgggttattgggttaagattatatagaaagtaagcggttggggttgagaatttagttttaggttaacgattttatatttagttttttttttatgttattaagaggttaacgatagagttagatagagggatagatattgagagaaagagattaagaaagattaagatttatttaggatttaggattagttttagagagagatgaagataaaataaggtagttttttgtgagagatagagggtaggttttgagaaagagtaagtttttaaggttattttattttgtttgcgtaattttttttggtgtagaagagtgggtaggtttggggcgaagtttgattggaggtttgtttttatttttggttattattttaaggggtgaggttagtgttttagggaagtggggtttttttattatgtgttttttttatttttatttttttttttttttgggtttgggagagggggaaggaagtagatagggagataaggggtttagtttttatttttttatatattttttgaaaaattttttttaatagttttttggaattatattagtgaagttaattattataattattaggatacgatttagaaaaaaaaaatttgttttgttattataaatatttattttttttatttgggattgttgtttaagtaatggttgttttagagttttggggaaattgaggcgtggagatggggattggggtagtgtgagtaagttaggtggtagtttgattagtttgtagggttaagggtttagttttttttatatttgagggaggggggtatagggaaaatggggatagataaggttaatggtttttgtttttagatgaggatatgaggttttatggttaagggtttttcgtttaaagttatatagttagaattggggttagaagtaggagttttgtaaatgatgtttttgttaagattttaaggtttaatataatttgaaaattttatgtttttaatattgcgtttatttttatagtattcgttatttttaatggaaattgcggaaggggtgttgcgtttttgtaggtgtgcgtgtttagggatagggaatttgagagattgtaggataatattatgtttaatagtaatattttggaattttatagagtttggttttagttttagttttgttttgaattagttgagtgattttgggtaaatgtttgatttttgtggatttgagtttttttatttgtttgatggagattataatagtattattttttgaggttgttttaaaaataaaatgagataatgtttggaaaataattgagcgtggcgtttggtttataggaatgttttcgtatgtggtggttggtattgtgatttatttttttttaggatattttttttttttgtttttatttttataggtgggttttttttttatgattaatttgtgtttggtggtgattgttacgtagtttttagagattaagtagcgggaaagttagttgatgcgggagtagcgtgtgcggtttttgtttaacgttagtattttggttagtttttttgagttcggtagttgttatgaggagttgtttaagtatttggtgtatatttttcgtaaggtagttcgtaggttggtttaggtttttcgggtagtaggtgtgcgggttgggttgtttagtagtttagtatttttcgggggttaggagatttagtttagtagtagttgttttcgtttttatcgtcgtttattcgtttattatttggtgtattattattattattattattattattattatttgggtaatgggacgtttagggtttttcgggttagttcggagatttaggatagggatgttaatgggtttcgtcggtttatgttgttattattttcgacgtttgtttttttcggggttttttttggtggcgtagagtttgtgtatagtttttattatgtcgattgttatttagagttagttcgttgttaggcgtttttttttaggtttttatttgaggtattcggtaggattgtgggtagcgggaaggtgtattttatcgtgtatattagttttttatcggagacgttgaaggagaaggtattagtagaggtggttgttagttttgggtttttaatttttattagttttaatattttattcgggttttatagttttatgtataagttgttggagatatagagtataggtgagaattttgggtggaggtatgtgggtgttttcgtttggggattgggtggcgttttagaggggattagggggtttggagttagagggattagggtttatatttttatgttgttttttatggtttaggtatttttaattagttatatttttgttatgagttcgaatttttttatttgttaaagtggaatttataatttttatattgtaatagtagtaattattatgtaataagtatttgtttcgtgttgtttgtaatgatgtttagtaattgttgtatatagtaatggttgtgtgtttgttatatgttttgcgggtaaaattttattggattttttttatttattaagtgataggtttttttagtatttttattgtgtggatgagaattaggaggtttgaggggattgtatgatttgtttaaggttttgttattggtgaggggcggattcggggttcgtattcgggattttttgttgtgaggtttagagaggaaatggtgtgtgattgtgtttagttttatgttttattggttaaatttgagttttattgttttcgtatagggagatttagtttagggagttgtttgtttgatgggtgatatttttagtgtcgtgggggtagtgagatatatagggacgtcgggttttttttagtagataggtttattgtagttgtagtttacggtttgtgttttaggaaggatgtggtacgtggggagtagcgggatattcgtggggatgttacgtgggaatgtgggttgggattagaaggtgttattatagaatttagagcgaaaggtttttatgttagtttttttattattttgttacgggacgtgggttagttatatgtatttacgtttttatttttttttgtgtaaaaggtaaggttgggtttataattatttttagtgggtgtttattgatttttttttgtgtgtagatgtagttaagggagaaatgtcgttgagagtttatttggggttaggttttgagcggggggtttttatatttatgttttatttggtattttttgaggtttttatattttgtgattaaagttggatttaaagggatattgatgttttgggttaggtttttgagtgtgtgcgtacgagtgtatttagtatgcgtgtatgcgtttatgtttatgaaggggtttagtgtgtgtgtgtgcgtgtgtgtatgtacgtgtttggtgtttatatgtatatgtgtgtatatgtgtttgatgtgtgtaggtgtatgtgcgatgtgaagttttttttttggtgtgtgtgtatgtgtgtatatgtttggtatatgtgtcgtgtgtgaatgtgtttgtgtatatatgtgttggtatgtgtatgtatgtgtgtttatatggtggtgtttaaatagtatatatgtgtatacgagtgtgcgtatttggagtacgtgtgtaggtgtacgtgtttggtgtgggtgtgtgtgtaagtgtacgtgtgtgggcgtgttttaaggattttatggaaagtgttgtttagaatagtgttgatgtagttttggtttttgggaaggggaaggggagcgaggttttttgttgaaggtatttaggatataggagttgtttaggattttagaggatatttaggttatttttttgagttttaggatatttagtagtgattgttaatgaagtgttattgatattagggtattttgtgggttaagattgtttattttgtttgatatttagtatttttggtttattaagtgtttagtattttattattgtaataattttagattttttgatttattttatatatatttatagggtagggtagttttaggtacgagattttggagttttttatttttatttttttgttttaggtgtttgttaaagtttttgtaagatttttagtttttgtttgaaagtagatagtggagtttgtggtttagatagttgtttttattgtgttcgggtcggggtaggggaggtggagttcgtcgatcgtgaaatgtttgatttagatagcgaggtagtttatgagtttatataggatgtttagtatagcgattttcgggatttttatagtcggcggtaacggagtttgggtttagatgtagagtttagttttgtgttggttttttggaggttaatttgtgatatttttcgaaagattgtggatagtaagtattttggtcggggaattatgatcgttattttggttaatatatttagtatgggtatcgaatattacgagtaggtaggagagtgggtagaggtagggtttttgttagttgtttttcgtttggggttggggttttttattttttttcgtatttttttttttgagtttagttttttttttatgttgttagtttatttggtaggtaggaggggaggtgggtgatggagtaatgtatggggattttttagagggagtgtttaaagtttttgagtatggaggtcgttttaggtaggttatagggtatgttttatttaggaaggttgtttagaggaggttggttttgaaggatgtgaataagtggtgagtattagtatgtggggagaggcgcgttattgggagatgtttgggtttttggagaaggtgtagtgcggagggcgggtgttggaggttttgtggtatttatttgatttattaagttcgggtgtgattgattggaggtaggaggggttatgtaaataggggtgtagaggggagggttggtgtttgcgtttgggtggaatgaaggtttgttggggttagggagggaggtaattttttttggtttttcgtttgggagtcgtgttgtgaattagggtagtttagggtggatgagagtgtttagtatggtaaggggatttgaagttatcgcgtttgaggaatgattttaagaatcgggatgtttagttaggaggagtaagggtttagtagggataggtaagttgtttttaaatatttgaagggttgttatgtggaagaggaagtaggtttgttttgtggggttgatggttataagtaataggatttgggttgagggggaggaggtttttttaatttttagagttatgtagagatagaaagggtagtttgggggattttattgattttttattatgagttgaagatgttcgtttgttgggggtttaagtaggtattatgggtttttataattgggtttggtttttttttttatagggttttttttagaagtcgttttttttttttttagtttggttttttaggttatttttgtggttgatttttggaaaaggagagaggttagtaagtaggtgttgtagtttacggtttttttaggttttgtttttttgggtgttttggtttttttggggtagtacggaggtattgggttattagaatttaattttttttggtttggaacgaaggttatgtatttttttattttcgtatttttttaattaggagtagaggcggagggggttagtggtgtggagtggtttttatattagtatagtattttgtgaaaggggtattttaaaaaggtggtataggtagggtggtataggtatgttgggaggtttgggttgaggttgaggggtataggttaagtcgggtttggagtagatagtgaggtgtttattttttcgggggattcgaagttcgtttttatattattgatttttgtatttgtaatatttcgagtatttagtttttatttaagattgttcgatttggttaggtgtatttttttttattattattatatattggcgtttttttttttaatttttatagggttttttttaagtagttatgaggtggagagagagtgggattttggttgtagtgttagcgggtgggcgtatttgatattacggtgggtatgttgtgtttgggttacgtgggtgtgggtgtgtgtgtatatgttaattttgttagttttttagggagaggtgttttattttgttagattggtggtagtggggggtgggtagtattttttgttttcgggatttaggtggtgatagtttttaattttttattatttaggttttttgaattttagtttttttttttttatttttgtttcggttatggttaggtgttttttttttagggggtatttttttagtgttttttttttatttcggggggagtatttagtagtttttgtttagtcgatgttgttggtggaggttttgattgtattgggaagaagttgagttatatagatttagggtagatgaagttttggtaagagggtttttagttagatgttaagaaggacgtttttttggagagaaggtagtagtcgttagttaggggtgtttgtattttttttttgtttaggtttttgaggaagggcggagatagtttagggtttttattaagtttttagtagtagggaggttttatttagtgatagtagtgtttgttttagggagggttttgttcgtatatttggtgttgagggttttatgggggtgagcgggagtttttagtaggttgggtagatgattgatagttgtttagcgggtttaggggtgcggagagtaagaagttttagaagttgttatggttttgtgtttgtaggtattgcggcgtgaacgtttcgttatttgggttttggagtttgagtaggttgggagtggggggttgttagggaaggtagtaaggagatgtggggggttgagatagagatatagagtgggtatagagagggagatagagatatatgggggaatggggatatagagggagatagagaggagattgatgggggcgagatagaggtacggagggtaagatggagacgggggaggagggtaggaagagagacgcgtaggtaggggagaaaggatatggagggagagatgagttatagcggagatagatagagataaatggagttatagagatatatagggagatagagatatagagagggagttgaagatagagatcgagttttagatgtaaatgagggtagagacggggtgggatggggagatagagatttttttggagttggttgtatgaggaggtttacggtttttttgcggtgtttttaatgaggtaattgtgtttattgatttcggaatcgattggatgggggggcgggtattggaaagggtgttgttggtgttttgttagaggaggagtttttgtttttttttttggtcgttatcgttgttttttttaggttttgtttttttttattattttttggttgatttattattcgtttgtttcgtttttttaatttgcgttattttattatttttttgattgaggaagtatttatatgtgatattttatttcgttcggggttggttttatgttgttttttgttttttgttttttttattttttaattattagttggaggagaattggtaggattgggtttgtttagagggttggtgagaaggataagaatttaggagattgaggagagagtaagaaaatgatttgatgtcgaagtgtgatttgatatggggttagtttatatgtgtgttttattcgtttagggcggtatatggagtttagaatttttttttaatttatttttttgtattggagttgggtttaagtagtgatttgttggtaaatgattaataattagtttttttaaaataataaagttttgatttgtagtatttgttaatttttatggtgtaaatgtttttattatagttggttttaagttattaatacgattttatcgaatgtggggttgggaagagacgtggataattggtttttttaagttagtgagaaatagttttagtacgttattgggtttaaggtattgtttttttttttaaagaggttataataagtaaacggttatatttatttgatgtggtatatgtttagagagggatacgtggaggaggagtttttaatttagattagagaaggaatttagggagggtttcgtgtaggaggtgatttttgggttgagtttgaaggaagagtaggatatagttagtgaaggtgaagggtagggtatagtatgagggtttcggtagtggtttaggtagtttatattatatttttatttttggaaatggagagtagagggttggggagagttggttggtagttggatttgtaggatttaattagttggaaatatgggttgagaggaggtagtaaggatgatttttaggtttttatttggggtgggagtaatgtggtttgagtagatgtgggttgggagatatgttgtatataaggtgtttgcgggttattttgattatatttagtaggttgtcggagtttagaaaagaagttgtttttttttttgtgttttgtttggttttgtattggggttagatttttttaggaagaggggagtgtaggagtggggttttggagatataggagttttttaatattttttttttggttttgggttatggtggggtgggggataggtgttagtttaatgttttagaagagggataatagtatatggggagaggggagttatatgtagtttagtggttttttgggttgtagacggggagaggaaggggagggattagggtagatggttttgtaggttgagagaggatagggtaggtgatgattttgtttattgtttatattttggggttattttgttattttagatatatgtttagagagggtttttatttataagtgagtgagtttggttgtttaaggcgagagaagttgggggtggggtaggaggaggtggtttagatatggtaagtttgaattttgaaggaggttatagatttttttttagttttgttgaaggttggggattttttttttagaaaatttttatatgtttggatattttaaatgtggtttttgagggtaaaggttgatggatattttttattttagttagttttttggtttttagatagaggagttttggttgaagagttagggttgaggattaagtagagttttgggggatgattttttgtagttgattggttttagatatttaaaggttatttggtgtgggagggagaggggtattgttttggagatgtttgttaaggtgtttttttgtttttttaggtattttttggttttaggtttttttagttttgtaaataaggggagtatattttgtgtatagtatattagaatagaatattagaatattagggggttgggggttgagttagaaatatttaagaaatgtaggttttggtggaaaagttattttgttttatggatgattatgttaaatgtcgtaagagaggttttaggggataaaggagagttgtttatttttagttttttttcggaagggttttacgaaggtggtggtttttgaacggagtttcgaaagatgaatggaattgatagtggtttgggtggtgggggtggggggaggtgggagatggaggggtgggtaggagtagagagatttaggtggagggattaaggtatatgtatagggtggtattcgatgttttgaaggatagttaggtttttttttttgttttggtttcgaggtgtttgagtagtgattgatgttagtttagcgaggaagtcggtgttttttattggtgtaggttgggtggaggagggtttagaggttatttttgttgtttagattagaggtaaagagggttttaagtaaggttatagttatgggaacgaggggttgtgggtaggacgtaattttattggtaggttttttgggtcggggtattttagtgtttagagggaggaagggtgggtaagaattttagataattcgaagtttttaaggtagaatttcgagtatgatggcgttattcgggaaggagtaggtttgggagaggaggcgagagggtttgttttggatgtattgagtttgagatggttgtgggttattttaggagggagattaggtaggttttggatttttggatgagaagttaggggtttggagagattgtttagtgtcgtttatattttagtgatagttagagaggtaggagtgggggtattggtggagggagcgggtttagattgaattttgaggaatgttggtttgagggaagagaggcggtgaaatgagtattgggaaggggaagaggtggttgtttagggtcggggaagttaagggaggtttagttgttgttgaggtatttattaagaggagggttgggaagagggtttttggatagagttggagttgtggggtttagagtttagaattgaatgagtttggagttttatagaagttttttgtttttaggtacgggggaaggagattggagaagtaatggatgtaggtataattgataggttagggtttaggggagtcgggggcgggggtagggggtgataggggggcggcgggggagtatattaaagaattaaagtgtaggtggaggaacggttggtttttttttaggagaggaagagagatagtgggatgtataatatagagttttttggaggagggacgtggagttttttatgtaagtttgtaacgaggggttaggtggggagtagggttgggggttgtagagtttagaaggattgaggtagtttttgggggagagaggagatttaagaagggaggaattagggattgtgaataaaggtatgaaatagttatggggttattatttatagggaattatttgtttagttagtatatgttcgtgtttttttttagcgatatttagtatttttagagtcgtagaggagaggaggagggtaagggtatttatttgggttggggttgggtagggtaggagtttttgaaagttttcgttagaagggtagtttttatgtggtttattgtggtttattatgggttagacgttgtgtaggtggataaggtataggggttgtagttttagtattttattatttatttattttaagagatggaattttgatttgttttttgggttggaatatagtggtttgattatggtttattatagtttggaatttttgggtttaagcgatttttttattttagtttttttagtagttgggattacgggtatttgttattatgtttggttatagttttagaattttaagtagtaggggttttgggttagttgttttgaagttgagtgggtatcgtgagtgtgttgtgtttagttagtttgtgtgtttatttttgagggtttcggggagttgggaaatattatgttatttatattttaatgatagtggagaggtgggagtgggggtgttggtggggggaataagcgtagaatgaattttgaggaatgttgttttgagggtagagaggtagtgattgtggttaaagtttttttttggtattgtttttgattaggaggttttgggggtattatgatatttagtagtgtgtttagtgggtaggagggtataggaggggggatttaaattggagagttttcgggggttggggaagattaggattatgatttatatgatgaggtttgtgagatttttaggaaattttttgttatcgaggtgttttttgattttttatatttttttgaagatttgttttttattgatttagtgatttttattgttttattgtagtttgtttgtgtttttgttttgggtgggtgggagtagtaggtaggtttattagaagtagaggtgaggtgagttgaggagtttgaatagaagagtagagattttagggttagtggagtaggtggaagttggggcgatggtagttggttggggtcgggtttgggtagagtacgagtgattggtttaagtttttgtttagttttgacgaggtttgtttagttttttatgttttttttgtaagaggtatattattgtttgttagagttggtttttaggttttttgtttggattgttgtagtattttaattggtttttgtttttattttttaagtcgtttatacgttgttattattgtagttagattaattttttttatatattgttttgtatattttttttttttttttttattcgtttttagggttttagtggtagcgtggtaggtagagatttgtttagagggagtagaggaaggttgttttatttggttttgtcgattttgtagtttttttttttattagttttttttattttttgatttgggtagataatttgatttttggttttgtattgtgttttgtatatttttttttttgttgtttttagttggggatattttttatggatatttttttaggttgttttttttattggtttattgattttagtcgggattgagttttcgtggtttttgggttttgtttttagtgtggtgtttagttgtagttttgtagatatcggttttgttttttgtgagtttggttttggggttggggttttttatagttttttatttttttgttttgtagagtagttttttaggaggtagtgttattttgtttaatagaagaggttattggggatttgagaggtaaagggaattgtttaaggttatataggaagaaagttttagagttggtggtatttttttaatattagtgtttggtatatagaaggtatttttagggttagttgatggagtagttatgaggtttggggagtttcggtgttgggaagtattgagtagtttaacgttgttgtaaggtgatagtcggaggggaggggagtggaggtgttaggaaatgggagatggagatttatagttaatattagtatagataagagatttgggatttttgggtgggataagtttaggttgtttggttttattttatcgaaatttttattgggttttgatatttgtgaatagtaggaaggatgtaggttagatttgggaagggatttttatagttgggggtggttagtgaggggtggttggttttagtttgatgagtttgtgtgttttttgtgtgagttttgtttgggtatatggtgggggcgatgttgtggaaaaggttttgagggtagagatgtagagggaggtataacggatttggttttgtatttttttaggagggtgatgtgatttttattaaggtattatatttttcggagttttagttttttagattatttaggaggtttatagttttttttcgtttgttgtgagtagggaggaaatgaaattttacgaggaggtttttagtttagttggtttgtggtgggtattgttagatgttggttttatttttgtttttttttagtcgtaattatagttttggtttttggggtaattttgttgttaagattgtgtttttatgttttcgttttgtattcgtagatcgtttttagtttttaatttagtaatttggatagatttggttatttgggggaggagggttttttttttatggtttattggagggaatatcggggttttggagaagaagtggtatttattttaagtgttgtagggagattagagagagtaaggtagggtcgagggagtgcgttaggtttttttttatttgtattaggttgttttgtttttttaggtttggagttatttggttgggtaaaataggggttttagtttttgttggtatagtttttgataaagtttaatgaggtaagttttatgggacggtaggttttttaggagtttggtattatttttttttataagtttttcggtggtgtgtaggagagtgaggtgtgtacgtgtttataagttattagtatagatttttgagagtttcgtggataatatcggggagtgaagagaatagtttttttttttacgtatagtagtagtcggatttttagaatttattgattgagtaaatatatgatattaaaagttattgtgtttttagtaatttttaaaagaacgttttattaatttttatttttagtagttttttgggggtatagtttatatgttatgaaatttgtttattataagcgtattttagttgtgtttttatatcgagttggtttttatttttagaattttgttgatttgaatataattttagaagatacgttgtgtatttagtttatcgtgtatttggatttataagttttttattattatcgtggtttggttttgaattttgattgtttaatatttttggagttagagggatgtgggattgggttttattttagttttttttgttttgtgattttgaatattatatttgtgcggtttatgtttattttaatttaatttaaggttcgaaaatacggcgagtggtagagtgatagggaggagggtttgtcgattttcgttttttggtagatcggatttggaagtatagagtggggggatttatttagttaggtggggtttgagtttagggttttatatgtattgattttggtttcgttttattttttgtattgtgtttacgtcggagatattaatggttttgtgtgatcgggttaattaggttaggtggtagtgtttttatttataatttacggagttacgatttatttgagatttgttggagtaacgggttttatgttatattggtttttacgatagttattttttttttgtatagttggttgtttgtttgtttgttggttttgattttgtttttaggtttgtttttgaatagtttgaaagtttatttttttttgagtaattgttgttttcgaggtttttaaatgtcgtttatttgttagttagaagttttttgtttcgagtttttttattttttatttaagttggttgtataaattagggttattaggatatatttgggtgtttttaggtttggttgtaggtttggttgggtagttggttagcgagatagtgagaagtaaggagaggtgtttgatggaatgagtgttttatttgaatgttttattaatttatattttttgagtagttattatggatttggtttttgttttttaggttagatatttagtttgtttagatatttattaggtggatagtggggtttattgagttaattatatttttttttgtttttttagttttttgtttggttatattttttttttttttaattagaattaggttgaggttgtttatgatttttttatttcgtgttatattatttagatttttggttggggagattttataaatttttaggtatttaagtgttgttttttttttaattaagtttttttttgtgtgtttattttttatttttttttttttgaattttcggatttgttgtttggataatttattttggtattgaagtatttaaggttttttgtggttatttagtcgttttgtgtgtgtataacgtgtttttagtagatattgagtttttgggaggcggggcgtgtggttggtatgtttttgtagtttttttaatgtttggtgtattgttaggtattttatattgaaagcgaggttattagtgagttggaatggtagatgagatagggttcgttattcgtttttttgaggattttagggtgtatttttagttttagttttagattcgggtagggagtatgaaaggaattatttttggtgttttatatttggttagagaggttgagaattttgttgaaggttatagagtgagtgataggataggttgaggattaattcgggtgtttcgggtttaggttgaggttttaggtgtttttttaattgtgataattttttttgggtgtttgcgtgttttttttttgtttattattatgtgtgtgattgggaatgcgtgtatttttttttttttttttttttttgtgtgtgtgtgtgtgtgtgtgtgtgtgtgtgtgtgtttggaaggaagtaagagtagttaattgttgtttaagagaaagttgttaagtttatagagtaattgtggaatatatgtgacgttgtgtggggtttgacgatcgggtgtgtttgtgaggttttggcgatcgttttttgatattcgttagtattgttatgttgttggtttgggttcgttaggtttgtattgtagtttaggttaagatgggttatgtagtttttagtaggagatagggcggaatttatattataggttttttattgagtttgtggtttttgaatttgagatttagagttggggttatgggttttacgtggtttttttttggggtttttgtttttgggtgtatttttttttggagtttttggggtagggttttttttatgggtttgagtatttagtaattttttcgtataagtttgttatttttgttttttttttttttggtgttttatgtttggaggattggatcgaggggtttagtgataagttagttgttttatattttattttgttttgtagttcgaggagtttattaacgttttagaaattagtaatatcgtttttattagtttttttgttttggagatgttgttgaagttgtttgtgtatggtttttttggttatattaagaatttttataatattttcgatggtgttattgtggttattaggtatgattatttttcggtattgatttttagttgaggaatggtagtaggggtggtttggggttaggggttatgttatttatttttttggggtggaggggtttggagttaggttttattgattttataggatttgttattttttttaggtggggggttttttgtgtttttatgttttttttattttttttttggttttattttgtttttgttgattttgggtttatttttttattgtttaggtttttttttagttttttttttttatttttattttttgtttttgattttatttaggtttgggatgggcgagggtgagattggttttagaggagttggaagaggtatgaggtttagttagttgttcggttcgaaaagtgtttggaaattattttagatattagtaatttgttttagggtttttaagattttgggaaagtgtttcgttttcgtaaggtttggggttaggagaattattttattgtttttggaattggttttagattttattagaagagaataaagtaaatattttataatttgatgtagttgtattggttagatttagggagggagttgtttattgttaggatgtgatttttggtagggaggagagggcggagggggtcggggttgttatttaaatttttattattttggaggtttttgtttagaggtttgggggtttatttgtgttttattttttttcgacgtgtttatttagttaggtttttgggtgttattgagtttttttcgagggagtagggggagagggtgaaggtgtagggggtttaggttgtttgttttttttgtagcgtgtgggagatcgtgggttagtaggggggcggtttgtcggtgttgcggatttttcgtttgatgcgtgtgttgaagttggtgcgttttttgtcggcgttgtagcggtagttggtggtgtttatgaagattatggataacgtggttattttttgtatgttgtttatgttttttatttttatttttaggtgagggcggtatggtattttgtcggttgagagatcggttaggttgggggtaggagggtttgaggggtgaggagtattgggttttgatttttagtttgtggtttttttgtgtttatagtattttgggtatgtattttttcggttgtaagtttgtttttgagcgggatggggatattttgttagatcggaagaattttgattttttgttttgggttatcgttattgttttttaggtgcgagggtaatagggtagggcgtggataggggtcgttaggtgtttttagtataggttttgatttttgttttttgttcgtagattttgatttaggaggattggaataaagttttttataatggtatggtttttacgtcgttttgggcggttttttattttattgtttttatgattttcggtaattacgtgttttttaatttgttggtcgttattttggtggagggtttttaggcggaggtaatttattgttttgtttattttattttgtttatagtagttttatttttaattggttgtttgttttgagttttttttttttgttgttaattttgggggtttgggaagttttataggaagagttttttagattaagtcggggtggattagggcgggaggttttagatttcgtgtagttttttattatatgggatatagggtggttgtttggggtttttttattaaagtttagttatcgagtagatattttttttagagttggttagattttttttttagagaggtagattagataagtgtttgtttgtggtgtagttggatttttgagtatagtgttttatggaatattcggagaggatttttttgagtcgaggggtgtaggaggtttgtgtgtaagttatttgagttttgattgagtagatgaagatgttattaagattagagtagggttgagttgtttagggtgagaaatgagtttaattagttacgggtatggtagagatgagcgttttatttttagtttaggttttattattttcgttataggtagcgttattaattaatattgatttatattgattttgtttttgttatgttagcgagtagtttttgtttagagggttgtattttttttttttttttagttttgtttttttttttattcgagtttttagatttattttagtttgttggggttttaaatagggtagtttgatttaatttagaaacgttttaggttgggtttggagaagtttttggtttagttttttttgggtgattcggatggaaattttcgttgcggtttggtttataaatatttggtatacggtggaaaaataaaaatttatttttcgatttttttttagttttttaagggagggtttttttttgtgggtcggttgggttggtggggtgtagcgtatttgttttatattggttttttttttcgttattttttttagtttgtagttattcgttatcgtatttttttttttttgtggggtagttagggtagttggtgggggaggttttggtgatggttgtgttttttgtagggaaggagggagggacgtcggtatgttttttggaatgggatattaatttgggggttttttgaggtttgaagaattaaggggtattatagtatttttataagagttagtagatttattttgttgttgtttagggtttataagaggaggagttgagtgaggatcgggttttttggttttttttgaaggtagtttttgttagttacggtttttttagaaaaattttcgtgtaattttgtggagggaaatggaaaatatcgcgggtttatttttttttttttttttgttatttagtcgttaaggtagtttggaggtgtttagtatagatggttttttttttagtatttagtttttttagtaaatattttgttaatttgagtgtagttgagcggtttggttgttaggtaatagtaaagttagagtgtgggaatgagcgtagtttggttttggggcggtttggttattttggttttgttgggggtttgggattgttttagtgtgagggtttaataaggtttacgtagttatattttttttaattttcgtagtattaggatttttgtagggagggttttatttaggatgcggtgttttgggttgggatgttttaggtttggggtgggatggagaaaggattttaagaatattttttttttatgggagtgggtagtgattgtggtttcggagtgtttatgggaggggttgggttagttgtttttttgttttgtatgtggtgggtagggttggggagtgtttttcgatgtttatggtttggataattttaaggtatttgtttttttttgggtaaggttttagggggttttacggtttggtaggggagtttggttttgttgttgtggtggtttgggatttttgtttttattttgataaataagataatttattttggtagaggaagtggttgtttttattttggtgggtttttttagtaggaggttttaagggtagtttttttgttggttttgttattttgttaagagttaggagggggtggtttagggatatagtttgtttggttggtgattttttgatttgtagggggtagcgttttgaatttttgtgtatttattatttatatatttaattaaatgaataggtagtaggttttgtgtgaggttattaattgatattaaataatattagagttattattttagtattatttgttatattttattttaaacggagtagttggatttgttttgatttgaagggatttaagttgagagtatgagacgttatgaggtttgatttggtttcgtgttgattttgattttcgtttatttttttttttgttttttatttattttttaagtttattgttttcgaatcggtgagaggagagtggtgttttgagttatagattcgggttttaggtttagatttattttttattttgtatgatttggggtagttttcgtaatttttttaaatttcgggttttttttgtgtaagatggcgattttggaatttattttttattttgtaaggaagttagttggtgttaaggaggtagttttttatgttaggtatatttttaatgaatggtggttgttattattaggattatggggggatttgtttttgtttttatttttttggtttttgtatttattttttagatttattttggtttgagggtttgtagttgaattttggaaggttgttttgttttttttttgtttttttatttttcgtgttttttagtttttttgttgtggggtttgcgtttttttttttttttattttttttcgatattgtcgatatttgaaggtttcgagcgtttgtgattagtagtttttttttgtttttttttttttttgtaggaaattagtaaacgggaagatgcgagtggatagttaagttgtatttagttgtttgtcgatttttagggggtaggtacgcgattatgagtcggtatgtttttcgtgttttatgttcgtgtttttttatttcgttttcgtgtttttgtgttcgtgtttacgtttcgttgttgtgtaatttgttatagtcgtgatggttattggtgttgtgaggtttgtttcgattttaagtttttttttttttgaggatacggaagggaggtatttttttgtttttgtttttattaatttattaagggtattatttttatttttgttagattggtggatgggtcggagaaggaagggatttagaattttttgtgtgtacgtgtgtggggtatttcgtgtgtgcgtgtttgtgttgaggtttcggaggagttttagacgttcggttttagtggagttaagatttggtcgtagattatatttttttattttttatttttttattttttgttttaggtttttgttggagatttcgtaagttgttttagtttaggataagtttttggaggatgtggggatgggatgtggtttttgttaaaatgtattaatattttaaattatttttgagtttttggtttttttattatttatttgggttcggttggcgttgttagggttggttttcggtttggttttacgatgagtttgtgttttgttgttttttgttttagtattagaattcggggcgaagttagtatttttgtgggattttatggtgttgtatatttcgagtagttttttggagattttatttgataattaaaggtttcgttagggttgtaaattgagttaatgaaaatgattttttgagatgttaattatttaatatttatgtttttattaaaagtagtaattaagtattttttaataattttttaaggagaagtatgtaattattggggaatttattgatttgttaagaagaaagaaaaaattgttttagagatagggagagaggtaaaaatggggttagggagggggtcgggatttggggaagatgaagggaagatatcgagggattgaagtggcgttttcgggttgagttgttttgtttggggttttttaatttttttttagggttttcgagtttgaggtttaggggaggggagtcgtggagagaaagtaaagggtttttagtgaatttttgtaagagaggttttagtgattattttatttaggtttttaggtttttagttttttttggtttgtgttatttgttatttagttattttttttttttttagttagttttggtgatcgtttagttaggttggttgtgttgtgggtttatataagttgtggttttttttgaggtgtggttggagaggtagaggtggtggggttttgggaagtttcgggttttaagtttggggggtttggtttgcgtcgtgtatgtttcgtgtcgtggttgttggtttttgtggtttatatgtggtgtgcgtgtgtgaagagagggaggttcggtttattttaattatttaagtttggtcggatttttaatggttcgttgtttttttgttttagggagatgttaataagttcgaattagagttcgatttttttttatttagtttggatggtgatggggataggaagaagtgtttggtttgtgagtatttattttggggtgcgatttttggttttgggttagttttgtgtggattcgggattttttttttttttttcgtgtagtggtgtttttgggagagtattcggagttgcggaagagtttgttgtcgttttttattatttatacggtcgttatatttatgtcgttgtttaagagtattagtacgggtttgggcgaggcgttgggttttgcgtcgcgtcgtattagtagtagcgggtcggtagagtttggggcggtttacgagatgaagttatcggtagggggtgtatgtgggtattttgatggtgggagatattttaaggaggataggaggaagagaggatggaggtaggcgggtttaagggtatagtttttgttttatgggttggatggggtttgggtgtgtttggataagtttttggggaatttgcgtcggtgatgtaaattagggtaggagttttagtttgggggttgaaaatagggtttaagttgattttttttgtattttagttgagtgatttcgggtaagacgttatcgttttgatttgtttttgtaaaatggaggtggggtgtttatatttttttaagattgaataataataatagtagatttttatttaggtattgattttgtgttagatattgttttaaatattatttcgaagtattttaaatgtatttaatttttatattaattttgggaggtaggtattataatgatttttattttatagagggggtttgagttttagattgtagaagggaatggtagagttagtattttaatttaggaggttagtgttggtgtttatgtttttatgattttatttatttttaatttttttaaatttcgtttttaattgataaatattaattgtgtatatttatggggtataatgtgatgttttgatatatgtatatattatgggatgattatattaagttaattagtatatgtattattttatatatttattttttttgtggtatgaatatttaaaaatttatttttagtaattttgaaataaatatgtattacgttattattgattatagttattatgttgtgtaataaatttcgaaaattgattttttttgtttaattgaaatttcgtattttttggttaagttttttttattggttttatttttattttttttaattttagtttttgttaattattattttattttttatttttatgagtttaatttttttggattttatatataagtgagattatatggtatttatttgtttttttgtgttttgtgtattttatttagtataatattttttagtttatttatgttattataaatgatagtttttttttttaaggttgaatattattttatagtgtatgtatgttatatttttttttttttttttttttttttttttttcgttttgtcgtttaggttggagtgtagtggtacgattttaatttattgtatgtaatttttgttttttaggttcgagtgatttttttgttttagttatttgattagttgagattataggtatgtgttattatgttcggttaattttttgtatttttagtagagatgaggttttattatgttggttaggttggttttaaatatttggttttaagtgatttatttgttttggttttttaaagtgttgggattataggtatgagttattgtatttggtttatattttttttatttagttatttattgatggatattaggttgattttatatattggttattgtgaataatgttgaaatgaagatgggaatgttcgtatttcgtttatatattgattttaaattttttggataaatatttagtgttggaattgttgggttatatggtaattttatttttaggtttttgaggaatttgtatatcgttttttataatggttgtattaatttatatttttattaataggatataagggtttttttttttttagatttttattagcgtttgttattttttattatttttataatagttaatttaataggtgtgagataatttattgtggttttaatttgtatttttttggtgattagtgacgttgagtatttttttatgtatttgttggttatttgtgtttttttttttttgagatggagttttattttgttatttaggttggagcgtaatagtttattgtaatttttattttttaggtttaagtgattgttttgttttagttttttgagtagttgggattataggcgtgagttattatgtttaattaattttttttatttttagtagagatggggttttattatattggttaggttggtttcgagtttttggttttaggtgatttgttcgtttcggttttttaatgtgttgggattataggtgtgagttatcgtgtttagttttgtgtttttttttgaggaatgtttatttaggttttttgtttattttttagattgggttgattttttgttgttgagttgtgtttttttattttattatatatattgttatttagttgatgataatattttttttattaaataaatgaggaatgagttttattgttatatttagtttatagatgaggaaatagatgtatagagaggtttaataatttgttttaggttatatagttggttggggtgagttaggatttgaatttaggtattagagtttagagtttttgtttatatttttatatttgatgtgatgttagtgaggtttttaggagatcgggtgtatatgagaggatagggttgttgggttttgtttgagattattttttttttgtttatttatagtttagcgttcgtagtttttcgtatagtttttggagcgttgtaagtagttggattagtaggcgttttagtcggaatagtttcggtcgtgtatttagtttgaagcggagaagtttaagtggagagcggcggtttttgttgtcgggagaaggttaggagagttaggatgaagaggagagtttagaagaggagcgggttagttttgcgggtagtgattatcgttatagggggtttttggagcgggaggttaagagtttttttgatttgttagatatattgtaggtgttagggttgtatcgtattgttagtggtcgagggtttgtttttgagtattaggattgtaatggtaagtcggttttagggcgtttggttcgggttttgcggtttgatgattttttattggatggggatgacgtcgatgacgagggtaatttggtgaggtttttgtgggtatagtgattttttatttttgattttgaaagaggggaggtgtgtttggtttggtagggtataagggagttattattttaagtttacggaatattaaggggtatttagaaatcgagttttaaataattttttttttttttttgttcgttttgttaagttttagatttttgttatgtttatgtttggggttgcggttttgttatttttggtggatatgaatgattttggatagatgtgtatgaattttttatggttttttttttgtgatttagaaagatttattatttatttttttaaattgatgtttcgtatttttttttttcgttttaattttattataagttatgattttttattttatttatatttatgtgtttttgttttagttttttattattattattttttttggggatggggtgtagtgattttagggttagtatgtgaagagtagggttagtgtttttttagttgaggtgtgtttttgaatagatagttgtgtggggttagtgtttgataattgatgttgttttttagtttagtagggaggataggtagggggttgggttggaggtaggggtggggagaggggagagcggggttggggatgtaggggaggagagggaggaggtggagaggtaaggggtttttagggatggggagggggtttggtaaggttgatagggagatgaggaggtggttttaggaataaaggaagagaggtagggtagagtttgggttttaggtgggagagggtagataaggagtgaggttcgtgattttgttgaggagttaggagtcggggaatttggaggtttggttttgtttatattttagtgtttgttttgtagagtaaaggggaacgggttcgcgcgtggattcgagttcgattttttgtttgttgtttcgagcgagatttttggttagtttatattttttttttttagtttaggtaagtgatagggtaggggtttgatttgtgtttcgattttttttttttacgggaaattatcgttggtgatgttgttagggatttgagaagtggtattttgtttggggtgtgagtagggtggttttagttgggagggtattggaggggtaggggttgcgggcggtgtttttcgttgttatttgttttgttttttttttttagtcgttgtttttatgtttgggtaggtttcgttttttgtgttatcggattattatttataagatgttcgattacgtggtttttgttattattttttttaattgtattattatcgttatggagcgttttaaaattgatttttatagcgttgtgagttattagtttcgtttagggtaaggttttttttggggtttgtatttaggattagtgagggaggtaaggaggttatagttgttgatttgtaagttatatagtagggaacgagggggttaggatttttttttaggttttttattagattttggttttcgggatgttttttgtgtttttttttgttttagttttttttttatgatatattagtttagttgggtgttttgttttattttaggttattttttatgagttagagttttgtggggtatacgcgtgagtcggggagtgttggggcggtgtaggggttgtgtgtagatggggaggtattttgtttagtttgttttagggtttcgggggtatgtagagtggttatggaagtcgttttttgtttttggttatttttttaggttaaaattaagtagatttttaggggttatagtggggatatgggttatttttgtttggttgcgaatttgttagttttttttagaaggagagttagaggttttggatatatcgttttagggtcgaatttttttagggtgggtttagtttattttgggagttgtttttttttagtttggtattatagtttttcgttgtcggtagtaattttggttttagaaggatgggtggggggtggttgtgttttcgtttacggtattttgtattatttgtttagaggtggttagggtttgttttttatttttttttgttattttttatattattgtttagattttagcgttgttggggtttttgttttttattagggtcggggtggagggagtttgaggaatggcgggagtagtttaagattaggcgggtgagagagtattcgtattggggattttatattcggagttatagggtaaggtaggggcgttggttgtattttagttttggttgtttttcgtttgaggttttgttgtagagttttttgttattatgttattgtttttacgttttttttattatttttttatttagtttttttatttttagttttgttattgtatttgttttttttttttttttttttttgtgtttatattttgttcgttatttttttagagatttgcgtttgttttttggttatttagggagggatttagtttatagatgttagggaattagatggtttttttttttgttttgttttagtttgtgtttgggggtgtagagtttgtgttaggattttagtttttattgttgttttatttttggggtgtatagtaggaaagtaagtgaagagggtgggatggtaggtaagggttagagattaagtgagattttgttttagtttttaaaaggaattagggaatagggtttaggacgtgggacgtagattatagtattgtagtgtagatttttttttttttgggttaagtggttgtgggggcggggagttttggttatagataggggtgtgattgtttatagagttgtaggggagttagggggtttggtattggttttgtgcgtgtatgagaggggcgtgatttatattgttgtggagggtgggggtcgttttttgagttaaatgttagaagtaggttttgatttgtgtatgtagagtagatttggtttaagggtgggggttttttggcgggtaatttttgtttttttttttttgtaggaacgtatttttttgattttttttaattatatttttatcgtagtttttttggttgaaatgatagtgaaggtgatgggggttggtgttggtttgggatttttggtttttggtgggggtggagatagtttgggttgagggtgggagggttggttgtagcgtagggagggcggtcgatgacgtggcggtggtttttaggtggtggtattgggttggtgtttcggggagtaggcgtatttgcggagtagttggaacgtgttggacgggttgttggtgtttattttcgttatcgatattttggtgtttatggtttttgatagcggtattaagattttgggtatgttgagggtgttgcggttgttgcggattttgcgttcgtttaggtgattttttttttagtattggaatatttttaagaggtggtttttttcgtagggatattttttatcgttagtattttttgttacgaaataaaagtttgtataggttagtattttgtttgtgatttttataggcgattttgttttcgttttagataatatttagattacggtcgtagtaatttttttttaggtgtatatttgttttttttttttttaatatgatatattttttagggtcgttgtattatgtgatgtaaggtgattgtagttttgtgtagtatatagtataaggggttacgagtaggatttttatagtttttagttgcggtttttttttgtgtggtttttaggggtgatatttagttttttttcgtgaggtgataggttttttttgttggttttttttatttttaggcgtttgttagtgattatttttcggtgatattttttttgattagggatttatttttttaggaatttttttttaattagttagttattatttttaatttagattttttttttttaatagggatgatgtggattaatggcgatgtttttttgattgtgatagtttatttttttttgtttttttttttttttgtttgtttttttataagtttattttttggtgtttttaatttataatatattgtatttttagggaacgttttatttgagttgaattttttttatttttaatttaaataggtcgtatatttgatattttgggatggaggtggagatgtggggtatggggatttttgttatttgttttgagagattataataggggttttgatggtaggggttttatgaaaagaggatttgtgttttgttattagaggttaggaagggattagtggttaaggttgggggtggggagtagggttaagggataagggagggtttgggttgggggaagttttattattttttttttttttttttttagggtgattagtcgggcgtaggggttgaagttggtggtggagacgttgatgtttttattgaaatttatcggtaatattgtagttatttgttgtgttttttttattattttcggtattttgggggtgtaggtgtgtggggttttgggggttagttgtgggtgaaagtttgaagagggtttttttttttggtttttgggttttatggtttaagttgttgttgttgtttttattttagaaaggaataagtagggacgtttttttttaggttttaggtttttttattttttgggtattttaaagaaaagtgggagtttagaggaaggttttaaggaggatcggggttgtcgagaggttttaggttatgggagtcgtaggttgttgtttttgttttttgtacgtattttttgagtatagacgttggttcgcggtttatttcgggatttttttttttttttttcggttcgagtatagtgggttgtaggttaggtttggggatttagggtttagatagttgggttaggttagtagcgtgttggtaggtaggcgggtgtagattttagacgaggtaggaagtgggggttgttggggaaatttggttttgggtttagggaggagatttggttttggaagagaaagagttagagttgtttgtaggatttagtagacgttttagggggtcggggagtttttttattatagttttttagggtttttggttttagttgttttagttgtagggtagatagttggttgtttaggtagcgtgggagtttttgggtggttatattttttttttttcgtttttcgtttttttggttttttgggatgtttattttgttttgggttgggggttgttttttgattttttagaaattttttagttttagggaataggttggggtgtatttattaaagttgtgtggtgtttttttgtatattttttttatttttatttagtgtttttttttttttttattttttagtttttttgggttagtagagtgaagtattgttgagtttagttttttcggtggatttaggtttgttttgagtagtttgtttaggttttttggttttgtttttcgttttttattagtggttatagtttggtttataatggaatgagggtgagttttttaattagatagatttgggttcgagttttttttttgttatttgttggttatgggattttagtgagtggattaatttttttgagttttcgttgtttttatttgtaaagtggggttgatgatatttatttttttatttagagttgttgtgagaattaaatgtttagtttagtggtttttaaatttgagtttgcgttagaattattagaacggtttgttaaaagatcgttgtttttttattttagagtgtatgatttagtagatttgggttggatttgagaagatgtgtttttagtatgtttttagatgatgttggggatttttatttggtatacgtttggtttaatcgttggtggaagatgaatgattgttattcgtttttatttttttttattgttcgtttcgattattttttttttttatttttggaaaggaagggggtgtcggtaggggagatttttgttagtgtttttttgatttgattggttttagagtagagtattttatatttatttaaaatgtgtttaggttggcgtgggggtggggtttaggagttttgggttttttgtggttatagtttatttttttttgtttttgggaatgtgtgtttagttttttaaagggaagtttttcgtgtgttagggcgaggatattaggaatattattaataaatcggattgtgtcgaggttagttatcggtgggttcggtataagtataattttgataattttggttaggtgagttttaggtttagaggtggggttgtggtgaaggaggttggagggggtatagggttatgtttagtgatatttgttgatttcggtggaggtgggttttacgaagagattagttttttatattttttgttgtttaattattagtatgtcgtaaagtttagtttattttatagtgttttaaaaagtgggtttatggggtttttagtcgtttttaaagatgaagaaatagaggtttagagagggtaaggggtttgtttagggttatagagttatatggtggagtaggaagtatacgtggtagtgggggtaggtagttttggatgtgaattttgtgtaaattttgattttattattgttagtttaatgatttggagtagttgatttattagggttttagttttattaattggtgaatggagttataatagaattttttcggaggttataataaggatgtaatgagatgatgtgtatatttttttaatatggtggaagggacggatatattgttaagataatttttttttttattttatatttgtagaaatagaaatgtagaaaatgaaattgttcgtttagttttgatttttagatttattttggttttggtttttggatttttagggtttttgtgtttttttttttatttggcggagggtagagggtgtgattattttttagggtttttttagttgtagtttagttatggaattttgagagggagggtttttttggagtttggagtgtgattttagtttgattttttaagggttggggtatttggagttgatgtaggaggtattttgggggtaggtgataggtgatttagttatatattttagattttaaatgtttttttttttttttttttattaggttttgatgtttttgttcgttttggtttttaaggatggttgggtggatattatgtacgatgggttggatgttgtgggcgtggattagtaggtagggttgaggtgggtaggatttatttgtgggtttaggttatttagtatgggttgattttaggatagaaagagtaaggtagggtggtaaaatgttatgaaagaagtattatattttatagtagaggttgttgttggtagtttgtgggttaaatttgggtatgttttattggtttataatatgtttaatatgttttgaattagtgatgaatatttttaaattggtgaatttgggttgtgtgtagtggtttatatttgtaatgttagtgtattgggaggtttaggtaagaggattatttgaggttaggagttggagattagtttgggtattatagtaagatttttagttttataaaaaataaaaataattagtcgggtgtggtggtattatttggagttttagttgaggtgggaggattttttgagtttaggagtttgaggttgtaataagttgtgatcgtattattgtattttagtttaagtaatagaataagattttgtttttaaaaaaagaaaaaataatggtgagttttatatagaaatttagatttgtgtttatttaggaaaagtttgaagatttgggaagattgggtttgtatttttttaaggtaggagttagttagaataaagaggtagttttggatggagaatttatttttttttttattatagttttcgtttttttttattgttttatattaaatttatattatttatttttatcgtttgttaggcggttgtagttatttgggttcgtaggaatttaggttgtgggtagtttttaagatagtttgttttcgggttgatgttttcgtttgttttttttgtttttcgttagtttattatgaattataatttttggatgttgttgtattttatttcgtttttgtttattgtggttttttttgttttgaatatgtttgtgggtgtggtggtggagaatttttataagtgtcggtagtattaggaggaagaggaggttcggcggcgggaggagaagcgtttacgaagattggagaaaaagagaaggagtaaggagaagtagatggttggtcggtagtttttttatttttttttgggtcgtgtttgattttggttttgcgattgtagggggttgggcgttggggtcgggggtagggagaagaggtttttatttttttttttatttttttttttttaagagtatgtttgtttttagagcgagtatgaagtagattattttagttttatgggtagggggagttgtttttattttggggttttttaggattttagtattattttttttagatgatgttaaatggaggttgatatttagttttttcgagtttgatttttagaggagttttattggttgttttattgttttatgttagtatttagaggtttagggtgggtagtaagtattttaattttgtatttatttagtgtttgtagttgtcgagtaaagttttagtagattttagtaatggataatagcgtaaaagagaatttagatatttttttttttttatttttaataaaattttttattatgatatatatatatatatatatatatttttgttaaatttaaaaaaagaaaaagtaaaaataaaaataaaaaaagaaaattttttttggtttggggaagttttggaataatttggggttttggagttttttatttttttatttgtgttttttagtattttttggtattgggtgggtgaagtttttattcgttcgtttttatgtttttatgttatgggtgggtcgagattaagtgagaagatagaggttaggaaggatgtgagagatatagtaggcgtttaggtttttttgtttttggggtatttttagatgcgtttgtatttgtttttttttttttcgggttttagggtttttatttgtttggtatagcgtaattttcgcgttttttttttttttttagttacggtttacgtttttttaagtgtttttgtgtgtgggtttatttaagtttttgtgtgtttgtttgtgtgtttttttttgtttggggtgagggttttttatgttttttttatttttttataaatcgtttttttttcgtcgataagatgggtgcggtggtttgagtttttttttggtgtgtttatatgtgagtattattaaatgagtgaggggttgtcgtgtttttgttttttttttgtttttagttttatttttttcggtttgggagtggtattttgaggcggggggagagtgtgggagttgtagacgagggtggaggtgggagggggtttgtgttttttgtgaagagcgggagttgttttaggatgtgggggagatattggtttttgggtagtaatgggaggtgtcgttttttacgtttttaatttttattattagtatttttaaggttttttgttcggtttagggtaggggttcgggttcggtttttttgtggatatttgtagttgagtaggtgtagtgttttttgtggttatcgttttatttttgttttattttttttatttttattttatagttaggtagatggaatttttttggtaggcggtatttgtggtttttgtttgtttagttggttttttttttggggtttgtagttgttttaggtgtagttgaggttataacgtaggagaagcggatatttgttttgatgatcggttgtttgtttttttcggtgtttttttgtttcgtgattttgattagttagttatattgtttgttttttttaagtgttttgtgtttttagtttcgggttggatatttagagttagttatttaatgggtttagcgtattttatttataggtagagtgaggtgggagttgaggggaagtcgtttttgaggggttttgtttagcgtatttggttcggttagtgattaatgtcgtgtttcgtttttttagatttaatgttggacgatgtaattgttttcggtagtttagttagcgttgcgttaggtattgcgtttggggtgtgggtttatgcgtgtggggatatgttttttatttttttttcgtggtttattgattttatttttttggggtgaaagggtgagggtttttggggtttttaagagggtaggggttgaagcgttgggttttgtagtatttcgtaggtttgcgttaaattggacgggaggcgagggtttgaggtttttttgtcgacgttttttggagagtttatttttttagtaagggtttttttggtcggttaagttttttattttttgttatttttttttttttgtgttttttttttgtagtttatcggtcgattattagagttgtaaattttttttgtttttttttgtttgaggggagattttgatttaagggagtaggatgagaggagtagagaggggaaggatttgttttaaaaatgtaataatgaataattgaatagatttattaatagttaagtgattacggtggttgcgttatcgttataaatagtaggaattgggaattaaaggtttgagttggttacgagttttttttaaaaaaagttaaagatttgggagtgatttgggtttttatttttaagagttatgtttttgggaagatttttttggtttagtttattttttatggtttttcggttttttgttttttttttttttattggtttttagatggaggtgtggaggtttatggagttcgtggtagggttgtggggttttataatattatgtttttagttggtggtttttaagttgtttatttttaaggtttttagttattattttttttaatagattttatattttagaaggttgtttatgaagttaagagtattttaataatgatttttttttattatttttattaattagaggcgtatttaattgttaattatagtttttgagttgtagaaggttatatattaaatgatggtaaagaaagattatttcgttattaaattagtttgtggggttttaatataggtaaagtatagggttttttttaagttttttgaagtattggaaagaatataagggtcgggtatagtggtttatatttgtaattttagtattttgggaggttgaggcgggtagattatgaggttaggggtttgagattagtttggttaatatggtgaaatttcgtttttattaaaaatataaaaattagtcgggcgtggtggtatacgtttgtaattttagttattcgggaggttgaggtaggagaatcgttttaattcgggaggcggaggttgtagtgagtcgagattacgttattgtattttagtttgggtgatagagcgagattttatttaaaaaaaaaaaaaaaaaaagagagagagagagtgagaatataaggatttttatggttgttgtaggtttggaattttagtttgggaattatcggttttattttttttatttttttggaagttagaattaggtagatgttgttttggggatgttgggtgttatgatttgtggggttttagggatttatttaagagagaatttttgagtttttattgagtaggttatttttgaggtttttagcgttatggttttatgatgttaagtagtggtgtttggtattgagagattgtttttttggggtttaggagtttttggttggtttgtgtttggattgttagggtttttatatttttgtattaggttgttttgtaaatttttgatttgttaggggatgaggggagggagggaagaagtggtttttagttttttttttacgggtttatttggtttgtagattgaagtgtgtatatttttatatttattttaaaatattttagtatagggttagtttatagagatttttttattttgggtgttattttagaaattaatatatgtagatttttatggtttttaagacgtgatttatttatttagtgttaaatattttcgtgatttttgtattgtatttttatttcgggtattttttgttgtgtttttgaagtggatagattttattgtattttggggtggtatacgtaggtatgtatattagttattttttttggttgttggtgaggatttagagatttcgaataagggtttaggttattttatattttattttttaggatttggagttttgcgtggtttatgttagagttttttaaatttttatgtgtataagaattatttggaaagtataaatatagatttttggggtttattttagaggtttttttatagtagtgtagatgtattgatttatttattagggtgatggggatagagttaaacgtagtttagggttgttgagaattaaatacgtgtatcgtatttttttgttagtatttttgttttggtgttgtttttagtaggggcgggagagttagattttagggaaaggtagaagagcggagtttgtgattatttggggaatgggtttgattagaagtttgggtttatttcggttttttagatggagggagggatcggggttgttgggttattaggttgttttacgggacggttaagtttttaatattagttttattttttttggttatttgtggcgtcgatttttatttatttattttttttttttttattaggtcgggatttagtgattaggtttggttacggtagttgaaggtgtggtttttgtcgtggggggtttgtgtttttgggagtgatttttgttttttgtttatttattgttatttttttttgtaaatttttcgttttggttatgttttgggttttttgtgatttttattaatttattgtttgttgttttgcggttttttttttgtattttttttttttttttgtttcgaagtggggatttgggttgttttagatatgtttttttttttattgtttgattttggtattttttttatttaaggtagtttattttggtgggaggtagggaggtggtgttatagttattaatgtattagtgattataggtttaggttttttttggattatggttggagtttttaaagtagtaggtttgtttaaggttttttttaggggttttttattttttttttatatttgggtgtttgtttgtagagtcgaggtttagagagtagtaaaggagggtggtatcgttaggttttaattttggaggtttttgggtagattatttaggggtgttttttgggttaaggttttaaagttttgtgtttgtatttatttggtaattggcgagggattcgggttggaagttcgggtttagttcggttatgtttcgtagttagttgaatgagttattttttgtttggttttattttttttttttgaaaaataaaggggttgttcgaggagatgttgattagattggtttggtattttttggatttgtgttttaatgggggatttttggtagttttagtatttgtcgtttggggtaggggttagggtggaggggtgtttgtatagattttaggggtcgggatttgtttataagtagatgttttgttttagtttttttgtttcgttttttttttgggttttttggaggagggtttcggttgaattgaagtttatttattttatagatttttagtgtaaggttagagttggtgggagtagttgtttcgtttggtttggaattgtttatagagttaggttggggtgacggggagaggagggtaatttttttagttttttttttatattgttttagttaataatggggttaataaggagtcgttttttttaatttaattgtatttaaatattttagttaattttttatttatattttagtataatgggatcgggtgttttcggtatttatggagattaatgtagagaaaatgtttcggttgtttaggtaatgtagggcgattagcgttttttggtttttgtggtatttaaggaaggaaggaagaggttcggtttattcggtttattttttattatcgcggtgtggatgattcgtagttttttgtttttttttgttttaggttttttagttttatatttttggggttttgttttcgaataaatagagttatagttggttggtcgatttttgaaaataggaagatggttttatgtatgtttaaggcgtagtagagtgtcggggattgtttgtttcgtggttatttatattttaaggtcgatgttggagagtggttaggtgggttaggagtatggtagtttacgaggttggatgtgtaatatttgggtgtttttttttttttagtttcgggtgggggtttattttaggtcgttttttgttttagtttatttttttgtttaatggttttgtgtatgggaaaggatagttatatttgagttggtttgggtttaaagttttttgttgtttttaagttagttattttttggtttaggttttagaggcggtagtttttattggttggtttttttttagattttttgagacggggaagggttgtttgggatttgaggttgttatatattttttcgtgaaaagttttttttttttttgtggtttcgtgggagattaatttgttaatttttttttaagaatatgtgttttaagttggtttggtttttttttagtatttggaagagggtttttttgaaattttttgtttttagatttattttgtttttttggtagtttaattttttggttttgtgatttttataattaagtggtttattaattacgagagaaatattatgtttttgatagattttagatagtgtttttagtttagtttgtagtttaaggttgtttaaatatttaggagtaggttgggtagtgttttattagaaattgggtgagtttaataggtggggtttttttagtttgagtttgggatggagtagagttttaaggtttttttttttgtttttattgatatgagggtataggaggtttaggtttcgttttttggaggttttttgggtgggttagtgtagttagttaagaagatgtttaatttttaattttcggttttatttttaaattttagttttgtgtaattttttttgttttttcgaggggttgagtttggtgaaggagtaaaagtttttgttttttcgttgatggcgcgttttttgagtttgaggagattagttgttttttatcgtatcgatttggttttgttgcggaatattgagtcgagggtgttatgaggggttggtggattttggaggttgtttaggggagggggtttatttggcgtttaatgtaggtggggggttttgtatgttttgatttattttgtttttaattgtagttagtataatagatgtttggagggggatacgtttagacggttgtttttattaaggggtagcgtggggagggcgaggatggtgatgattatggaatgttttagttttggcgttagaggttggtggttgtgagggattgggggtggaggggtgcggggggtaggggtttgacgtttgttttgtttttttttttgttttattagaagtttagtgtaaattttattatttcgattattttcgttttcggtttttcgtttattatttgtgtattagttattatttggatttttttattataggtgttatcgggttgaacgtggttattatggttatggagtattattagtagttttaggtaggagcgagtggattagttatttggtttttttatttttagttgaggaatttttgggtaaggttaatatagtttgagttagggtatttttgtgttaagtaagtgttaggtatattatatgggttttttttgtgttttttggaggtgggtattatttttgttttatagatgaggatattgaggtttagagatgttagttgatgtggttaaggttatatagaaagggagtggaggatttggtttttttatttagtaaatgttgagcgtttattatgagttgcgttttggatttttgagggtaaaaaggtagatggatgtttgtttttttggagttgagattttagcgaacgtttagttttagagtttatttgtgattttgttatttttttagttagttttttttggttgttttttagtcgtcggtttttttgtttatttaatgagggggttgaatttgtaatgtataaggttttttttagttttggtatgtcgtgttatttagtatatttttatgtgatttttttattattttttaaggagaaagattttttagtataaggttgatttatttatgtgaataagtgttttatttttttttggggtttggtggttaatggttagttattatgatgggaatagagaagatagggttttttggagtttttttgttttttagatttgggcggtatgatggaggggcggggggataagttttagttttgggttttaagggattttgtattttgtttttatttttgttagattttggatgaggttttgaagatttgtaattatatttttattgttatttttgttttggagttagtttttaaatttgtggtttttggttttcgtcggtttttttaggataggtaacggagaaaaggggggttttggggatttgcgtagagatagaaaggaatgagttttttggggaaatatttaggaagatttagtgtttaagattttttttaatttttgaggtttagtttttattttgtggttgacgtaggggattaggggatgggaaggtatggtttttaggattaggagatgggaaggtatggagagaatttgataagatagggtttgggggatgttggtagttagaaattagtgtgatttagtttggggtttaagagtatagagtttggagttagattgtttgaattggatttgaattttggttttattatttagtagttggtggttttgggtaagttatttaatttttttgtgttttagtttttttatttgtaaaatgagagaaaataatagtatttatattatagagttgtgagattatgaatttttatttggttttgagggtgtttttcgttttgttttgttttgttttgttttttgatgtttaggttggagtgtagtagtttagttatggtttatagtagttttgattttttgagtttaagttgtttttttattttagttttttaggtagttgggattacgggtatttattgttatacgtagttaattattttttatttttatttttagtagatatagggttttattatgttgtttaggttgttttcgaatttttgagtttaagtgatttttttattttagatttttaaagtgttgggattgtaggtgtgagtttttatttgtaaagtttttaaaagtgtttggtgtatagtgaatattatataagtgttaaattaaaaataaaagtaaatgaatataaatgaaaagtagaggtttttgagttaaagttttagttttattcgtgttattagttggttgtgtggttttagataagttacgttttttttttgtgggatgggaggttggattcgttgatgtttgttttttttttaagttttgtttttttgtgttacgattgtttttttttttaggaatttttttttttaatttagggagttgtattttgggttttttaggtggaattagttggatttggttattgtgttgttgtttattatgggtattacgttggaggaaatcgaggttaacgtttcgttgtttattaattttattattattcgtattatgagggtgttgcgtattgttcgaggttggtgtttagtttacgtatttgtttttttagggtgattagtttagggagagagagtaagggtcggttttgtggttggttaaggtttgggcggttgtgggtttttatgggttttttttttagtttttgttaagggaggttggagatagggttgaggatggggatgtaatttggttggttcggagatggttattttagtagttttagtttagttttggttttgattttgttagttgtttggtcggggatttaaagaggttagtttatgacgttgttttgttttgtagtgttgaagttgttgaagatggttgtgggtatgcgggcgttgttggatacggtgatgtaggttttgttttaggtagtcgggaggtggggggtttttggggagggggaggtgttttttagagggaaggggtttagagaagttgattgggagatttagcggtatcgtttttattttttttttttttttttaggtggggaatttgggatttttttttatgttgttgttttttatttttgtagttttgggcgtggagttttttggagatttgggtgagttggggtaggggagggtggaggagttagggttggagattagggggtttttggattaatatgggtttttttttttttttttttttttttagagtgtgacgagatatatttttgtgagggtttgggtcgttatgttatttttcggaattttggtatggtttttttaattttttttcgagtttttataggtgataattggaatggtattatgaaggtaagggtttagggttggtttaggttttagggaggtagttttattttttgagttaggattttttgggaagatgaattggttataaataaaagtatgtgattttttttttttcgtgttagaatattttggaatttttttttttaggaatatgttttgatttatatttgtagtgtttttttgtttttaaatatttttttttttttttttttttttttattttttaatgttttgtgatattagtgatttgattttttataatagttttaataattgttttttttagttttatttttttattttattttttttaggatatttttcgggattgtgattaggagtttatttgttataatacggttatttcgtttatttattttgtgtttttcgtgttgacggtttagttcgtgttagttaacgtggtgatcgtcgtgttgatgaagtatttggaggagagtaataaggaggttaaggaggaggtcgagttagaggttgagttggagttggagatgaagatttttagtttttagttttattcgttattgggtagtttttttttttggtttggggtcgagggtttcgatagtttcgatagttttaagtttggggttttgtatttagcggtttacgcgagattagttttttatttttttttggagtattttacggtgagtagatatttattttagtcgtgagaggagttggggtaggagaagggtgtggagggtggtgggcgggagttaagcgggtagtatataaattttaggttttttttggaggttttcgtttttcgttttggatgttgagcgagtagttattgtttttttttagggatggttgtttatatttattttatagggttattttagtagacgggttagtttagttatgttttgtttttttagtttggtttggttttttttttttgatttataggtttaaggttaagttttttgttttttttttgttttttttttatttttgtttaattgttaaattttttttttatttattttttaatttgtttgatttttttttatttttttatttttttattttttttttatcgtttttttttttttttttcgtcgtgggttttgtttattttttattttttattttttttttttttttcgtttttttttttttttatttttttttttttttttttttgttgttgtgtgtgtttttgtgtgtgtgtatatgtgtatgtgtgttgtttgggtgttattttttttttttttgttttttttgttaatttttttttacgatattttttattattgttttttgatttttgtttttttgttttttcggttttttttacgggttggttttttaggataggtagttgtttgatattatatttttgttgatttagggttttttggagtgggagttgaagttgatggacgagttggtaggtttagggggttagttttttgtttttttttttgtttttagtttgggaggtttcgatttataggttattgtgtttttgtgttgtgtttttttttttgatcgtgttgggttgtgttacgttgtgttatgtttttggggaagttgggagtgtttttgtttattgggtatttgtagaaagtgtagttttggagttttagttgagtgtaagaggtagttaggggtttttttagattgagattatttttagaaaagagttggaaggtagggttgttgagattgtttttttgatgagaagggtgtgtggaggaggagtttggggaggggagaggggatttgtaagaatttggaagagaaaagaggggatggggtagaagataagttagtagggggattttagggggtggagggaaggaggtattagatttagggaggaaggtttttagagatagtgtaggtggttagggagttcgttgttaagttgtagtttttttatttgttcgtgtttagtatatatttgttagtttttagtttggtggttttttaagttatggagtttattgggtatggtgagtgttgttaggagttattgatttttgttttgagagagatagaaggttttagttgggagtggattttgagaatttggtgtgaaataggatttggttttttgtttaagtttagtttttttttatagcgttatatggtttttttttttagttttatttaattttaggttttttgttttttgggttgtttttgttttttttttttttttttgatttttttattacgatttattattacgtgagagagggttttattttttttttatttaggtgagaggttgtagattcggagtggagataggtgttagttgtagatagaaaagtcgagttttttagaggtttttttgggtggtggggtaggtaggtttttaggaagtttttagtttgattttagaaaaatggatagtgatttttatgtgggaagggattttgttttttgttgggatttagttttagatttggtaatgatttagaatgattagtgggaaagtgagttttttttcgaggttttttttttttgaaagaggtttatagggaaaggttgtgggagaagaggatacgatgggaaggtgatggggttttgggagggacggtttaattgttttttagtattttgtgggtattgaggtaattttttgggttttaggtgagttagttagatggtgtggtagtttattcgagtgcgtttattttaggttaacgggagaatattttttagagtttaagttggagagggcgggcgggttgtaggtaggcggaggagggtttacgaggggagaagttagaatttgggggtaggttaagttttgttaggttgttggaagtcgagagaataggtagaaaatagtcgttagattggtggtattgtcgtcggcgtttttcgtgtcgttttgtttgtgtcgggaggagagatagtgttttgttggtttttttttattttttttttttttggtattatttttttgagagtcgtaagttttcggttttttcgttttttttttgggtggtggtagtgtgggaggggttggggaggtttttggggtatttttagaatgcgtttttgtgttttttcgttttgttagtgtttgttttggttttttagtgtttgtcgtagtttttttgattagagtagggggttgaagtgggtgcggggaggtattgttagtttgtttggggaaagggtggggagagagaagggatgtttttttttcgtttttttgtgtttcgtgaaaagggggaagtggggattgagagagagcgcgtgtgtgcgtgtgtacgcgcgtgtgcgttgttttggttttttatgtttgattatttttttttttgtttagatttttttagttgagatggaggttttgtttttgacgttagagattgtgtttgaatcgttttgttttttagttttgacggatgattttttgtttgatgatatgtatatatttttatttagtgttttggagagtaatgtatatatatattgtttttattgttttcggttattttcggggttggattggttgtagggttttagatcggtttagggagggttttggggtcgtttttttttagtttgttgttaggttttatttagaggtattaattgttaggatttcggtggtttacgttttgttggtataaggtttttaggttttttattggggataaagagattagataagtttaaattggggttttgttttgaagggtataggagtagcggtagttattatgaaaaagtgaatttagatatttaggagtgatacggtttaaaataggtgttattagagttaatttatgaatttggagttttgtgtaagttagttttttttgtgtttgttttttttttttttattttattttattttttaataatatgagatttttatattacgtggtgggtgagagtcgtatttttgttatcgttgttatgtttttttttatttggagcgttgtttttgtttttttcgttattgttttcgtgtgtttttgcgtttttattaaatttagtggggtgaatggggtttttttgtgttttgatagtttttttatttttttttttttttagttttcgttttttttgattgtgagtagtttttttttttttattgttttttttttgttgttagaggagggtttagttgaggtagggattggattatcggttggggtgtttttaggggttttgggtggttggtagtagtggagtttggggttgagaggggaagtaaaataagattgttttttaatttagttatttttaggtttgttggggttatttaattggttgggtttgtatggcgatagggtttttatagtttttttgggaataaggggtgaagggtttagggggaagggggttatagagtgatggagaaattttttgagaataaattaggtttttttatgttggagtttaaggttgagtattttttttttttgaaatagagtaataattttatttttatttcgagtttgtttattaagggagtagttgaatttggtttttatttttatttgttagagttattggttaaagtggaggttagggagttagttgtgatatgtttttggtggttatttgttatttaatttatttgaatttaatttaggttttgtgttgggatttggggttgttgtaagaattggatgaatagtttgtaatttgtaagtttttttgagttgtttggtttttgttttttgggagggtttttttttttttattttttttattgatagtatagggtcgtaggggttgttgttggtttttttttttttttttttttttgagatagggttttattttgttgtttaggttggagtgtagtgatatgattttagtttattatagttttgattttttcggtttaagtaatttttttattttagtttttggagtagttgggattataggtgttacgttattatatttagttaatttttttttttttttttttttttttttttttagaaatggggttttgttatgttgtttaggttggttttaaatttttgagtttaagcgatttgtttattttggttttttaaagtgttgggattataggtatgagttattagttattgtgtttggtttgttgttagtttttaatttttttttgagttgttttgggttagggttttagtttatttttgtggatatcgggattttttttagagtttttaaatggggtttttagaattagtttgtgagttatttgtagggttgggggttgggggttgtttttttttttttggatattttttcgtttttttattattatagtgggagtttaaaggtgatataatgtgtgtagttttgtagggggtggggggtagggtttgtagattttttcggttgtttagatttttttttatttgtttttttttcgcgtgtggagggtttatttatgtgtttgtttttttttttagttatgtttatgtttatttttattttgttttgggagggtacgggggtgagggttgggcggggggcgttgttgttttttgttgttagcgttgttttagttattaaatttacgtatattttttttttttattttttttttttgttttttttgtagatgtagttttattttacggagttgttaggattagatttattgattgtgcggaagtttggggttagtcgaacgtattttttgtttaatgatagttatatgtgtcggtatgggagtattgtcgaggggtttttgggatataggggttgggggttttttaaagtttagttaggtattagggttagagtaggttaatttggtttatatagggagattttattttggtttaagttagttttgatttgaggggatggggaattgaggtagttaaagaggtatttttgattttaggggagtttttagtttgggggaatggttttgagtttagggggtaagggtagaggttttgatgagggggagagagtggaagggagggtttaggtgagaatttgtttttttgaattttttagttttattttttttttttatttttttttcgtttttttttttttataggtttcgttttgttcgtttatttttagttagtagatattagttatattttgtagttttttaaagatgtattttatttgttttagttttatagcgttttaatttggggtattatttttaaattgtttttattaggacgtttttttttggtttagaggttatttaggcgttaggtgagtagatgtggaaaggtaggtataggtttgggggttggattttttgttgttggtgatgatttgtgttgatatttttatttttttagtaaatatttattgtgtgttagtgatgtgttaggtttagttgtagatattagggatatagtattgggtaaagtagaagtggtttgtgtttttttgaaatttgtatttagttttttgttttattgaggaggtttggagattagaaggggtagtgtttgtttagggttatgtttatttggtcggaggtagaattttagtttttggtttttttttttttattaattagagttgttttttaatttttttttttattttggattgagttatggggtataaggtaggttttaagtgtttttatttttggttaagtttagggtttattttttagagtttagatttttttttttttttttttttttgagtttcgtttttgttgtttaggttggagtgtaatggtataattttggtttttcgtaattttcgttttttgggtttaagtgatttttttgtattagtttttcgagtagttgggattatagatatgcgttattatgtttggataattttgtatttttagtagagatggggtttttttatgttggttaggttgagttcgagtttttaattttagatgatttggtcgtttcggttatttaaagtgtcgggattataggcgtgagttatcgcgttcggttttagagtttatttgtgataaggttatagtttatgttatgtgtgtgttttgaggtatgagcgtggatatatgagaattttaattttatatgtttgggggagtaggtatagtttttatttattttgtaaatagttattaagtagtttttgtgtgttaggtattggcgatatagtttttgttttttgaagtttatagtttaatagtggagatatgtttgttattagattattgtagttttagtttatagttgttagatatttatgtgtggagggtagtagggatatagaaggggaaggggtcggttttatttggggatagagattgttatatattgtgttatagagaatttgagttcgtaaaatcgagggatttttgttaattaggaagggtatttagagttaaaggggaagtttaggtagaggcggggaggcgtgaaggagttagtttagtgagtagagatggtttggttttttttatattttaggaggtaggggttgtagagagagcgatttttgtaggtttaggggagattagagtatgggggagggaagatagggtttagtggggagagaggaggtatggtggataatagaggttaggttgtaatgatttttatttattagtaagagcggttattaggatttttgtttaggatagttttgttgtgtttggtggtggtgggtagggggtatagttagtttgataggagggttagtttatgttggagaggagattgttgggttgagtttttttttattttatataggtagtaataaggattgattttttggacgtttagggtttgggtagtcgggaagatttgttggtagaggtgagtgggtttttttcgtttttggttcgggtttattttttttggggttagttaagtatttaggtatagtagtattttcgtagttatagtaagatttttaagtatatgatttcgttagttttttgtttaggtttagaatttaattggggtaagggttttttagagattagaagtagtttagagttggatacggagttgagttggattttaggagattttttgttttttggcggttaggaggagtttttatttttacgggatttgaagaagtgttatagcgtggaggtttagagttgttagcgtcggtttacgttttggttggatgagtagaggagatattttatcgtcgttagttgtttggatagcggtttttaattttatttgggtatagatttttttaattttgggggttagttttttggggggtttgggagtcggtttaagaaaaaatttagttcgtttagtattattatagattttttcgagagttaaggttttcggatttcgtttagttttggtatttgttttcggaggagggtttcgtttagcgattttaaggattttttggtttttggtttttttgatagtatggttgtttcgttttttttaaagaaagatgtgttgagttttttcggtttattttttgatttagtagatttggatttttgagttttgttttatttttttatttatttttttttattgggtgttaagttttagtttttttttttgggttatatttttgataaaagttttatatagatattaaggaggcggaggcgtttttttttgttttagtggttttgggtatttgtaagtagaatttttaaagagagttaaaagtagtagtttcggtaattttggttttaggtagaaggagaggttcggtgtagttgaggttttcgatattagaagttgttgggagaaagtaatacgtttgtgtagaatttttatgtatattttattttattaaattaattgaatttagtatatgcgggatgtacgatattttgtgattgaagagatttgtttttttttatttttatgtgttttagaatatttttgaggcgaaggcgtttgttttttggttattttaatttaaaataatagtttagttatattttttttttttgtaaagtataagttgggatcgcgagtatattgtagttttaacggtggtttatttttagcggagagcgagaattattttggaaattgtaatgtaatttatttttttttttaatttcgttattattttttgtagggaaaaaaaaaagaaaaagaaaaaatgagatttta

SEQ ID NO: 175 - DNA, 67922 bp, Artificial Sequence
  Chemically-Treated DNA
taaaattttatttttttttttttttttttttttttttatagaaaatgatgacgaggttaaaggaaaaaataagttatattatagtttttaaaatggttttcgtttttcgttgaagatgggttatcgttggggttgtaatgtgttcgcggttttagtttgtgttttgtaagaagagggaatataattagattgttattttaggttaaaatagttaagagatagacgttttcgttttaaaaatattttgagatatataaaagtagaaggaaataagtttttttagttataaaatgtcgtatatttcgtatatattagatttaattaatttaataaaatagaatatatatagagattttgtataaacgtattgtttttttttaatagtttttggtgtcgggaattttagttgtatcgggtttttttttttgtttggagttagagttgtcggggttgttgtttttaattttttttggaagttttgtttgtaggtatttagagttattgaggtagggaggagcgttttcgtttttttggtgtttatatggaatttttgttaggaatatagtttaggaggaggagttaggatttggtatttagtggagaaaggtgagtgggaaagtggggtaggatttaggggtttaggtttgttgggttagaggataaatcggagagatttagtatatttttttttggggagggcgaggtagttatgttgttaggggggttagaggttaagggatttttggagtcgttggacggagttttttttcggaggtagatattagggttgggcggggttcgaggattttggttttcgggggggtttatggtgatattaggcgggttgagtttttttttgggtcggtttttaggttttttaagaggttggtttttaaggttagaggggtttgtgtttaggtggggttgggagtcgttgtttaggtagttgacggcgatagagtgttttttttgtttatttagttaggacgtaggtcggcgttggtagttttgggtttttacgttgtagtatttttttaggtttcgtggggatgggggttttttttggtcgttagggggtaggaggttttttgaaatttagtttagtttcgtgtttaattttaagttgtttttggtttttggagggtttttgttttagttgggttttgggtttgggtaaggggttggcggggttatgtgtttggagattttgttgtggttgcgggagtgttgttgtgtttgggtatttgattggttttagaaagagtaggttcgggttaggggcggggagggtttatttatttttgttagtaggttttttcggttgtttagattttgaacgtttaaggagttagtttttattgttgtttatatggggtgggggagggtttagtttagtagttttttttttagtatggattagtttttttgttaagttggttgtgttttttgtttattattattaggtatagtaggattattttaagtagaggttttggtagtcgtttttattagtagataggggttattgtagtttgatttttgttgtttattatgttttttttttttttattaaattttgtttttttttttttatgttttggttttttttaagtttgtaagaatcgttttttttgtagtttttgttttttgggatatgagagaagttaggttatttttgtttattgagttggtttttttacgttttttcgtttttgtttagattttttttttggttttgaatattttttttgattggtaagaatttttcgattttacggatttaggttttttgtgatatagtgtgtgatagtttttgtttttaagtaaaatcgattttttttttttttgtgtttttgttgttttttatatataggtgtttggtagttgtgagttgaggttgtaatgatttgatggtaggtatgtttttattattagattgtgagttttagggggtaggggttgtgtcgttagtgtttggtatatagaggttgtttagtgattatttgtagaatgaataaggattgtgtttgtttttttaagtatgtgggattgagatttttatgtgtttacgtttatgttttaggatatatatatggtatgggttgtggttttattataggtgggttttggggtcgggcgcggtggtttacgtttgtaatttcggtattttgggtggtcgaggcggttagattatttgaggttgggagttcgagtttagtttgattaatatggagaaattttatttttattaaaaatataaaattatttaggtatggtggcgtatgtttgtaattttagttattcgggaggttgatgtaggagaattatttgaatttaggaggcggaggttgcggggagttaagattgtgttattgtattttagtttgggtaataagagcgaaatttaaaaaaaaaaaaaaaaaaaagaatttgggttttggaaggtgggttttaggtttggttaaaagtgaagatatttaaaatttgttttgtgttttatagtttagtttaaagtggggagaagaattgggaggtagttttggttggtgaggaaggaaagattagagattggggttttattttcgattagataggtatgattttgggtaagtattattttttttggtttttaggtttttttagtggaataaggaattgggtgtaaattttaagaaggtatagattatttttgttttgtttagtattgtgtttttggtatttgtaattgagtttggtatattattggtatataataaatatttgttggaagaatgaaagtgttaatataggttattattagtagtagagggtttagtttttaggtttgtgtttgtttttttatatttgtttatttggcgtttgagtggtttttgagttaaaggggagcgttttggtgggggtagtttggggatggtgttttaggttggggcgttgtggggttggagtagatgaggtgtatttttgggaagttgtaggatgtagttggtatttgttggttgggagtgaacggataagacggagtttgtggagggagggaagcgggggaggggtggggggagagaatggagttggagggtttaggggagtaggtttttatttgagtttttttttttatttttttttttttattagggtttttatttttattttttggatttaaagttatttttttaggttggaggtttttttgaggttagagatatttttttggttgttttagttttttatttttttagattaggattggtttaggttaggatggaatttttttgtgtgagttaaattggtttgttttagttttggtatttgattgagttttggggagtttttagtttttgtgttttaggggtttttcggtagtgtttttatgtcgatatatgtagttgttattgggtagagagtgcgttcggttgattttagattttcgtatagttagtaagtttggttttggtagtttcgtggggtggggttgtatttgtaaaaggaataggggagggaggtggaggaagagggtgtgcgtgggtttggtaattgaggtagcgttgataatagaaagtagtagcgtttttcgtttagtttttattttcgtgtttttttaggataaggtagagatgggtatgagtatggttggggagaggggtagatatatggatgagttttttatacgcggggaggaagtaggtaggagggggtttgggtagtcgggagagtttgtaggttttgttttttattttttgtaaaattgtatatattgtattatttttaagtttttattgtggtggtggaggggcggggaggtatttagagaagggagagtagtttttagtttttagttttgtaggtggtttataagttgattttaaaggttttatttagaggttttgaagggagtttcggtgtttatagggatgggttggggttttgatttagagtagtttaggggaggattaaaagttaatagtaggttaggtatagtggttggtggtttatgtttgtaattttagtattttgggaggttaaggtgggtagatcgtttgagtttaggagtttgagattagtttgggtaatatggtaaaattttatttttaaaaaaaaaaaaaaaaaaaaaaaaaaaaaaattagttggatatggtggcgtggtatttgtaattttagttattttagaggttgaggtgggaggattgtttgagtcgggggggttaaagttatagtgagttgggattatattattgtattttagtttaggtaatagagtgagattttgttttaaaaaaaaaaaaaaaaaaaaaagttaatagtagtttttacgattttgtgttgttagtgggggaggtgagggggagaggatttttttaaggagtagggattaggtagtttaggagagtttgtaggttgtaggttgtttatttagtttttatagtagttttaggttttagtatagggtttgggttgggtttaggtgagttgaatggtagatgattattagaggtatgttatagttggttttttgatttttattttaattaataattttggtaggtgagggtggaggttaaatttagttgtttttttagtggatagattcggggtgggagtggggttgttgttttgttttagagaagggaggtatttagttttggattttagtatgagggagtttagtttgtttttaagaggtttttttattattttgtgatttttttttttttgaattttttattttttgtttttagggaggttgtaggggttttgtcgttatgtaggtttagttagttaaatagttttagtaggtttgaggatggttaagttggaggataattttattttgtttttttttttagttttaggttttattattgttagttatttaagatttttagggatattttagtcggtggtttagtttttgttttagttgggtttttttttgataataggaggggaatagtggagaggagggggttgtttatagttagaagggacgggagttggagaagggaaagggtagggaagttattagagtatagagaagttttatttattttattgagtttggtgaagacgtagggatatacggggatagtgacggaggagataggaatagcgttttaagtgaagaagggtatggtagcggtggtagagatgcggtttttatttattacgtggtgtgaaggttttatgttgttggggggtggggtggggtggggaggaggggaataggtatagggagggttggtttgtatagggttttaaatttatagattgattttgatgatatttgttttgggtcgtgttatttttgggtgtttggatttatttttttataatggttgtcgttgtttttatattttttagggtaaggttttaatttaaatttatttaatttttttgtttttagtggggaatttgaagattttgtgttagtaaagcgtgggttatcgaggttttgatagttgatgtttttgggtggagtttggtagtaaattgagaggaggcggttttaggattttttttgggtcgatttggagttttgtagttagtttagtttcgggggtggtcgggagtagtgagggtagtgtgtatgtatattgttttttagggtattaagtaagagtgtgtgtatgttattaggtaaagagttattcgttagagttagagagtaggacggtttagatataatttttgacgttagagatagagtttttattttagttagagggatttagatagggagagagatgattaggtatgagaaattaggatagcgtatacgcgcgtgtatacgtatatacgcgtttttttttagtttttatttttttttttttacgaagtataggggggcgggaaaaaggtattttttttttttttttattttttttttaaataagttgatagtgttttttcgtatttattttaattttttgttttgattagagaggttgcggtaggtattgaagagttagagtaaatattgataaagcgaggagatatagaaacgtattttaaagatattttaggagtttttttagttttttttatattattattatttagggagggagcgggaggatcgagggtttgcgatttttaaaaagatgatattaaaaaaaaaaaaaatgaagaaaggttagtaaagtattgttttttttttcggtatagatagagcggtacggggggcgtcggcgataatgttattaatttgacggttgttttttgtttattttttcggtttttaatagtttggtaggatttggtttgtttttagattttggttttttttttcgtgggttttttttcgtttgtttgtagttcgttcgttttttttaatttgggttttgggagatgttttttcgttagtttgaagtgggcgtattcgggtgggttgttatattatttggttggtttatttgggatttagggggttgttttagtgtttataggatgttaggggatagttggatcgttttttttagaattttattatttttttatcgtgttttttttttttataatttttttttgtgagttttttttaggaaggggaggtttcggaaagggatttatttttttattgattattttaggttattgttagatttgagattgaattttaataagaggtaaggtttttttttatatgaggattattgtttatttttttgggattaggttaaaggttttttaagaatttgtttgttttattatttaaaagggtttttggaggattcggtttttttatttgtagttgatatttgtttttatttcgggtttgtagttttttatttaggtggagggagggtggggtttttttttacgtggtagtgggtcgtggtgaggggattaaggggaggggaggagggtaggaatagtttagaaagtagaagatttggaattaaatgggattgggggagagggttatgtggcgttgtgggaaggggttgggtttgggtaggaagttaagttttattttatattaagtttttaaaatttatttttagttggagttttttattttttttaggatagaaattagtggtttttgatagtatttattatgtttagtgggttttatggtttaaaaagttattaaattgaggattggtaagtgtgtgttggatacgagtagatagagagattgtagtttggtagcgggttttttggttatttatattgtttttggaggtttttttttttggatttgatatttttttttttttattttttaaggtttttttgttaatttattttttgttttattttttttttttttttttagatttttataaatttttttttttttttttaagttttttttttatatattttttttattagaggggtaattttagtagttttgttttttagtttttttttggaggtgattttagtttagaagaatttttgattgttttttgtatttaattgaggttttaaggttgtattttttatagatatttagtgggtaggaatatttttagtttttttagaagtatggtatagcgtggtatagtttagtacggttaggggagagggtatagtataggggtatagtaatttgtgggtcggagttttttaggttgggggtagaagggaaggtagagggttggttttttgggtttgttagttcgtttattagttttagtttttattttagggagttttggattagtagggatatggtgttaaatagttgtttgttttggggagttagttcgtaaggggagtcggagaggtaggggagtaggggttagagggtagtgatgggaagtgtcgtggaaggggattgataagagaaatagaggagaaagaggtgatatttagataatatatatgtatatgtgtatatatataaaaatatatatagtaataaagagaaaaagaggagggggtggggaagagggaaggcgaaggaggaaggagagatgggagatggaaaatgagtagagtttacggcggggggagagagagagagcggtaaagagaagataaaaggatggagagatggaagagaattaggtaggttaaagggtgggtaggaaagagatttggtagttgggtaagggtaagaaagaaataggaaggaaatagaaaatttagttttgaatttatgagttaggaaggggaggttagattaggttggaggagtagggtatggttaagttggttcgtttgttggggtggttttgtggggtgagtgtgggtagttatttttggggaggggtagtgattgttcgtttagtatttaggacggagggcgggagtttttaggaggagtttagggtttgtgtgttgttcgtttggttttcgtttattattttttatattttttttttgttttagttttttttacggttggggtgggtgtttgtttatcgtggggtgttttagggaaaagtgggaggttgatttcgcgtgggtcgttgggtgtagagttttaggtttggggttgtcggggttgtcggggttttcgattttaggttagaggaaggggttgtttagtggcgagtggggttgggggttgagggtttttatttttagttttagtttagtttttagttcggttttttttttggtttttttgttgtttttttttaggtgttttattagtacggcgattattacgttgattagtacgaattgggtcgttagtacgaaggatataaagtagataggcgagatgatcgtgttgtagtaggtggatttttggttatagtttcggagggtgttttggggagggtggaatagaggggtgaggttggggaggatagttgttggagttgttgtggaaaattaggttattggtgttatagagtattggaggatgggaaggaaggggaggaggagggagtgtttgggggtagaggagtattataagtgtgagttagagtatgtttttgggagagggagttttagagtgttttagtacgggggagagaaggttatatgtttttatttgtggttaatttatttttttaaggaattttagtttaggaagtggggttgtttttttggagtttaggttaattttgggtttttatttttataatgttattttaattgttatttgtggagattcggaagagggttaggaaggttatgttaaagtttcgaaaggtggtatgacggtttaggtttttataggggtgtgtttcgttatattttgggggaggagggaaagggggagaggtttatgttagtttaggagttttttggtttttagttttggtttttttatttttttttattttaatttatttaggtttttaaagagttttacgtttagagttgtaaagatgaaaaataataatatgaagagaagttttaggttttttatttggaaaaaaggagaagaaatagaaacgatgtcgttgggttttttagttagtttttttgagttttttttttttggaaagtatttttttttttttagaggttttttatttttcggttatttggggtagggtttgtattatcgtgtttagtagcgttcgtatgtttatagttatttttagtagttttagtattgtagaataggataacgttatgagttggtttttttgggttttcggttagatagttggtagagttaggattagggttgggttggggttgttgggatggttattttcgggttagttaggttgtatttttatttttagttttgtttttagttttttttggtagaagttgggagaaagatttatgggaatttatagtcgtttaggttttgattagttataaagtcgatttttgttttttttttttgggttggttattttaggagggtaggtgcgtgggttgggtattaatttcgggtaatgcgtagtatttttatgatgcggatgatggtggggttgatgggtagcgaggcgttgatttcgattttttttagcgtgatgtttatgatggatagtagtataatggttaggtttagttggttttatttggaaagtttagaatatagttttttgagttgggggagggggtttttgaaggagggggtagtcgtggtatagaaagatagggtttgaaaggagggtagatattagcgggtttagttttttattttatagagaagaggcgtggtttatttaaggttatatagttaattggtggtacgagtaggattaggattttagtttaaaagtttttgttttttatttgtatttatttgtttttatttttaatttagtatttatatggtgtttattatgtattaggtatttttaagagttttataaataggaatttatatttgtagttttaatattttgggagtttgaggtgggaggattatttgagtttaggagttcgagaatagtttgggtaatatagtgagattttgtatttattaaaaataaaaataaaaaataattagttgcgtgtggtagtgggtgttcgtagttttagttatttgggagattgaggtgaaaggatagtttgaatttaggaggttaaggttgttgtgagttatgattgagttgttgtattttagtttgggtattagaaaataaaataaaataaaataaaacgaaaaatatttttaaaattaaataggaatttataattttataattttgtgatgtggatattattatttttttttattttataaatgaggaaattgaggtatagagaggttaagtaatttatttaaggttattagttattaagtggtgagattaggatttaaatttagtttaggtagtttggttttaggttttgtgtttttaagttttaggttaggttatattgatttttagttgttagtattttttaggttttgttttgttaaattttttttatgtttttttattttttggttttggagattatgtttttttattttttagttttttacgttagttatagggtgggggttgaattttaggaattaagaaaagttttagatattaggtttttttgggtatttttttaagagatttatttttttttatttttacgtaagtttttaagatttttttttttttcgttatttgttttggaagaatcgacggaaattaaaggttataagtttgaaaattgattttaagataaagatgatagtgaagatgtagttgtagatttttagagttttatttagaatttggtagggatgggggtaagatgtagggttttttaaggtttagggttggggtttgttttttcgtttttttattatatcgtttaggtttgagaggtaggggaattttaaggagttttgttttttttgtttttattatgatggttggttattagttattaaattttagaagggagtagggtatttatttatatgaatgaattaattttatgttaaaggatttttttttttgggagatggtgaggagattatatgagaatgtattagatgatacggtatgttaggattggaaggggttttgtgtattataaatttaatttttttattggatggatagggaaatcgacggttggaaggtagttaagggaggttgattggagaagtggtaaggttataggtgagttttggagttggacgttcgttagaattttaattttagaagggtaggtatttatttgtttttttatttttaaagatttagagcgtagtttatagtagacgtttaatatttgttggatgaagaaattaggttttttattttttttttgtgtgattttggttatattaattaatatttttgagttttagtgtttttatttataaaataaagatgatatttatttttaaggggtataagaggaatttatgtagtgtgtttagtatttgtttggtatagaggtattttggtttaggttgtgttaattttgtttagaggttttttagttggaggtgggggggttagatggttggtttattcgtttttatttggggttgttggtagtgttttatggttatggtgattacgtttagttcgatgatatttgtgatgaagaggtttaggtagtggttggtgtataagtggtggacgaggagtcggaagcgggagtagtcggagtagtaaggtttgtattgggtttttgatggggtagggggaagagtagagtaagcgttaggtttttgtttttcgtatttttttatttttagttttttatagttattagtttttaacgttagaattgaaatattttataattattattattttcgttttttttacgttgttttttggtgggggtagtcgtttgggcgtgtttttttttaagtatttgttgtattggttgtagttgagggtaggatggattaggatatgtagagttttttatttatattagacgttaggtgagtttttttttttaggtagtttttaaaatttattagttttttataatattttcgatttagtgtttcgtagtaaggttagatcgatacgatgaaaaataattggtttttttaggtttagaggacgcgttattaacggggaggtaaaggtttttgtttttttattaagtttagtttttcgggggagtagaggagattatatagagttgggatttggagataaaatcggagattggaaattggatatttttttggttggttgtattgatttatttagagggtttttagaaggcggggtttgggttttttgtatttttatgttagtgagagtaagaggggaggttttggggttttgttttattttagatttaagttgggagggttttatttgttggatttatttagtttttaatgaggtattgtttagtttgtttttgggtgtttgggtagttttagattgtaggttgggttggaagtattgtttgagatttgttagaggtataatatttttttcgtaattagtgaattatttagttatgaaaattatagagttagaaggttgggttgttaaggaggtagaataaatttgggggtaggagattttaggggggtttttttttaggtgttgaggaagggttaggttaatttggggtatatgtttttgggaggaagttgatagattggttttttacgaagttatagagaaggaagaggttttttacggggaggtgtgtggtagttttaggttttagatagttttttttcgttttaggaggtttagggggaagttagttagtgagggttgtcgtttttgaggtttgagttagggggtagttggtttaggggtagtaggaagttttgggtttaggttagtttagatgtaattgtttttttttatgtataggattattgaatagagaggtaaattgaggtaaggagcggtttggggtgggtttttattcgaggttgaaggaagaagagtatttaggtattgtatatttagtttcgtgggttgttatgtttttggtttatttggttattttttagtatcggttttgaggtgtggatgattacggagtagatagttttcggtattttgttgcgttttaggtatgtatgaggttatttttttgtttttagagatcggttagttaattgtggttttgtttgttcgagaatagagttttaagagtgtggggttggagagtttggggtaagggaggataggaggttacgggttatttatatcgcgatggtggagggtgggtcgggtgggtcgggttttttttttttttttttgagtattataagaattagagggcgttagtcgttttgtattgtttgagtagtcggaatattttttttgtattaatttttataaatgtcgagagtattcgattttattatgttaaaatatgaatggagaattaattaaaatgtttgaatataattaggttagaaaaagcggttttttattagttttattattagttgagataatgtagaggagaggttgggagagttgttttttttttttcgttattttagtttgattttgtaggtagttttaggttaaacggagtagttgtttttattaattttggttttgtattaggagtttgtggggtgggtgggttttaatttagtcgggatttttttttaagaggtttagaaggaaggcggggtaggaggattgaggtagggtatttgtttatagataggtttcggtttttgaggtttgtataaatatttttttattttggtttttattttagacggtaggtgttgaggttgttagaaattttttattagagtataggtttaaagagtattaggttaatttgattagtattttttcgggtaatttttttgttttttagagggagagaatgaagttaggtaaaaagtgatttatttagttagttacgaggtatgatcgagttggattcgaatttttagttcgagtttttcgttagttgttaggtgggtatagatataaggttttgaggttttggtttagaggatatttttggatggtttgtttaaaggtttttaaagttggggtttggcgatgttatttttttttgttgttttttggatttcggttttgtaggtaagtatttaggtgtggagaagaaatagaaagtttttgggaggagttttgggtaagtttgttgttttgagagttttaattatagtttaggaggagtttggatttgtggttattgatgtattggtagttgtggtattatttttttgttttttattaggatgagttgttttaggtggagaaaatattagagttagatagtggggggaagggtatatttagggtagtttaggtttttatttcggggtagggagggaggaagggtatagaaggagggtcgtaaggtaataggtagtgagttagtaggagttatagggagtttaaggtatggttagggcggagggtttgtaaaggggagtggtaatgagtaggtagaagataggggttatttttaaggatataggttttttacggtagaggttatatttttagttgtcgtggttaggtttgattattgggtttcggtttggtggaaggaaagagggtgagtgagtgaaggtcgacgttataggtggttaaggagagtggagttggtgttggaggtttagtcgtttcgtggggtagtttgatgatttagtagtttcggtttttttttttatttgggaagtcggggtggatttaggtttttggttaggtttattttttagataattataggtttcgtttttttgtttttttttagggtttggttttttcgtttttgttgggagtagtattaggataggagtgttagtagggaggtgcggtgtacgtgtttgatttttagtagttttggattgcgtttgattttgtttttattattttggtgggtagattagtgtatttgtattgttgtaggagaatttttggggtaagttttaggaatttgtgtttatgttttttaggtgatttttatgtatatggaagtttgaaaagttttggtataggttacgtagaattttaggttttaggaagtgggatatgggatgatttgagtttttgttcggggtttttgagtttttattaatagttagggaaggtaattggtgtatatgtttgcgtgtgttattttaggatatagtggggtttatttattttaggagtatagtagaaggtattcggaatgggagtgtagtgtaagggttacgagagtgtttagtattgagtgggtgagttacgttttaggagttatgagagtttgtatgtgttgatttttgggataatatttaaggtggaaaagtttttgtgggttagttttgtgttaggatgttttggggtgagtgtgaaagtgtgtatattttagtttatagattaggtgggttcgtaagggaaaagttgaaggttattttttttttttttttttttattttttaataagttaggaatttgtaagatagtttgatgtagagatgtggggattttggtaatttagatataaattagttagagatttttgagttttagagaggtagttttttaatgttaaatattattgtttagtattatggggttatagcgttgagggttttagggatgatttatttaatgggggtttaggggtttttttttgggtgggtttttgaggttttatagattatgatatttaatatttttagggtagtatttgtttgattttagtttttagaggagtggggaaagtggagtcggtggtttttagattgaagttttaagtttgtagtagttatgggggtttttatgtttttattttttttttttttttttttttttttttttttaaatggagtttcgttttgttatttaggttggagtgtagtggcgtgatttcggtttattgtaattttcgtttttcgggttgaagcgatttttttgttttagtttttcgagtagttgggattataggcgtatgttattacgttcggttaatttttgtatttttagtagagacggggttttattatgttggttaggttggttttaaatttttgattttatgatttgttcgttttagttttttaaagtgttgggattataggtgtgagttattgtgttcggtttttatgttttttttaatattttaaaaagtttgaaagaaattttatattttgtttgtgttaaggttttatagattaatttaatgacgaaatggtttttttttgttattatttagtgtgtaattttttgtagtttagaagttgtgattagtaattagatgcgtttttgattagtaaaaatgatgaaagaaagttattattgaagtgtttttaattttatagatagttttttaaagtgtgaagtttgttggaggagatgataattgggggttttggggatgaatagtttgggaattattagttggagatatagtgttatgaggttttatagttttgttacggattttatgagtttttatatttttatttgggggttagtgggggagaggagagtaggggatcgagggattatggagggtgggttggattaggagagtttttttagagatatggtttttgaaaataaggatttaagttatttttaaatttttggttttttttggaagaagttcgtggttaatttaggtttttgatttttaatttttgttgtttgtagcgatgacgtagttatcgtgattatttgattattaatgagtttgtttaattatttattgttatatttttaaaataaattttttttttttttgttttttttattttgtttttttggattaaagtttttttttagataaaaggagataggagagatttgtagttttaataatcgatcggtgagttataaggaggaggtataggagggaagaggtggtaggaggtggggagtttggtcggttaaggaagtttttgttgggaaggtgggttttttaaagggcgtcggtagagaggttttaggttttcgtttttcgtttagtttggcgtaggtttgcgggatgttgtagagtttagcgttttagtttttgtttttttgggggttttagggatttttatttttttattttaagaggatagaattaatgagttacggggagggagtgaagagtatgtttttatacgtatgagtttatattttagacgtagtatttgacgtagcgttggttgagttgtcggaagtaattatatcgtttagtattagatttaaaagaacgaaatacgatattggttattggtcggattaggtgcgttgggtagggttttttaggggcggtttttttttagtttttattttattttgtttatgggtggggtgcgttgagtttattgggtggttggttttgaatgtttagttcgaagttgggggtatagggtatttgaggaagataagtaatgtggttagttggttagggttacggggtagggaggtatcgggaggggtaggtagtcggttattagaatagatgttcgttttttttgcgttgtggttttagttgtatttgagatagttatagattttagaaggggagttagttgggtaggtaggggttataagtgtcgtttgttaaaagaattttatttgtttgattgtgaggtgggggtggggaggatggagtaggagtgggacggtggttataggggatattgtatttgtttagttgtagatatttatagggaagtcgaattcggatttttattttgagtcgagtagaaggttttgggggtgttgatagtgagggttggggacgtggagaacggtattttttattgttgtttagaggttagtgttttttttatattttggagtagttttcgttttttatagggaatataggtttttttttatttttattttcgtttgtaatttttatatttttttttcgttttagagtgttatttttaggtcgagggagatagagttgagggtagaggggaggtaggggtacggtaattttttatttatttggtggtatttatatgtgaatatattaaaggaaaatttaggttatcgtatttattttatcggcggaaggaagacgatttgtgaaaaggtgaagagagtatgggaaatttttattttaaatagagagagatatatagatagatatataaaggtttagataaatttatatataaagatatttagagagacgtgggtcgtgattgagagagagagagaggcgcggagattacgttgtattaggtagatgggagttttggagttcgggagagagggagataggtgtagacgtatttggggatgttttagaaataaaggggtttgggcgtttgttgtgttttttatattttttttggtttttgtttttttatttagtttcggtttatttatggtataagggtatgaggacggacggatgggggttttatttatttaatgttaagagatgttggggagtataggtgaggaggtgaggggttttagggttttaggttattttagaatttttttaagttaaggggagttttttttttttgtttttgtttttgttttttttttttttaagtttagtagaaatatatatatatatatatatatattatggtagaaagttttgttagagatagggagggaggggtgtttgggtttttttttacgttgttgtttattattgagatttgttgaggttttgttcggtagttgtagatattaggtgggtgtagggttgagatgtttgttgtttattttgggtttttggatgttggtatggggtagtggagtagttagtgaggtttttttgagagttaagttcggggaggttgggtgttaatttttatttggtattatttggggaggatgatgttgaggttttgggaggttttagggtggggatagttttttttatttatggggttgaagtggtttgttttatgttcgttttaaaggtagatatgtttttggggagaaggaggtgaggaggggggtgggagttttttttttttgttttcggttttagcgtttagttttttgtagtcgtaaggttaaggttaagtacgatttagagagaggtggaaagattatcgattagttatttgtttttttttattttttttttttttttttagttttcgtaggcgttttttttttcgtcgtcgggtttttttttttttttggtgttgtcgatatttgtggaagttttttattattatatttataaatatgtttaggataaagaaggttataatgagtaggaacgagatgaagtatagtagtatttaggggttgtggtttatgatgggttggcggggagtaggaaggataggcggaggtattagttcgagggtaagttgttttaggagttgtttatagtttgggtttttgcgaatttaaatagttatagtcgtttgataggcgatggaaatgaatggtgtgggtttgatgtgaagtagtagggaggggcggggattgtggtaaaggggagagtagattttttatttaaaattgtttttttgttttggttgatttttgttttgagggaatgtaagtttagtttttttagatttttagattttttttgagtagatataaatttgaatttttgtgtaaaatttattattattttttttttttttagagatagggttttgttttattgtttaggttggagtgtagtggtgcgattatagtttattgtagttttaaatttttgggtttaagagatttttttattttagttgggattttagatgatattattatattcggttaattgtttttattttttgtagagttgggggttttgttatgatgtttaggttggtttttaatttttggttttaagtgatttttttgtttaggttttttaatgtattggtattataggtgtgagttattgtatatagtttaaatttattagtttaaaaatatttattattaatttaaaatatgttaaatatgttgtagattaataaaatatgtttagatttggtttataggttattagtaatagtttttgttgtaaaatatgatgttttttttatggtattttgttattttgttttgttttttttgttttggaattagtttatgttgagtgatttgagtttatagatggattttgtttattttagttttatttgttggtttacgtttatagtatttagtttatcgtatatgatgtttatttaattatttttggaggttaaaacgaatagggatattagggtttgatggggaggaggagaaggagatatttgaagtttaggatgtgtggttgaattatttattatttgtttttaaagtgttttttgtattagttttaagtattttagtttttgaggggttaagttggagttatattttaggttttaggagagtttttttttttagggttttataattgagttgtagttggaggggttttgagagatggttatattttttgtttttcgttaggtaggagaagggatataaaaattttggaaatttagaaattaaaattagagtgggtttgggaattaaaattgagcgagtaattttattttttgtatttttgtttttgtaaatatggagtgaggaaaggaattattttgataatatattcgttttttttattatgttaaagaaatatatatattattttattgtatttttattgtgattttcgaggagattttattatgattttatttattagttaatgaaattgaggttttggtaagttagttgttttaggttattgagttgataatggtggggttaggatttgtataggatttatatttagggttgtttgtttttattgttacgtgtgttttttgttttattatgtagttttgtggttttgggtaagttttttattttttttgagtttttgtttttttatttttaaggacggttagagattttatgggtttattttttggggtattgtgggatggattgggttttgcgatatgttggtggttagatagtagagggtgtgaagggttgattttttcgtggagtttatttttatcggagttagtaggtattattaagtatggttttgtgttttttttagttttttttattatagttttatttttgagtttggggtttatttggttaaggttgttaaagttgtatttgtgtcggatttatcggtaattggtttcggtatagttcgatttattggtgatgtttttggtattttcgttttggtatacgaaaaatttttttttgaagagttggatatatatttttagagatagagaaaagtgagttgtgattataggaagtttaggatttttgagttttatttttacgttagtttgggtatattttgagtgagtgtggggtgttttgttttggggttagttaagttagggaaatattgataagagttttttttgtcgatattttttttttttttaagagtggggaggaaaggtaatcggggcgggtagtgggaaagggtggaggcgggtaatagttatttattttttattaacggttaggttaggcgtgtgttaagtgggagtttttagtattatttgggaatatgttagaaatatatttttttaggtttagtttagatttgttgaattatatattttgaggtgggggagtagcgattttttaataagtcgttttggtgattttgacgtaaatttaagtttgagaattattgagttgggtatttaatttttatagtagttttgggtgggggagtgggtattattaattttattttatagataagaataacggaggtttagagaagttaatttatttattaaggttttatagttagtaggtagtagaaagggagttcgaatttaggtttgtttgattggaaagtttatttttattttattataaattaggttatgattattagtgaaaaacggaaggtaggattagggggtttgagtaaattgtttaaaatagatttaaatttatcggaaggattgggtttaataatgttttattttattgatttaaggaggttgggaagtgaggaaggggaagggtattgggtgggagtggggagggtgtatagagaggtattatatagttttggtaaatgtattttagtttgttttttagggttagagaatttttaggaagttagggaatagtttttaatttagggtagagtggatattttaggaagttaagggaacgaggggcggggaggggagggtgtagttatttaggggtttttacgttgtttgaatagttagttgtttattttgtagttgaaatagttggagttaagggttttggaagattatgatggaggggtttttcggttttttgaggcgtttgttgaattttgtaggtagttttggtttttttttttttaaagttaagttttttttttgggtttaaggttaagtttttttagtagtttttattttttgtttcgtttggggtttgtattcgtttgtttgttagtacgttgttaatttggtttagttgtttgggttttggatttttagatttggtttgtagtttattgtgttcgagtcgggaaggaagggaggggatttcggagtagatcgcgggttagcgtttgtgtttagggagtgcgtgtagagggtaggaatagtagtttgcggtttttatggtttgaagtttttcggtagtttcggttttttttggggtttttttttaggtttttatttttttttgaaatgtttaggaggtaaaagggtttagagtttggagggaagcgtttttgtttatttttttttggaatgaaggtagtaatagtagtttgagttataggatttaggggttaaggggaagggttttttttaggtttttatttatagttggtttttagaattttatatatttgtatttttaagatgtcgaaaatgatgaagaaggtatagtagatgattataatgttgtcgatgggttttagtgaggatattagcgtttttattattagttttagtttttgcgttcggttgattattttggggaggggagggagggaggtgataaggttttttttagtttagatttttttttgttttttgattttgttttttatttttaattttgattattggtttttttttggtttttggtggtagaatataagttttttttttatgggatttttgttattaggatttttattgtaattttttaaaataagtggtagagatttttatgttttatatttttatttttattttaggatgttaaatgtacgatttgtttgggttgggagtggggaggatttaatttaagtgaggcgttttttagagatgtagtgtattgtgggttgggggtattaggagataaatttgtaggggagtaggtagagaggggaaggggtagagggagatggattattatagttagggaagtatcgttattagtttatattatttttattaaaaaaaaaaaatttgagttgggggtggtgattggttgattggaaagggatttttgagagggtggatttttggttaggagaaatgttatcggggggtggttattggtaggcgtttgaagatggggaaagttagtaagaggagtttgttattttacggggaggggttgagtgttatttttagaggttatataagggagagtcgtagttgaagattgtgagagttttgttcgtggttttttgtgttgtgtgttgtatagggttgtagttattttatattatatggtgtagcggttttgaggaatatgttatgttgaagaggaggaaagtaggtgtgtatttggagggaaattattgcggtcgtaatttgagtgttgtttggggcggggataggatcgtttgtgggggttatagataggatgttggtttgtgtaggtttttgtttcgtggtagggagtgttggcggtgggagatgtttttgcggagggggttattttttggaggtgttttagtgttggggagggagttatttgagcgggcgtagggttcgtagtagtcgtagtatttttagtatgtttaggattttggtgtcgttgttagagattatggatattagaatgtcgatgacggagatgagtattaatagttcgtttagtacgttttaattgtttcgtaggtacgtttgtttttcgaagtattagtttagtgttattatttggggattatcgttacgttatcggtcgttttttttgcgttgtagttaatttttttatttttagtttaagttgtttttatttttattaggaattagaggttttaagttaatattagtttttattatttttattgttattttagttagaaagattgcggtgaagatgtaattggagagggttaggaagatgcgtttttgtaagagaggggaggtaggggttgttcgttaggaagtttttatttttgggttaggtttgttttgtatatataagttaaaatttgtttttaatatttgatttagaaaacgatttttattttttataataatgtagattacgttttttttatatacgtatagagttagtgttaggttttttgatttttttgtagttttgtggatagttatatttttgtttgtgattagagtttttcgtttttatagttatttagtttaagggggagaggatttgtattgtagtgttgtgatttgcgttttacgttttaagttttattttttggttttttttaaaaattggggtaggattttatttgatttttgatttttgtttgttattttattttttttatttgtttttttgttgtgtattttagaaatggagtagtagtggaagttggggttttgatatagattttgtatttttaggtataggttggggtagggtagggaggaaggttatttagttttttggtatttgtggattgagtttttttttgggtggttaggaggtaggcgtagatttttagagaggtggcgggtagggtgtgagtatagagaggagggaaggagaggagtaggtatagtgatagagttggagatggagaagttgagtgggaagatggtgagagagacgtggagatagtgatatggtgatagagagttttatagtagggttttaggcgggaggtagttaaggttggagtgtagttagcgtttttgttttattttgtgatttcgggtgtgaggtttttagtgcgggtgtttttttattcgtttagttttgggttgttttcgttattttttaggttttttttatttcgattttaatagaaaatagaagttttagtagcgttgaaatttaaataatggtgtgggagatggtaaagagggatgagaggtaaattttggttatttttaagtaagtggtgtaggatgtcgtgagcggaaatataattattttttatttatttttttggaattagaattgttgtcgatagcgaagggttataatgttaggttaggaagagatagtttttagggtgagttgggtttattttgaaggggttcgattttggggcggtatgtttagggtttttggttttttttttgagaaggattgataggttcgtagttaagtagaagtgatttatgtttttattatggtttttgaaaatttatttggttttgatttggaaggatgattaggagtaaagaacggtttttatggttattttgtatgttttcgaggttttgaggtagattgggtaagatgtttttttatttgtatatagtttttgtatcgttttagtatttttcgatttacgcgtgtgttttataaggttttggtttatgagaaatagtttggaatgagataaagtatttagttgggttgatgtattatagaagggaaattgaggtaggagaggatatagggggtatttcggggattaggatttggtgagagatttaaaggagagttttggttttttcgttttttgttgtgtgatttgtaggttagtaattgtggtttttttgttttttttattggttttgagtgtaaattttaggagaggttttgttttgagcggggttggtgatttatagcgttgtgggggttaattttggggcgttttatggcgatggtgatgtagttaaggaagatgatgataaggattacgtggtcgaatattttgtgggtgatgattcggtgatataggaggcggaatttgtttaggtatggaggtaacggttgagagggggaggtagggtaggtggtaacgagaggtatcgttcgtagtttttgtttttttagtgtttttttagttgaggttattttgtttatattttaggtagggtgttattttttaaatttttgatagtattattagcggtaatttttcgtgagaagaagaggtcgggatataggttagatttttgttttgttatttatttggattgaggagggaagatgtaggttgattaggagtttcgttcgaggtagtaggtagggagtcgggttcggatttacgcgcggattcgtttttttttgttttgtagaataaatattggagtatgagtaggattaggtttttaggtttttcggtttttggttttttagtagagttacgagttttattttttgtttatttttttttatttggggtttaagttttgttttgtttttttttttttatttttaaagttatttttttatttttttgttaattttgttaggttttttttttatttttgaggattttttgtttttttattttttttttttttttttttgtatttttaatttcgtttttttttttttttatttttgtttttagtttagttttttgtttgttttttttgttgagttgggaagtagtattagttattaaatattggttttatatagttgtttgtttagagatatattttagttgaggagatattggttttgttttttatatgttaattttgaggttattgtattttatttttagggggaatggtggtgatgaggggttggggtaggggtatatgggtatggatagagtgggaagttatggtttgtgatgaggttgagacgagaaagggggatgcggggtattagtttggagagatgagtgatgggtttttttgagttatagggggagggttatgaaagatttatatatatttgtttaaaattatttatatttattaagggtggtagagtcgtagttttaggtataggtatgataaggatttggggtttggtaaggcgggtagagggagaaaagggattgtttggagttcggtttttaggtgttttttgatatttcgtgggtttggaatggtaatttttttatattttgttaggttaggtatatttttttttttttaaggttaggggtgaggggttattgtgtttataggggttttattaggttgttttcgttatcggcgttatttttatttagtggggggttattaggtcgtagggttcgggttaggcgttttgaagtcgatttgttattgtagttttggtgtttagaagtagattttcggttattggtagtgcgatgtagttttggtatttgtagtgtgtttggtaggttaaaggaatttttggtttttcgttttagggattttttgtggcgatggttattgttcgtagggttggttcgttttttttttgagtttttttttttattttggtttttttggttttttttcgataatagggatcgtcgttttttatttgggttttttcgttttaggttgggtgtacggtcgaggttgtttcggttggagcgtttgttggtttagttgtttgtagcgttttaggggttgtgcggagagttgcgggcgttgggttgtgggtgagtaggggaggagtggttttaggtagggtttagtagttttgtttttttatgtgtattcggttttttgggagttttattggtattatattaagtgtagggatgtgagtaggagttttggattttgatgtttgggtttagattttggtttattttaattagttgtgtgatttggggtaagttattaagtttttttgtgtatttgtttttttatttgtaaattagatatggtaatagagtttattttttatttatttggtgagagaagtgttattattagttgagtggtagtatatataatggggtgaagaaatataatttaatagtaaaaaattaatttaatttaaaaaatgggtaaagggtttgaatagatattttttaaaaggagatatagggttgggtacggtggtttatatttgtaattttagtatattgggaggtcgaggcgggtagattatttgaggttaggagttcgaaattagtttggttaatgtggtgaaattttatttttattaaaaataaaaaaaattagttgggtatggtggtttacgtttgtaattttagttatttaggaggttgaggtaggataattatttgaatttggaaggtggaagttgtagtgaattgttgcgttttagtttgggtgatagagtgaaattttattttaaaaaaaaggagatatagatggttaataggtatatgaagaaatgtttaacgttattaattattagggaaatgtaaattaaaattataatgagttattttatatttgttggattggttattatgaaagtgatgaaagataataagcgttggtgaggatttgaagaaaagggaatttttgtgttttgttggtggaaatgtaaattaatatagttattatggaaaacggtatgtaggttttttaaaaatttaaaaatagagttgttatatgatttagtaattttagtattgggtatttatttaaaggatttgaaattagtatgtggacgagatacgggtatttttatttttattttagtattatttataatagttaatatatggaattaatttagtatttattaatggatgattggataaagaaaatatgggttaggtgtagtggtttatgtttgtaattttagtattttgggaggttaaggtaggtggattatttgaggttaggtatttgagattagtttggttaatatggtgaaattttatttttattaaaaatataaaaaattagtcggatatggtggtatatgtttataattttagttaattaggtggttgaggtaggagaattattcgaatttgggaggtagaggttgtatgtagtgagttgagatcgtgttattgtattttagtttgggcgatagagcggaaaggaaaagaaagaaagaaagaaagaaaatatggtatatatgtattgtggaataatatttagttttaaaaaagaagattgttatttgtgataatatggatgaattggaggatattatattaagtgaaatatataaggtatagaaagataaataaatattatatgattttatttatatgtgaaatttaaaaaaattgaatttatagaagtagagagtggaatggtgattagtagaggttggggttgggagaggtaaggatgggattaatggggaaggtttagttaaaggatacgaagttttagttggataggaggaattaattttcgagatttattgtatagtatgatggttatagttaataataacgtaatgtatatttattttaaaattgttaagagtagatttttaaatgtttatgttataaaaaaaataagtatgtgaagtgatgtatatgttaattagtttgatgtaattattttataatgtatgtatatattaaaatattatattgtgttttataaatatatataattagtatttgttaattaaaagcgaaatttaaaaaaattaaaaataaataaaattatgagagtatgggtattaatattagttttttggattaaaatgttggttttgttatttttttttgtaatttgaggtttaggttttttttgtaaaatggggattattgtggtatttattttttagggttggtgtgaggattaaatgtatttagaatgtttcggagtagtgtttagaatagtgtttggtatagagttagtatttagatgagggtttgttattattattatttagttttgaggaggtatggatattttatttttattttatagaagtagattagagcggtggcgttttgttcgaggttatttagttagggtatagaagaggttagtttaggttttgtttttagtttttaggttagggtttttattttggtttgtattatcggcgtagattttttaggggtttgtttaggtatatttaggttttatttagtttatggggtaggggttgtgtttttggattcgtttgtttttatttttttttttttttgttttttttggaatattttttattattagggtatttatatgtattttttatcggtgattttatttcgtgggtcgttttaggttttgtcgattcgttgttgttggtgcggcgcgacgtagggtttagcgtttcgtttaggttcgtgttggtgtttttgggtagcgatatgggtgtggcggtcgtgtggatgatgagaggcggtagtaggttttttcgtagtttcgggtgtttttttagggatattattgtacggggagagagggagagatttcgagtttatatagggttggtttagggttaaaagtcgtattttaggataggtatttataggttaagtatttttttttgtttttattattatttaggttgggtgagaagaaatcgggttttgattcggatttgttggtatttttttagggtaggggagtagcggattattagggattcggttaggtttgggtggttgggatggatcgggtttttttttttttatatacgtatattatatataggttataggaattagtaattacggtacgagatatgtacggcgtaggttagattttttaggtttggggttcgaggttttttagggttttattatttttgtttttttagttatattttagaaaaggttatagtttatgtgagtttatagtataattagtttggttgaacggttattaaggttggttggggagagaaggggtagttaggtggtaggtggtataggttagagggggttggggatttggggatttgagtgaagtggttattagagttttttttgtaaaagtttattggaggttttttgttttttttttacggttttttttttttgagttttagattcgaggattttggaaggaaattgaaagattttagatagaatagtttagttcgaggacgttattttagtttttcggtgttttttttttattttttttaagtttcggttttttttttggttttatttttatttttttttttgtttttgggatagttttttttttttttttagtaggttagtaggttttttagtaattatatatttttttttaagaagttattaaaaaatatttgattgttatttttgataaggatataaatattgggtaattggtattttaggggattatttttattaatttagtttatagttttaacgaggtttttaattattaagtgggatttttagggggttgttcgggatatgtagtattatggggttttataggaatgttggtttcgtttcgaattttggtgttggggtagggaatagtagagtataggtttatcgtggggttagatcgggagttagttttgatagcgttagtcggatttaagtgggtgatgaaggggttaaaggtttagaggtgatttaaaatattggtatattttggtaagagttatattttatttttatattttttaaggatttgttttgagttgagatagtttgcggggtttttaataggggtttggggtaaggggtgaaggggtgggagatgggggagtatggtttacggttagattttgattttattgaagtcggacgtttgggattttttcgggattttagtataggtacgtatatacggggtgttttatatacgtgtatatagaggattttaagtttttttttttttcggtttatttattagtttggtagggatggagatggtgtttttggtgggttgatgggggtagaggtaaggaggtgtttttttttcgtgtttttaagggggaagggatttaaaatcgaagtaaattttataatattaatgattattacggttatgataggttgtatagtagcggagcgtgaatacgagtatagagatacggaggcggagtggaggggtacgggtatggggtacgggaggtatgtcggtttatgatcgcgtatttattttttgggagtcgataggtagttgaatatagtttaattgtttattcgtattttttcgtttgttgattttttatagggaaagggggaggtaggggagggttgttggttataggcgttcggggtttttagatatcggtagtgtcgagagaggatgaagaaaaggaggggcgtaaattttatagtaggggaattgagagatacggggaatgggggggtagagaggggatagaatagttttttagaatttaattataggtttttaggttagaatgaatttgaagggtgagtgtagaggttaaaaagatggggataagggtaggtttttttataattttaataataatagttattatttattaagggtgtgtttggtatgggaaattgtttttttaatattagttggtttttttgtaaggtaggaagtgggttttaggatcgttattttatataagagaaattcgagatttggagaagttgcggaaattgttttaaattatatagagtaagaggtggatttgggtttggaattcgagtttgtggtttagaatattattttttttttatcggttcggaggtagtgggtttggggaatgggtaggaagtaaggaaaggaatggacgaaagttagagttaatacggagttaagttaggttttataacgttttatgtttttagtttaagtttttttagattagaatagatttagttgtttcgtttgagatgggatgtgataagtaatgttgagatgatggttttgatgttatttagtattaattaatggttttatatagggtttgttgtttgtttatttaattaagtgtgtgaatgataaatatatagggatttagggcgttgttttttgtaagttaggaaattattagttaagtaggttgtgtttttggattatttttttttagtttttggtaaggtagtaaggttagtaggggggttatttttgaagttttttgttggggaagtttattaaaatgggggtagttattttttttgttaaggtgggttgttttatttgttaaaataaaaataaaaattttaggttattataatagtaaaattagatttttttgttagatcgtggggttttttgaaattttatttaggagagggtaggtgttttggagttgtttaggttatgggtatcgaaggatattttttagttttgtttattatatgtaggataggggagtaattggtttagttttttttatgggtatttcggggttatagttattgtttatttttatggagaggggatgtttttaaagttttttttttattttattttaggtttgaagtattttagtttaagatatcgtattttgagtgagattttttttgtaaaggttttgatattgcgaaggttggggagggtgtggttgcgtgggttttgttgagtttttatattggggtagttttaggtttttagtagggttagagtgattaggtcgttttagggttaggttgcgtttatttttatattttggttttgttgttgtttagtaattaggtcgtttagttgtatttaagttaataaggtgtttgttgaaagggttgagtgttggggagggggttatttgtgttgggtatttttagattgttttggcggttgagtggtagaggaggggaggggaataggttcgcggtgttttttatttttttttatagagttgtacgggaatttttttgagggaatcgtggttggtaggagttgtttttagaaggggttagggggttcggtttttatttagtttttttttttatagattttgagtagtagtagagtgagtttattggtttttgtgggagtattgtggtgttttttaattttttaggttttagggaatttttaaattagtgttttattttagggagtatatcggcgtttttttttttttttttgtaagaggtatagttattattaaagttttttttattagttgttttggttgttttataggagggaggaaatgcgataacggataattatagattgaaaagggtagcggggagaaagattagtgtgggatagatacgttgtattttattaatttagtcggtttatagggaaaagtttttttttgaaagattgggaaagagtcggaaaatagatttttgtttttttatcgtgtgttaggtatttatagattaggtcgtagcgggagtttttattcgggttatttagagagaattggattaagagtttttttagatttaatttggagcgtttttaggttgggttaaattgttttgtttgaagttttagtaagttggggtgggtttgggggttcgggtgggaagagaggtagagttgagggagaggagggggtgtagttttttgggtagaggttgttcgttgatatggtaagggtaggattaatgtaaattaatattaattgatgacgttgtttgtgacgaaggtgatggagtttgggttggaaataggacgtttatttttgttatgttcgtagttaattgggtttattttttattttgggtagtttagttttgttttggttttagtggtatttttatttgtttagttagagtttagataatttgtatataagttttttgtatttttcggtttagaggggtttttttcgggtgttttatagagtattgtgtttaggagtttagttgtattataggtagatatttatttggtttgtttttttggggaaggggtttagttaattttgaaggggatgtttattcggtagttaagttttggtggagggattttaaataattattttgtgttttatgtgatgaggggttgtacgagatttggagtttttcgttttggtttatttcggtttagtttaagaggttttttttgtgggattttttaggtttttaaagttggtaatagagggaggaggtttaagataggtagttaattggaagtgggattgttgtgggtagggtgaggtgggtagagtagtgggttattttcgtttggaagttttttattagaatggcgattagtaaattgaagagtacgtagttgtcgaaggttatgagggtaatgaaataaagggtcgtttaggacgacgtggaggttatattattgtagaggattttgttttagtttttttgggttaggatttgcgggtagaagataggaattagggtttatattaggggtatttgacggtttttgtttacgttttgttttgttattttcgtatttgaaagatagtgacgatggtttagagtaaggagttaaaattttttcggtttggtagggtgtttttatttcgtttagaggtaaatttgtagtcgaagagatgtatgtttaggatgttgtgggtataagggggttataagttagggattagagtttagtgttttttattttttaggtttttttgtttttagtttggtcggttttttagtcggtaaggtgttatgtcgtttttatttgaagatgaagatgaagagtataagtagtatgtagaaggtggttacgttgtttatggtttttatgagtattattagttgtcgttgtagcgtcggtaggaagcgtattagttttagtatacgtattaggcggaaggttcgtagtatcgataggtcgtttttttgttggtttacgattttttatacgttgtaaagggggtaggtagtttgagttttttgtatttttattttttttttttattttttcggagaggatttagtagtatttaagggtttggttgggtgggtacgtcgagagaaaatggggtataggtgggtttttagatttttaagtaggagtttttaagatagtgaggatttgggtgatagtttcggtttttttcgtttttttttttttgttagagattatattttggtagtagataattttttttttaaatttggttaatgtaattgtattaagttatggaatatttgttttgtttttttttaatgaaatttaaagttaattttaaaagtaataaagtggtttttttggttttaggttttgcggggacggagtatttttttaaggttttggaaattttaaagtaagttgttggtgtttgagatgatttttaagtatttttcgagtcgggtagttggttgggttttatattttttttaatttttttaaagttaattttattttcgtttattttaggtttgggtggggttaaggataagaggtagaagtggagagaggagattaaagaggggtttgggtaatgaagaggtgagtttaaggttaataggagtaaggtggggttaagagagagatggagggggtatggggatatagagagttttttatttaggaggagtggtaggttttgtggggttagtggggtttgattttagatttttttattttaggggaataggtggtatggtttttggttttaagttatttttgttattattttttaattgagagttagtgtcggggggtagttatatttgatgattataatgatattatcgaagatgttgtagggatttttgatgtagttaaagggattatatataagtagttttagtagtatttttagggtaaagaggttggtgaagacgatgttgttgatttttagggcgttggtaagtttttcgggttgtagggtagggtgggatgtgaggtagttggtttattattgagtttttcgatttagttttttaaatatgggatattagggagaggaggagtaggaatagtaagtttgtgcggaggggttgttggatgtttaggtttatggggaggattttgttttaaaggttttaggaggaaatgtatttaggggtaggggttttaggaaagggttacgtgaaatttatagttttagttttgggttttagatttaggggttataaatttaatgggaggtttgtggtgtgggtttcgttttattttttgttgggagttgtatggtttattttgatttaggttataatgtaagtttagcgggtttaggttagtagtatgataatgttggcggatgttagagggcgatcgttaaggttttataggtatattcggtcgttaagttttatataacgttatatgtattttataattattttgtggatttggtagtttttttttggataatagttggttatttttgtttttttttagatatatatatatatatatatatatatatatatatatagagagagagagagagagaaaaatgtacgtatttttagttatatatatggtgataggtagaaggaagatacgtagatatttaggaagggttgttatagttgaggagatatttggagttttagtttgagttcgggatattcgggttaatttttagtttattttgttatttattttgtgatttttagtaagatttttaatttttttggttaaatgtgaaatattagaggtaattttttttatgttttttattcgagtttgggattgggattgaggatgtattttagagtttttagaaggacgaatgacgaattttgttttatttgttattttagtttattagtgatttcgtttttaatatgaagtgtttagtaatgtattaggtattaaaggagttgtaaaaatatgttagttatacgtttcgttttttaggagtttagtgtttgttagaaatacgttgtatatatataaaacggttgaataattataagaggttttaaatgttttagtgttaaaataaattatttaggtagtaagttcgggagtttaggggagaaaaggtgaggggtgaatatatagagaaaggtttagttgggagagaggtagtatttgaatgtttaagggtttgtggagtttttttagttaagggtttaggtggtgtggtacggggtggggggattatgagtaattttagtttggttttggttgaagaagggaggggtgtggttaggtagagggttggggaagtaagaagagatatggttggtttaatggattttattgtttatttgatggatgtttggataaattaggtgtttggtttggagggtagaggttaagtttatagtagttgtttaaaaagtatgggttaatgaaatatttaaatgaggtatttattttattagatatttttttttgttttttattgtttcgttggttagttgtttaattaagtttgtagttaggtttgaggatatttaaatgtattttaatggttttagtttgtgtagttagtttggatgggaggtgaaaagattcggaataaggggtttttgattagtaggtgagcggtatttgggagtttcggggataatagttatttagagagagataaatttttagattgtttaaaggtaggtttgggggtagagttagggttagtaggtaggtagatagttagttatgtagagggggagtggttgtcgtgggggttagtatggtatggagttcgttgttttagtagattttaagtaagtcgtagtttcgtggattgtgagtgggggtattgttatttgatttggttagttcggttatatagggttattagtgttttcggcgtgagtatagtataggaggtggggcggggttaggattaatgtatataaagttttgggtttagattttatttggttaagtggatttttttattttgtatttttaagttcggtttgttagggagcgggagtcggtaaatttttttttttgttattttgttattcgtcgtgttttcgggttttggattagattaaaatgaatatggatcgtataggtatgatgtttaaagttatagggtaggaagagttggggtggggtttaattttatatttttttgattttaagaatattagatagttaggatttagaattaagttacggtgatggtgaggggtttgtgaatttagatatacggtggattggatatataacgtgttttttaaaattatatttaaattaatagagttttaggaataaagattaattcgatgtgaagatatagttgaggtacgtttataatgggtaaattttatggtatataaattatatttttaaaaagttgttaaaaataaaaattaatgaaacgtttttttaaaagttgttgaaaatatagtagtttttgatgttatgtatttatttaattagtgaattttaaaagttcgattattattgtgcgtggagaaggagattgttttttttatttttcgatgttatttacggggtttttaggagtttgtattgatggtttgtggatacgtgtatattttatttttttgtatattatcgagaggtttatggagaaggatgatgttaggtttttgagaagtttgtcgttttataaggtttgttttattgaattttgttaagggttgtgttagtaaaggttggaatttttgttttgtttagttaagtgattttaggtttggaaaagtagggtagtttgatgtaggtggaaaggggtttggcgtattttttcggttttgttttgttttttttagtttttttgtaatatttagggtaaatgttattttttttttagggtttcggtattttttttagtgagttatggaaaaagagttttttttttttagatagttaggtttgtttaagttattaaattggaggttgggaacgatttgcgaatgtaggacgaggatatagagatataattttagtaataaagttgttttagggattagagttgtaattacggttgaaaaggggtaggggtggagttaatatttggtagtgtttattataggttaattaggttgaagattttttcgtgggattttattttttttttgtttataataaacgagggagggttgtgagttttttagatagtttgggaaattgaggtttcgaggggtgtggtgttttgatggaggttatattatttttttggagaggtgtagagttaggttcgttgtgtttttttttatatttttgtttttaagattttttttataatatcgtttttattatatatttagatagagtttatatagagagtatataaatttattaggttggagttagttattttttattggttatttttagttgtggaagtttttttttaggtttagtttgtattttttttgttgtttatagatgttaaggtttagtggaggtttcggtgaaatgaggttaggtagtttgagtttattttatttagaggttttaggttttttgtttgtgttgatgttgattgtaaatttttattttttattttttaatatttttatttttttttttttcggttgttattttgtagtagcgttaagttgtttagtattttttagtatcggggttttttaagttttatagttgttttattaattagttttaaaagtgttttttgtgtgttaaatattggtgttagaaaggtgttattaattttgagattttttttttatgtgattttgggtaattttttttgttttttagatttttagtggttttttttgttaaatagggtaatattattttttgggaggttgttttatagaataaaggagtgaaaggttgtgagaaattttagttttagggttaagtttatagaaggtaggatcgatatttgtaaggttgtaattaaatattatattgggggtaaaatttaggagttacgggagtttaatttcggttgaggttagtgggttagtggggaggatagtttgggaggatgtttatggagggtgtttttagttggggatagtaagggaaggggtgtgtagggtatagtgtagaattaagaattaagttgtttgtttagattagagggtgagaggggttggtgggagagaaggttataaggtcggtagggttaggtggaatagtttttttttgttttttttggataagtttttgtttattacgttgttattgaggttttgggggcgggtgggaagggaggaaggagatgtataaagtagtgtatgaagaagattaatttggttgtagtggtggtagcgtgtggacggtttggagggtagagatagaaattaattaggatattgtagtagtttaggtaggaggtttgagagttagttttggtagatagtgatgtgttttttgtagagagggtatgaggggttggataggtttcgttagagttgagtagaggtttggattagttattcgtgttttgtttaagttcgattttagttagttgttatcgttttagtttttatttgttttattgattttgaaatttttgtttttttgtttagattttttagtttattttatttttgtttttgatgggtttgtttgttgtttttatttatttaggataggggtatagataggttgtagtgaggtagtgagggttattgggttagtgggaggtaagtttttaaggaggtgtgggaagttagggaatatttcggtggtaggaggttttttggaaattttataggttttattatgtagattatggttttggttttttttagttttcggaagttttttagtttggatttttttttttgtgtttttttgtttattgggtatattgttaggtgttatggtgtttttagggttttttaattagaggtagtgttaaggagaggttttagttatagttattgtttttttgtttttagggtaatattttttagagtttattttacgtttattttttttattagtatttttatttttatttttttattgttattggggtgtaggtgatatgatattttttagtttttcgaagtttttaaaagtaaatatataagttaattaggtatagtatatttacggtgtttatttagttttaagatagttgatttaaggtttttgttatttaaaattttggagttatagttaggtatggtggtaggtgttcgtagttttagttattggggaggttggggtgggaggatcgtttgagtttagaagttttaggttgtagtgagttatgattaagttattgtattttagtttagggggtagattaggattttattttttaaaataaataaataataaaatgttggagttgtagtttttgtgttttgtttatttgtatagcgtttagtttatggtgggttatagtaggttatataaaggttgtttttttgacgaagatttttaagagtttttgttttgtttagttttagtttaggtaagtgtttttgtttttttttttttttttgcggttttggaagtgttgagtatcgttagagagaggtacgaatatgtgttgattggataagtgattttttgtgggtggtggttttatggttgttttatgtttttatttatagtttttggtttttttttttttaggtttttttttttttttaggagttgttttaatttttttggattttgtagtttttagttttattttttatttggtttttcgttgtaggtttatatggggggttttacgttttttttttaaagagttttgtgttgtgtattttattgttttttttttttttttggaagggagttagtcgtttttttatttgtattttgattttttgatgtgttttttcgtcgtttttttgttattttttattttcgttttcggtttttttgggttttggtttattagttatgtttgtatttattatttttttaatttttttttttcgtgtttaaaagtagaaagtttttgtgggattttagatttatttagttttgaattttgggttttatagttttagttttgtttagggattttttttttagttttttttttagtggatgttttagtagtagttgagttttttttggttttttcgattttgagtaattatttttttttttttttagtgtttattttatcgtttttttttttttaggttagtattttttagagtttagtttaagttcgttttttttattagtatttttatttttatttttttggttgttattggggtgtagacgatattaaataatttttttaagtttttggttttttatttagagatttagagtttgtttgattttttttttgggatggtttatagttattttaaatttagtgtatttaaaataaattttttcgtttttttttttaaatttgttttttttcgggtggcgttattatgttcgggattttgttttagaaatttcgggttatttaggatttttgtttattttttttttttttggatattaaggtgtttcggtttagagaatttgttagtgaaattgcgttttatttataatttttcgtttttatagttatggttttatttggggttttttttgtttttgatttgaataatagaaatagtttttaggtttttttttatttagtttgtattaatgggaagtatcggttttttcgttgggttaatattaattattgtttagatatttcggggttagggtagggaggaaaatttgattgttttttagagtatcgagtgttattttgtgtatgtgttttaatttttttatttagatttttttgtttttatttatttttttattttttatttttttttatttttattatttaagttattgttaattttatttatttttcgaggtttcgtttaaaagttattattttcgtgaagttttttcgaaggagagttggggatgagtagtttttttttgttttttgaagttttttttgcggtatttggtataattatttatgaaatagaatgatttttttattagaatttatattttttgggtgtttttggtttagtttttaattttttgatattttaatattttattttagtgtgttgtgtataggatatgttttttttgtttgtagaattgggagagtttggagttaggggatgtttaaaagaataagagaatattttagtagatatttttaaaataatgttttttttttttttatattagatagtttttgaatgtttggggttagttagttgtaaaggattattttttaaagttttgtttggtttttagttttagttttttagttagggtttttttatttggagattaagggattggttggggtgggaggtgtttattaatttttgtttttaaaggttatatttagggtgtttaggtatatggggattttttggggagagggtttttagtttttagtagaattgaaaaggagtttatgattttttttaaagtttagatttattatatttggattatttttttttgttttatttttagtttttttcgttttgaatagttaaatttatttatttataaatagaaattttttttggatatgtatttggagtgataggatggttttagagtgtgagtaatgagtagagttattatttgttttgtttttttttagtttgtaaggttatttattttggtttttttttttttttttttcgtttatagtttaggagattattgggttatatgtagtttttttttttttatatgttgttgttttttttttagaatattagattagtatttgttttttattttattatgatttagagttaggaaggagatgttaggaagtttttgtgtttttaaggttttatttttgtatttttttttttttggagaggtttggttttagtgtagagttaggtaggatatagaagagaaggtaattttttttttgagtttcgatagtttgttggatatggttaggatggttcgtaggtattttgtatgtaatatgttttttagtttatatttgtttaagttatattgtttttattttaggtagaaatttgggagttatttttgttgtttttttttaatttatgtttttaattgattgggttttgtagatttagttattagttagttttttttagttttttgttttttatttttagggatgaagatgtagtatgaattgtttggattattgtcggagtttttatattgtgttttgttttttatttttattggttatgttttattttttttttagatttagtttagaggttattttttatacggagttttttttgaattttttttttggtttgggttaagggttttttttttacgtatttttttttgagtatgtgttatattaagtaaatatgatcgtttatttgttgtgatttttttaaaaagaaggatagtgttttgggtttagtggcgtgttggagttgttttttattggtttgggagaattaattgtttacgtttttttttaattttatattcggtggaatcgtgttggtagtttaaaattagttatggtgggagtatttatattatggaaattggtaaatgttatagattaggattttattattttagaagggttagttgttaattatttattagtaaattattgtttaggtttaattttagtgtaaaaggatgaattggaaaaaggttttggattttatgtatcgttttgagcggatggggtatatatgtaggttggttttatattagattatatttcgatattaggttatttttttgttttttttttagttttttgggtttttgttttttttattagttttttgggtaaatttaattttgttagtttttttttagttggtggttaaggggtggaggaagtaggagatagaggatagtatggggttagtttcgggcggggtggggtattatatataggtgtttttttagttaggaggatggtggggtagcgtaggttggggggacgggataagcgaatgatgagttagttaggggatggtgggagaggatagggtttggggagggtagcggtgacggttaggagggagggtagggattttttttttggtaaagtattagtaatattttttttagtgttcgtttttttatttaatcgatttcgggattaatggatataattgttttattaagggtatcgtagggaagtcgtgagtttttttatgtagttagttttaggggagtttttgtttttttattttatttcgtttttgtttttatttgtatttgggattcggtttttgtttttagttttttttttgtgtttttgtttttttgtgtgtttttgtggttttatttgtttttgtttgttttcgttgtggtttatttttttttttatatttttttttttttgtttgcgcgtttttttttttgtttttttttttcgtttttattttgtttttcgtgtttttgtttcgtttttattagttttttttttgtttttttttgtgtttttatttttttatgtgtttttgtttttttttttgtgtttattttgtgtttttgttttagttttttatatttttttgttgttttttttggtaattttttatttttagtttgtttaggttttagggtttagatggcgggacgtttacgtcgtagtgtttgtaagtatagggttatggtagtttttgggattttttatttttcgtatttttgagttcgttggatagttgttagttatttgtttagtttgttggggattttcgtttatttttatggggtttttagtattaggtatgcggataaaattttttttggagtagatattgttgttattgagtgaggtttttttgttgttgaggatttagtgggagttttgggttgttttcgtttttttttaggagtttgagtaagaagaaggtgtaggtatttttgattgacggttgttgttttttttttaaaggggcgttttttttgatatttaattgaaagtttttttattaaggttttatttgttttgggtttgtgtgatttagtttttttttagtgtaattaaaatttttattagtagtatcggttgggtagggattgttgggtgtttttttcggggtagggagggggtattggggaggtgttttttgggggaggggtatttgattatggtcggaataggggtgagggaaaggaggttgaggtttagggagtttgagtaatgggaggttaggggttgttattatttgggtttcggaagtagaaaatgttgtttattttttattgttattaatttggtagagtggagtatttttttttgggaggttggtagagttggtatgtgtatatatatttatatttacgtagtttagatataatatgtttatcgtggtgttaagtgcgtttattcgttggtattgtagttagggttttattttttttttattttatggttgtttggagggggttttgtggaggttagaggaagggacgttaatgtgtgatggtgatggggaggggtgtatttggttaggtcgagtagttttgggtaaaagttgggtgttcgaaatattgtaggtgtagaggttagtggtgtgggggcgggtttcgaatttttcggaaaagtgaatattttattgtttgttttagattcggtttgatttgtgttttttagttttaatttagattttttagtatgtttgtattattttgtttgtattatttttttgagatgttttttttatagggtgttgtgttggtgtaagagttattttatattattggtttttttcgtttttgtttttgattgggagggtgcggaggtggggaggtgtatggttttcgttttaaattagggaaggttgggttttgatggtttagtgttttcgtgttattttagggaggttagaatatttaggagaatagagtttgggaggatcgtgaattgtagtatttgtttgttagtttttttttttttttaagaattagttataggggtgatttgaaaggttagattggggggagggggagcgatttttggaaagaattttgtggaagagggagttaaatttagttgtgaggatttatggtgtttgtttggatttttaataagcgggtatttttagtttatgatgggggattagtggggttttttaggttattttttttatttttgtatagttttgagggttagaaaagtttttttttttttagtttagattttattgtttgtagttattagttttataaaataagtttgtttttttttttatatgatagttttttaaatatttgaagatagtttgtttgtttttgttgagtttttgttttttttaattaaatatttcggtttttagaattattttttaaacgcgatggttttaagtttttttgttatgttgggtatttttatttattttgagttgttttggtttatagtacggtttttagacgggaggttaggaaagattgtttttttttttgattttaataggtttttattttatttaggcgtaggtattaatttttttttttgtatttttgtttatatggttttttttgtttttaattagttatattcggatttagtgggttagatggatgttataggatttttaatattcgtttttcgtattatattttttttaaagatttaaatattttttagtgacgcgtttttttttatatgttgatgtttattatttgtttatattttttaaagttagttttttttgagtagtttttttgggtagaatatattttgtggtttatttgaggcgatttttatatttagagattttaagtattttttttagagaatttttatgtattgttttattatttatttttttttttatttgttaggtgggttagtagtatggagaggaagttgagtttaggaggaggggtgcggagggaggtagaaggttttagttttaggcgaaaagtagttggtaggagttttgtttttgtttatttttttatttgttcgtggtattcgatgtttatgttgagtgtgttgattaggatggcgattatgatttttcggttaaagtatttgttgtttataatttttcggaaggtgttatagattagtttttagaaggttagtatagagttgggttttgtatttgggtttaggtttcgttgtcgtcggttgtgggggtttcggaggtcgttgtgttgggtattttgtgtgaatttataaattgtttcgttgtttgagttaggtattttacggtcggcgagttttattttttttgtttcggttcgggtatagtaggggtagttgtttggattataggttttattgtttgtttttaagtaagggttggagattttgtaagagttttggtaggtatttggaataggagagtagaggtgagaggttttagagtttcgtatttggggttattttgttttgtgagtatgtgtaaaatgagttagggagtttggggttgttatagtgatggggtgttaggtatttagtgggttaggggtgttgaatgttaggtaaggtgggtagttttgatttataagatgttttaatgttaatagtattttattgatagttattgttgagtgttttggggtttagagaggtggtttggatgttttttgaggttttggatagtttttatattttaggtgtttttagtaaggagtttcgtttttttttttttttttagaagttaggattatattaatattgttttgagtagtattttttatgggatttttaagatacgtttatatacgtgtatttgtatatatatttatattagatacgtgtatttgtatacgtgttttagatgcgtatattcgtgtatatatgtatattatttggatattattatatgggtatatatatatgtatatattaatatatgtgtgtataaatatatttatatacggtatatatgttagatatatgtatatatgtatatatattaaggaaagagttttatatcgtatatgtatttatatatattaagtatatgtgtatatatatgtatatgaatattagatacgtgtatgtatatacgtatatatatatattggatttttttatggatatagacgtatatacgtatattagatgtattcgtgcgtatatatttagggatttagtttaagatattaatgtttttttaaatttagttttgattatagaatatgagaattttagagagtattaggtaaagtatggatgtggaagtttttcgtttagggtttggttttaggtgggtttttagcgatattttttttttgattgtatttgtatataggagggagttagtaagtatttattgagagtaattatgggtttagttttgttttttatataggaggaaataaaaacgtgggtgtatgtgattggtttacgtttcgtggtagggtagtggaggagttggtatagaaatttttcgttttgggttttgtgatagtattttttggttttagtttatatttttacgtaatatttttacgaatatttcgttgttttttacgtgttatattttttttgaaatataggtcgtgggttgtagttatagtgaatttgtttgttggggagagttcgacgtttttatgtgttttattgtttttacgatattgggagtgttatttattagataagtagttttttgaattgggtttttttgtgcggaggtaatgagatttaggtttagttagtggggtatgaagttgggtatagttatatattattttttttttgagttttataataaggagtttcgagtgcgggtttcgagttcgttttttattaatagtaaagttttgggtaagttatgtaatttttttaagttttttggtttttatttatataatggggatgttaagaaagtttattatttaatgggtagagaggatttaatggaattttgttcgtaaagtatgtgataggtatatagttattgttgtgtgtaatagttgttagatattattgtaaatagtacgaagtaggtgtttattatatgatagttattgttattataatgtaggaattatgagttttattttagtagatgagaaaattcgagtttatagtagggatgtgattggttgaaggtgtttaagttatgagaggtagtatgagaatataagttttggtttttttgattttagattttttagttttttttgggacgttatttagtttttagacgagggtatttatatgtttttatttagagtttttatttgtattttgtgtttttagtagtttgtgtatggagttgtagggttcgggtgggatgttgaggttggtgagggttgggggtttagagttggtagttatttttattagtgtttttttttttagcgttttcggtggagggttggtgtgtacggtgggatatattttttcgttgtttatagttttgtcggatgttttagatggggatttgggagggggcgtttggtagcggattggttttaagtggtagtcggtatggtagaagttgtgtatagattttgcgttattagggggggtttcggagagggtaggcgtcgagggtggtggtagtatgagtcggcgggatttattggtatttttgttttggattttcgggttggttcggggggttttgagcgttttattgtttaggtggtagtggtggtgatggtggtggtggtggtgtattaggtggtggacggataggcggcggtgggagcgagagtagttgttgttgggttgggttttttggttttcgaggggtgttgggttgttgagtagtttaattcgtatatttgttgttcgagagatttgagttagtttgcgggttgttttacgaaggatgtatattaggtatttgagtagttttttatagtagttgtcgggtttagagaagttagttagggtgttggcgttggataggaatcgtatacgttgttttcgtattagttggttttttcgttgtttggtttttgagaattgcgtggtaattattattaggtataggttgattatgaagaaggagtttatttgtaggggtggggataggaagaggaaatgttttgaagaaaagtgaattataatgttagttattatatacggaggtatttttatgagttaagcgttacgtttagttattttttaagtattattttattttatttttaagatagttttaggaggtgatgttattgtaatttttattagataggtaaggaaatttaggtttatagaggttaaatatttgtttaagattatttagttaatttagagtaaggttaagattggaattaagttttatgaaattttaagatattgttattgaatatggtgttattttgtaattttttaaattttttgtttttaaatacgtatatttgtagagacgtagtatttttttcgtaatttttattaggagtagcgaatgttgtggaaatgaacgtaatattagggatatggggtttttaaattatattgagttttgagattttgataaaaatattatttataagatttttgtttttagttttaattttagttgtgtgattttgggcgagagatttttagttatgggattttatatttttatttgaaaatagggattattggttttgtttgtttttattttttttgtgttttttttttttagatgtgggaggggttgaatttttgattttatagattagttaggttgttatttgatttgtttatattattttagtttttatttttacgttttagtttttttagaattttggaatagttattgtttggataataattttaaatgaaggaaatgaatatttatggtgataaagtagattttttttttttagatcgtgttttagtaattatgataattagttttattagtgtgattttagagagttgttaggaaagattttttagggggtgtgtgggagggtggaaattaggttttttatttttttgtttgttttttttttttttttttaagtttaggagggaaagggagtgggggtggggggggtatatggtgagaagattttatttttttgaagtattggttttattttttgaggtggtggttagggatgggaataggtttttagttaggtttcgttttaagtttgtttatttttttgtattaggggaagttacgtaggtagaatgaggtggttttggggatttgtttttttttagggtttattttttgttttttataaggagttgttttattttgtttttatttttttttggagttagttttaggttttgagtagattttaattttttttaattttttttttttaatgtttgtttttttgtttggttttgtcgttggttttttggtgatatggaagaaaggttgaatgtggagtcgttagtttgggattgaatttttagttttagtcgtttattttttgtgtgattttggtttagtgatttattttttggggcgttgaatttttatttaagagatggggattataatttttgttttggtattttataggggacgacgaggattaaataggtagtagatgttatagtatacgttagtagtgatgttttatttttggagattaatatatagtataggtaaagcgtttggtagggttagataaatgaggaaatgttagtttttttatttgtaaaatggagaggattacggtgaggattaaatgtattagtatattgaaagtgtttagattaggggttggcgtatagtaagtgtttaataaatattagtttaaagtggtggcgatgaagttattaattatgaatggtagtgattaaaattattaaatattgttgtttttgttttcgttttttgtttttttaaagtttggtaatttttgaattggtaggaataagagattaggtagtatttaatattaattgattattgattagaattttgggtagaataattttttatttgtaagtattttaggatgtttagtttttttttttttttttagtaataaattgttaattgtattttttttgtttttataaaaaaatagaattttgtaaatatgtttaaaaaattattggatttatttaaagggatgaattgaatgatatgtgagttatgttttaataaagttattaaaaaaaattaaaattagaattatttttttttatttttaaatgttttttgggagaggtggtattattttaggttgagaattatttattttatttatgaagaaatagaggtttagagtagtgttggaggttttatggagaatgatttgtttaaggttttaatagtagttaagtttcgttttgattttggatttttttttgattttgtatttggtgttttttttattatatgatggatgttttttttataggatttgttttgagagttaaaaattttagatagagtaaattattttttttttggattgtttttataggtgtttttaggatcgtttatttttacggggatttgaggagttatttacgatgatgaggaggatgaagtagatgaaattgtagaaggaatgagtatttattataaagtatatgatgtcgatttagttttttagcgtgatgatttagggggtgtagaggggtaggttgattatgggtttattaaatttttttttagttttttttagaggttttgatttttattttaattttgagagcgattatttcgattttgggttgtgttttggggttggtgttttggggaagttttcggggtttaggttgttttatttggaagatggcgatttaggtatagttaatgttgttaaagttgatggcgtttttgaaggggttgtgttttttcgttgagtagttggtgtagtattggttttagttgatataggtggtgttgttggagttgttgtaggttttatagtttagatcgtaaggtgggttatcgttttcgttttcgcgtagcgtgggtacgtttttgtaggatcgtatgtcgttttcgcgtggttgggagtagatgaaggggtttttattttcgttttttgtttggtaatagcgttttaggtttacgtttagggggttgtaggatgggaaggggaataggggtgagattggggagtgggttttttagggagagggtttaggaagggagagatggtacgagtgttcgaggtatatagggtgagtagggtagaattaagaatggggaagggattgggtagggtagggatttgtgggtattaggagtatgaggtttgagtggggaaattttagatttaggatgttggaaggttatattttggaatagtgatttttaaattttattgtaagttaggattattggaggggttgaaaaaatttttatatttaagttgagttttagagtaatgaaattagaatttttggaggtggtatttaggtattagtattttttaaaattttttaggtggttttaatgggtagttaagtttgagaattagatatgttttagatgttagaatagatatgttagtagtaatcggaagtgaggaatttgggggggtgtttagttttataattatttttaggttttttttggattttgtttattatttataggttgaaatttttaggtaggaagtatcggtttcgaagtagttttgtttatagttggacgtcgacgatgtcgaagatgaagaagacgaagaagtagagtagtaggacgttgtttagtatgggtagcgtatttagtagtaacgtgataaggatgcgtatgtttgtgggggtagaagttacgttggggatattaggttggtcgggttaggttgattgttacggttcggtagtattttcggaggggttttattagggattttgaggttgagacggttcggtttaagttggaggggagattaatagatatttttgattttttagatagtttttgtagttttttgtttcgatttatttttttttgtggtttgtttacggtaatttgtatagtattattaatagtgagttggggaaattgtggttttttttaatttttttaatattattatatgtggataatattatttttaatttatagatgagaagtttgaggtttggagaaatgatttgatttatttagtattatatagttgttaagtgtaggtgtcggaattcgaatttaggttttggttttcgaatttttttttaatatatatttatattcgtatatatttatacgtatattttttatttattttttttttttaataggtatagttatttgatttttttaagttattattattagagttattagggaaattgaggtagcgaattttaggaggaatgatagtaggtaggaattttattttgagagttagtttttaggtaggggttaagatgttttgtgttttattatggttttgagttttgtttttttgaaattattttttgtttggtttagatttttaaattaggatttgaagagatataatattgtttttttagaagtttattaatttataattttttttatagggaaagttattgaaattttttttttaaaagttttgttagggttattttttttttttcgtattttaggtttagaatttaatcggtttaaatggtttgaattagtttttagttcgttaagttttcgttaagtagatagatttttaatggttggttttatttttaaagtgttatttatggttttttggtttttttagggtaaaagttgttaagtagtagttaattaatttttttggtgattgtagcgtttagtttcgtttttgttagtttagtttttttatttagtttttttttttttttttttattttatttttttttagtttttttgtgttttaattgagattaattttttagggtttgtattaagggaattatatcggtggttagatagaggtttataaatttgttagttattatttggggcgggagaggaggcgaggtatgttttttttttggagtttttgttaatattaatatatttcgagttttagaggatatatttaatagttttgtttttttaggggtagtagtaatattatatatatatatatatatatatatatatatagagcgtagggggttgttgttatattaggtatataaataggtattgagttttagaaatatgtatttttcgttaattattttatttttaggattatagtagggattatttgtagtttgtgtaggttggggagttgtaaagggggtttgagtaaagggagggggtagtatgtagggagaattagagttgttaaagtttcgttggttttagaaattaatgtagtttaatttagataatgggttcggtagttattgtaatgggttggaagggggcgggaaggaggaaggggatagaggcggagggtgagatatggagtggttttgttttgagagaagttacgtttagcgtggttagcgtgttttattagtaagaattagattgtatgagaggttgttttggttagaaaaggttattagtattttgcgtttattttttgtttgttagtttttttagtttttatatttttatttttttggggggagtggttatttagttgaaggaagagggttatttgagatgtttttgagattttgatttaaagttaggttaaaatgaggtggggtttttttaggtaatttttatagtgttatatttaggagttttattttgttttagtaattttagttttttattgagtttttttttgacggggtttgtgaggggttaggtgaggatatagtagtagaggtggggtttgagagttttatatttttttttggggttttttttaggggttgagggttgaggggttatttattgggtattcggttaatggttttgagcggtcgtagtatacggattgttttgatagttgagaagttgacgttttgtaggtttagcgagtattttagtattttgtagggaggggtttaaagggaggttttttgagtttgaggttatagtggggttaaaagaggttaatgaggaattttgttttaggggtagtaggatgatttttgattttttttttttttttattaagggattttgaagattcggttttttgtttggggggtaaggttatttcgagataaggatagattgtttattagagaagggggtagaattaggaatagggttttggaatttagaatataggttatagtgttagaggtagggtagttttagatttttaggagatagttagggagaaagtggtgttgtaattgggttggagttgagaggttataggtttagaattttggtttcggggaagggatcgatttgatttattgtttttttattttagtttaggtttttattttgcgatgacgatgaaaaagttaagtcggttttaagtgttttttaggtaatatttttttttaaagatgtttaaggttattatttttattattatttttacggtaaagaaggtaaagatgaagttattaaaggtttgatgtggggataagaggtggttgaaattgagacgtgggtgagggaatattttttagttttattttagtttttattagttgggttagggttttttgtagaggagtagagggtattaagattaagaggggttaatttttaatatatataatatatatatatatatatatatatatatatttatttgtaggattcggtagcgttgggagttataggcgatgttttcgtatggtcggaatatgtttagggttacgtagttgagaaggatgattaatatgttgatgcgtttaaattaggtattggtagttaaggaaatagttggttaaggttggagttgaggtcggtttttcgatttcgttttaatatttttttttcgtttattttttggttttatttgaggttaagtaggtgtggtgttagggttttgatatatacgtagattagtttttagttttagattttttattagagaaggggagttttattttggttattttatttttttggatttagtttttttatttgtaaaggaagataagttataaatattttgattatttgtataagttatttggggaataaatcgattatgtttgtggaaatgttagatattatgagtttgttgtagaatttgaattttattttttttattttatagggtagatgtgagaagtaaatgagatattgtatgtgaatgtgttatataaatttaaagtcggattatgtttgttttatagtttattaagtatttttatataatgttatagttgatgtttataatagttttgtgaaatatttggggtagattatttttttttttagaattcgaggaagttgaggtttagaaatgtcgaagttatgtgttgaaggttattcgagaaggtaggatgagacggtggtttttaagtttttgatttatgatagttttttttgtatattatagttgtttaggtaggtagaattgtttgttatgatcgttttggtattaggtgtaaggtagacgtttatagttgtagttttcgttgttatagtattagagttcggggtttttttttttattattagttttttaattttttaatatttttaaatgattattaggtatatttatatatttaaatattgaggatttattatgtgttaggtattatgttgggtatagtttttaagtcgtgtagagtggataatgtttatttttttttttaagaggttattgtcgttattatatttgtttgtggtttttagtttagattagttaaaatagtaagtaggagagaggggttttttttaaattttgggtttttttatatagtggattttatggggtgatttatttttagtttattagtaggagaatgtataaaacggttttcggattttagaaggttttaggtattggatttacggttaaatgattaagtattttattttttttaaggaaaatatgagaagggtggggaagagtaaagaggttagaaaagattagagagtaggagattggggaaaggagattagagattttttggggaatggggatgggggaggtattgtggtagtttttggtatgatttattaagttagattttgtagggtttagagtaggtggaattttgtttttggaatgagaaggttttggttaggtatgaagaggttagtaggaatgtttaggaatttatggattttttttttagttggttttagttatagtttatttttgttttgatttttaagttatatgtttttttttatagtttatgaattttttaaatttttgatagtttttttttgttttttttttattatttaggttttttttttttagatttatatgtttgttcgttatttgttcgtggtatttcgagagttttaatgtattgtagtttttttaatttttatttttttataagaataagagggtttaagaaaaaagttttaggtttttgggggtaggtagatgatagggaggaaataaaaagtgttttgtttttacggaattgtttttttgagtagagtcggagtgtagtggatttttttttagaatgggggttagttaggggttattttggaaaaagggggataggaagggagttattatttggaaagggaaagatatagttatttttaagaattggtttgttttttttatgtaggttttttttttttttttgtagggaaaggggggtttggaaggagttttagtgagtgaatgtttttgtgtggaggtagtagatttttgaggaagaggggtttttaggatatttgtttggatttttttaatggtagagttttatcgtgttagtaatttgtgtatttgtcgattttttttgttgagttggggtttttgataggtaggggtattttgatacgtttttagattttttacggagtttgttgtagtgtttggtacggagtagatgattaatatttgggaagattgaatgaatgaatgaacgaattaattaattaataagtttttttgtttagaagttagatgtgtgtttttatttaggtttttttgttttgttttttttgatagaggtgaattgtttataattgggggaaggtatagaagtgattttatagaggagttgtttttttttttgtttttattttatttaggtttagattggaggttttttataggtaaagtttgttttcgaataattttatgtatagtttttgattatgttagtttttttttaagggttttttggtaatttagtttatttttaagtaatattttgtttattttgtatagttttttttttacgatacgtaagtataaacggatagggaagagattaaggtatacgataatttgggatattttgaatagaggaataattgatggggggggggttttttattttttttagagtagggtttgtttttttgggaatatggtagtatgttattgtgtgatgtttttttgttgttataacgataggaggatgtgttattaggtggtgtggatttgttgttatggtaattaaaaagattttttttatatgattttttttgattgaggttgttgttttgtttttatgtaggggaggagaattagggagatttataggttattaggttgggggaaaattatgtgatagatttttatggtaattaagggaacgggggatattggttgttatagtgattatgagagatttgtgtagttatatgtttattgttgttatggtgattgttcgggttggagtggattttaaagagggggtaggagaggggaggattttttttttttttataatttattattaaaagtagagaaaaaggaaacggtagagagaggaattttatttttatttttttttttttttttttttttgggagagagaattagagtatgttatttttataaatgagttttttgtgtggggttttatttagatagagtttttgtttagtttggtagtcgtaagggtgaggaaagtagggagaggaggggggtggttgggatatttttaggggtataggggttttgggtatgggttgagaaggtaagtaggttttttagcggttttatttttatttaggagtttggaaatgtgagattaaggaacgttgaggagaaaatgggtttggatttaggagttttggttttttagtaaatgaggaggtagggggataggtttttgttttatttattttatagagaggtttttggtgtttatcggattcggtaatttttagggtaatatgggatgtaggggtttcgttttgttttaaagtttaaagggggatttttttagtagaatttttcgttttattttataagtttatttttttgtggttttttttttattacgttttagtgcgtgggtgtagggggagagaggtttttagttgaattgaaaattgaagtttatagaaaggtagtcggttttatttagagatagagatatgagatatagagatataagagagacggttcgttggaatttttggaaggggaaataggttagaaatttgatttaaacgtttgtgattttgtgtgtgtgtgtgcgcgtgtgtgtgtgcgcgcgcgtgcgtatgtttgcgtgtgagtagttgtgtttgtcgttattttggttgaggtaggtagggcggggtgagtgttgggcgggagtaggcgagggtggggggggttgtgtggtgggggtaattttaggaatggttttaattggtattacgggtgatggggagttttttagtagagcggtggagtagagcgggtgggaaggaatgtgtgtgtgatttagaaggaaagtgggtttggggtagaaagtatgttaaggggtgatttggtttttttttaattttatttaattttttagttttagtttttttttttagaattttttttggtgagtttagggtttggaaattaaattggaggagggaattgatgaagagataggaagaatattttttttattattttttttgaggatagaaatggagaattttttttaggtaagagaaataggtagatttggggtattgggatagtgtggtaaggaaggttttagaaatttttgtgtttttatttttttagagggatatatttagatatatagagtgacgtatagttatttatttatatttatttttggaagttattagggtttttgtcgtttaggtttttttttttttttttttttcgatttttggtaggtttttttttttttttttggttttttttttattttttttttttcggtattttaaatgttagtttgtgatttttaaatgagaaaaagttgtgttgggttttgagtttggagaaatttttatataaatttttagatgtgatataatagttagagagggaatgcggaggaattttttttcgagaggggagcgcgtttttttatatttgtaggaatatatattggaaaggttagtatgtttttttttgatttgaggtaggggtgattgtttgttagtatttttgttttttatattaaagtttgtatttttgagttttttgttgtttttttttgtaatatatatatatatatatatatatatatatatatatattttttatttgggtttagattttttttttaggaaatttggttttttaaaaaggagaggttaagaagtagaatgtattaagaaaagtttaattagttttagttagttgggggtggaggggagtgtttttatgttttttcggtttagaggcgtatagggatttttttgaagtttgtggggagttatagatattataaagagaaagagggaggttttggaggtagtttagagtttttttggtagtaaaaatataggtgttttttggtatttgggtaggatggtagtggtgaggggtatagtttaggtagttttttgttaaaaaattgtttttaatttatttttagttaatttaggtttttttagatttagtaatgttgatgttatatatttaattattatttttttgggggaagttgttttttaatttttaaggtgagtgttgtttttttatttttttttttttatgttaggttttaatatttgttttcgtttagattatttagtgaaggagtttgtttttagattttttattagtatttggagatagggtaggcgagaagagatgttagtttagaggtttgtttttagggagaggggagagaagagttttttttattttttttgggatttttgagaaggaggatatagaggttgatgtttttttttattcgtggaaggggtaaatgattaggggtagagaggagagttgttcggaatttattttttttagttatattagttttttatttttatttttgtttgggagaaaggggtttggggttgggggtttaaattttaagattgtgtttatttagtaagaatatagatttttgaggtttgtatttttttttttgtagtttagagagaaaggaagaaggggtagtggatgagaagaggatgtgatgaggggagttttttaaagatttataaggtgtagaggatgggggtgggggggttataagtttatttttgttttgcgtattagaggtagtagagttgtagagagtgagggcggtattaattttttattttttttttttaaagtagagtttttgttaggtttataggggttataagggagatttggggttttttattttgggtttataagaatttttgagttggaaggaaggagtttagagaagttgtttagatttgagatggtagtaatattttttttttatttttttttttttcggtggtaggattcgttagggagtttggggttaggcgtttgttaagtggcgttttgagttagggtttgattgggttggggttttttttattattttagtttgggtagatagggagtagtgttaaatttatttttttggaatgtggggtttgtattttttaaatttatttgcggagtttacgttggggtggtggattcgagttttttttagtgaatatattgatagtattattgtttttttaagattttcgcgggtttgtagttttttatatttggtttgtaggagtattttttatttgtgaaaggggaggagtaatttggattagtttaattttattttttatttgttaaaaaagtttttgatatagtttttttttttataagaaaaatttagtataaaattttttaatttaattttaagtattttgtatcgaatggagatcgggtaggaggtattcgcggtattgggttttagcggaaaggggttttatttttagtttcgggggtagatagtttttttttattatattttgtttttattttgcgtttttgatattagtcgtcgtcggaatttttttgttgtgtttttaattcgcgaggtggggggtgaggtgggttaggatttggttttcgttttttaatatttttttttaggttagtaaaaattttagttttaaggattaggttgggggattagattttagaattcgtcgtaaattttggggcgggggaaggagggaaatttaggagattgcggttttttttttttcgttttcgtagttttttttttatcgtttttatttattttttattaaattcggaaattaaatttagttcgttaatcggcgcgggtagagtatagtttttaggttttcgaagttttttatatttggaggatgacgatttttttttgattatatttggagggcgtttagttgcgagttagcggggtatagttttttttttttggtttggatttttatttttttaatttaggaagattgaggtgtgtgtacgtaggtggggtaagttcgggttatcgacgagatttgttcgcgttttcgtttttattttggtgtttttttttttttttggtagttttttttttattcgtttatttttcgggtttatttcgatttatttggcggtgggtttttttttttttcgattttcggcggtgcggttcgttttttttttgatttcgcgtttggtcgtcgtgtttcgaaggatatgggttatagatcgtgcggagatattagtttcgcgggcggttgttttggtttaagtagaagaaaattatcggggttagcgtcgggtacggtagttttttcgtttcggagttcgcgttgttcgggtttttttttgttgatttcggtttcggtcggttttcggttttcgataggtcgttgagtcgtatgaagtttcggggttgtttcgatttttcggcgttcgttttattttttttttcgtttattttttggttagtcggggtttcgggcgattcggagaggggtaagcggcgttttttagaggaggtgtttttacgtaattcgggggtttcggcgggggtatatttggtgggttttagggcgtaagttgagttttcgggagggttagtttagtttagttttttttgttcgtaggggtatgttgttcgcggggcgtcggggcgtagggaaatttcgttcggcgcgagtttcgttttttttgcgtttttggggtttttcgggttagtcggtcggtttttttttattttgtttcggttttttcgtttcgcgtttaggtttcggttgtcggattcggcgttattttcggcgaagtcgtttcgagagggcgaacgaaaaggggggtagcggcggagggcgggggttcggggaggggcgtttttttttttcgcggcgtagttggagtcggatttaaggggttagtatcgtttcggtttcgcgttaggcggcgggggaggggaggagggatttttttaggggtgggtttggagggggtgggggcggttttttttttcgtttcgtcgcgggtttattgttcgggaggggcggggagatagtggggggtagtttcgggcgggagtggaggcggagatgtcgtcgtcgtagtcgtcgcggtggttgtcgttgtcgtagttgtcgtcggcgttatagttttttttttcggtcgagacgcggagcgagcgagcgaaagcggcggcgaggagtttcgcgtatattatagttggattttttattttaattttaagtttcggtttcgtttttagatagtttcgtagttaatcgtcggacgtcgtcggtttcgagtcgcgcgtttattggtcgttcgtcgtggtagtgcgggcgggagcgtagggagagaattatagttggaattcgatttttattttaaaatttaggatcgttttttttttttttttttgtttttgggttcgttttcgaaggttggagttaattagattgttgtttagatcgaatttatttttttattggttattggggtttttgggatttttttggagggagttcgaagaattagagtattcggcgcggggttttggcgtagggtcgtaggttttaggtattttttgtttacgatttttgatttgggtagtagtcggaggacggagtttagttttgggcgggtttggggaagaaaggagataggcggtacgggggtgagggttgttattagggggttttagagcgaaattttaggtttttatttggttaattttttattttggagttgagtttggttgcgggattgggggagggaaggagcggagttggatgttttgggggtggggttttaggttggaggggtttagttttggagaaacgggcggagttcgagaaaggttagggtaggtatggtttgggcgtggtttttataaattttttgggtttattggttatattttcgagttaattttgagatttcgattttgatttcgtaattttaattcgttggatttgattttatattgacgtttttgggttttatttttttgtttttagggattttttgaagggcgtggattttacgtaggggtttcgtgtttgaatacgtggttttaggtaggtcgcgttggatcgtagagttcggatttttaggaggggttgcggagtagagcgaggatttttaagaaggaatttgtgggggtttcgagtgtgtgggagggggcggaagtatagagttgggttttatcgattcgatttttaaagtttttattatcgttattttttaatttcgtgttttagttttttttaagtttttatgtggtttagggaaagagtgttcgcggaattggaatttcgcgggtttgtcgtttttatttatttattttaattttatcggtagcgggttttcgtgggtttgtgttttttacgcgtgtatacgtacgcgtagatttcggtttttgtttcgtttattttttcgagttttggggtttagtcggttttagttttt

SEQ ID NO: 176 - DNA, 7836 bp, Artificial Sequence
  Chemically-Treated DNA
attgttttttttgatatgtataaggttttaattttaataggggatgttttattagaaattgagggtataagatattagggatttattttaggtatgttgtttttgtgttaagtgagttagattggttggttaatagagtgtttataggtttttgaaatttttttgggaaaaatagtataaatagtagtagagattttattgaagggtatagaaaatatatttttaattttgatagagtttataaatgatagtattgatatttttttaaataaatatttttgttaaggtatagtattattatgtgtttttagatgtttaagaggtagtgattttatgtttttttgaggtttagtagagttattaatgttaatagggtggttgacggggtttagatttgttattagataagttaatgagatatgttgttagatttatggttatataattaagtatttaaaaagatgtataataggtaattgtaatgagtttgttttgtatttagtaatagttttttttaaataaagaagatagtttttagtattaagaaggatgtttatatgtatgttttttatggagttttttttataaattgtttttattatatattaaaaggagtttagttttattgtgatttaggaggaagaaaataatagttagaatttagttattggttaattgttagatttaatatttattattttatttgttttttatagtaatgtttggaggtaggtattattgtagtttttaatttatagatggagaaattgaggtttggagagagttaagtaatttgtttatggttatatagttggtaaagggtaaatatagtttttgaatttaagtttgtatatttaatttagaggtatataatatagtaatgtatattttaaaatgatagtgttattattttttaaatttaaaggttagaataattaaaattataaatgttaaatagtagtgttttaaataaataggatttgtattttttggtttgatgattttagggttataaggagagattgaaaaaatagagatgaatttaaattttagggttttagttattggaatttagatattggtgtgggtatttttttttatggattttttaaaattatatggttttagagaggtttagagtggttttatatttttgtaaaaattagttatttatttttttattttattatataagggtagttatttttttgagttatttagttgtttaggtttgaaggtttttgcggcgtttgttaaaggttttggaatttatattggtgggtataaagttgttttttattatattttttgatttgtttagtaagtttgttagtcgatgagttatataggtggtagtgttataggtttttttttgggtaatgattttgatttgtaggatggagaaagaagagaagatttgtgagtgagaggttgggagagaggttagttttatgggatttttatggtaaagttgttgtgttgaaaggtattaattaattttaagtgttttttttaaatataattattagagtagaaaattataaggttattagggaaaatgttatgattattttttatagatatttttaggggtgttagaaaatttaaggtgattttggatgattggttatggaatgtggagtagtaatagttaattttttttgtataaattaattaaaaattaaagcggaggtttatgatattggagtgaattatggttttatatttagttttatttataaaggattataaaatttatattttagttacgggtattaaatatttttttttaggaaaataaaaaattttttagttttatttggaagaggagcggagtttgtagtattaagttttagaggtgtttatttgttttttaggatttttgttttttttgtttgagtttggttaaagggattatttattatattttttgtttagttagtttagggttaaggttatttttaagtataggttttagatattatgaagtttgggatatagattagagtaatgattattatagtttagatttttggggaaaaataattttattttttaaatgattagtatatttagaagtaggatagaggagttttgatgatatttttgggggatttaaagcggtttttattttttggtatttttttaggtgatttttttttaatttgtgagttttgttttttttttttttatttgaagtttgagatattttttgttataaggaaagttattaatattagtttaaagagttattagagaggaattaaattatatgtattaagttataggaaggatgtaagaagggaaattaggaaggaaagggaggagtttagttggtattttggggtatgttaatatgagggcgatggtttttttttaagtcgttggatatattttttttttttttaggtgttttaattttaattgtagtttgggggaacgtgtgaaatttgttgaagttttgcgtgtatgtgtttagtatgtaagtatttagattatcgtatcgtttagatttggggttgtttaggttgtagggaaaatatatattagatagtattatgtattagaatttgtttttatgggtagttatttagaaggttagattaggtaggggattttgggagtaggaggggtaggtaggagggtagtttatttatttattttttattaggagagtttagaggtgtagtgggttagggtaatgtagggaagggttggatggggaaggatgattttttttggtattttatatgttgtttagttttttatgtttgatagaggggtttttagggtagatgtaggggtaatatatgtttttgtttgagtagtgttggggttaggttaggggttggtttttgtttaggtttaaggtatatagggatgtggatttggggaagggtgttttttttggttttttgataatatgtatatttttatagatgttatatatttaaaggtttaaatttattttagatattgttttatttatttttattttttgtaagggttttatttttattttgtaaatgtgaaatgaaagttttttgtaggtgtgaaagaatgtcgtatgtagattaataaggtggatttaaatttttaaaattttttgagatgtattatgtgtatttttgattttatttttattagttttaatttatttagtgttgggaggttttttagtattgtaagaataatttttatagtgagcgattttatatttttttattttattttttaagaatttttagaaacggagttttttgttatgtttaattacggtatttttagttgtagtgggatttttgttttttttggaggttgagaatagttgggttttaggtttcggtgaataatatagtttgttggatttttggttagtgtgtttttttttatttttcgggatttatttttttgtgtatgttgcggggagaggaggttttgtgttgagcgtttggggagttttatttggagtttttttttttttgtttttgttttagtttattggtttttatttgtatatagttttgtattagtgtagttagtaggaggcgcgtttcgtttttattgagcgtggtcgggtttgttgggttgttttttagggtagatttgtggaggggaagtaaatttagtgtaggttgtgagtttttgtttgtttttttttaggataagtagttaggttttttggtttttgtttttttttttgaggatgtggttagcgggagttttaggggatagggtataaggttagtgttttttttaggatttaggtattggtgtggtttttaaatagtggtgtgttggagttagtttgtataggtttgtgaaagttaatggttaaatttttaagaattttgtaagttgagtgtagttattattaaaaattaaatgtaaaaatttatagttagtgttgaatttgaaaatagttttagtttaatagatttatatgtgggtgagaaatagattaataggtaaaatattagatttaataataataaatttagtggtaaattatttaatagaataggatgtaatttattttttaaattatggttgaataggataaataggatggttatatatataaaagtttggttaaaagtaataaaagtattttgtgagatttagtgggttatataaaatttataataggtcgggcgcggtggtttacggttgtaattttagtattttgggaggttgaggtaggtggattatttgaggttaggagtttgagattagtttggttaatatggtgaaattttatttttattaaaaatataaaaattagtcgggtatggtggtgggcgtttgtaatttcggttatttgggaggttgaggtaggagaattgtttgaatttaggagatggaagttgtagtgagtcgatacggtgttattgtattttagtatggatgatagagtgagattttgttttaaaaaaattataatgaagaatattgtttaaatatttattattatttataaattgtgtattatatatttttatattaaaaaattatatatgtgtatgagtatatattttatttcggttttttgtcggtttttaagtatttagtatattatatttaagaggtatggaattgtttgatattagtgtggttttggttttaggttgttttatttgaatggtgttgtatggaggttgtttgtttgtaataggattaagatgttgagagttaggaagggggagaatttttggaagtttatgatatttttttgtaagggaagaatgagataaattatttgcgttagttcgaagttttaggagtttatagattttggtttttattttggttttttgttttgtttttaacgttttggttttgtggttttagattggttattatatttttttttttttttgtttttttattagtatagtggatttttgggaggtttagtgggtttgtagtatgtatagtttgatagagttggaggagcgattttagagggagagttgagtgggggaggttttagttttatttttttttttaaagttatatagatatatataaatttgttagttaggtttttgtggaggatatgtttttaggtttttgttatagaagttgattttataaggaaatttagagttgttttttttttttggggtttttgtatatattttggtgggaggggtgggatttatttatagagattatttttgtaattggaatttgagaaataaaagaattaattttagtgtttagtttaagtttcgtttgttggtattttagttttttgtaggaattaagttttatttttaaattgggatttaagattttttttttttgtttttagagtttgtgattggggtttgtagtttagggttgtttgttttttagtcgtcgtgtttatttgttatttattcgttttgttttaggttttgaattaatttttttgggattgttgggttttagacgtcgtttttgatcgtatcgtttgcggaaagttttttttgttttaggttttgtgcgcggtttttggggagtttgagtgtttcgagattggtttaagtttgtgtgtagtgcgagagagtaagattggagttcgtagtcgagtaggaagagcgagtcgggggattgagattgttcgatttaatttagggtacgagtttggtataaatcgcggattaatagagattatttgatgaagagattaacggagagagagggagaggaggaaagggagtgagaaaatgacgaatggagggagagggagggagagatatatatttgagttaggatttcggggtttatttggcgggaggtggtttggattagaggcggtggtagcggcggcggcggcgtttagttagagttttgtggaagcggcggcgatatttgggttgggtagtgtttttgatgttttttagcgttagcgattgtttttattttcgtcgttgtgggtcgggaaagtttcgttagtgtatagtaattaatgggcggaggggttttttgtttttgggttgcgttatttttatgtttttagaatttggaggatttagtaggatcgttttatttgtatttgtattgaggttattgatggaaatggtgggggatggtgggggtattaataagtaacgtttttaaagtgagcgggaatttgagggtagtttgacgttatggtgaattttattttttagttcggtttggttttgaattttcgttttattttatttttggttttacgatttggcggaaagggtttaggattgtagggatttttttaattttgattttagatttttgtttaagtgagattttaaaggttaatgtttttaagggtgggttttgggtttaagaaatttgattttagtagttggtattatttatagagggttagggttcgtgggaaataagagacggagttgggagtaagaattttgttagataggagtttaattatagttggtttaatttttggttgtgtgattatgggtaagtaattttatagaggtttagtgtatttatttttgaaatggggattataattttattttgaaggaatattgtgagaaatagtttagcgtttgggttttagataggtagggatttataagagttttttggttcgtataggggattttgtaagatttttatggatatttttcgaatttttattttttcggattgtttcggggtattttttagatttattatatgtgtgaggagggggtcgatgatttgttgggtttgaggggtgagttgtaaggtatagatgcggaagtttttatttagatttttggatttttttttttttattttgttatttattatttgtttgagtcgtttgtatagttgtttttttgttttcggttgttgtttgttaagatgttttagagatattttatttcggtttcgtatttttattttcgtattttagttttttattaaagagtaggtaggtgtgatagtgttgtgtggtttttgtttagattaagtttatattcgttttcggttatatttatttatatatatttaaatttattattgttttttaatatgtgtttattttgaattatagatattaaaaaatagatattggttagaagagtattttgaggtgtttatttaaacgtgttttaagtttgttttcgagtttttcgggcggtcgtatttatatattcgtacgacgatgatttgtttgtattaaatttgtatatattacgaataggcgttttttattatatttaattacgcgtgattttaatagtttttatatttcgtagaatcgggttttagttttattgtgtttgagcgtttagtttagtagaggtagggattaaggcgtttgtcgtttatagcgtttagagtggtaagaaagaagttttttagcgtttttattatttttcggtggaacgcgtagcgcgcgatttgttgtagtcggttcgggcgttgtttgtgcggtgagcgtagtagcggtatttcggggttgtgggcggaggtaaggattttagtttgaggttttttgaggtagagtagaaattagtttttaggtgtgtcgttcgtggcgcgagttacggaattttaggtatttcggggtcgtgttcgtatttttgtttttagtttttagaagcgtcgaaattttttagtacgatatttttgtttcgcgttatattttttttttttagggggttggtggttttcgtgtttaaaggaggtagcgggaacgtttaatttttaagatgtttttaattgatttttttttttttaattatagcgagggaataataattcggggttggggattgggtatttaagattcgtttttcgtagggttcgtcggtagggcggttataggattcgggattggaattg

SEQ ID NO: 177 - DNA, 7836 bp, Artificial Sequence
  Chemically-Treated DNA
tagttttagtttcgggttttgtggtcgttttgtcggcggattttgcggagagcgagttttagatatttagtttttagtttcgagttgttattttttcgttgtagttaagaaggaggagattaattaagggtattttagaagttaggcgttttcgttgttttttttgagtacggaggttattaattttttagggggaagagatgtagcgcgaggtaggggtgtcgtgttaagaaatttcgacgtttttggggattgaggataaaggtgcggatacgatttcggggtatttggagtttcgtgattcgcgttacggacggtatatttaggggttaatttttgttttgttttaaagaattttaagttagagtttttgttttcgtttatagtttcgggatgtcgttgttgcgtttatcgtataggtagcgttcggatcggttgtagtagatcgcgcgttgcgcgttttatcgggagatggtggagacgttgaaaagttttttttttgttattttggacgttgtgggcggtaagcgttttagtttttatttttgttgagttgaacgtttaggtatagtggaattgaaattcggttttgcgggatgtgagagttgttgaggttacgcgtaattgggtgtgatggagggcgtttgttcgtgatgtgtgtaggtttgatgtaagtaggttatcgtcgtgcgagtgtgtggatgcgatcgttcgagagattcggaggtaggtttgggatacgtttgagtgaatattttaggatatttttttggttagtatttgttttttagtgtttgtgatttagagtgggtatatgttgggagatagtaatgggtttgggtgtgtgtaaatgagtgtgatcggaagcgagtgtgagtttgatttaggtagggattatatagtattgttatatttgtttgttttttagtagaggattgaagtgcgggggtgggggtacggggtcggaatagaatgtttttgggatattttggtaaatagtagtcggaagtaaaggggtagttgtgtaaacggtttaggtaggtgatggatggtagggtaggaagggggaggtttagaggtttggatggaggttttcgtatttgtattttgtaatttattttttaggtttagtaggttatcggttttttttttatatatgtaatggatttgaagagtatttcgggatagttcggggagatggagattcggaaagtatttatggagattttatagaattttttgtgcggattaggaaatttttgtagatttttgtttatttgaggtttaggcgttgggttgttttttataatatttttttaagatgagattgtggtttttattttaaagatgagtatattgagtttttgtgaagttatttgtttatgattatataattaggaattgggttaattgtaattgaatttttgtttaataaagtttttgtttttagtttcgttttttgttttttacgagttttggttttttgtgggtaatattagttattggagttagattttttgggtttagaatttatttttaggggtattaatttttaaaattttatttgggtaggggtttgggattagagttggaagagtttttataattttggatttttttcgttaaatcgtgaaattaggggtggagtggggcgagggtttaaaattaggtcggattgagaggtgaaatttattatgacgttaaattgtttttaaattttcgtttattttaagggcgttatttgttggtgtttttattattttttattatttttattaatgattttaatgtaaatataagtgggacggttttgttggattttttaggttttggaagtatgagggtgacgtaatttaggggtaaaggattttttcgtttattggttgttgtgtattggcggaattttttcgatttatagcggcgggaataagagtagtcgttggcgttgggaggtattagagatattgtttagtttaagtgtcgtcgtcgtttttatagggttttggttggacgtcgtcgtcgtcgttgttatcgtttttgatttaagttatttttcgttaggtgagtttcgagattttggtttaggtatatgtttttttttttttttttttttattcgttatttttttatttttttttttttttttttttttttttcgttagtttttttattagatagtttttgttagttcgcgatttatattaggttcgtgttttaggttggatcggatagttttaatttttcggttcgttttttttgttcggttgcggattttagttttattttttcgtattgtatataggtttaggttagtttcgggatatttaggttttttagggatcgcgtatagagtttgaggtaagagaaatttttcgtagacggtgcgattagggacggcgtttggagtttagtagttttagggaaattggtttagaatttggaatagagcggatgggtggtaaataggtacgacgattgagggataagtagttttaaattgtaagttttagttataggttttgggagtaaagagagaaagttttgggttttaatttaagagtaaaatttggtttttgtaggggattgaggtgttagtaggcggagtttaggttgagtattaaaattgatttttttattttttagattttaattgtagagataatttttgtggatagattttattttttttattaaggtgtatgtaaaagttttagaagaggaggatagttttgggtttttttatgggattagtttttgtgataggggtttgggagtatgttttttatagagatttggttaataggtttatatgtatttgtgtggttttggggagaagggtaggattgagattttttttatttagttttttttttaggatcgtttttttagttttattagattgtgtatgttataggtttattgaattttttagaagtttattgtgttgatgaggaaataaaaaagaagagaaatataatgattagtttgaagttataaagttagagcgttagaagtaagatagaaaattaggataggagttaaggtttgtgggtttttagaatttcgaattggcgtaggtggtttattttattttttttttgtagagaggtgttatgggtttttaaaagttttttttttttttggtttttagtattttggttttgttgtaggtaggtagtttttatgtagtattatttaggtaagatagtttgaagttagaattatattggtattagataattttatgttttttaagtgtggtgtattgaatgtttaaaaatcgatagggggtcggggtaaggtatgtatttatgtatatatataattttttgatataaaaatgtgtggtatataatttataagtagtgataaatatttagataatattttttattataatttttttgagatagagttttattttgttatttatgttggagtgtaatggtatcgtgtcggtttattgtaatttttattttttgggtttaagtaatttttttgttttagttttttaagtagtcgggattataggcgtttattattatgttcggttaatttttgtatttttagtagagatagggttttattatgttggttaggttggttttaaatttttgattttaggtgatttatttgttttagttttttaaagtgttgagattatagtcgtgagttatcgcgttcggtttattataaattttatatagtttattgagttttataaaatgtttttgttgtttttagttaaatttttgtatgtgtagttattttatttattttatttagttatgatttgaaaaatgaattgtattttattttgttaaatagtttgttattaaatttgttattgttaaatttggtattttatttgttgatttattttttatttatatataaatttattaaattgaaattatttttaggtttagtattaattgtaagtttttgtatttaatttttaataatggttgtatttagtttgtaaaatttttgaaaatttaattattagtttttataagtttatataaattggttttagtatattattgtttagaggttatattagtgtttgggttttgaggaggatattggttttgtgttttgttttttaggattttcgttggttatatttttaggggaagaagtaaagattaggaagtttggttgtttattttggggaggggtaggtaggggtttatagtttgtattgagtttgttttttttttataggtttgttttggagagtagtttagtagattcggttacgtttagtgaggacgaagcgcgttttttgttggttgtattggtgtagaattatgtgtagatgaaggttagtgagttggagtaggagtaagagagagagggttttaggtgaggttttttaagcgtttagtatagggtttttttttttcgtagtatatataggaaggtggatttcgagaggtaggagagaatatattggttaggaatttaataggttgtgttgtttatcgggatttggggtttagttgtttttagtttttaagggagatagaggttttattgtagttggaggtatcgtggttagatataataaaaggtttcgtttttgaaagtttttaggaaatgaaatggggaggtgtggaatcgtttattgtgggaattgtttttgtagtattgggagattttttagtattggatgagttaagattagtaagggtgaagttagggatatatatagtatattttaggaagttttagaaatttggatttattttgttaatttgtatacgatatttttttatatttgtaaggagtttttattttatatttgtaaggtgaaggtgaggtttttgtaggggatggggatgggtagagtagtgtttgaggtaggtttgagtttttaaatgtgtggtatttgtggagatgtgtatgttgttaggaggttagggagagtatttttttttagatttatatttttgtgtattttgagtttgagtagagattagtttttggtttggttttagtattgtttaggtagaggtatgtgttgtttttgtatttgttttgagaatttttttgttaagtatgaaggattgaatagtatgtggaatgttagaaaagattatttttttttatttagtttttttttgtattgttttagtttattgtatttttgagtttttttaatgaaggatagataagtgagttgtttttttgtttgttttttttgtttttagggttttttgtttggtttaattttttaagtgattgtttatggggatagattttggtgtatggtattgtttggtatgtgttttttttgtagtttggatagttttagatttaagcggtgcggtaatttgagtatttgtatgttgggtatatatacgtaggattttaataagttttatacgtttttttaaattgtaattggggttggagtatttggaaagaaaagggatatgtttagcgatttggagagagattatcgtttttatgttagtatgttttagaatgttaattaaattttttttttttttttttaatttttttttttgtattttttttataatttgatgtatgtggtttggtttttttttggtggttttttgggttggtattggtggttttttttgtggtagaggatgttttaaattttagatgggaggaaagagagtaggatttataggttggaagagaattatttgggaaaatattagaaaatgagggtcgttttgagttttttagagatgttattagagtttttttgttttgtttttgaatgtgttgattatttgaggaataaaattatttttttttaaagatttgagttgtggtggttattgttttgatttatgttttaggttttatagtgtttaagatttatgtttagaaatagttttaattttaggttagttggatagaggatatggtgggtggtttttttgattaagtttaagtaggaagaataggggttttaaggagtaggtaagtatttttaggatttgatgttgtaaatttcgttttttttttaggtaagattgaggaattttttatttttttaagaaagggtatttggtgttcgtgattggggtgtagattttatagttttttgtgaatggggttgggtgtgggattataatttattttagtgttataaattttcgttttgatttttagttaatttatataggaaagattggttgttattgttttatattttatagttagttatttagagttattttgggttttttgatatttttgggaatatttatggggagtgattatggtattttttttaatggttttgtgattttttgttttgataattgtgtttaggagaaatatttaaagttaattggtgttttttagtatagtaattttattatgaaggttttatggggttgattttttttttagttttttatttatagatttttttttttttttttattttgtaaattagaattattgtttagaagagagtttgtgatattgttatttgtgtgatttatcggttggtaggtttgttgagtagattagggggtgtggtgaagaataattttgtgtttattaatgtgggttttaaagtttttggtaggcgtcgtagggatttttaagtttgagtagttgaatgatttaagaaggtgattgtttttgtatgatgggatgggaagatgaatgattggtttttataggggtgtaaaattattttgagtttttttgagattatgtggttttaaaaaatttataagggaaggtatttatattagtatttgagttttagtagttaagattttagaatttggatttatttttgtttttttagtttttttttgtaattttgagattattagattaagaaatatagattttgtttatttagaatattgttgtttgatatttataattttgattattttagtttttgagtttgaaagataatgatattattattttagagtatatattattatgttgtgtatttttgaattaagtgtatagatttgagtttaagaattgtatttgttttttattagttatatgattatgaataggttatttaattttttttaagttttagtttttttatttgtaaattgagggttataatagtatttatttttaagtattattataaagagtaagtgaggtaatagatgttaagtttgataattaattagtaattaaattttagttgttatttttttttttttaggttataataaagttgaattttttttaatgtgtaatgaaagtaatttgtaggaaaggttttatggaagatatatatataggtattttttttgatattgaaaattattttttttgtttgaaaggaattattgttaaatgtagaataagtttattgtagttatttattgtgtatttttttaaatatttgattatgtaattataaatttgatagtatgttttattggtttatttggtagtaaatttaggtttcgttagttattttattgatattggtggttttgttaaattttagggggatatgaaattattgttttttgggtatttggggatatatggtaatgttgtgttttgatagaagtatttgtttaaagaaatgttaatgttgttatttgtgaattttattaaaattaaaaatgtattttttatattttttaatggaatttttgttgttatttatgttattttttttaggagagttttaggggtttgtaagtattttgttgattaattaatttgatttatttagtataaagataatatgtttgggatggatttttagtgttttgtatttttagtttttagtgaagtattttttattggaattagggttttgtgtatgttaaagagaataat

SEQ ID NO: 178 - DNA, 10077 bp, Artificial Sequence
  Chemically-Treated DNA
ttatatttaggatttgttatttaatttgtagattttagtgtaaaataaaaatttaggattttttgtttaaaaagtattatggggttaggtacggtggtttatgtttgtaattttagtattttgggaggtcgaggagggcggattacgaggttaggagatcgagattattttggttaatatagtgaaattttgtttttattaaaaatataaaaaattagttgggtatagtagtatatatttgtagttttagttatttgggaggttgagttaggagaattatttaaatttaggaggtagaggttgtagtgagttaagattgcgttattgtattttagttcgggtaatagagcgagattttgttttaaaataaataaataaataaaaagtattttgacgtttaagttggtaatagtagagtatttttgtttttttattttttaatttaattattaggtttttttaagtgtatggttttgtgtgattgtatagacggtacgtttagaatgtcggttttgtttatgtttttttttagttggtgatggttttattttttttttttgtttttagttgtttttttagatagattttcggagttttttggtagtaatttagttttagttatttttagaagtttttagggttttgtttagtaggtatttagtatagattttttaaggttttgggggaatttttattttaggttattatttatattttttttaaattaatgtatagttatcgagttttatttggttaagttttaggaagggaggataagtggataaacgattattgttttttaggagtttagtttatagtagagcgaagatttgaataagagtaggatcggataagaattttgttaatttagagaaaaataattatagtttattaggaaattgaattttataaaagagagagtataaagatgggttttcgtgaatgggtaagatttgattaattcgatgaggaaaggggtatttaaggaagaagttatggtatgggtaaaaatttagagataataaaatgtatggtacgttttagaattttgaattgtatagtttggttgaggtgtgtagatggtaaaatagtgggaaaaagttggaaggaaaatgtatagagaagagttataagggtaatagtgaagtgtttgtatttttttagtggaaatatcgaggggattttaggtcgtgatgtttaggttatttgggagtaaagggagaagattttttttttttggtttttatagtttgttcgaagagtgtaaagttttacgtttttgtaaaataggtcgtatttagtttagattttggagttgatttagtttatgtttttcgatttatagtttgttttgagttttgataaaggtttggtttttttttgtattcggaacgcggaggattcgtagttcgtggattcgcgttttagtgtttaagttggtgttgatgggggttgcggttttttgttatttattttttatgggttttgtggggggcgtggggatgcggggagagggttttagaataggatttcggattgggagggaagggatattatttgggtatatttagtaggtacgatcggaggtgaaaaaagagtgggttttattttttgatggtttcgttcgttatttattttaagtttatgttatggatatttttaaatatatttaaaagtagagagaaaagtagaattataatttaagtttatatcgtttagttttaatagttattttttttaagtttattttgttttagttaatttttttttattatttattttaaagcgggatgtgggtgttttgagggaggtggaggttttttagttggagagcgggtgttcgtatttttggaggttgaggtataattgggttgggagttgagcgtatatcgagtaggggttgcgggggagcgggggtagggtcggcggggcggggttagaagttcggcggggttgggggcgtttttttagtgatttaaggcgcgtagcgttgggcgtaaagcgttagttttcgttttgcgagtttagagtgtgttcgttgcgtcgtcgttgttcgtatttgtcgtcgtcgttatcgttattatgtttaatttcgtcggtatttggaagatgcgtagtagcgagaatttcgacgagttgtttaaggtattgggtaagttggtgtagagggcgcgtttcgacggggagatgcggttcggaggtgttttggtttcggaagtgtttcggttttggagggggtggaagttggggagtttaggtaggagggagttttcggggtaatagatcgttttgttttttaggcgtatcgggtttcggagaagttggtagagatttcggaatttacgcgtttagcgaacgtttgttgaatgtttggcgtttttttcgatggtgcggattttatttcgtgttagattatagcgaggagagattattggagagtaaggaggattagggatttaaatttggagatttaaatttgggattaggttttgttacgaatttattgtgtaattcgaggaaagttatttattttttttgtgttttagttttttatttcgaaaataagggcgagggtagggaaacgagtggattaattttaaggtttttttttaaagttagggtatgattagtgttcgatcggtttcgagattggcggcgaggtttcgtgatttaagtttgtggtgtattttgcgtaggtgtgaacgttatgttgaggaaagtggtcgtagcggttgcgtttaagtcgtacgtggagattcgttaggacggggattagttttatattaagatatttattacggtgcgtattattgagattaattttaaggtcggagaaggttttgaggaggagatcgtggacggacgtaagtgtagggtgaggttttagagttattatagcgttttcgtgttttcgttcggtgtttatggtttattgttgttggaggaatttgtgtttttttttgtagtttgtggcgcgttttttttgtagggtgtgtatattggttgtttgtagagggggtttgtgtattttagttgtttttggtttaagataaagtattatttttattttattttaattttatttttacgttgtttttcggggtgttaatagtcgcgtttaaagagcgggttttgggttgcgtcgcgtttttagtagtggtttttgtagcggtttgtagcgttaagcgtaggcggcgtaggaggaggaggaggttgtaggagtcgttaggttttttgtcgtaggtgaagtcgtagtttttgtatttttttttcgtcgtatttttcgcgttcgttcgggtttttgggtcgtttgggtacgttttggatatagttttagtagtttcgatggtttcgttattttttttttttcgttttcggtttggttttttaaaggaacggcggagtttttttaaaagtaaggtaggttttggttgggaaaatggattagttgtttttttttagtttttaagggtaagagtttttttttatttttttatgtatcggtttagggatgaatcggtggattgaagtaaggggttgtatattcgttttttgtatgggtaaaaattgtatttggttaattagatggaaaaataattatcggtgttattatttatttaaaaagtgatagaatgtttttttttttttttttaattttttttttttaaagaaaaaagtcgtaatattttagagagtgggaaattgttttttttattttttttgagtagtgtttggtttgatttcggaatgggattttttgagtatcgggtttggaaggataaagaaataaagttttttagaagtaggttgatttaggaggtaatttttggttttagaattgttatagtttggaaatgatttttacgtttggagggggtgggatttgaagtttaaattgtattgtagaaataaagagtaggatagtatagagtgaagggttgggagtttaagagaggaggtttggtaataggtagggtttagtttggggatatttaatgttggttattgttaggaagggtaattttgatttaaaaaaaaaaaattaaaggtttatataatagtcgggagagtggggttttatgtattttttatttttttatattttgtttaatgaatgtgttttatgtgttagttaaaaattgattatgtgtatatttagttttggtttattttttagtttagttgtattatatttagttttgtgtagatattggggaaaaattttaggaaatttttttttttgttttttatttttaaaagtatgaagagtttttagattgatttgttttttaaattttttttaaagggatgtaatcgggaaagtggtagtattttaatttttagagttaaagatatcgaggtttattagtgtaggggtgtattaaatttgatgaggagtgaatagaaaggacgtttttattttaaaatttatgtagggaatcgtgtttttgataggttgatgatagatgtggttataaatttggtgttttaattgttgttaaattttgtggttttgatgtgaaggtttttgtttttaaaatttaaattatgtttatttgaggttaggagttcgagattagtttggtgaaattttatttgtattaaatatattaaaaaaattagttgggcgtggtggtaggtatttgttattttagttatttaggaggttgagataggagaattgtttgaatttgggaggtggaggttgtaaggagttaagattgtgttattgtattttagtttgggtaatagagcgagattttattttaaaaaaaaaatgaataaaaataaataaaatttaaattgtttgaagggttagttaatttttatataaatgaattattttatgttttaaattttatttttagagatgtaaagtatgtttaaggtttcgttgttttagtaagagattgtttgtgtgtgtttgtgagtgtgtgtgtgtgttatataaggtgtatttatattttataaaatttgtgattagtattttgaatttggattttataaggtttagcggagaagaatttgtggtttgttgatagggattatgtgttgattttttgtagagtaattattttttaatgtttattgttgtttttgttttcgttgttgagattttaattaatgttattaatggttttttcgtttgtagagtttagttatttgggagaatgagaataagatttattgtacgtaaattttttttgaaggggacggttttaaaatttattggattcgtgagttggttaacgatgaatttattttggtagggaatttttgattttgaaataattttgaagtttttttagagggggttttagatgggttttataaatatgttttttttattcggtcgtttagagaaagatattatttgttttggattaaaattagagtagaaaattcgagatgatagtttaggttagaggaaattattgttaaatggttggtaggaaagaggagtggtttagaggatggaataggggttggagataggttggagtgtttgttattatttatattaatatattttagtggcggtgatatgttttaagttaagttttttttttattaggtttggaatgtttaggttttatgaggtttttacgtttatatggtagaagggatttttttttatttttatttttttttttgttggttggaaaaggttttagtaatttttattatattagtatttagaattttagagaatatttttagttgtgatttgtaaattttaatggtttttgggagttaggtaatgaatgttaatttgggaagtgtttgagtataatatagtgtggagagatgagtttttgtagaattaaaaaagataggtttttttttaaaagtatttagattttagtattttggggggttaaagcgggtggattatttgaggttgtaagtttgagattagtttgattaatatggagaaatttcgtttttattaaaaatataaaattagtcgggcgtggtggtatatgtttgtaattttagttattcgggaagttgaggtaggagatttatttgaatttaggaggcggaggttgtagtgagttgagatggtattattgtattttagtttgggcgatagagattttgtttttaaaaaaaaaaaagtatttagacgaaaatattttaaatatttgtttttagttaaataaaatttatttagtgaggttaaattagaaatttttataatttaagtatatatttttttttttttttttaggtagagaataaaggaaggttgagggtagaataatttttttcgttttttttttgtgttataaaattgggttgggattggtggtttatatttgtaattttagtattttgggaggttgagtttaggagtttgagaatagtttgggtaatatagtgagatttttatttttataaaaaaaaaaaaaaaaaattagttgagtgtggtggtatatgtttgtagttttagttattcggaggttgaagtgggaggattatttgagtttaggagtttgaggttgtagtgaattgtgattatgttattgtattttagtttgggtaatagagttgagattttgttttaaaattaaaaataaaaaaaaaaataaaaaaattaattaagggttttgtaattattttttttttttagattagaaaagggaaagttgttttgggtaattaggaaattatattttttgttttttattaggtattttgttaatttttgttttattttagtgaatgttattttgaaatgttgtgaataggagattgtttgttgaagggtgttaggaaaggatttgtagtgtgatttgagtataggttttttttttttaagtttttttttttgttatataatgaggggttaagttgaagtttgatttttgaggttttttttagttttgaaattatatgtttattttgtaagaagattttaaattgagttattatttgaaatgagattgtttgatttttttttttttttttttgtttttttttggtatgatttaatatgttttttttttttatagagaaaggattggtttaatttgtaatttggttaatattgtttttagggaaaggatatttgttgggtttgggggagtaatttgaggttgagatatggaaatttaggagaaaaggcgtatatggtttattggtattagagatagtagagggagatgattttagagttttagaatgtagttgagggtttagtaggatcggtttgttttgagaaagagtgattttattaatttttgtagtatacgagtagttggagttataggttaaattttgttagatggattttattatttttaaattttttttttttttaattttagttttatttttgtatttttttttggtatagtaaatatatatataagatttaaagggaaagggagtattaatttttggtattttggatttgaaatgtgggtttttgttttaagggttattattattaataaatttaaaacgtagagagatgtagtttttatataataagaggtaattattttagttaagttgaaataagtttttttagcgttaatagtaaattgtttttaggttataagttgtttttttttgaaaattgagtatatttttataaattattttggaatattttatagagagtttttgtcgggaatttttaagtatagtttgtaggttgagaagggcgttttaaatgtggttggaaatgcggcgatttttttttatgttatgaagttatttgttagttggggagagttgttagttagtgagaatagtttttttagggtatagcgtttaatatttaaatgttggtagttatttgataatttatggttgtagaatttaaagaattatggaaaattaatatggttttgaggcgtttagatatttgcgaggtagatttacggtgggaaagttaagttttatattttttagtatgtagaattatttgtatttttttttaatagagaagaggttaggataaaggtgtttaggagtgggtataattgttagtttggttaggagatttttagtatgaaaagttagtggttgggtgtagtggtttacgtttgtaattttaatattttgggaggttgaggtaggtggattatttgaagttaggagttcgagattagtttggttaataaggtaaaattttatttttattaaaaatatttaaaaattagttgggtatggtggtgtatgtttgtaattttagttatttgggaggttgaggtaggagaattatttgaatttgggaggtagaggttgtagtgagttgatattatattattgtattttagtttgggtgatagagtaaggtcgttttaaaaagaaaagaagttagtgatgggtatttgtttttttagttattaaggatttgaattatttttttgaagtatacgtgttaggataatgttttagtatatgttttttgagagtatttcgtgattaattaagatggtagggtaagaatataaagattttaggatagttaaatgtttcgtttagtggttttaatatttttgtaattttaggttattttaagaatttgaaagataaggattttttggtatataaatgtatatttgtaaataaatatatttatattaggtttatagattggggaatttttgttttttggtttttgtttttgttttttttttttttaatatatatattgttttttttgttttaattgtttgtgagaggtttaggagagtaggtttgtgagtaattgttagttttgggggaaagttgagatagtttatttgtgggtaatattattttaggggttagtagaaaaatgtttttttttatttgtgtaatgattcgtgttttttttatagtaaataaattaagagttatagaattttagttggaagagtttttgcgatgattattttgttaattttatttttttttttaatattagtttttgtttgttttttttttaaataggttacgagaggaaaatatttgtttttaagtttagttagttgtgagttgtaggggttaggtttggatgttaatgttgtgtttttgtagttgagattaattttttagtttgtaggtgatttgagtattatatatatagtattttagtttgttttttaggttagatgattgttttttggaaagtagttttattttttttttaaagtaaggaatagaattggttggtgagtgttgggttttatgattttagttgtttgagtttttttttattttgaagttatttgaaaagagatagagttattttagaaatgtttattgtgatatttttttttttttagtttaattttaaaattaaaatttttggtattttttatgttagtattttataggttttataagtaaaggaaaatggtatataatataattttatattttggttatttttttattaatagcgtttaagggggaaaaaatattttttaatgtttagtttgagtatatatataggaaattgaatgtttgttataaagagtttttaatagggtaataagtggttttattagtgatatgttttaaatatttttgtataggtatttgtattgattggttttttttttttttttttttgtagacgtttggcgtcgatgacgtggtttgtattagaatttatgttcgagagtgaaggtagttggtttgtttttatttttaggaagggatgtaggtttttttgaggaatatgttatagttttgagttgttagtggatcgttttttttttttattaatattaggtgatttcgttttttttatgataatgttgtagtgttttttatttttattttttaggttttggtgttttttgtatttttagtgttttatagtttggtatttgtacggtttcgaagttattaaattggttagacgtgttttaatttttttttttttttggtttgtttttttagttttaacgtgggagttattgtgtatttattgtttttagtattgtgttggtttgtgcggtatttttagttttggtttgttggtttcggtgtggggttttgagtatacgttagtagttgtaagttgggttttcgtagattggttggatttagattgtagatttaggtgtg

SEQ ID NO: 179 - DNA, 10077 bp, Artificial Sequence
  Chemically-Treated DNA
tatatttggatttgtagtttggatttagttagtttgcgggagtttagtttgtaattgttgacgtatgtttaaagttttatatcgaggttagtaggttaaagttgagagtatcgtatagattaatatagtgttaaggatagtaggtatataataatttttacgttgaaattgaagaggtaaattaaaaaagggaaaaggttgagatacgtttaattagtttaatgatttcgaaatcgtgtaaatgttaaattatggagtattagggatataagaggtattaaggtttggggggtgggggtgggggatattataatattgttatggggaaaacgggattatttaatattggtaggggaaaagggcggtttattggtagtttagaattatgatatattttttaggggagtttgtatttttttttgaaagtaggagtaagttagttgtttttattttcggatataaattttggtgtagattacgttatcggcgttaaacgtttgtagagaagaagaaaaggaaaattaattagtgtagatgtttgtgtaaaaatgtttaaagtatattattaataaggttatttattgttttgttaaaaattttttgtaatagatatttaattttttgtgtgtgtgtttaggttaagtattaagggatatttttttttttttaagcgttattggtaaagaggtaattagagtatagaattatgttatatattatttttttttgtttatggaatttgtaaaatgttgatataagaaatgttaggagttttggttttaaaattaaattgaaagggaaagaatgttataatggatatttttgaagtggttttgtttttttttaaatgattttaagatagaaagaagtttaggtagttggggttatgaggtttagtatttattagttagttttgttttttgttttggagaaggaatagaattgttttttaggaagtagttatttaatttgggagataggttgagatgttgtatatgtaatatttaagttatttgtaagttagaaaattggttttagttgtaaaagtatagtattggtatttaaatttagtttttgtagtttatagttggttaagtttgggggtaaatgtttttttttcgtggtttgtttgggaaaggggtaggtaggggttggtgttgaggagaggggtggagttgataagatgattatcgtaaaggtttttttagttaaaattttatggtttttagtttgtttgttgtagggaggatacgaattattgtatagatggaggaggatatttttttgttggtttttgaaatgatattgtttataagtaaattgttttaatttttttttaaaattagtaattatttataggtttgtttttttggattttttataggtagttagaatagggaaagtaatatgtatgttaaaaaaaaaaaaaataaaaataaaaattaagaaatagaaattttttagtttgtaaatttgatgtgagtatgtttgtttgtaaatgtatatttatgtgttagaaggtttttattttttagatttttaaagtggtttgaaattatagagatgttaaaattattaaacgaggtatttagttattttaggatttttatatttttattttgttattttagttggttacgagatgtttttagagaatatatgttaaaatattattttgatacgtgtgttttagggaaatagtttaagtttttagtgattgaggaagtagatgtttattattagttttttttttttttgagacggttttattttgttatttaggttggagtgtaatggtgtgatgttagtttattgtaatttttgttttttaggtttaagtgatttttttgttttagttttttaagtagttgggattataggtatatattattatgtttagttaatttttgggtatttttagtagagatggggttttattttgttggttaggttggtttcgaatttttgattttaagtgatttatttgttttagttttttaaagtgttgggattataagcgtgagttattgtatttagttattagttttttatgttagggattttttgattagattggtagttatatttatttttggatatttttgttttagttttttttttattgggaagaaatgtaggtgattttgtatgttagggggtgtggggtttgatttttttatcgtaagtttatttcgtagatgtttggacgttttagaattatgttaattttttataattttttgagttttatagttatggattgttaaatggttgttagtatttgggtattgaacgttgtattttggagaaattatttttattagttgatagttttttttagttaataaatagttttatgatatgagaagaaatcgtcgtatttttaattatatttgaagcgttttttttagtttgtaaattatgtttagaggttttcgatagaaattttttgtagaatattttagagtggtttgtgggagtatatttagtttttaaaggaaggtaatttatagtttgggggtaatttattgttggcgttgggagagtttattttaatttaattagaataattgttttttgttatatagagattgtatttttttgcgttttagatttattaatgataataatttttgaaataaaagtttatattttagatttaaaatgttaagagttaatattttttttttttttgagttttgtatatatgtttgttgtgttagggaagaatgtagggatagaattgaagttgggaggagggaggatttgaaagtgatggggtttatttagtagaatttggtttgtgattttagttgttcgtatattatagaggttaataaaattatttttttttagagtaaatcgattttattgaatttttagttatattttaaaattttaaaattatttttttttgttgtttttggtattagtaaattatatacgtttttttttttaaatttttatgttttagttttaaattgtttttttaagtttagtaagtattttttttttggaaataatattaattaggttgtaaattaagttagttttttttttgtgaaaggagaaagtatgttaaattatattagggaaggataagaggagagagagaaagattaagtagttttattttaagtaatagtttaatttagggtttttttgtagaataaatatgtaattttaaggttgagagggattttagggattagattttagtttaattttttattgtatagtaaggggaagagtttgggaagggaaggtttatgtttaggttatattgtaagtttttttttagtattttttagtaggtagttttttatttataatattttaaggtgatatttattaagatggagtagagattaataaaatatttaatggagaataaaggatataattttttggttatttaaaatagtttttttttttttggtttggaagaaaagggtggttgtaaaatttttaattagtttttttgtttttttttttgtttttaattttgagatagggttttagttttgttgtttaggttagagtgtagtggtatgattatagtttattgtagttttaaatttttgggtttaagtgatttttttattttagttttcgagtagttgagattataagtatgtgttattatatttagttaattttttttttttttttttgtagagataggggttttattatgttgtttaggttgtttttaaatttttgggtttagttttttaaagtgttgggattataggtgtgagttattaattttagtttagttttgtaatataaagggagagcgagggggattgttttgtttttagtttttttttgttttttatttaaaaaaaggggaggaagtgtgtgtttaaattatagaggtttttaatttggttttattaggtaagttttgtttggttaggagtaggtgtttaaaatgttttcgtttgaatatttttttttttttagagatagagtttttgtcgtttaggttggagtgtagtggtgttattttagtttattgtaattttcgttttttgggtttaagtgaattttttgttttagtttttcgagtagttgggattataggtatatgttattacgttcggttaattttgtatttttagtagagacggggtttttttatattgattaggttggttttaaatttgtaattttaggtgatttattcgttttggttttttagaatgttgggatttgaatatttttaaggaaaagtttattttttttagttttataggggtttatttttttatattgtgttatatttagatattttttaaattagtatttattgtttggtttttaaaggttattggagtttgtaaattatagttaaaaatgttttttaaggttttgagtgttgatgtgataaaaattattgaaattttttttagttagtaaaagggggaatgagaatgaaaaaaaattttttttgttatgtgagcgtggggattttatagagtttaagtattttaagtttgatgagaggggagtttggtttaaagtatgttatcgttattgggatgtattagtgtggatagtggtaggtattttagtttgtttttagtttttattttattttttgagttattttttttttttgttaattatttaataatgattttttttgatttgaattgttatttcgggttttttgttttaattttaatttagggtaaatggtgtttttttttgaacggtcgagtgaggaggatatatttgtggggtttatttggggttttttttgggggaattttaggattattttagggttaagggttttttattaggataagtttatcgttggttagtttacgggtttagtaggttttggggtcgttttttttaagaagagtttgcgtgtagtggattttgtttttatttttttaagtggttaaattttgtaggcgggaaaattattagtgatattaattagagttttagtagcgggagtagggataataatgagtattgaaaaataattgttttgtagagaattaatatatggtttttgttagtaggttatagattttttttcgttgagttttataaagtttaaatttagagtgttggttatagattttatggggtataaatatattttgtataatatatatatatatttataagtatatataaataattttttattgaagtagcgaggttttaggtatgttttatatttttaggaataaaatttagagtatgaaatgatttatttatataaaaattagttaattttttaaataatttggattttatttatttttatttattttttttttgagatggagtttcgttttgttgtttaggttggagtgtagtggtataattttggttttttataatttttattttttaggtttaagtaatttttttgttttagttttttgagtagttgggatgataggtgtttgttattacgtttagttaatttttttggtatatttagtatagatggggttttattaggttggtttcgaatttttgattttaggtgaatataatttggattttaaaagtaagaatttttatattagaattataagatttgataatagttaagatattaagtttgtaattatatttgttattagtttattaggagtacgattttttgtatggattttgggataggaacgttttttttgtttattttttattagatttagtgtatttttgtattgataaatttcggtgtttttggttttgagggttaaaatgttgttattttttcggttatatttttttagaaaaaatttaaaaagtaaattaatttgaaggttttttatgtttttggaggtgggaggtaaaaggagggattttttgaagtttttttttagtgtttgtataaagttaagtgtggtatagttgggttggggggtgggttagagttgaatgtgtatataattagtttttaattaatatatgggatatatttattaggtaaggtgtggggggatggggggtgtataaagttttattttttcggttgttgtgtgaatttttaattttttttttttaaattagaattattttttttggtagtagttaatattggatgtttttagattgagttttgtttattgttaagtttttttttttagatttttagttttttattttatgttgttttgttttttgtttttgtagtgtagtttaggttttagattttattttttttaagcgtggagattatttttaggttatgataattttggagttaaagattgttttttagattagtttgtttttggggggttttgtttttttgtttttttaagttcggtgtttagagagttttatttcgagattagattaggtattgtttaggaaaggtgaaagaaataattttttattttttggaatgttacgatttttttttttaaaaaaaaaaaattggagaaggggagggagatattttgttattttttaaataagtggtagtatcggtgattatttttttatttggttaattaaatgtaatttttgtttatgtaaaaaacgaatgtataattttttgttttaatttatcggtttatttttgggtcgatgtatggagaaataaaaaaaaatttttgtttttgaggattaagagagggtaattagtttatttttttagttagaatttgttttgtttttggaaagatttcgtcgtttttttaaggaattaggtcgaaggcgggaagggagaggtgacggggttatcgggattgttaaaattgtatttagagcgtatttaggcggtttagggattcgggcgggcgcgggggatacggcgggaaaggaatgtaagagttgcggttttatttgcgatagagaatttggcggtttttgtaatttttttttttttttgcgtcgtttgcgtttggcgttgtaaatcgttgtaaaagttattgttgggaacgcggcgtaatttagagttcgttttttaagcgcggttgttagtatttcgggaggtagcgtagggatggggttgagatggaatgaaggtaatattttgttttgagttaggggtaattaggatgtataaattttttttgtaaatagttagtgtatatattttgtaaggaaggcgcgttataggttgtaaagggagatataggtttttttagtagtagtgggttatgggtatcgagcggggatacggggacgttgtagtggttttggggttttattttgtatttgcgttcgtttacggttttttttttaaagtttttttcgattttgaagttgattttagtggtgcgtatcgtggtggatgttttgatgtagaattgattttcgttttggcggatttttacgtgcggtttggacgtagtcgttacggttattttttttagtatggcgtttatatttgcgtagggtgtattataggtttgggttacggggtttcgtcgttagtttcgggatcggtcgggtattggttatattttaattttagaaaggggttttaaaattgatttattcgtttttttgttttcgtttttgttttcgagatgagagattgaggtatagagagggtaagtgatttttttcgagttgtatagtgaattcgtggtagagtttggttttaaatttgagtttttaaatttaagtttttgattttttttgttttttagtaattttttttcgttatgatttagtacgagataaagttcgtattatcgaggagggcgttaaatatttagtaaacgttcgttgaacgcgtgggtttcgggatttttattagttttttcgagattcggtgcgtttgggagataaggcgatttattgtttcggggatttttttttgtttgggttttttaatttttattttttttaggatcggggtattttcgggattagggtattttcgggtcgtattttttcgtcggggcgcgttttttgtattagtttatttagtgttttgagtagttcgtcgaaattttcgttgttgcgtattttttaggtgtcggcgaagttgggtatggtggcggtggcggcggcggtaggtacggatagcggcggcgtagcgggtatattttgagttcgtaaggcggagattggcgttttgcgtttagcgttgcgcgttttgagttattaggagagcgtttttaatttcgtcgggtttttggtttcgtttcgtcggttttgttttcgttttttcgtagtttttattcggtatgcgtttaatttttagtttagttgtgttttagtttttagaggtgcgggtattcgttttttaattggggagtttttattttttttaggatatttatatttcgttttaaaatgggtggtgggagagggttagttgaaataagatgggtttggaggggataattgttgaagttgggcggtgtggatttgggttatgattttatttttttttttatttttgaatatgtttgaaaatatttataatataaatttaaagtggatagcgagcggggttattaggggatgggatttattttttttttattttcggtcgtatttattgggtgtgtttagatggtgtttttttttttttagttcgggattttattttgaaatttttttttcgtatttttacgttttttataggatttatggggagtgagtggtaggaaatcgtaatttttattaatattagtttgggtattgaggcgcgaatttacgagttgcgggtttttcgcgtttcgagtgtaggagggggttagatttttgttagggtttaggataaattgtgggtcgagaggtatggattgaattagttttagaatttgggttaggtgcggtttgttttgtaaaagcgtgaggttttgtatttttcgggtaggttgtgagggttaaggggaggaagttttttttttttgtttttaaataatttaaatattacgatttaaagttttttcggtgtttttattaagggagtataaatattttattattatttttgtagtttttttttgtatattttttttttagtttttttttattattttattatttgtatattttagttaaattgtataatttaggattttagaacgtgttatgtattttattatttttaagtttttgtttatgttatggttttttttttgaatgtttttttttttatcgggttaattaaattttgtttatttacgaaagtttatttttatgtttttttttttgtgaaatttagttttttaataaattgtgattatttttttttgaattgataggatttttgttcggttttgtttttgtttaagttttcgttttgttataaattgaatttttggagggtagtgatcgtttatttatttgttttttttttttaaggtttagttaggtggggttcgataattgtgtattgatttgaggaggatgtgagtggtggtttggggtgaagatttttttaggattttggggaatttgtgttgagtgtttattgaatagggttttggaaatttttggaggtggttggggttgggttgttgttaggaggtttcgaggatttgtttaagaaagtagttgaggataggagaggggagtggggttattattagttggaaaggggtatgggtagggtcggtattttggacgtgtcgtttgtgtagttatatagggttatgtatttagaagggtttgatagttagattggaaaatggaaaagtaggaatgttttgttattgttagtttgaacgttagaatattttttgtttgtttgtttgttttgagatagagtttcgttttgttgttcgagttggagtgtagtggcgtaattttggtttattgtaatttttgttttttgggtttaaatgatttttttggtttagttttttaagtagttgggattataggtgtgtgttattatgtttagttaattttttgtatttttagtagagatagggttttattgtgttagttaggatagtttcgattttttgatttcgtgattcgtttttttcggttttttaaagtgttgggattataggtatgagttatcgtgtttggttttataatattttttgaataaggagttttgaatttttattttgtattgggatttgtaaattaagtagtaggttttggatgtgg

SEQ ID NO: 180 - DNA, 85734 bp, Artificial Sequence
  Chemically-Treated DNA
taagagtttattgttttgtttttttttataatagggaagggggttagagagtttttataagcggaattgtttttaaatgataagattatttaattggggttttatttgttatattagagtaatggaggtttttagattgttgtatttttttttttatttatagtttttttttgtattattgggggttttgtatgtttgtggaaaattggagaaatgtttgtttgttaaagttttttttatttttttttttttttttttattatagttatttttttaagttagttttgggaggataaatttaaagaagaggtttgtataggttttggaatgaatttaggatatgtgggtatatatttttggggttttatgtgtttggaggcgaggtacggggtatattattttggttttgtgattttttattttgtgggaaagagtgcgggggatagttagagatgggttttttaagtatatagtttagggtaggcggttttggttttttagtttttaggatagaaaaggttttggaaaggataaaagagagagttaggtttaattaagagaagtagaagtggaagtagtttaggtgtgtgggtaagtatgttagtatttatttttggaagtgggttttaggatgtaaggtaagtaaatttagtgtggagtagaaagtggttggttgtattatttgtgagtaaaagttatggtgtgtaaatgataatagttaatgtgatgttatgttgttgttttggataaatgtagtttttttttttattttagtgatgttgttattatttttttgattgtatatataggatatttgggagttatttttggtgtttgttttttattttttattatttattagtaagttttattaattttattttttggatttatttttaatttagtttttttttttttatttaatttttttttattttttttttaatttttgtgttagttttttaattgaattttttgatgttttttgttttttttgtttatttttatagtaattagaatgattttagtaaaatagagttgattatgatatgttttagtttaagatttttgatgaattttttattgtttttaaaataaagtttaaattttttattgtggtttattaatttatttatgatttggttttaatttattagtgttatttttttatttttatattttttaagttttattttttttgaattttatttcgttttttttatatttttaaatattttgtaaagatggggtttttttatgttgtttaggttggttttaaatttttggttttaagtgattttcgtgttttagttttttaaagtgttgggattataggtgtgagttattatatatacgtttttatttaggtatttttttgttttttgttattttattaattgtagtattgtattgtggttttaatttttatttttttgatgattaatgatgtttagtttattttttttttgaaatttttgtttggtttttatttgttttaagaagtaatcgttttttttatagattaagtttttgtttttttttgtagttttatgataattaatatttatttttattttggttttaatttattaaagtatagttgttttatttttatttttatatttatcgttattattataaatatatatatatacgattgtgtattttttgaaggtagaagtagtattatatttttttggtatttttagtaattagtatagatttgaaatataatttttatataataaatatgatgagtgaatgaatagttgtttaataaattaaagaatggatgaaggtaggtagttaggtataaggttttgtagataggtttggttgtgttaattaaatttttttttatgggtttttatatttagtaagtttatttttaaaaggataatgttgaagatataaatgtttataatgattatagcgatgacgggattcgagagaaaggtaaggcggaaggggtgaggtcggaagtcgaagtgtcgtagggagttagcggcgtttcggttgttatggagattaggagttttaaaacgcggaggtttttagcgtttcggattaacgagtgttaggggataatgtgggcgttaatttcgttattagtcgggtttagtagttttagttagtttatttggaagttttttttgtatttttttttcgtttattttgaggttttttattatagtttcgtagttcggtttcgtcgttttacgtagtttgcgttggcgtagcgtttcgagttttagttgtttcgtttgcgttttttttcgttgcgtatttaagatatttcgtatttgtttatcggcgtttttcgtaatttgtatttagtcgaggttatcggcgacgaagtgagcgtaagtttgattaaggttcgcggtagcgagaatgagcgttacgaggagttcgtggattagttgtagtaggtaacgtggcggtggcgtcgcgtttgcggacggtgtcggggttttagcgttcggtacgcgttagtatttgttaggtgttaggcgttgttttaggatttggggttgtagttgagaaatagtttattatgtcgaagtgggttcgatattttagtggaaggacgttttatttatatatatatatgcgtaaatattatatatattatataacgtgcggtatatatttgtagtatttgtttatatttttttagatatatacgttatatattgtatatattaatgaacgattgcggtagatcgttgaatagttgttttatggagaggataaagttaaaagttattcggttttggggtgtttttgtattataaattataattttgattgggttatttatgcgtagattttaggaagcgtgtttagtttttagaatagtaattttgtttttttatttgtataaggagaaaattagttgattcgcggtttttgtgttgagtcggtttttgttggttatattattgaagatttttttaaatttgtgggtattttttttatattcgattttttatttcggtgtgttttttgttttttagatttttttttttttttttttgttttgttttttatttgttttttaagtgatatgtattttacgtcgttagttttagttatttttttatttaatatatttgttgaatgtttgttgggtgttatattttgttttaggtagtggggatttagtagtgaataaaaacgttagtgttcgggtatatttatatttatatacgtaatttgttttttgtagtttttaatttaattgaggtagatagatattaataaaatgaatatttatatagtatgtgagatatttataggattagtttcgtcgtttttacgggttataggttttttaaagtgtagttagagtttttggttgggattttgtattttgtgattcgtgggttattatatttattttgttaagattttagtttatttagttagattttgtttttgaattttagatttatatttttgttatttatatgagttagaatatatggagtattataaatttataaattttatgattagttatttagtttattggattttatttttttagtatttgttttataagtagttattatattagagtttgaattggtaaatagtgatttttttttttgaagaaaaaaagtaatatatattataaatttttttttttgatagagtttggttttgttgtttaggttggagtgtagtgatgtgattatagtttattgtagttttaatattaggggtttaattgattttttttttttagtatttggagtagttaggattataggtgtgtattagtatgtttagtttatttatttatttatttatttatttgagatggagttttattttgttatttaggttggagtgtatggcgtaattttagtttattgtaagttttattttttatatttatgttatttttttgttttagttttttgagtagttggcgtttgttattatatttggttaatttttttgtatttttagtagagatagggttttattgtgttagttaggatggtttcgattttttgatttcgtgatttgtttattttggttttttaaagtgttgggattataggtatgagttattatatttggtttaaatttttattttttaaaaattgtgagatggggttttattatgttgtttaggttggttttaaatttttggttttaattgatttttttattttagtttttttagatgtcggtattataggtgtgagttattgtgtttggtttatattataaaaattttaatttagaagttgaaatttaatttaaatatttgaagttttaaaattgtagaaattttagaatgtagaaaagtttaaagagtgattttttatagaaatataattatgcggtcgggcgtggtggtttacgtttataattttagtattttgggaggtcgaggcgggtagattacgaggttagaagtttgagtttagtttgattaatatagtgaaattttgtttgtattaaaaatattaaaaattagtcgggcgtggtggtgtgtgattgtaattttaggtattcgggaggttgagataggagaattgtatgaatttaggaggcggaggttgtaatgagttaagattgtattattgtattttagtttgggcgatagaacgagatttcgttttaaaaaaaaaaaaaaaaaaagaaatataattatgtaaagataagttgattttataaattatggtatatttatattatggaatattataaagttgttaaaaagaatgaattatatttgtattgtagataaatatagttgttatttatttatttatttatttttttgaggtagagtttcgttttgttgtttagtttggagtgtagtgttacgattttggtttattataattttcgttttttgggtttaagcgatttttttgttttagttttttgagtagttgggattatagatatgtattattatgtttggttaatttttgtatttttagtagagatggggttttattatgttggttaggttggtttttaatttttgattttaagtgatttgttcgttttagtattttaaagtgttaggattataagagtgtgttattgcgtttggttcgttatttattaatttagtaaaaaagttatagaataatgttaggataatttaattttttataatatatatgtatgggaaaaaagttgaaaatttttataataaaatgttaataatatttttatgggatatttaattttttttttgtatatttttatattgtttgaattttgtaatgtatacgaattaattttgtaattataaaaaaagaaattttgaaaagagtaggtatttgttattttatttttgtaatgttgttggttttttttttttttttttttttgagatagagttttgtattgttgtttgggttagagtgtagtggtacgattttagtttattgtaatttttgtttttcgggtttatgtgatttttttgttttagttttttaagtagttgggattataggtatatattattatattaggttaattttttgtatttttagtaaagatagggttttattatgttggttagattggttttgaatttttgatttcgtgatttattcgtttcggttttttaaagtgttgggattatagacgtgagatattgcgtttagtaatgttgttgtttttatatttatattttttttttttttttttttttcgttatttgttttttgtttttttttattcgtttttagatgttattgttatgtgattatttgtataggatttagatttattttttttgggaggagtaataattattatttcgtatgagtgtttgtattgtttgagttttttttttagataatttcgttggtagttgattttttttaagtttatttatagaaatattttatggtttaatgattgagagtaaatgttttggaattatatattttgggtttaagttttggtttttatatatattatttataggattttgggtgatatttatttttataagttttagtttttttatttgtaaaatgtagataataataatatttattttataggttggttgttttgaggattaaatgagttaatatagtaaagtatttataatattgagtatttataatatggtaagtttttagtaagtgatagttggttttgttatttggattagatgttaatttttatatttagaaattagggttagagattgttagtagatttaaatagtaagatatataatatagaatatagtattttatatttgaggaattgttttaggttattgttttttgaaaaatattttttgattttaagaagatttagttatttttttttagttttttatatatttttatttatatgttattatagcgtttttaagagttgattttatttatttgtatttttgttaggttttttttgttaaattgtaaattttttaagagtagaaattatatttgatttatttttttaaatgtaaatggtaattatataataaattttttttttttaagatggggttttgtttttgttgtttaggttgtagtgtaatggtataattttaatttattgtaatttttgttttttgggtttaagtgattttttcgttttagtttatcgaatagttgggattataagtgtttgttattacgtttgggtatataataaatttttattaaaagaatgattaaataaatttttgcgattttattaattttaggaatataataaggaatattgtttttttatataaattgtttttttttttttttaaaagaaatggggttagttgggtatggtggtttgtgtttgtaattttagtattttaggaggttgagatgagaggattatttgagtttaggagtttgagattttatttttataaaaaaatttaaaaattagttggatatggtggtgtatgtttgtaattttagttatttggaggttgaggtaggaggattttttgattttaggaatagtaggtaggagtgagttgtgattgcgttattgtattttaggttaagttataaagtaagattttagttttaaaaaataaataaataagaaaggaaaataagattgggcgtagtggtttataattgtaattttagcgttttgggaggttgaggtgagtagattatttgaggttaggagtttaagattagtttggttaatatggtgaaattttatttttattaaaaaatatataaaaaattagttgggtattatggcgggtatttgtaattttagttgttttagaggttgaggtaggagaattatttgaattcgggaggtagaggttttagtgagttaaggttatgttattgtattttagtttgggtaataagagtaaaattttgttttaaaaaagaaaaaaaaagaaagaaaggaaaagaaagaaatagggttttattgtgttgtttaggttgattttgtatttttaggtttaagcgatttttttgtttgttaagtagttgggattataggtgtatattattatgtttggttaatgtaaattattttttatattatttgtattagtgagttttttgttttttgtttcgagaagtttgaattagaaaatatggattagaagtttggttggttgaatagttaattagtaattagttttgaggagtatgttgggtatttaagtggattttttgggcgtaagtattgtgatagagtttgggttataggtgtttgttagttattaatatttgtgaggggaggggaatgaaagaaggagtgagttacggaagaagttgaattgtgatgggggtttaataagttttgataaatgtagtatgttgttttgaagagagtattgtttgttaaagtttttttttttgggttaaaatggttaggtttttatatttttgttttttttagttataggatgtgggtgttgtagaaaggatatggttttaggtgatttttttttagtagtttaggtagattgtgaaggggttgtttgttgacgacgttttttgtagttagggagtaagtttttttttgaacgtggatttgggtggtattataggaagtgtgttaatttgtatttggtattttattgtttggatggtagttttttttattgtgaagttaggagataggtaattaagtttaagtttgttattggttttattatggaaatttttaaattatttttttttatgggttttagtttttagatttagtagtttagattagatggttggaatagttttttgattattttatgttttattggaagttttgattttggggtagggttgagtaaagttaagtaatggtaagtaattttattatatttttgtgtatttgattatttttttgttagattcgggagttttataagtagcggttggatgagtttgaaatgttggagagatatattatttaggtttaagtacgggttattgcggaaaatgagcgggttatgagttaggttggagtataggatttcgagagttttgttaggttgtttttaggtgtgtataaagaatttttatatgtttgtttaattttcgggttgttgatattttattgtgtttgttttattgtttattttttaggttttttttggatatttggagagtaagtcgtagatatgataatatgaatattattataaaagaatattttattattataaaatatttttgtatgtgtatttttaaaataaggacgtttttttatataattagtatataatttttataatttggaaattagtttttgtgtaatattaatttttgatttatagatatttgttaatttaaatagtagagagagattttttaaaagaaaatgatggatattgtaatgggaatatatgtgttattgtaaattgtgtgtatatttagggaggtaaaggaagataaaggtttttaaaggaaaagtgaggaggattatataatggttttgaagtaattatttttggttgaaaaattattaataagagtagtattagtttgagattaaataggcggttgttgggtagatttgtgtgtgtgtgtagggttgtaatgatttttgtgtgaggttgtgatttttgtggcgtgatatggtttgtttgtatttttatttaaattttattttgaattgtagttttcgtaatttttacgtgttatgggagggatttggtggaaggtattgaattatgggggtaggttttttttttgttatttttatgatagtgagtaagtttgatgagatttgatggttttataaagggtaatttttttgtatatatttttttgttttcgtttatgtaagatatgtttttgttttttttttattttttattatgattgtgaggtttttttagttatgtggaattgtgagtttattaaatttttttttttttataaattatatagtttcgggtatttatttatagtagtatgaaaatggattaatataaggtattttttgtgataatttttgttattaggtatttatgtatggttttttttagtattatttgttagggttttttaatataagtgattttattttgatttagataatttttatattttatttaaattttattgattgttttattgtggtttttttttttttttaggtttaggattttgtttaggaagttatgttatatgtaattgttatgtttttttttgagatgtttttatttggaataattttttgatttttttttgttttttatttttttgatagtttttgattagatttatattttgtaggatggggatggttttgtttgatgtttttttatgattagatttaggtaaatattttgggtaataggattatataaagttattttttgtttattttattgtagtatagtaggagggttacgtgatgttaatttttattttttgagtaggttggtgtttgttaggattttttgtattaaattttttaaattaaattataattgattagtattttatagagaggtatttttagattatattaatattttgttttttattaaagttttatcgttatattattagtatttattgaaaattttttttttaatgtagaagtttaaagagtgattttttagaaatataattatgtaaagataagttgattttattaattatggtatatttatattatggaatattgtaaagttgtttaaaagaatgaattatatttgtgttgtagatatagatggttgtttgttatttattaatttagtaaaaaagttatagaataatgttaggataattttatttttatagtatagatgtatgaaaaaaagttgaaaatttgtatattagaatgttaataatgtttttagggggtaattaattatttataattaaaattgggttgttttttttatggatttgtttatagtttggattttattgatattagtattatggtgttatttaatttgtttttttttgtattttttataaatttgtaattagttttagagattttatgaggtttaggtttaatgatggttaggtggtggggaaagagtattttataggtgatgttgtgtgttttttttaggaggtatatgatatgtggttgttatttttttttttatgatgttggtagtttttttattttattattttattaggggttataaattataatgaaatgttaatggtaataataattttatttttatttatttgttagttgaattatttttataaagataaattttttagaaattattttgattattttaaagtatgggtagtattaattttttttttttatttgttagtgtttaaaatagtgagttggtttttttaatatttgttaaaggtgattaatgaggtttgtttggttgttttagtattattgtgtacgtttggattttatgattgtaaattatttattatttttttggtgtttaaattgttttatttttggtagagagttttttttagttgattgttgatttatttgataattagttgtttttgataatttttttgttttttgagttggtgagatgttttaggttattttgggtatttttggttttagatttggaattagttatttttttaagaaacgttgattttttttattttttttattattttttataaagattttgatttgtttttttgaatttttgaaaattttgaaaatttttgaaaattattattttttagtgtagtagatagaaaagatagtatatttaggagatttgttatatttatggtttagagggaaagatttaagggaggaagaagtggaagatatagtgttttaaaaggtatttaaatttatgaggatttattagggtttagatgttaatatgttttgtataggttattttattaaattttttcgataattttgtaaggtaggttttttttttattttataggtgtaggaattaaatttagatgattaaacgatttttttgaagttttatagtttggaagggggtgggatttagatttgaatttgggtgtgtttgttgttaaaatttatggtttttttttatcgggaggaggaaggattgttgatgagttatggtgttttaggagtgttgatgattttttttagagtgtggttttgagtagtagaagttttattttttattaggtttgttagatttttgagatttaagttttattaaatagtaatatttaggtataggttttgtatttttttttgtttttttttttattatagtatagtgtagttgtaaggattttttttttaatggtggtttagataatgtggattttgtagaaattattggtagtaaatgtttagagtttttattggttgtttgatgttttttgaattttgggagttagttattgttttttttttgttgttgttggttagagattaggggagattaaataattaattatttgggtttttttttttaatgaaagtgaaataaaatattgagaattaggagataaatgttagtttggagaattttttaatgatttttattttatttttatttaagaatgatattaagttttaattagttattatttgttttggttttttaggtttttgttggtgatgtgttttttttttaagaagtgaagaagtagatatattaatttagttttatggatatttttttggtgtgtttgttttttagagaagggtgaggtaatttttttttataatttagataattggtaatgaggatatttttttaaaagttttttatttgaggtatagaggtaatttttttgtgtttgttaataaaaatgtgataaagtggtaagtatatgtaaattttttaaagtgagggagaaagattagaatgttgtagaatattttgtgtttttatttttgttttttgttggaaatttgtttatattatttaagatttcgtagagttatgtttaggagttatagtgttagtataggaagtttattttttttaggggagaagagatggttataaggttagagtaggtttttttaaggttcggggtatatgtttaggtttgatagtttttgtagatatagtatttagttatttataatttggggtaggattgtggaaagaattgtattagaagagagaggatatattttttgttatatggtttttattttttgtatagaagttttattttttgatattttaaataggttattattaaagtttttgggaattgggttagtttgtgttaatttggtattgttgttatcgtttgttaaagtttttgttgttaaggagagattagggagtatattttttagaaggtattttttatttgtgtttttaggataggttagttgatgagaagtttttggtgagttttggaaaggaaggttatttattttaaaaagtagtagtaggtagatgattgagtggttgtgagtttgaaaataatttttagataatttttttttttttttaagatagggtttcgttttattatttaggttggagtgtagtggtgtaattttagtttattgtaatttttgatttttgggtttaagtaatttttttattttagtttttttagtagttgggattataggtatatattattatattcggttagttttttgtatttttagtagagatagggttttgttatgttgtttaggttgagtttttagataacgttttaagaaagttttgttttagtgttattggttgaagttgttaatgatgatgttttagtttatttgtgttgttgtaaaggaatatttgaggttgggtaatttataaagaaaagagattgatttggtttatgattttgtaggttggaatattgggtatttggtgaaagttttagtttgtttttatttatgggggaaggtaaaggggagttacgtagatattatatggcgagaaagtaagtgagagtgggggttttgggggggttaggtgagttaatatagtgaggatttattttttgtttgtttttatttagggtatttatttatatatgaggggtttatttttatgatttaatattttttattgggttttatttttaattttaggaaaaaattttagtataagatttgagggaataaatttttaaattatagtagatggtttttttgatattattttttttagtttttaattttttgtattaaaatttttaatatttgatatatatagattagtttttgtttttttgatggaatttttaatgaatatatgtgatgggggaatgtatgtttttattgataggttggttataggagatttttaaaaggaaagattatttaaaggtattatgttttttttttttttttttttttttgttggagggtattggttttatattggtttattgtaatttttattttttaagggatttttttattttagtttttagagtagttggaattatagacgggtattattatatttattaatttttgtattttttgtagagatggggttttattgtgttgtttaggttggttttgaatttttgggtttaagtaattcgtttattttagttttttatagtgttgggattataggcgtgagttattttatttggttggtaatatgttttaagataatgttggttaatggagtaaataataaagtttgaaaatttttaataagttttttgttcgggcgttggtgatagtcgggattgatcgtttagcggtagtggcgtagaggttttttttttggtttatcgcggtttttatttaattttatttgtttttgttgtttgttgtcgtagtaggagttggaggttgttgttgttagagggtaatgagttttagtggtgttttttttaagttaatggggttatcgaggaggatatggttgaagatttgttataggggagaggttagaagaggttttgacgattattagtgagtgattagggggttatatagttttattttgtagtagatattatttttattgttgagtttaattattttggagattttgtggtaggagataaggacggtggagtcgttttttagtagagttagagaataaaagtcgtttttattttaggggagaatataatgtttatagtatttttaaaggttatgaattagggtttggttattagaaaagtttagaaattgagtaaaaaataaaattaggtggttataatagaatattgtttattttttattttttataaatgataaaattataaaattatggaaaagaagcggatgagataaaagagtagaaagttataatttgaatgatgaagatggatgattttaagatttatttagaattatagtattattaatgatttgaggattaatttatgatatttagaaattatatatagatattttgacgtggtagatattaaatttgttaatttggagtagttgatagaagttattgtggtagttaagttttatttatattagtgtaatgtgtttgtttatagtagtagtaaaggaattattgattaagtagtatgggtttttcgattttgtgtaatagatattttaagttttttgaagagttttaagattttagtagtaggtttttttttttagaaataattttatttatatttaatgtaaaatgtagttatagtgggtagtatttgatgattagagattttttgttggtgaaggtgtgggattttaatatagagagtaggttgggattatatcgggattacgagtatttgtatagtaagttttgttttttttatgagaatgattgtatttttgatagttttgaatgttgttggaatggttcggataggtgtatagttgaattataaataagtaagggaaattttttaatagttagaaacgaagagggagttgaaattagaatcgtagtttttaaagacgtttattgcgagagaagttttatatttttggttggttttgggtgtattagttaatagtaggaatcgttgttttttgtgaatagtaagttgtggcgtagagttgaagttttggattatgaggtgtggagttggaattgcgtttttaaagatgatgaggttttcgtttattggagtttagagggaagtttatttgagattttgtattggggtggttaaagtttttttgagatgtgtaagtatagttttttattataagggtttgaagttttttttttttttttttttttcgttttttttttttttttttttttttattggtttttttttgatgttattaaagttgtgaaagtcgaggttggattgtattgtcgttatttcggtttattgtaatttttttgtttgatttttttgttttagtttgtcgagtgtttgagattgtaggggcgcgtcgttacgtttgattggttttcgtatttttttggtggagacggggtttcgttgtgttggtcgggttggtttttagtttttaatcgcgagtgatttgttagtttcggtttttcgaggtgtcgggattgtagacggagtttcgtttatttagtgtttaatgttgtttaggttggagtgtagtggcgtgatttcggttcgttataatttttattttttagtcgtttgttttggttttttaaagtgtcgagattgtagtttttgtttagcggttattttatttgggaagtgaggagcgtttttgtttggtcgtttatcgtttgggatgtgaggagtttttttgttcggtcgtttagtttgggaagtgaggagcgttttttttcggtcgttattttatttaggaagtgaggagcgtttttgttcggtcgtttattgtttgagatgtggggagtgtttttgtttcgtcgtttcgtttgggatgtgaggagcgtttttgttcggtcgcgatttcgtttgggaggtgaggagtatttttgtttagtcgttttgtttgagaagtgaggagttttttcgttcggtagtcgtttcgtttgggaagtgaggagcgtttttattcggtagttgtttcgttcgggaggtggggggtagttttcgttcggttagtcgttttattcgggaggtggggggcgtttttgttcggtcgttttttttgggaagtgaggagtttttttgtttagcggttatttcgtttgggaggtgtatttaatagtttattgagaacgggttatgatgacgatggcggttttgttgaatggaaaagggggaaatgtggggaaaagatagagaaattagattgttgttgtgtttgtgtagaaagaagtagatataggagattttattttgttttgtattaagaaaaatttttttgttttgggatggtgttaatttataattttatttttaatttcgtgttttttgaaatatgtgttgtttttatttagggttaaatggattaagggcggtgtaagatgtgttttgttaaatagatgtttgaaggtagtatgttttttaagagttattattattttttaattttaagtatttagggatataaatattgcggaaggtcgtagggttttttgtttaggaaaattagagatttttgtttatttgtttatttgttgattttttttttattattgttttatgattttgttaaattttttttttcgagaaatatttaagaatgattaataaatattaaaaaaaaaaataaaataaaaaaataaataaataaataaaaataaaaataagggtttgaagtttgtgttggtggtagttgcgtgatttggaaaagtttatattgaggagtttttttgtttttatgagggtagcgtgtaggcgtttggaggtattgacgtttttttgggtttgatttttattttgtttatagattaatttgttagtttatagtgttttatagatgttgattgaagatatgaggtttttgggtttttggagtatagtaagtagtatgagttttttgttggtataggttttttagggggtgatataaggggtttaggtagatgttatgtaagtagtggggttgatgttatggtcgatgtatgttgaggttggagaatttattgtttttttagtggatagttaataaatttgtattttgattagaagaaatatgattttatttttttagattatttgttgtaagtatagttttgagaagtggtttaggttaaaagaatggtgttttttgtaaatttagtgagaatatgtatggtgggtggttgtttttagtatatttaggtttttttggatttttttagattaaaattagttaaatatgagtttataggtaaaattattaagtatatatgggaaaagttattacgagtaagttagtagaattatagcggaattgaattttagagaatttagtttttgatattttaaattaaattaagaatgtttgagatatttatagattaaaggaaggaaatagtttgaattaggagttataagattattaaaatgatttggtagattggagaggaattaaagagaacgtttggaaatgataagtataatagatgaaattgtgggtttaataataggtttattttggttagagattttgaattagtagatggaaaggaaaattagaagaaatgtagattagagagttaaagagatagaaaatatgaaatataagaagtgtggaggttaggatgaggtatagtatatatttaaatagagaagtgtggggatatgaggtttaaagtgatagtggttaggaattttttgtaagttatgaaagtttgaatatatagaagtaggaagtatagaaatttatatttatattattatgaaattgtaggatattaagtgtaaagagaagattttaaatgtagttaaggaaaaagtataaattatagagagtagatgttgagattgagagtagattttatagtagttatagtgggagtcggaagttatgtgatatagtgagtgtgatttgggattttttattattagtttagaattaggtattgaaatagatggttgtttaagaatttgtttatggtaaaggtatttttagatgggaaatagaatttattataataggaaatttaggagagtgagatttaaggaatttattgaagaacgtatttttagtagaaggagagtggttttggagaaagggtgtgattttgagataggtagatgaatagagtagttagtgaagacgtgagtaacggaaagtaacgtggattttaaagttttgttaattgggtgattttggttatttgggttgcggggagaaaaattagagtttttattaatattatatagtaaataagttttgaatgttttaaagtttagaagacgttatgggagagtatttttatggttttggagatgaaaggttttttttaataaggttttaaatgtttagtgaaggaaaatattaagaaatttaggttgatcgtgttggtttaagtttgtaattttagtatttcgggagatcgagttgggtggattatttgagtttaggagtttgagattagtttgggtaaaatggtgaaatttgatttttataaaaaatatatatatatatatatatatatatatatatatatatatatatatatatatatataaatagttgagtgtggtggtatgcgttttttagttatttgggaggttgagatgggaggattatttgagttagggaggtggaggttgtaataagttgagatcgtgttattatattttagtttgggtgatagaatgagattttgttttaaaaaaaaataatattgtagttaaatttagtggtttttggttttttggttttgtttttgttttttgagatagagttttgttgtgttgtttaggttggagtgtagtggtttaatttagatttattgtaattttttttttttgggtttaagtgatttttttgttttagttttttgagtagttgggattataggtatgtgttacgaggtttggttgatttttgtatttttaatagagatggggttttattatgttggttaggttggttttgaatttttgattttaagtgatttgtttatttcggttttttaaagtgttgggattataggcgtgagttattatgttcggttaattatattaaattttaaatttttttattttgaaataaaaagtaaaaataggttgttttgtttatggagtagttatttttttatttttttattttgttaataaattagtttttattttaaaaaaaaagtgaaaataaaatttataaaagtaaatataacgaatagatttagtatttaaaatatgtaaagaattaggagttaataagaaggtggtaaatagtttatttaggaaagagtaaaaattatgattgggaatttgtagaaatggaaaaataaataaaaatgtttatttttagtgattagtaaattagagttagagggatgtttttttatatttattagaatgatgatgatgatgttagggaaaggaatgaaggttagtgggcgagattattgtttttttgtgggtttttttggtggtagtaagtttagttgggagttttttgtatgtatagataagaaaatgtatttagaagtttgaaatagtaaatatttggagatagtttaggggtgtattattaggggaatggataggtaggttgttgtttattatatgttaaaaagtagtaagaattaattatttgaattatatggattatagttgggtatagtggtttacgtttgtaattttagtattttgggaggttaaggcgggtagattatttgaggttaggagtttgagattagtttggttaatatggtgaaatttcgtttttattaaaaatataaaatattagttgggcgtggtggtacgagtttgtagttttagttatttaggtagttgaggtaggagaagcgtttgaatttaggaagtagaagttgtagtgagttgagattatgttattgtattttagtttggatgatagagcgagattgtgttttaaaaaaaaaaagaattatatggattatataggtggattttataaagataaagataattcgtaaagaaagaaaatttaggcggaatatatatagtgtgatgatatttgatatgttatatttaaggtatgtagaagttttatttgtttttaagaatttgtaattatttaaaaatataaacgtgtatggggatgatatatacgtattttagtgagtgatttttttagttggggataggattggagatgatttttttagagtgggatatggtggaggttaattgttttagtaatgatttatgggtatttggatatttattgtattatttttttttttttttttttttgagatagagtttcgttttgttgtttaggttggagtgtagtggcgtaatttcggtttattgtaaattttattttttgggtttacgttatttttttgttttagttttttgagtagttgggattataggcgttcgttattatatttggttaatttttgtatttttagtagagacggggttttatcgtggtttcgattttttgatttcgtgattcgtttgttttagttttttaaagtggtgggattatagtatgagttatcgtgttcggtttattgtattattttttgttttttttgatatatttgaaatattgtgaagtatatttaaattatatatttttaagaatatttaaaagtttttttggtaatatttgtttattttatttatttttataaatatttttatatttttttgtttggaaatatttgttgagggatgggatgaaggggaatgagattttttagtgttttttttgtttagttttgattttttgtgtgatattattttttggtgttttaggttgtttcgtaaaattagatatagtcgtttgtttttgagtgtgtttgtattgtttttattttaggttagtatcgatgtaggcggttaggcggttgttttgtttatagtgtggaaatgtttatttttaggttagtattgtttattaataattgataagtgataataaaattgtataaaagttgaaaaagttttatattttttttgttttttttttaatttttattaaagtaataaatatatatggtttttaaaaattaaatagtttagaagaatttttaatgaagaataaaaagtttttatttgtatattataaatttgtataaatgtatagaatgtatattattaagagtgatttgtaatgtaaatatggattttgggtgataataatgtgtttatgtaggttttttagtagtaataaatgtatttttttagtgggggacgttgataatggtggaggttgtgtatgtaggggttgtatggggaatttttgtattttttttttaattttgttgtaaatttataattggtttaaaaataaagtttatttttaaaaaagttttttttattttattttttttaattttagtttatttgttaaaggtagttattgttagttttaattttttggaatatttataaataatgttatttatatgttatataaataataatgtgtttgttattatttttgggtttattatttatagacgttaattattatttttttttttttgagatttttttttttttgtatttgtaggttagtggggaattggtcgagttggttgggtttggttggttggattggttttaagttgtgggtttagttaggtatgtttttttcgtaggttaggtttaggtttgttttggattttttttggggtttaagatgaagggatagggaagtttttgttataataatggtaaagttataagagggaaggtttagttgtataagtgtattttaaatttttgttaatattttattggttaaagtacgttatatggttatagttaggagtgaagaagtgtattgtttttagtagtaggtattgtaaagttatatagttaagggtttggatatagatagaagtgaagaattgggattttttatttaatttattatattttttataattttgtttttttatagatttttttgtaatagtattttagtttaaataatataatatagttttgtttaatggttggttttttttaagtggttgatagatatttgatgagttttttaaattttaatatttttataggtttttgagaaggaattttgttagatagtttaggtttggcggatgaagaaagtttgggtgtgggttttttaaagttagtttggttggaaatattttgtttttttttttttttttatgaagtgaagagtgtttttagatggtgtatagatagcgagttgttacggaaatattatttgatttttttagaagattattatatcgatatagtgtcgttttattttgtatttaaaggtaatgtttttgtgtttttaaggtttttgatattatttgggggaagtttagtagggttacgttggttatttttgttgttatttttttgtttagaggttttttttattttttttttaatttcgatggtgattgttgggaaagttaaatttgagtatttgagtatgttaattttttgttagtgttttttcgtttgtatgattgaagtttaggtttttttatgtggattatgatgtttatatttgttgtttaatattaagaattatgtaagtgtttggagttgtagttgaattaagagaaggaaaaattgaagatatagaaaagtaagggagcgtgtatttgatgagttggagtagggatttatgggtttttttatgtaggaaaagagtagttttttatttttttagaatggagggaagtttgggtagagaggtagagagggtgtgtatatgtatgtgatattgggttagttttttgtgatatgggaggtaagatattttgagaatgagtggggtgggaggttgtgatgtgggtttaagtagcgagttagatttatggaagagtttatacgtggatagggagaagtttttgtgtggattttgtggttagttatcgggattgtttagtatgttgggtttagaagataagtttttttatagttttagttgagggattgtttgattttttggggtttgggagttgagaaggtgtttggggtgggaggattgggatttagaaaattgagggtgtttttggggagagttttattgatggtttgagttacgtagggaagtaaggtaagaaagaggtagtagaattaagtgttatggagtattaagttatttagtatttttttttttttgaggtagagttttatttttgttgtttaggttagagtgtaatggtacgattttggtttattataatttttattttttaggtttaagtaattttttttttttagttttttaagtagttgggattataggcgtgtgttattatatttggttaattttgtatttttagtagagagggggtttttttatgttggttttaaatttttgattttaggtgatttatttattttagttttttaaagtgttgggattataggtatgagttatcgtattcggttattatttagtattttaaagttagttggaaatttagtattttatgtaggttaataagaatggggttaatatgtattgagagttaattaggtattgtgttaagagatttgtgatggtatttatttgattgtatttttgttagtaatgaatgtttttatttaatttttggagggatggtttttttgtttgtttgtttgtttgtttgtttttttttgagatagagtttcgttttgttatttaggttagagtatagtggtgtgatttattgtaatttttgttttttgggtttaagcgttttttttgttttagttttagttttttgagtagttgggattaaaggcgtttgttattatgtttggataatttttttgtatttttagtagagatagggttttattatgttggttaggttggtttttaatttttgattttaagtgattcgtcggttttagttttttaaattgttaggattataggtatgagttattgcgtttggttagggggtgggggatgattttaatagtgtaaaaagtttatataaatttttattttttttgtgagttttttagaaagtatgtttatgtatggggtatgtgtataggtatgtgtgtgtgatagtggtttatttatgttttttgattatgttggaaaatattttaatattttagttttaaattttgttgttgtttgtttgtttgtttttgagatcgggttttgttttgttgtttaggttggagtgtagaagtataattataatttattataattttgattttttgtgttgaagtaattttttttatttagttttttgagtatttgggattataggtatgtattattatatttagtaaatttttaaatttattttttgtagagatagggttttatttttattatgttgttaaggttggtgttaatttttgggtttaagtgatgtttttattttggttttttaaagtgttgggatgataggtgtgagttattatatatggttattttgaatatatagaataagttttaggagtaatttatatgttgaagagtaattatagttggtgtggtaaatatgaaagtttaggagaaagattaagttaattgtggttttggtggttttatttggttattttaggaatgtttatttttttattttgttgtagtgatttagtttgtttttttgatgttgtaggtatttttttatttggatgtttaaaattgatatttagttgtgagaagcgtttcgtttagaagaaagagttgaataagaagtttgaagatttatgtaggaagaagtttgttgagttcgaagatgagttagattatattgtggatagtttgatatggaatttaatttttaaggttaaagaaaggattagagaattttttaaggttagtttggaaggttgtgtagagtagtgtttggggggatagagaggtagtgaaggggaaggtatttagatgatatgagaagttgtgatgaatttatcgtaaaatagagtagagtttgtgttggttatttatgggttatgtagttggttaagatgttaataagtataatttttttgtttgttattgattttatgtttttgtatgttttaaagaaagtaagttaattaaggaataaaaattggatgaattatttacgtgtgttatagagagagttagatagatttttgtttgttagaatggagagtcggaattattttttaaaaaattttcgtttttttttttttaatattcgatatggaggtaagttttttgttttttttttaaagaagttagtatcgataggagaattttagagtatagagttagaatagaggtatgtttttttttggtttgaatttttagaaaatttggtttatgagagttaatttagatggtttttcgtttggtttggttgtagaggtttttagatttgtggggtagggtagtagtattagaatagagtagggttgtagggttatttattggtgtggtttttgaattttttttagagttttgggtttatgtttttttgatttgttaggggttttgagaaataggggttggtgttggttttttatttatattggagtaatttgggttaaatggaagtaatttcgttagagatataggttttgagtaataatagtatttgaaatttgattgattataaataattagtgtaaattgtgatttttttttaagagtgtttttgtttatatattagtaattgtttttatgaaagtaatgagttgttttatgggtttataattttagtaagtttaaaattattaatatttttttattagataattaatattttttattaagaaaaattagatataaaaattagttgggtatggtggtatgtatttgtgattttagttatttgggaggcggaagtggaaggattatttgagtataggggtgtcgaggttgtagtgagttaagattgtgttattgtattttagtttaggtgatagagtgagattttgttaaaaagaaaatagaagagaagagaagagaggaggagaaaagagaaagaaaagaaagaaagattagaaaagattaatatttgagatatttatattaaaaatttatttatttattggtgtttaaatatgtagagttttttttatgtatattgaaaatgaaatatgtagttatttatgtttttataaagattggattatattgtaaaattattttataatttgtattaataataagatttaaaaattttttaataaatggtatattgtgaatatttttgatggtttttatgtatttatttttatattaattagttattgtttattattttattgtatggatgaaattaatagtttttttttttttttttttttattttatagttgtgttgatattttagtgtttttagttaagttattaattgggttttttatagattatgaaattggtttagtttatgaggtagatattttgtttttttatagtttttattttatttgtttttttatttttaaaaagtttttattatggaaatttttttttttttttttttttttttttttttttagtatttattgattatttttgggtgtttttcggagagggggatttggtagggtttaggataatagtgaagggaaggttagtagataaatatgtgaataaaggtttttggtttttttaggtagagggttttgtcgtttttcgtagtgtttgtgtttttgggtatttgagattagggagtggtgatgatttttaacgagtatgttgtttttaagtatttgtttaataaagtatattttgtatcgtttttaatttatttaattttgagtggatagagtatatgttttagagagtacggggttgggggtaaggttatagattaatattattttaaggtagaagaattttttttagtatagaataaaatggagttttttatgtttatttttttttatatagatatagtaaaaatttgattttttttttttttttttatattttttttttttttatttgataaaatcgttatcggtattatggttcgttttttatgagttattgggtatattttttagacggggtggcggtcgggtagaggggttttttatttttcggacggggcggtcgggtagaggtttttttattatttttcgggaagggcggttagtcgggcgggggttgttttttatttttcggacggggtggttgcggggtagagatattttttagtttttagacggggtcgcggtcgggtagaggcgttttttatattttagacggggcggcggggtagaggcgttttttatattttagacgatgggcggtcgggtagagacgttttttattttttagatgggatgacggttaggaagaggcgttttttattttttagattgggcggtcgggtagaggggttttttatattttagacgatgggcggttaggtagagacgttttttattttttagatggggtggcggtcgggtagaggttgtaaatttagtattttgggaggttaaggtaggcggttgggaggtggaggttgtagcgagtcgagattatgttattgtattttagtttgggtaatattgagtattgagtgagcgagatttcgtttgtaatttcggtatttcgggaggttgaggttggtagattattcgtggttaggagttggagattagttcggttagtatagcgaaatttcgtttttattaaaaaatacgaaaattagttatgcgtggcggcgtacgtttgtaatcgtaggtattcggtaggttgaggtaggagaattaggtagggaggttgtagtgagtcgagatggcggtagtatagtttagttttcgttcggtattagagggagatcgtgtagagggagagggagagggaggagagggagattgtgtagagggagagggagagggagagggaggagaggaagatcgtgtagagggaaagggagagggagagggcggaaatttttaattgtatataaaattagggaaaagattataattattttttatgtgtttaatatgtagttttaatagttatttatattttgttaatttggttttgtttattatttttataatttttttatgtatatatttatatgtatatgtatgtgttggagttatagaaggaaaatatgatattatgttattttttagttaatatattaattagtatttttaatagataagggttttaaaaagtaattatagtattattgttatatttagttatattaataatgattttttaatattaattaatatttatttatgtttgatttttatttgttttaaaaaaaagtttatttatatttggtttttttgtattagaatttaaatattgtatttgattaaagtattttttaatttttttttagttgataataattttttttttattttttgttttttaaaaatgttatttatttgttgaagaaattgtaatttcgtatattttggatttggttaattgcgttattgtggtgatattaaacgtgtttttttattttttatattttttataaattggttattagatatagagatttgatgagatttaagttttatttttttttttttttgataagaatatttttttggtggtattgtgtattttttattgtaatttattaggaggaagtatgggatttgggttttttatgattagttatgaatggtattaggtgttgaaattttgatttattttttataaagtttttattaaatttttatttaatagttaatagtttagatgattgttagatgattattgtttagatttattttttttttaattagggtttataaaatggtaatttttaattttattattttatttatatttattagtttgattttttatttaaaaaatagaataaaattttttttttaattttgatttttgttttttttttttttttgtatttttttgatatttataggtaattatttttattagtttgtatttttttattgtttttttttgaattataagtaaatatgtatatatagttgaatttttttttttttttattgttttttatattttaatagtatatttagtaatttttgtaagagtagaggttttttttattttttttttttagttttttttttttagaagttttttatttttttggggaattaggttaagattaagtttagtagttattaattttgtttattaggtataaagataattaggtttaatgatagtaatttttttatatgtatatggattgtattttatagtttaaagagtatttgtttatttataatttttgaggaatgttttaattatttatggtaaaaagtagattaatatggtagttttatatgttgaatattagaggaagtattttgtttattttttggatttaatagtaatgtgttgttttttgtatttttgtgtttgggatttttgtgtttggttattacgttttaaggatagttgtagaagttggtaaatatttagaggaaaggagttaaaattatgttagttagggaatagaatagggaaaagggagagttgttgatggatttatggaagatatttttttttagggtttttagatgtttgttgtggaagtttgtgtttagagtttggagattttgaggttgtagatgaggtagatatagattgttatggaatagttttttttttgatttttgtttatttgtttaatttttatttttttgatgtttataatagttgtttattcggttaaattataaagtgtaaggataaaaatagtttaaatttttagtttttaaaaatttatgttttatgtattttttttttgaaattttttagggaatatgtttttttaatagaaatgaggaaattaatgaagaggaaggtatggaatgtggtattaagagatttaatataggggagaggtgaaggaaatttttaggttaataatttttaagagattttgtagttaatattgttgtaaagtaaaattttttaaagtttagtaatttaaaataattattttattatgtttataaattttttgggtgaaaaatttagagagagtataatgggaatgatttgttttataatgtttgaggttattgttggaaagagttagtgtttaggggtgatataaaagttggggttgatgttgttgatgttgttgtagatagagagttgaggttgtttattagaatgtttatattatatagtttttttatgtgggttgtgtttttttatagtatggtaattttaggttaattagatttttatatgataatgtaagtgagtatttgtatttttttttttttttttttgagatggaattttgttttattatttaagttggagtgtagttgtaggattttggtttattgtaatttttgttttttgggtttaagtaatttttttattttagttttttgtgtaattgggattataggtacgtattattacgtttggttaattttttatatttttggtagagagagggttttgttatgttggttatgttggtttcgaatttttgattttagatgatttattcgttttggttttttaaagttttgggattataggcgtgagttattgtatttggttaagtatttgtatttttaagtgagtattttagtaagtaagaaggagattgtattatattttatgatttaattttgtaagttgtatagtattatattttttgtatgtcgtagattataaataagttattaaggtttatttagatttaagggaagatatgtagattttatttttttttttttaaaatttttttttttgaaataaggtttggttttgtcgtttaggttggagtgtagtggtatgattttggtttattgtaatttttgttttttgggtttaagtaattttttttaatttagttttttaagaagttggggttataggtgtaggttattatatttggttaatttttgtattttttgtatagacgggtttttgttatgttgtttaggttggttttaaatttttgagtttaagtaatttattcgtttcggttttttaaagtgttaggattataggcgtgagttagtgtttagtttagattttatttttaatgagaatagtgttaaagaatttatggatgtgttttaaaattgttttaggagttattttatatgatagtagtaggtgtagtgggtaattagtttagattagaagaggttagaaagttttaggagaggttgatttatggagatgatattgagaagagtttttgatatatttggatatatgggggagagatttgtagggtggtggagaaggattgaattattgataagtataaagtaaataaaataattagttgattatttattttaggaaaattaaaaattgtataaggtagggaaaggaattattttatgtttagttgtgaatagtaattatttagtaatttgaatataatatgaattattaatttaattagtagtatgatataattatattggaaatatgggggataggaagggcgtgttatatggtgagttagatatgggagagggaagagggaatatttatattttttatttataattaatatttaaaattgaataaaagtagtatattatttggagatatggaaataaatattaaaataattagttaaaggatgaaaaagtgtttatttttggggagtgggaaatggtaggatggggttaggggaagagggtagtattttatttttaaaattttgtcgaattttgattttttaaattatgtggttgtttaatttagaagaaaataatttaaaaaaatttaaaattttttataaaaagaaatattaggtttagattattttgtaggtatagattatgaaatattcgagttattttttattttatgaaattattttagagattagaaaaagagggaatgtattattattattaggtaataagtttaattattttgatattaaataaaaatatatattagttttaagaatataggtgtagaaatattaggtaaaaaatagtaaattaaattaaatagtaaggaataatatatatatatatatacgtagttaattttttgaaatttaggaacgtagggaatgtttttatagtaggttttgagttggtagttggttttgttgagtttattattttttttttttaaagtttttagtgttgttaaggaaagttagtttatgttatagtttttataatgattattattttaaattttgtagttattatagttattatgttttattttttggttttttatttgtattttattttagttgattattagtgaaagttttggtaattgtgataatattattttatggtgtttatattttagtttttattagttgttttatagatggattggtgtaatatgtagtgttggttaaaaattgatgtaaatgttgatttaggaatataaatttataaataaaaataggaagatatattttatatttatgttaatttttatttggtggggggttggtagaggattttaattttatttgtaatgttttattttttaagttgggtgatggaaatatggtttttgttatgttataatttatatattgttttttagtgtaatattttataaaatattaataaaagatgtgtatttgtattgatgtgttatatattgtgttgggtgtagttggaggattaggtttagattttgtttttgggggttttttaatttggggtggtagaaaagaaagtggggtttaaagggggtgagtgggttgcgtaagaggtttaattatattttgatatagaggtgttataatattttttgtgtttatgggaagaatggtttagagatacgtgttgaggaagatagtaagtaagaggtgaggtgagtaaaattttgaaattagatattttaggtttaaatttaattggtgtttttttgaattttagtttttttagttgtgagatagaaatagtttttattttttttggttgttgcgaggttgaggaggtatagagtagatgtttataaatagtaattgttattttaaataataggttagttttatgtacgttcgtgtgaagagattgttaaataagttttgtgtgagtaataaaagtttttaattatttgggtgtaggcgagttgcgtttataaagagagttagtgaaaagagatggggtgggtttattttataagatttgggtgggtaaaggaaaattgtagttaaagggggtttgttttttggcgggtaggagtgggagtcgtaaggtgtttagtgggggagttttttgagttaggaaaaggatttttataaggtaatgttattatttaaggtaaggatcggttatttttattttttttgtggtggaatgttattagttaaggcggggtagggtatttttattttttttgtgattttttagttattttaggttatttgggtatataggtgtaagttataggagatgcgatggtttgttttgggtttagaggtttgatatttttgtttttttatattaataagaaaaatgaaataaaatagtgttgaagtgttggggtggcgaaaatttttgggggatggtatggagagagagaatgggcgatgttttttagggttgttttaagcgggattggggtagcgtgggaatttagagtgggagagagaaagttgaagggagattttgtggtaagtggtgatatcgtggggttgttagaagaaatatttgttgtatagaatgattggtgatggtttggatatggttttggatgaattgagaaattaaacggaagatataaggtttgaataaaagaaggagaaaaatgggtattaaaggattaagaattgggaggatttaggatatttaattagagagtgtttaagggggtttagcgtaattatttgtttggtttagaagtgatttttttgaggatagatttttatgatggaaaggaaatgagaggttttaagagacgggttagcggtttgtaatttatatggaagaggttatgaaatgacgatagaatagaatgggtttgtgaggttggaaggaggtattttttttggtttaagaattatttgttttgtgtgggaagagattgataggtggaaattttagcggggaagtaggtgggagtgatcgatgtgaaggagaaaaattggttttgagggatagaagttggagagttagttgtttgtttagttattttattagtataagcgttgtttagagtaatgggatttgacgttttttgatgttttttgtagtgaatgattttagttttttttggaagtaaaggggttttgagtagagtttttattaaagaggtattaatgatggaggatttttgtgtagtgagggagttttttttagtttatatgattatatggtggtgtagaatatgaaaggtatatttagaattagtgtagatattgacgtatagtttttttttaagagtgagggtttgagttaaggtaattagtttggtttgttgagaggtagtggaggggggtagagtggtagttttaatgatagatgtggaagatattatagtatagtttgtttttgttggtgagtggtaattaggtttggtggaattgttattaataaattaagtgtgattagggtgagaaataaggaagaaggaaatgtggggaaatggggtgaatattaggtggattagagagatgtagttatgagggttaggtgtggtatttggaataatgtgggaggttagattgaagtttaggttaggaataatggtaattgtgggagatttaacgaagagtgagtgtagttgaaggagtcggggagtagaaagtatatgcgttaggtgtgaggaagaaaatagattttggaaattatgagagttgtagagagtgagttgagtatagtttgtgattttgagggtttttaaaagtattagggcggtagtagttattgtacggagatatgatggttagtttaaaatagtaaggttaagttgtttggataaaaaggttataggacgcgattttggtttttgtgtaagaattttgattgtatagttttgtatttcggttgtgtgtaatgaaaagagttgggatgagttagggagagttagagtgggggtagtttttaaagttgtttttaaggaatagaaagaggagtggggaaaggatttaggatttatggggttaattaggtttttttttgtgagtttatataatggttttgttaggatggtaaaattaggtatttaaaggcgaaaatatttaattatgtttaggaaggaaaggagttgttgttttgtagaaggggttggggtttgagagattagtcgggtacgattggtagggagagtacgtgtgtttttatgaagaattatgtcgaggtaggtaatggatggagaagatatttgagttttggagggagatatttgatattttttggagaataaatgttgaaggagtagaagtgtgttttgttgagaagatttaaaggaggggttataaagaagaaggttattaatatattgaataaggtgagaagcggaggggtggaaagaaagtaaattacgagaaagagtttggttgaagtaatgagggttgtttttgaaattttgcggtagtatagtttaggtaagttgttgggattgatgggtgatagggttagtttaggtgaaagtaaagagaggttgggatgaggagtgtaggggaatagtgaaaaaagtatttttaagatcgagaatagaatattgagttgtggaggaaggtattgaggataaaagagtgtatgggttgggtattataggatggatggtaaaataatttggttgataaggtgtagattttgaattaatttgtaagatttgtttggtttttggataggtaaagtgggggaattgtaaggagagtttttaggttttagaagtttatgttgtagtaggcgagtgataataggttttaatttttttaaagtgtgttgtgggatgggatattggtattgagtggggtaagggtgattaggttttaatgggatggtaataggtatgtgattagttgttagggaaggagtagagatgttttatatttgtgggttaaggtggggggatacgagaggaagatataaaggaggttttgggttggggagaagagcggtaatgagatgcggttatagtagttagggaagtagataatttggttaaaatatttcggtttaataagggaattgggtaggtggggataattgaaaaagagtgtataaaagagtgttgtttaagttggtattagagtgggggagtttttaggggttttgaagtttggtcgttagtatttataatagttattggggttagggaaataggtttttgaaaagaaggtaatatggagtgggtagtttttgtgtcgattaaataggggatggatttattttttattgtgagagttatttgaagtttagtatttgtgatggtttagggggattttgaggtgatcgggtagtattaatttttagtcgttaagttgagtagatttgggaaggagtcggttagagagttttgggttagagttttaggggttttaggagtggttgttgggcgagttgggtagtttgttttttagtgggtttttatatagatgggatatggtttggaaggaattttgggttgtaggtattttttggtttagtggttagatttttggtatttgaagtaggattttgatggaggaagttttgtaggaatgtttgattgttgtagtttaggtattttgaagtttttgtatgttggaggtgtggttgagttttgttttatagtagaggtaagtaattgtaatttagaaatgcgttgttatttggttgttttttttttattattgtatattttgaaggtgaggttgattaatttttgtttgtggggtttgagggttagattttaatttttgaagtttttttttaatgttaggagtggattgggtgataaaatgtatattgagaataaggcggttttttggtttttttgggtttagggcggtaaagcgtttaagggttgttgtttaagcgggttatgaattgggttgggttttcgtttttattttgggtagtttttttaagtttgttagaattaatagttttgtaagttgtttttttaagttttttaattaggtaggaaattatgtaattttgtttagttatatttggggaatttgtttggtagttttattggggatttttttggggaattgttttaatgtttttttggaggttaggtttatgaagtcggcggttattagtatgagattgggttagagaaaaaatttttttttgtttatttggggagagggtagaagttaggatgatatttaagttattttaggttaaattgtaggatagagttagatattagaatttttgtatatatttagtggggtttgatgagaaagagtttaaacgttgattgatttgagagaggtttgatagagaaaaaggtatatgtattttgattatgtttttagttttagttatttttttaagaggaaattgttgggcgggtggggaaaagttagtcgtagaattaaattgtaagtcggatcgggtgtgaggaggggaggtggtagaaggattataggatggaagagcggaggttgaggaagaattgggatttagtttaatttggttatgagtagtttgaggaggaggggaaaggttagatgggtttgtagaaggaagattggaaagatttaacgacgtttggggttgggattgagggggtaggcgggaaggaaagaaggaggatttgggaggaatcgtattgggaatagagattagggagggaataaagtgtgaaaagtgtttggacgtaaggtattttagattatttgtttattttttgataaaaattatttaggttttgtaggatggagaaattgaaagtgttattttttggttatttagagttattgttaagtttgtattggggttaagtagtgttgtagaagaaaataaggtatttaggttttaggttagatgtgagttgaagaggttttaagtttttgagaatataggttaagggagaagaaggaggaatggagggtggaaggttgtttatagtgaaggaggtaagtttagagaaaagagagagtagagatacggagggaaggggttcgggggtttttattttttagaaaagtgggaaaggggtcggggcgtggaaataaggggttggggtatagagataagaggttagggtatggaaataagggatcggggtgtagagataagaggtcggggtatagaaataagggattggggtatagggataagaggttggggtatggaaataagggattgggggtttttgttttttagaaaagcgggatttgttattaagggtgaaggagaaggggttgaggggtttttgttttttttttagaaaagtagagaaggggtagagatttagagagaaggggttggggtatttgttttttttttagaaaagcgggatttgttattaagggtgaaagattaaggtaggtgtttttgtgtggtttgatatttttgaaacgtgggtgaataattagagaggtatttttgtaatgattaaatattaagggaaggttgtttttttagtttgtgatcggtatcggagttttgggtttacggataaaatatgttttttttgtttttattagaaaatgaaaggaattgaaattaagagaagggagagattgaagggtggcgttaagattgaaaggagaaagaggttgagggatagtgagggaggttggagaagagagtaaaaagaggtcgtttattagatttgaaattggtgagatgttttttgggtttatcggtttgaggatttgaggtcgtaggtggttttatgtgcgttcgtgtgaagagattattaaataggttttgtgtgagtaataaagttgtttattttatttgggtataagtgggttgagtttgaaaagagagttagtgaagggagatggggtggggttgttttataagatttgggtgggtaaaggaaaattatagttaaagggggtttgttttttggtaggtaggagtgggggtcgtaaagtatttagtgggggagttttttgagttaggatgagttaggaaaaggatttttataaggtaatgttattatttaaggtaaggatcggttatttatattttttttgtggtggaatgttattagttaaggtggggtagggtatatttattttttttgtgattttttagttattttaggttatttgggtatatatatgtaagttataggggatgtaatgttttggtttgggtttagaggtttgatatttttgtttttttatattaataagaaaaataaaataaaatagtggtaaagtgttgggatagtaaaaattttgggggatggtatggagcgataatgggcgatgttttttagggttgttttgattaggattaggggtagcgtgggaatttagagtgggagagattaagttgaaggaagattttgtggtaaggggtgatattgtggggttgttagaagaaatatttgttgtgtagaattattggtgatggtttggatatagttttgtatgaattgaaaaattaaatggaataagagaaggagaaaaatagatataaaaggtttaagaattgggaggatttaggatatttgattagagagtgtttaaggagatttagtatagttttgttagtaaagattatttatttattttaagagttaagaatggtagtttggggatagtacgaggagatattagttgtgatggtttggagaaatagtgtaaatcggtagtgtaaataagagtagggtatgtatgagtagttgagaatggagaataggagtatgattagatagaaaatagtagggatgataagtgtttttggggtatagtttaagttggtttagtgtttggaatgagattgggatttaataaaaaggagtttaaatgggttgtattttgtagtatttcgaggataggtttgatttttgagaagggaaagtggtgaaagtattgtttagttttttttaagttggtggttgagtttggtgaggtttgtttttaaaagatttttagtttgttttattttttttgaagatagaggatcgtaagggatataaaggttttttgaaaaattgtttggttgatttgataaataaaggttggtttgttattagattgtatagaggtgggaaggttaaattgaggaattatgtttgatagaagggaagaaattattgggatggtttttttagattttgtaggaaaggtttttatttatttagtgaaagtgtttatttagattaagaggtattttagttatttgatttagggtatgttgagtaaagttaatttgttagttttgggtgggggtaaatttttaagtttgatgtgtagggaagggagggggtttgaataatttttgaggagtagtagaatagtagatggaatattgagaagttattttttcgaggatagatttttataatggaaaggaaatgagaggttttaagaggcgggttagtggtttgtattatagtatagtttgtttttgttggtgtgtggcgattaggtttggtggaattgttattaataaattaagtatgattagggtgagggataggaaagaaggaaatatggggaaatggggtgaatgttaggtggattagagagatatagttatgggggttaggtgtgttattaggaataatgtgagaggttagattgaggttcgggttaggaataatggtaattgtgggatttaataaagagtgagtatagttgaaggagtcggggagtagaaagtatatgcgttaggtatgaggaagaaaatagattttggaagttatgagaaatgtagagagtgagttgagtataatttgtgatttttagggtttttaaaagtattaaagtagtagtagtcgttgtacgtagatatgagggttaggttaaaatagtaaggttaagttgtttggatagaaaggttatagggtgcggttttggtttttgtgtaagaaattcgattgtattaattatgtttaggaaggaaaggagttgttgttttgtaatagattgaggtttgggagattaattgggtataattagtagggagagtacgtgtgtttttatgagaattatgtcgagataggtaatagatgaggacgaaatttgggtttgattgaagtaatggggtttatttgtgaagttttgcggtagtatagtttaggtaatttgttgagtttaatgggtgttagggttagtttaagtgaaagtaaagagaggttgggatgaagggtgtaaaggaatagtaaagaaagtatgtttgagatttagaatagaataatgggtagtagagggaggtattgaggataggagagtatatgggtttgatattatggggtggataggtaaaataatttggttgataaggtatagattttgaattaatttgtaaggtttgtttggttttaggataggtaaaatggaggaattgtaaggagagtttataggttttaaaaggttatgttgtagtaggcgagtgataataggttttaatttttttaaaatatgttgtgggatgggatattggtattgagcggggtaagggtgattaggttttaatgagatggtaaggggtgtatgatcggtcgttaaggagggagtagaggtattttatatttgtgggttaaggtgggggaatataagaggagggtttaaaggaggttttggattgggaagaagggtagtaatgagatgtagttgtaatttaggaatagttagggaagtagataatttagttaaagtgtttcggtttaataagggaattgggtaggtggggataattaaaaggagtgtttaaaagagtattgtttaagttagtattagagttggggagttttaagaggtttagaagtttggttgttaatatttataatagttatggaggtaagggaaataggtttttgaaaataaggtaatgtggagtgggtagttttcgtattgattaagaaggggatagatttattttttattgtgagagttatttaaagttcggtgttcgtgatggtttagggggttttggaggcgatcgggtagtattagtttttaggtattaagttaagaagatttgggaaggagttagttagagagttttgggttagagttttaggggttttgggagtggttgttaggtgagttggatagttcgatttttagtggggttttatatagatgggacgtggtttaggagaaatttcgggttgtaggtattttttggtttggtggttagatttttggtattcgtagtaagtttttgggggaggaggttttggaggaatgtttggttgttgcggtttaggcgtttggaagttttcgtgtgttggagatgtggttggggtttgttttatagtggaggtaaggaattgtaatttttttttattattgtatattttgaaggtgaggttaattaagttttgttgtggggtttgagggttggaatttaatttttggagttgtatttaatgttaggagcggattgggtaataaaatgtatattgagaataagatagttttttgattttttagggtttagggttgtaaagcgttttagggttgttgttgaaggagttatgaattgggttgggtttttatatttgatgaaaaagtttaaatgttgtttgatttgggataaagaaaaaggagtattaattttgattatgtttttagttttagttatttttttaagagtaaattgttgggtaggtgggggagggttagttacggaacgaaattgtaagtcggattaggtgtgaggaggggaggtgataaaaggattatagggtggaggagtagaggttgaagaagaattgggatttagtttggtttggtgaggaggggagaggttagatgggtttgtagaaaaggaagattagaaagatttaatgatgtttggggttgggattgaggggataggcgggagggaaagaaggaagatttgggacgagttgtattgggtatagagattaggaagggattgatgtgtaaaagaatgtttggatattaggtattttagatcgtttgtttattttatgataattatttagattttgtaggatggaaaaattgaaagtgtcgttttttagttatttggaattattgtcgagtttgtattggggttaagcggtgttgtagaagaaaataaggtatttaggttttaggttaggtgtgagttgaagagtttttaagtttttgagaatataggttaagggaggagaaggaggaatggagggtggaaggttgtttatagtgaaggaggtaaatatagagagaagagagcgtagagatacggagggaaggggttcgggtgtttttttttttttttttttttttaatttattttttattgataatttttgggtgttttttatagagggggatttggtagggttatgggataatagtggagggaaggttagtagataaataagtgaataaaggtttttggtttttttaggtagaggattttgcggtttttcgtagtgtttgtgtttttgattatttgagattagggattggtgatgatttttaacgagtatgttgtttttaagcgtttgtttaataaagtatattttgtatcgtttttaatttatttaattttgagtggatatagtatatgttttagagagtatagggttgggggtaaggttatagattaataggattttaaggtagaggaattttttttagtgtagaataaaatgaaaagttttttatgtttatttttttttatatagatacggtaattattcgattttttaattttttttttatttttttcgtttttttattttataaagtagttattgttattttggttcgtttttaatgagttgttgggtatattttttagacggggtggtggtcgggtagaggggttttttattttttagtaggggcggtcgggtagaggcgttttttatttttcggacggggcggttggtcgggcggggggttgattttttaatttttttttcggacggggcggttggtcgggtagaggggttttttattttttagtaggggcggtcgggtagaggcgttttttatttttcggatggggcggttggtcgggtagggggttgagttttttatttttcggacggggcggttggtcgggcggagggttgatttttttatttttttttcggacggggcggttggtcgggtgggggggttgatttttttatttttttttcggacggggtggttggtcgggttgaggggttttttattttttagtaggggcggtcgggtagaggcgttttttatttttcggacggggcggttggtcgggcggggggttgatttttttatttttttttcggacggtacggttggttaggcggggggttgatttttttatttttttttcggatggggcggttggtcgggcggggggttgatttttttttatttttttttcggacggggtggttgtcgggcggagatgttttttattttttagatggggtggttgtcgggcggagaggttttttattttttagacggggtagttgtcgggcggaggggttttttattttttagacggggtggttgttaggtagagggtttttttattttttagacggggcggtcgggtagagattttttttattttttagacggggtttcggttaggtagaggcgttttttatattttagatggggcggcggggtagaggcgttttttatattttagacgatgggcggtcgggtagagacgttttttattttttagatgtgatggcggttgggaagaggttttttttattttttagatgggatggcggtcgggcggagacgttttttattttttagattgggtagttaggtagaggggttttttatattttagacgatgggcggttaggtagagatattttttattttttagacggggtggcggtcgggtagaggttgtaatttcggtattttgggaggttaaggtaggcggttgttttttgttttcgggtttcgcggggttcgtttcggttcgggtgtttttaattttttagaaaagtgggaaaggggttagggtacggaaataagggattggggtatagagataagaggttggggtgtggaaataagggattgggggtttttgttttttagaaaagcgggatttgtcgttaagggtgaaggagaaggggttgaggggtatttgttttttttttagaaaagtagagaaggggtagagatttagaaggggttggggtatttgttttttttttagaaaagtagagaaggggtagagatatggagagaaggggttggggtatttgttttttttttagaaaagcgggatttgtcgttaagggtgaaggattaaggtaggtttttttgcgtggtttgatatttttgaaacgtgggtgaatgattagagaggtgtttttgtaatgattaaatattacgggaaggttgtttttttagttcgtgatcggcgtcggagttttgggtttataaataaaacgtgttttttttgtttttattagaaaatgaaaggaattgaaattaagagaagggagagattgaagggtggtattaagattgaaaggagaaagaggttgagggatagtgagggaggttggagaagagagtaaaaagaggtcgtttatcggatttgaaattggtgagatgttttttgggtttatcggtttgaggatttgaggtcgtaggtggttttatgtgcgttcgtgtgaagagattattaaataggttttgtgtgagtaataaagttgtttattttatttgggtataagtgggttgagtttgaaaagagagttagcgaagggagatggggtggggttgttttataagatttgggtgggtaaaggaaaattatagttaaagggggtttgttttttggtaggtaggagtgggggttgtaaagtatttagtgggggagttttttgagttaggattggttaggaaaaggatttttataaggttatattattatttaaggtaaggatgggttatttttattttttttgtggtggaatgttattagttaaggtaaggattagttatttatattttttttgtggtggaatgttattagttaaggtaaggattagttatttatattttttttgtggtggaatgttattagttaaggtggggtagggtatttttattttttttgtgattttttagttattttaggttatttgggtatatatttgtaagttataggggatgtaatggtttagtttaggtttagagttttgatagatttatttttgtttttatttttattttgtattttatttatttgtttttaaaattttaaattaatttttttgtttttttttttggtagagagagtttttttatgttgtttaggtaggttttaaatttttgattttaagtgattcgtttgttttagttttttaaagtgtcgggattataggcgtgagttattatatttggtttgtattttattttttattatggaaattttttaaaataaataaaagtatataggatggtataatgaatttttatgtattttttagttagtttcgatagttattaatatgtggttaagtttattttatttttatttttattttttttttatattagagtaaattttggatatcgtattatttcgtttataagtgttgttgtttaaaagagattattttattttttaatagatggtaattgcgttgtagaatattattacgattagtcgttatttgcgagttttttcgttttttacgttatatttcgttttgggattgggtaagtttagtatttgtaagtttattagtagtagtggtaatagtagtggtggtattagtagtaatagtagtagtggtggtagtaatggtagtaatgatagtagtagtggtggtggtagtagtagtagtgatggtggtagtagtggtagtagtagtagtggtggtggtagtagtagtggtagtagtagtagtggtggtggtggtggtggtagtagtaatagtagtggtggtggtggtagtagtggtggtagtagtagtggtagtagtagtagtggtagtagtagtagtggtggtggtagtagtagtggtagtagtagtggtagtagtagtagtgggggggtggtagtagtagtagtagtagtagtagtagtagtattgttattattttgaggattgttttaaagttatttgttgggtttgttgttagttgttgattttcgttttgagtttatagtttgggtttggattttttttattagtagtttttgagggttttttatgttttattagtaatgtgtttttagagttttgatagttttttttttttgatcgtttttatttaggtattggttttgttatttttttatttttcgtgttgttattttttttaattaggttttttttattttttatttaagttttagtagtagttttttagttagtttttttattttagtgttatagtatttgttttaagaataattttgattatgttatttcgtttagaaattttaaaagtttttttgttatttattaaagaaattttaagttatagggttaggtatggttttatttgatttttttggatggatggtgttatttttttttaggttttggtatgtttatttggagtcgttatttttgtagtttgtttttttcgtatgttttttttttgttattagcgtggttttggtttagaaggtatttatagagttagttttggtagggttggggtttgtattagttgagtttaagttttggtggttggttgtttttaggatttttatttgttatttttgttatgtatagggatgtttttaggaaaaggtggaatggtggtttttggaatgatttgttagtatattgtttagttttttttcgattgttttggggattttgatgattttattttagtggagatttagttagtttatatatttttgatttttttgtaggttcggaggtcgtttttcgtgttgatatgtgagtgtgtatcgtagttttttatagatttagttaaggttggagagtttttataaggattgtttgttttttaggttttttttgtattagtatatagtttggtttttttgggtaggggtcgtgggttttgtagaggaaattgttagtagtttttgtagttatttatagtgttaagttatgattgttttgtttgtttttgggtttttttagtggaggttgatttatagtaggggatgaggttaatagtttagttaattttattataggttttgttggtttatgaatatttttgaggggatttgtgttatagtgggtaaggaagaagtgtttgtgtattttgaggagttttaataggtcgtcgttgttttcgtggttgtgggggtaggagtttttagtaaagttggttttagttgggtttttttagcgataagtttttatagttgggtataggttggaatttgggatcgtgattttttttatttttgttatagtttttaaggattatgttgggtggttttggttgagtatgaatttataatgggtattgatttttgttgttttagttaggagtgaatagagttttatggtattattgttatgtggttagtagtagtttgggtagagtttaagtgggtgtagggttaggatatgtttttatttattttttttgtatagggtgttgggttgggattagttgttttgatttttggttgtattttaggagaagtatgatagtagggtttattaagagtgatttgttgttttttttgtatatgtttttttgtggttatagtgttatcggtgttggattgtggttattgttttattgggggagttaagatgattagatttatttgtaaaaatgtgggttttagtgttggtaggttttgtattatgtttaaaataagttggttattattaagttttaaggtgagtgattataggttgttaattggaaaaattataagtttattaaaggaaataatttttagaggaatttattagagtatatttatgattggaaatatatagaacgtagagtgttgtaaattttttatgtaattgttataattcgaatgagaatggatgtataagggtttagtgttgtagttttggttatgttattaatatttgtattatgttgggtaagcggtattattttttttattttttaagttttggtttaaatgtgattgtatttatttatttagtttttttttattgtagtaaatgattgaatagtttagaggttataaattggttgttttttggttaaattttgttggtatttgtttggtatagtatttaatattttttgagttaatatttaaaaataaggagatttggttaggcgtagtggtttatatatgtaattttagtattttgggaggttgaggtaggtagattatttgaggttaggggtttgagattagtttggttaatatgatgaaatatcgtttttattaaaaataaaaaattagtcgggtgtggtggtatgtgtttgtagttttagttatttaggaggttgaggaaggagaattatttgaattcgggaggtggaggttgtagtgagtcgagatcgtattattatattttagtttgggcgatagagtgagattttattttaaaaaaaaaaaaaaaatggagattttatataaagttttatatttttagttttttgaaaaattggaagatatgaaggttagggttaggatttattgtgagtttgttggttagggttgggggtaggttttgtgtattttgttttgagtgtttagttttattagttttaagagtattttagtattgatattatttattagtatgtttatattatttattagtattgatattatttattagtattgatattatttattagtatgtttatattatttattagtattgatattatttattagtattgatattatttattagtatgtttatattatttattagtattgatattatttattagtattgatattatttattagtatgtttatattatttattagtattgatattatttattagtatgtttatattatttattagtattgatattatttattagtattgatattatttattagtatgtttatattatttattagtattgatattatttattagtatgtttatattatttattagtattgatattatttattagtatgtttatattattattttttttatagtaaagatatttatttgtatttagaaaataagggatatatttagaggatgatattttaagatgttttaagaaagatattttatttatttttgttattgattagggttttgtaggtatgggtttgtgtttttggtatgttaagtgattttttgtgtaggtattggggttgtagttttcgtgttttaggagtttgtagttaggggtgggttagggttggaggtagatatatatgttagtatttgtgatattgggtgttattgtaggaaaaggataatgtgttttgggagtttaggggagggtttatttagtttattttttgagtgagatttttttatacgtttgttattttgtgttttaattatttggtgatggtgttttttgtattttttgttagtagttagttttttatagatgttttaagatttattttttttaatttttagaattttatttggtatttggtgatggttgagtaaatgtttgttgaatgaataagttttagtttttttattattatgtgattggatgatttttaagtttttttatattgtaaaatggatgtttgaaggagagaagtttgtaatttgaatattggtttttataatgttttttatattgttgggtaatttgtttttttttaaggttattgtaatcgtcggttttgttgaataatttttttttggaattttgttttcggtgtttgagttggtttcgggatatgttatattagtggaggtaggtaattagatattggtatgtatttttttaattgtttgtatgtttgtatttgtttttgtttttatgatttaagtgtttagttttattttatattatagttttagtgatttttgggtagacgtatatttttgtattttgtagggtgatgttagatgttatttgattgttttatgagtatttttataaagtaaatgtagatagttttagtattatattataaatttgagttttgttagtttatatttttagtttgggagttatttttattaatgtttaagttgtttttaagattttcgtttggttttttagttttttttgggtttttttttttttaggtttttttattatttggtatttgattattgcggttattgtggttttgtttttatttttttgttttatttttagtttgtatagttagtaaggtttaatttcgttacgttttattttgaatttttgtagaagtttttagtggtttgtttttggttgtgggcgtttttttttttaattggttttttttgttgttttttttagttgattatatttgtttgttggtttttagaggtgtttatgagaaatggtgatattttttgtttttgttgtagtatattgttatttttttcgatttttggtttaggagtttgattttattttatgtgattgggtgtgggttgttatagatatgtttggttttttatattagtttgtcgagggaggtttttgatatttaggagtaaaaatcgtttggtttttgggggtggatttggtttgtgttatattattaggtagtgagatttagtagtttttatttttaaatttagttgtatattgtaattatttgagagatttggaaataatattaaggttttatttttgaggttttgagtttattagattgggttgtggtttgggtgtcggatttttaaagttttttagggaatgttggtgtgtagttaagttggagtttaattgttatagcgattttgttatgttgttaggaagggtttttttttattagttgttttttagttttaagtgtttagtaggttttgtagttttaggatgtggtttttttatttatgtttttgtttatttgatttttgatgagaaattagtttttgggattgagattgagttagtttaggggttttgttaggttttatttattgttgaggggtaggttgggtttataaggtttatatataggttaggttttttgtttttttggtgtagtttaggatttgttataggtttatcgaagttttaaggaattggagttgttttgttttggatattttttttattttatttttttgggatttttaagtaaaggaagagggtagtagtaggatttttaggggagtagtgagggagttggggaaggttttttttttggtattttttgcgtattttgtttattgattgtttgggggtttgtttgttttaaaatgtatttatagttttaaataagaaatatatttgtatgattaaaaatttaaaagagagattgggtgtagtggtttaggtttgtatttttagtattttgggaggttaaagtaagagaattgttgagtttgggagttaaagattagtttgggtaatatagtgatatattgtttgtatagataatttttaaagtaaaaaataaatttaaaagagttaggtgtagtggtttatatttataattttaatattttgggaggttaagataggaggattatttgaggttaggagtttgagtttatagtgaattgtgattgagttattgtattttagtttgggtaatagagtgaaattttgttttaaaaataaataaataaaaataaaatatttaaaagatgtaaataggtaaatagtgaaatgtttttttttattttagttttttagttatttagaggttatatttggttagttttttgaatgtttttttagagatagtttatgtttaaataagtaattgtatatgtttttatttttatttttttttttatatataaagttgtttattttatattttgttttttgttttgtgttttttatttaattttatattttagagattatttttatatgttttagtaattgtatagtattttattgtgtgaatggattataatttagtttagtagttttttgttgattgatttgaagatttttttttgatttttggttataaattatgtataaattatatatatattattttgtttaaggatgagtttatttataggatatagtttttgaagtagatttgttgatttagcgttttgtgtttttataattgtaaggtatgttgttaaaatttttattatgcggattgtattaatttatatttttaatagtagtatgtaagggtgtttgtttttttatatttttgttaatatagtatattataaaatttagaaattgtttatggacgttgtatataaaaatatatataaaaatagagagaataatgattatttatgtatttattatttatttttaataattattaatttttggttaattttattatatttatatttttttattttttttagatattttttattttgtttttttagattattttgaataaaattaagataaaatattattgtatttaatagaatgaaattagatttgtgttttttattatatataaaaattaatttattaataaaatggattaaagatttaaatataagatttgaaaatgtaaaattattagaagaaaatggtggaaatttgtatgatattggtttgggtaatgattttttgtatatgattttaaaagtattggtaataaaagtgaaaataggggttaggtgcggtggtttagtattttgggaggttgaggtgggaggattttttgagtttaggagtttgagattagtttgggtaatataaggagattttatttttataaaaaatttaaaaaattagtcgggtgtggtggtatgtatttgtggttttagttatttgggagttgaagtgggaggatcgtttgagtttaggtgttagaggttgtagtgagaaatgattatattattgtattttagtttgggtgatagagtaagattttgttttaaaaagtaaaataaataaatgaataaataaaaaaataaatatgaatagataaatgggattattttaaacgaaaaagtttttatatagtaaaggaaataagtaatagagtgaagagataatttgtgaaatgggagaaaatattattatatttgaggaggggttaattttaaaaatatataaggaatttaatgtaatagtaagaaaataatttgttttttttaatgggttaaagattaattagatattttttaaaagaagatatataaatggttaatgagtatatgaaaatatttttaatattattaattattagggaaatgtaaattaaaattatagtgagtttttatttgatattcgttagaatggttattattagaaagatgaaaggtaagtgttggcgaggatgtagagaaaagggaatttttgttcgttgttgatgggaatgtaaattattatagtcgttatggaaaataatatggagtttttttaaaaaattaaaaatggaattattatatgatttagtagttttattattaggtatatatataaatgaaatttggttggagtgtagtgatgtgattattgtttattgtattttttaatttttgggtttaaaagatattatttaaaagatattcgtatttttatgtttattgtgttatttataataggtaagttatggaattattttaagtgtttattgatagaggataaagaaaatgaggtatatgtatataatggaataatagttttgtaaaagaaggaaattttgtcgtttgcgataatatggataagtttggaggatattatgtgaagttaagtatagaaagataaatattgtatgattgtatttatatgttggattttaaataattgaatttataaaagtagagaatagaatggtgattattagggttgggggttgggggaattggggaaaaaatagaaaataaattattgtatttatgatagtttattttttgttttttgttagtatgagtggtaaaaagtcgtttttttggatggtttttattgatattttttttattatgaatgagggtatgtgttgttatttatttaagggttatttgtattttggtttttgtgaattttatttttatatttttttagtttgttttttgtttttttttggggtggagttagggtaaaatatttggttttaggagtaaggtgggaggtggtagggaggggaatagagagtgaagagtaaagaaaggggtgtgtgttcgagaggaggagggtgggaggcggggagggtggaagttttttaatgggaggtaacggaataattttttttttttttaggttttgttttttttaaagagtttaggaaaggtagagtagatttttattattatgtgcgataattgttagataaaggagttggtgattataggtgggtttgagtgtatttttaggggtaaggttggagaggttgttttagttttaggggttattgattatagtagtattagcggtagtttatttgttttttgtgtgtgttaggagcgtatattaagaatgttgtagtttttaggtgttagagtttcgttttaggtttattgttttggtttgattttggagattaagttagtgtggtttttaagatagtttaaggagttttttagtaagagatagttggaaatttggggtgaaattttttattgttttattttgaaatttattttgattttttttggggaattgttagtggtttatatataaatagttagagttatttttagatttttgtagggttagaagaggtattttaggaatcgtgataagatgtttttggtcgttttttttttttttttttttttttttttttttttttttttttttttttttttttttttttttttttttttttttttttttttttttattaattgagtgtttgttatatgttaggtttttaaaattatttttttttggtttttaaagatgtgagaatattaatttgtgggcggatattttttttttttttttagtgtgagtttgtaggaattatggttaaggttagttgtatgtggatggcggtatgggttttgtagtagttttggtttgattttagttttagtgagtttttattgattttatttattttattttggtaggaattgggtagttgattgttttggatttgatttatatttttggtgaaaaaagttagttagattttggagagtttatagatttaatagtttagtattttatacgatttgagtttgaaaattttcggtttacggttaggaagtagttgattattagaaatgttacgtgggtaatttttgtgtgtgttttaatatttaatttttttttttgtttatttggtttttagttttagtgagataggaggtttttttaagggtttggggaagattgggtatagaatggatatttaaatttaattgagggatttagattgatttagtttattatggaaattagtagttatttttggttatttaaatttaaattaattaatattaaattaagagtttatttttttagtggtattagttatatgtagttagtggttgttatattggatagtgtagatttgtaagatttttatttttttaggaagttatgttagatagtgttgttttaaattattttggattatttttagttagttttagttttttagagaggatatattatgtttgtgtaggggaagttatttaagttttaggggtagatagattatagtttgtgggttttattttttttgttatttattttttgattcgtttttgagtattattatgaaattaggataaattttagggagttttttaattagggttgttttggggattttagatattatataggattttgttatttttttttcgggatagttgtaagttttgttttttttatgttatggagttgttattgtttttgttggtagttagtaggtatatatttttttggatatagtttttttgggagtttataataggaaaggtagagggtaggaatggggttgatgtggtaaattttggaaatttatgtggtgagagatattgtagaagatttttttaatattagggggtgatgtatagttttttttattttaatgattggaatatgagtttttgatttattatgttttttgagttatggtaggtttaatttttagttgttatggttgggaagcgaggagtttttttatatagtttttgttttagattttttcgtttatttgttgttttttttttattggagggttttttattggaagggtgtgaaggttgatttggtttttttttgtttttaggtttttttttgtttttttttggagtagggtagggaggtatggggtggagggatttggttttagtagaattgggatatggttttggatgcgttgtttttataggtacgtggagttggttttttattggtagattatgaagtttaatttgtagttttttatgtttggagaaatttttagtatggatagtattaagtgttatttcgataaggagattgttttttttattatgtttagaaagggggttttaagtttttatatagattacgagtttattttgagtttttttttttatgaggtttagatggtgttattttagtagttatatatggttggattatgtatttagattttttatttgtgttttttaattatattgaagttatagttgggtttatcgaggtgttattttgtttaggttagtatttggttgagttgggttggagtatatatttggtgtgtagggtgaagtagtttattttgtttggttttgattttagatttattttatttgtagtaagatttttggttggtttttttcgttttgggtgttttttatatgtttattatggtaaaaaatattattatttttatttatattatagtattttttagagagagtgaggtgtagggattcgagggttaggttagtatagcgttggttttagtatggagggaagttttgtgggttacggtaggttagaagggaattcgagttgggtatgaaaaggatgtttcggggttattgttagtgggtttggggttgagatgagtgattttgtttttggttttagtatttagttgtttcgttgtttattttgggagggtgtggtgtttcggatacgttgaggggttttgttagtattaggaaggtttttgttttttgtatttaggtttagttgagataggtttttgagttttggtttatgttttggtagtaattttattttttttaaggaggggaggaggtagtagggaagtaattttgggtttttagaaggtttttttgatggttaggttaaggggaggaagaatttttgttatgttttagttttttttaggataatttgttggaacgtagtggtgtttttagggtattgtgtttgttttgtagttgagggatttttatagtgtgttttagatggtgttagaggaagttttagagtttgtaaggtgagagaaattgggttttggatgagaagtgggtagttgggtttttttttattttgggggtttttttggggaaggtattaggtgagggggagtgggtagtttggttttcgtaggttttggggagtgagagtattttttttgttttgttttggtaatttagttttgtaatgggttgagtatattaagttcgttaaatttattatgaggttattttaggaattttggagttgtgttttaggtttattgttgtttttggggagttaaattggggggttttcggtggtggtgagtgtggaggaaaagttttgtttttatggtgtaaatttttaggttggggttttaggtagtttagtgtagagattttaggttggagggttgtagatggtttttggaggtagtagggtaatgtttcgttttagtttttatgttaaattattgttatagttatcggtgtttattattttttaggtattggttaatgtttttgatttagggggtttaggagttgtgggttaggtagtgtttttttttttataaggttaaacgtgggatagaggtagggatattttaggatgtgtttttaggtgtgtcggtttttagttaacggtgggtttgtgtttagtttagaagcggagagtttggggtattttttttattttgtggatgatgtgattgttttggaaatcgaggtgaaaggtttagtagaatttttttaggtttttttagagttatatgtttttattattttaggggagaattatattgggataaatgtgaagaaggtttttaaggtaggttattgttttttttttgtttaggttggtcgaggtagtgttgatatgagtgtaagtgtagggaggatatagtaggaggggtagatggtagtagttattgtatggaggttgaggttatttttagggttttgaatttaatttgatttgtatagatgtataggttaggtatggttgtttttttttattagttttttagaattttttgaaagttagggttatggaatttattttcgtttttggtagagtatgttagttataggtattgtagtgtggagggagggtgtttttgggttgggaggtttatggttttgggtggttaggaattagtcgggaagtgttatatggattttttacgagtttataattttatagttttttagtaggtatagaattgatatgaaggggtagtaaatgggtagtttggtttcgggtgttttttagatgtggaataatagtaagttatttattagatatttgtgggggaagattagcgattgttatattattgaagtggagttcggtataggggttataggtattttggggattgtaggaggggttgtgatttgtttggggttggtttaggaagaaatttttagagttaaaggggtttatgtagggtttttggtgttttgtgattgttttggttgaggtttgggatgtgagggagatgagaagtttgtgtaagttagatgtttgggtttaattataggaggaaattgtttttgttttttttttttatttttttttttttttttttttttagagtttagtgaggtcggggattttgagttgaattttattgggggtgtttttggttttataagttaggatttgttgtgtgaaatcgaagattcgttttcgttagtggtgttatatattgaggttgtttttaaggtgttgtaggtggagttgggtagtggggtgggtttagagaggtggtagggttgggatattgagttatttttaggtggtttagtgataggttttttgggtgttttaggggtttgtttttattattaacgttttagttttttagtttggtttgtttcgtttggggtagaaagttataaattttatttagattcggaacgttagttagtttttagttatatggcgtatgaaggagagtttagtttttttttaggaaaggtttgaggatgtaagttaggtattgttggtttttttggtgtttttataatgagttcgtttagtttgttttggtgaaatttgttttggtgtgtttagattagagtttcgaggttggtggaggaaaagtttgtttggtgatttcggtttggcggtgttttttgttttttttatcgttgaggtagtttagtttttttttatagttaaatgtaattttttattagtattttttgtgttttttattattatcggatttagaaatagggcgtgggttttttttttagagtcgtttgaggtaggaagagatgggtagttaggttgggtaggaagtttttaaggttgttgttgttttagtcgtatttttattttttttttattttttggaaggtttagatttttttagggatttgttattagatggtatttggttataggttggtagtttaaatttaaggttttaaaaagaaaatttaagatttatttcgatttaaatggtattttttattataaaagtaggaaaaaaagtagttaagtattattataattatatttaaatgtagtgggcgatttggaataagataaagttatataaattattagttattcgtaaaatgttcgtagtgagtcgtatattatcgtttttttattacggtatggttgtagttttttggtggattgtatatgtgagattttggttatgtttggtgattatattttttttttggttgttttttatcgaggtttttattttgtttgtttatttgtttttcgagttagaatatcgtatatttttttttttgtattaaggagtttagggaagataatttaagttatgtatatattttattttgttagtgtgtattttttttttgtaggaaagtgggtttttttttttattttagggaggtttcgtttttttatttgatggtttatagttgggtattttgaaatttagaagttatgatagtgtgtattaaattgttaacgttattgttaagtatttgttatataggtttggagtttaatatttttttttttagggtttatttattttttattatggattttgaaattataaaagattaaggttggcgtttgggttgggatggggttgggggtagggtggtattagtatttttagtgtttatattatgtttagttaagaattttttttttaaatgaaattttatgtaaaagtttagaatatagaataaattgtgattgttttagttatttagagatttttttgttaggtatttttgttttattttgtttttttttatattttagttttttgtatttttagggattttttgggattttttagagtatagttagaagtttatagattttagttagtttttttatttgatagaggagagattggaaggggtagggtttttttaaggttatacggttgatgggtagcggtattatatttgattttttttgtttagtttttagtttgtggtgtttttttattgtgaagaataattatgttttataatggaaataattgttaatgttatagtattgtaagataattttttttttatagttttttgtattttatttttttgagtttttaaaaataatgttgggatttggggtttgttagatggttttagattaggggacgtagagttgttgaaatttaattttagattatagttatttttagagttttaagggagatgtatatgagtaataaagataaaataaagtaaagtggttttttatagggataagtgtttttttttagttagggtaggaagaatggaatgtaaagagttttttttagatggggatatttttttttttgttttttttttttttttttttttttgtgtgtgtgtttggtatgggaggaggagtagatcgggggcggggtgggggtgggggcgggtaaatgaggttgagtttgtagtaggggatagaaggaaggggtgggggaaagattacgtgggtgtaaaggagaaatttggttataatagattttttttttttttaatttagtgatttggtggttttttttagttgaagttgtttagagggttatttttttagtttggtttattagtttttttttggttttttagttttttttattttttttggagtattttttttcgttttttattttttagatttgggttagggtatggggttttttgatttatgtatttttttatttggagatttagtttttatgtttttaattttgagatttttgtggttgtggttttttatttgtttgtttgtttttggattttagatggtttttggaagagttggggtagtttaggagtgattttggttaggtatggttagtttttagtttttttgtaattttaagtgtttttagtgtttatttttttgagtgtttttcggggtaggtgttttttttcgatattgagttttcgagtggttagttttattttttgggggagtgtagggtggatattattttggaggttttgtattgttagtatttggagatcgttttggagttggaggtggaaaatggtgtttggaggtaagggtgtcgtgggaagagttattataataaattatgtatattcgtgatgtatttatttatattatatatttatttagagatgttttggatttaaaattattgaatttagaaaattagtattttataaaatttgtaaattatagaaaagaaatttaaaatgacgtataatttattttttagggatgatttattgataatattatgtatatatttttttagggtgtgtgtattaaagagatgtaaattagtataattattttcgaaattacgttagtattagttagtgtttgtttttttgagtatatttttagggaaatttttatatatgtatagtgggagatgtgtgtttatgttggaatgtttagattggattgtttttataggaaaaattagaaaaaattattgtttgttaataggagaatggatatttaaaaagtgtgatatatttaaataagtatatattattgtattttgggaggaatatgttagaggttttaaaggtattggtagtattttttttttttttttttatttttttttcgtttttttatttttttttttttttttttttttagtggaaaattttttatatatataaaaatagaaagaatagtataataaatttttatatatttttttttttttttaataattgttaatttattgtaagtattgttttatttatattttttatttttttttttttatttttttttaaattatttttaaataaaatatttatttttttgttgggtatggtggtttacgtttgtaattttagtattttgggaggtcgaggtaggtaaattacgaggttaggagttcgagattagtttggtaatatggtgaaatttcgtttttattaaaaatataaaaattagttaggtatggtggtgttcgtttgtagttttagttatttaggaggttgaggtagaagaattatttgaattttggaggtagaggttgtagtgaatgaatatatatatatatttatttttttaagttggttggtgataatattttgtttttaaagttgtgtggaggtagtatatagatgttgttttattattcgttaaattatatatatgtttaaattgtatatatgttttatatttatttttgtatatatttggtgttttattgtaaaaatatttaaatgtttatttaaatttttgtggatgtttttgaattattttttaaaaagattgtgttattttatatttttgtttatagtgtgtgagattagttattattttatatttttattatgataaatgttgttggattttgtatatttgattatttgatagttgtttaaatgtttttttttgtgataataaatataggtttaggtatgagtttttgtattggttttttagggtaatttgcgggtattagatgtgaaggttaagtttgtttgtagtttaggggaagggttttttattaagtttgtgtttattttttttttttttttgtttttgtttttttttttgaaaggattttgtattattagaatgtttatagtagtaggtgatggaaatatagatattattaatttaggtaaaaaagaggaagtattggtttacgtaattgggtatttttattttgttgaatttaagggtttaatatttttttttttgtttggttttttgttttttttttttttttatttttttttttttttttttatttttattttagttttaatttatttattgttttttttttgtgggttttttttttttttattgataagggtttttcgtattttgttttggggagaggttatttagagttttaggtttatatatttttattttaataatttttgagagttaatttggttttttgtagagataggttttgattgtttttgtttttgtgtgggttatgtattcgtttttttttttgttgggtgatagggaggatttgtttttagaagaggtaattatgtttcgaaattttaagttttgttgtttttgcgtttttttttttttatagtaatttgttatagttttattaatgtaatagttttttagatttttttaagaaaatgaatttttgtttttttagatgttggagtttttttttattttttgagtttttttttgtttttagtaatttttgtttgtttagttttgtttttgaatggaggaggaagttgatttgtataaggagttggtgttgtaagttttttttgagtaaaagggggtagatgtggagagtatttttattttaagggatgaagtatatgtgagttattatttttagagtatatagttagtttgaatttattagagaaagggatttttggggaaaatagttttaaataaatagtggagaaaatttatattgggtagttatataaattaattcgtgtttttatttataaataagaatgaaggaatagtatttttttggttgttttttttttatgatagttgagaggtttagtgttattgtaggttttgttttggtttttttttagcgtgatatttatagtttttagtgggggtaaatattgtggtagtttagttttttttttaatttttaattttaatttttattatttgtataaatttatggggtatatgtgtaattgtgttatgtgcgtagattatatagtggttaagttagggttttagggtatttattatttaaatagtatatattgtatttatgaattaattttttattatttattttttttttatgtttttattttttcgagttttcgttgtttattattttaatttttatgtttatatgtatacgtttttagtatttatttgagtgagattatgtgatatttgatttttgtgtttggggtagtttatttttttatgtgttgttttgagttttggggttggagttttgatttggttaagttaatggatttttagtagtgttttgtttagttttttcgttttttgatgtttttattttattattaaggattgtattgtacgtaatttgtgtagggattttaagtagtagttttgtttttttttgttttattagttaatttgattatattattttttttttttatttttttttttttgtttgtataatattttatttgttttattattttttattttaaaatttttataaatagggtatttgttagatattatatttttttgtatttataatttgtttgtttggtataaagttagttttttgtttgtgttagttttgaatgtgttttttttattaagtttaattattttttagtttaattattttgatttaaagtgagatacgtacgatttttttttttatttgaagatttagaggttattgtagggttattagttggtttaattttaatattgttgtgttttaaggaatagggaggtttgaggagagggagagagacggaaatgattagtaagtagagtagttaaaatgtatatagtatttattagttgagtttattatcgtatatgattgttgtttatggtattttaaaataattatagtagtaatattaaagattattaattataggttattataatagttatagtaaaaaagtttgtaagatatgatatagagatatgaaatgaggatatgtaattggaaaaatgatattgataggtttgtttaatgtagcgttgttataaattttcgatttgtaaaaattatagtatttgtgaagtataataaagtagagtataataatatgaggtatgtttgtaattgaattttttatataggttaatttagattttttttttggttaggtatagtggtttatgattgtaattttagtattttgggaggttgaggtggacggattatttaaggttaggagtacgagattaggttagttaatatggtgaaattttatttttattaaaaatataaaaattagtcgggtgtggtggtgtatatttgtaattttagttattcgggaggttgaggtatgagaatagtttgaacgtgggaggtagaggttgtagtgagtcgagattgtgttattgtattttagtttgggtaatagagtaagattttgtatgttttattttatttttttaaaaaaagattttttttttttttttagttttggtagtttgtattattttaggaatttaggaatttgtttattttatttgtgatgtaatttgttggtatatagttgttagtggtattttttgataattatttttatttttgtatgattagtagtgatgtttttatttttatttttgatttttttaatttgaatttttagtaaattttttttggttagtttagtttagttaaaggtttattaatgttggtgatatttttaaagaattagtttttgtttttgttgattttttgtaatgtttttttattttttattttatttatttttgttttttagtttttattatttttgtttttttatttgttttgggtttagtttgtttttttttttttagttttttaaggtaaaagttgaggtttttgatttgtaattttttttttttgtttgtttaaagaaaattgtatttataaatataaatttttttttaattatttttttagttgtattttataattttttatatattatgtttttatttttattgatataaaagtattttttaattttttttgtggttttttatttgatttgtttatgaatgtgttatttaatttgtatatattttgttttataaatttttttttgttgttgatttttaatttgattttattgttgttggagaatttattttatataattatagtcgtttaaaatttattgagatttgttttatgggttattttggagaatattttttgtgtattcgagaaaaataatgtattttgttgttattgtgtagagtgttgtttgttttgtttggtttatagtgttgtttaaattttttattttaatgtttattttttggttagttgtttttttattattaaaaatgggttgttgaagtttttaattattattgttgaattgttgattttttttttaattttgttagtttttgttttatgtattttgtggtgttgttgttagatatatatatgtttataattgttatatttttttaatttatttttttataattataaaatattttttattgtttttaataattatttttgttttaaagtttattttatttaatatttatatattttttggagtttttttttgggtattgtttgtatgatatatatttttttattttttttttttgaaattatttgtgtttttgaatttaaagtgttttttgtaaatagtatatatttggattatttttttaaaatttattttgttaatttttgttttttgattggattgtttaatttttttatatttaatgtaaatattgataaagtagaattttatttttcgttttgttatttgttttttgtatgtattttgtgttttttgtattttttgtgttttttgtatttttttattattgtttttttttttgttagataggtagtttttagtatgttattttaatttttatgttttttttattttttaaaaagttatttttttattggttgtttagggttttatagtatattttaattttaaaatagtttggtttagattaatattaatttaattttagtagtttgaaatgttattgtaatatagtttagttttatttttttttttttttttgtattattattgttatataaattatatatttatatattataggtttattaagatagttttatagttattggtttgtatagttgttttttaaattagatagaaaagtaagtaaaaatatatttattttgtttttgtatttatatatgaatttattttgatatggttatattagttaaggtttaatatttattttttaataatttattaagatatttattataaagaattaggttatataattatagggattagttaggtaagtttaaaatttgtagggtaggtttttaggaagggtatgttggtatttttggggataagatgaagatgttataaatatatggaatttttttgtttgggtaagtttatttttgtttttaagattttttagtggttaggtatggtagtttatttttgtaattttagtattttgggaggttaaggtgggaggattatttgaggttaggagtttgagattaatttggttaatatattgaaattttatttttattaaaaatataaaaatttgtttggtatggtggtatatgtttgtagttttagttattcgggaggttgaggtagtagaattttttgaatttaggaggtagaggttgtagtgagttaagatcgtattattgtattttagtttgggtgatagagtgagattttattttaaaaaaaaaaaaaaaaaaaaaaaagattttttaattaattgaattaggtttatttagattatttaggataattttttttatttaaatttaattgattatgaatattaattatatttataaaatatttttagtcgtttagatatgtaaagagtttgtttattaagtttttgtttttataataaggaaagattgaataaattgaaataatgattttttttagatttattagagagttgaggttgtaggataagtggttattttaaaagttggagatataggtaaatattgagaatatagattagtttatttgaagtagaagaatatttaaatggtagttttaataaatttttggtggttaagtgtaggttagtttaagagtttaaaaattttgggggtttagtaggtttttatggtgaaaattggaaaaaaaatttttttttgtttagttagggtgggatggggaggggaagtaattattttgaaatacgtttagaggaaaagtgaaataagttattttgaaataagtttagagtgtttttgtaataattttttttatattcgagatttttattttttgagtaattataaatggtattatattttaaatttcgatttttatatgtttgttgttagtatataaaaatgtgatttatttttgtatattgattttatattttgaaattttgtcgaatttatttattaattttagagtttttaaaaatatagatattttgggattttttatatagattgtatgttatttagaaatagggatagttttatttttttttttttaattagtatgttttttgttttttcgtgttttagttatttttttgtgtatgttgaggtatagaagttttatgtgtatttatagagtagttaggtggaggttagaaatttttatttgggtgtgtttacgaagataattattatatttattaatggtacgtttttgtttatttagttttattggggtaaggtgagtgagtttatagtattaggtagtagtttgtagtttttagttatagaggtttatatagaggggggtattgttttttaaatatttttatagaatagagatatttagttttttttttatagtttgttttttgttcgtagtgtgtataaaagttttttaaaggagtagtatatttggtttagtttttttttgttttgtttttagggaattttagttttttgattaagaaggagtttttggtgaatatagttagagttttttagttaatatagtttatgattggtttaggtagttgttggagtttagttgtggtgttgtttttgttcgtggttgattggggagttttgagtgttatgggatataaggttatatttatgtgtattagaagtatttgttttttgttttttatttttcggggtttttaagggtagttttttttgtttagataattttttaataagtggtaaagtttatttagggttggggaggagaggagaagggattcgtggtttatttttagaagtgagtatttagttttgtcggttttgttgtgggttttagtttgttagtttttagtattgtatgtagtagtgttgagtattttttggatattggtttattttgggagtttagtaagtgataataggtttatttatgtgtttgttagtttttcggatattaagtagaattttgtatggtgatagttttttttaaatatggtttgttgggtttaagtgaggagtgttagtttaagttggagttgattgtttatatttaggtgagtaaggtaatgtagggtttgagtgatcgggaaggtattttgttaattatacgtatttgtgttattagggaggttttagtttaggttatattgttggtttttgtgggtggggaagagattttttgtatttgggtttggggtttttatttttgttgggtttgttttttagggatatatggttagagagtttggagtaggtttggggatgtgttttgagatttattggttatgtttggtttttggtatgagtttttgttttttttaggttattttttgtggtcgtaggtgggtttagttttttgatttgtttagagatttagagtagagttgttgtttatagtaggtattgtgttaggtattatttagggaggttaattggtatttaggtttttcgttggaggttattagggtggaatatgtttagttatagggtcgtttttagttgtttttttgtggtttttgtgggaaaagaaattttttttttatagagatttgtaaatttaggttttagttttttttggtaaatatggggatggtcggtttgagttttgggacgatagataggtaggtttaggtgtggaatagattttgtttagggagggtttgatttttagggtagtagttttattagaggaagtgcgtagtttttttagaggttttttttgaggggtttttttttacgtgggtatgtttagatatttggggtagatttagatagttataaggtttgaggaaagggttaggttttttggggttgagggcgggtcgattggttgggtttattggagggattggagatgagtttggttagaggttaaggttttatagtaattttttgtgttgcggaagattatttgggtttatttttagaggttttaggtttggtttgatttttggatgggtttttttataggaagagttgatttatttggtttttttttgttacgtgttaggtatgaagaagttattggttttaggtatttttgggaagttttagggattgtaagtggttattattatttttaaggagagttttgattgtaggtgagtttagggttggtggtttgggggtggtagtggattgaggaatgaggtagtcgcgtttaggattagtacggtattgtggtattagtttgcgtttatttgatttttgtaggtaggaaaacgttatagtgttattgcggttatttattatttttgtggggatagttttttttattttatttttgttttttgtgtggtttttttatatatatttggaggcgtggtgttttggtaggtaggagatggtaggggatagggttgtaggtattttgggtttgtttatatgaggtttagtaattgggagttatgttagtatgtcgttggttagggacggtttgtgtagagtttgaggttttttttagtattatgggtgggtaggaaaggtgggtttgtggttggtagtttaatgaaataggagtttgaggatgaagtttggtgtttgggtagtttttgtatgtttatttaagatggttttttgggtagggttaagggtggtgtgttatatagtattaatgggtataggatagtgtttttagtatagagtagtggttaggttatttaaaggagtttcgtttggattttggtttagcggtgttattgaggattcgtgtgattcgttagtttatttttattaatcgttttttaatacggattcgttttttttttaagtttgagtatttcgggagtttttaaaatagtttgagtaaaaagattagtttgtaagttttgttttttttattttttagggtagatgaagttggatggggtgtattttgttgagtttttgtgtggtttaggtggttagtggttggtcggtgtgagagatgggagtgtgtgtttttataggtagatatggggataggtagagaggaaatggtttttgttgtttatttttcgggttttgagtgggcgtgtgggagaggttgggattgcggttttttttttttagtttggtttgttggagtggaggtttttgatggattaggtagatgggtttgtagtgagggagaggttattgtagatagaaggaattgtgtaggttaaagggtgggaggaatagtttaggagtagggagtttttagggattattgatagcgtgtttgggttgatatgtggagagtgagatggggtgttttatagattagatagtgattagtaaagttattatgtgtaaggatagaggtaagatttagagtgttgtttatatagatatatatatatatatatacgtatatatatatatatatgtatatatatatatatatatatatgtatatatatatatatatatgtatatatatatatatatatatatgtatagatataaatatatatatatatatatatgtatatatatatatatatgtatatatatatatatataaatatatatatatatgtatatatatatatgtttatatatatatatatttatatatatatatatatataggtgtgttagaattagttagtattggtttaggagaattgattgttaaatatttaggaattttgtaaatttttaatttgaaattaaatattataatttaggattttttttttttggaatttttattgtgtggatattttattatttaatttagtgaagtaagagggtttaatttagaaattacggttatgggtggaaggcgatttatgaatagtttataaggtattaattttttattgtggaaagttagtgtgtatttaatgttggatagatgttagtaggaaaaattggaaatgggtttgttgtagaattttgggttagagatggggagtttgggttgggtttgtgtttaggagtaattatggtatagagtttgtgggtagggagttttgttttagagttcgtttgggtttttggggaggtaatttttgtagttggcgggtggttcgtagttggggatgtttgaatggtaggggtatagtgggagtaaagattagagaaggaggtaaaggaaagaattgattagtttttttttgggaagagtaggtagggttatttttttttgttgggtatttggtagaatgttggttgttttagaatttggtttaggttttgggataggtttgtttgatttgatattatttttgtgtttttatttgtaaagttttaatatgttttttgttttgttaaagatagtgcggatgtaagagtatttggttaagcgagagtagttgggtaagcgttattagggtggggtttcggggtttaggttacggttagagttatagttttttgtggatgtgggttggtagttgttagggagcgggattaggattagagattgtttttagatggttaaggcgttttatttgataatgtttttttttgttgaggttattttttttttagggtataggtttatgtatagggtttggattttatttgggatgggagtggtttatgagggagggtttttatggggatttagttttttagggagtagagaggttgattacgtaggattttgagtagtttgtttttggattttaggtttttaggaggagggtatatgtagtttgattaaggagaggttggagggtggtttatcggggatagtgttttgtttatatacgagggtttggattttatttttaattttaggttcgtgaattttttatagtcgcggtttttttttagattttatggagagtatgttattttacgggaaaggagttgttttttttttttattttttttagggtatgttggggttttattagtagttgtgtattgatattataggttgtgttaatatgtggggcgagtattgggataattttatttgtacggtaagggtatataagagggtagtggtttggggggtggagagtttgtttagttttcgtttttagttttttttttttttaatatttggtttttagatttttaaattttattaggttgaaacgcgatgtttatcgagtttgggatgggtattcgtgtttgaggtagtttttggggttttggttgaggtattttaggtaggaggggtttttataagtagtagaattttttatatttttttttaggagatgtagggttggggttatatcgaggagggaagaggagatagtaggttgttgtttgggttaggatttaagatttggagtagggagtgtggagtggagggatagtagtagttttttagagttaggtttttgtttcgtttttggtggggtttatttaggggtttatttaattgttttagtatttagtataaatggagtatttattgtgtgtgggtttttgtgtgggtcgttgtagtgtggaggatatagggatgaataaggtaattagtaaggtatttttagtttagtttggagggatgaaatttgtatacgttattttatcgttaagttgttaaatagaagatttttatgaattatttagtaaattgaatagattaattatagtagatatttgttttaaattgtgtgtgttttgtatgataaagaattgattatgttaatataaaaagggattttaagtaataggaagttggggaagagtattttaagtgggtaaggtttgaataaataattttaagaaagataaatatagatagacggttaataaatatattaaaatttgttattattattgataattaaagaaatgtaaaataaaagagttataaaatattggttttgatatattagcgaggtttaaaagttgttggtgaagatataggggaaagggtgttttgagtttttttttttacgtttgttagtagaggagtggatatagatattgggttatatttttaagggaattttgtatagtttgttatatgatgttgtaaattttttattagtaaaaattaattttatattgttcgttgggtgtagtggtttatgtttgtaattttagtatttagggaggttgaggtgggtggatgttttgagtttaggagtttgagagtagtttgggtaatatggtaaaattttttttttataaaaaatataaaaattagttgggcgtgatggtatatgtttttggttttagttatttaggaggttgaggtgggaggattatttgtgtttaggagttagaggttgtagttagtcgagattatgttattgtattttagtttgagcgatggagtaagattttgttttaataataataataataataataattttatattgttaaaagaaaagattattaaaggtatgtgtagtatgttttttatttatatttgggtttttataaaagaagtgtagatatttgtatattgaaatgttaatagtaagttatgttgtagaggtaggattggaggtgattattatatttttatattttttaaaaataagatttattatttttgattagtagagaaaagtaataaagttttttttatttaaaagatagaaatttgattaaagggattattagaggtcgaagagttttaggtttgttaggtgtagtggtttatatttgtagatttaatattttaggaggttgaggtaggaagattgtttgaggttagtagtttgagattagtttgagtaatatagtaagattttgtgtttattaaaaaaaaaaaaaaaaaaaaaagtttttaggttgggagttttgtgtaggttgtttggttgggagggagagtggagatggcgggaagtgggagagaagatagagtggtatatagtgaggttgggattaaattgtggggtttttgggttggttggataagtggaggttttgtttagaggggatgtggtcgtaatcggtgataggagtgataaagggttggggtgtgtttgtaggtgggagatttgttgtcggaagttattttagtgtatatggtagcggtgggttgttttattagttttttgaggattattttttatattattgattaggtttagaaggaattagttatgaggtgttttatgtttagtttgagtttttgttttttggtagtttttgaaatttttcggttttcgggttgggttgtttacgttggtttgttattttttagttggtttagggttattggtgttatttataagaaggttttaggttagggtttttttgggggaaggtggttttaggggacgtggttattatttggatatttttgagggattttgtggggtagaagtggcgagtagttagtgtggttcgaggttagtattagttttggggtttttggtatagttgaattggaattagtatagtttgtttagggtaggtgggtgggttgttagggtatagggtagttttagagtttagtttatttggtgtcgtttggggaaggtattagttttaggttttattaattttcgagtgaggttagattattgtggtatttttttttgtttgagtttttagttttagtttttttttttatttgtaaggtgtacgttggttgtggttgtattgagtttagtttgtttttttttaggttcggtatttaggttttcggaggagatatagttattcgaatttttcgtttgaataattttagtttttgtggtaagatatgtatgagagaagttagtgtttttgttataggttgtgttttgtggtgagttaggttgggagggaaggtgggagggaagtcgatggtttatgaataggatttaggtgtttagggggtttgtggttacggaagtgtggatgggtttatagatgttttgtttttattagggttgttgtttggaggaatagataataagaggggattttttttttatttttttagtcggtaggatttgatttgtttgagagttgttggggatatagcggggataggatagtagggtttttgtcgaggggttttttttttgatgggtgggatagatgtgattgtggattgtagtgtgtggagtgtgtggtatataattgaagggaaggtcggagtgttgggggaacgtgttgaagggttaggtttttttgtggaggggaggtagagtgtaggttgagtttaagaggaagggtaagtcgatgtgggttaggggagtatgtgggggtaaagagtgttttgggtttgagaaagggttaggagaggaagttggtgatattgaagagggggttttggttatgtttgtttttgaggagagttgcgagtaggattgaaggtaggaggggaggggaagatgggttcgatgtaggtagatgtttaggtttgggataggattttggggattttttagtttgggggtttttgggagatgaggtggggttatcggttgggtgtgggaaggtagatggaggtgttagaggagggtagggatagtttgatattgttatggtgtaggttggagagagagtaatggggagttttagtttaggttggggatagattgatgggggtggtaatttgtttagttgggggattttttttagtggtatttagagggacggtatagtttagtttttttagggttaggtgttgttaggtgggtgtaaagggagatacgaggatgttggtaagatagaggtggatatggcggtttttaaagattagtttgtttggggaaggacgtgaaagttgatataggttgatggatagatggggagaaggaagggtatgtgggggttagagagtttagtttgtttataaataggtcggaaggagaagtagttgtgggagagagtagagtatttgtatttaggtatttggatatggagatttggttttgtgattatgaggattttaggtgatagagttaaacggtataagtttgtaaagtttttttaaaattttaaatgagaattgtttggaagtggtattagagaggtagagaggtattttttttatttgggtatgggagaataggttatttttgtttgggggtatgaggaggagggggtttcggggggttgtttgttttttttttattttttattttgttttatatatttgttttagatattcgtttggattgggagatttatgttttagaagataaggaagatcggttggtggagttgttggtgttttatgggttatttttttcgttgcgggattaagtcgggaatgagtttgtgtgttttgatatttttgagggtggttgttttttttggtttttaggtttttttagtttatcggaatttagttatgaaattgatttattagtgagtaggggtggaggggcggggtaggttggttattgagggttattgaggtgtggttagtaggttagttgaattttagtgattgcgtgaattttagtgattttttggtgataggttgagggtagttttagtgttagtaatagggtggtatagaagtttattttagttattttgtaggtatatgagggggtgtttttcggttatttgtattgtattagttttaagtaggtggtgagttggggtatgggttgggagttgtttgtattggtcggttagtgggtatgggatagtgttaaggttgttgtgtttatgttaggtggtttttgttgggggtagtagtattatttatattttttttatttttatggtgtttagttttgagattttgtataaggtggagtgtattggttacgttttgggttttatgagtttggatagtaaggtgagttttttcggtttggggtgggggtcgtagttattgtttttttttgggtagtatgttgtttatttagtttagggattagttgtgattagatttgggtttagtaggtggaaagggagattttagggaagaggtatcgtttgtaggattttgcggtgggatttttgaaattggatttgtatagttacgtgaggtttgtatagtgagttagttggggtgttttatttttttttatttttatggggtgtatttttattaggtattggtggagttaggtagggtttttagagtaaaaggacgggtatgggtggagaagttagtagaggagtttagggaaaggttggttcgaggttggatgagtagagtgggggtagttagaaggttttaggcgttcggtttgttttaataatgtttattgttgggtaggttaagtgtggagttggattacggcggtagtatggaattttagtgttaggttagtgattttattttcgagtagttttgttttggggtgagtgtgttgttattttttggttttgttagtttatttggattttagatgtttttgtgtgtttttgtgggatttaggttttatagtttgagtttaaatttttttttttagtttttttagttttattttagagttatggggttgaagagagagataagatgtattttttgttttttatttttgtggttgtttaggtgttgagtgagttggtgattatttattatttgaagttgattaatattatagagattttatattattttcggtttatggtttttaggttttttttcgttttttaagatggggcgagttaggattatagagtttttggttttggttagaagtaggagtgtgaggaggagatagttttagcggataagtagttggtgttttaagtataggagaatatgttggttagtgggggagtttgtagtttttgtttcgatggtatatttttatatgtgtatagatagtatttttgtacgttatttttaggtgtttgtatttagacgtaaattgtatgtttgattttgttatattttgtatgaatattcgggggtgtatttttattagagatattatatttagtatttttgtataagtggtttatatgggtatggttatattagacgttgtgtttatatatatgtatgtacgtgttttataaatgtttttagattttttttttttttttagtttttattgttgagatgttggtggaggttgatgtatttttgtgagtattttttttttttatatatatagatttcgtttttttgtgtaagtttagggtttgtgttttagtttaggtgagtttatggggttgttataattgtaagatattttaggttttaacgtaaaatttttttttttgatttatttttagtgataattggattttggatttttagagttggttaggtaggggaaggttttgggaatgttaggattttattggaaattattaattttttttggtttttgaggtaattggaatgaggttgagtgtgcgtatatttatatttgtatagtgggtttttagggtgtgtagaggtaggttgagggtagatagcgtcgttttgttttttatttttttttttgttttagaggttttttttttttttttcggagggtttttttttatgttgtgtttttttgagttttgttaggttttagttttattttgtatatttttgggttgttttatttatttttagagttttagtgaatagttatattatttttatttaatgtatattttattgtgtagcgagggtttgttgtgtattagatgttgtgttaggtgatggtatttttcgaggattttattatggaggttagggatatatacggatttgtagaagatagaatggtatttttgatttattttgcgtttgttttttttaacgagttaaatggatgggaaggtttagagtatagttagaggttttattttattagagtttttaaggagatacggcggttagttattaggtatttaaaagtttttggtagttttggggaagtttaaaagttttagaaaaaggatattatataattaatggtgttgtattttattttttatgcgttaataatgtttaggtttttggtttttggttagaattattttttaggttttagagttaaatttaatttgtttaaagtgaattttttattttttttttattttgttttgttttatatttgtgttttttttttgtggtggtattttgttttagtaaatattaattttagtttttttgtttatgtttagagttttggtattttttgttttagatttatttttgattaagttattaagttttgcggatgtttttttttaaagtttttttaatattatttttttttttttatttttatatttatattttggtttaggatagtagtttttaagtttggtaatagattagtggtttttttttttttagattgggttttgttgtgttatttaggtcggagtgtagtggcgtgattatggtttattgaagtttcgattgtttggggggtttaagtaatttttttatttcggttttttaagtagttgggattataggtgtatgttattatgtttagttattatttgtagagataaggttttattatattgtttaggttggttttgaatttttgggtttaagcgatttttttaatttagttttttaaagtgttgggattatagatgtaagttattgtttttagtaaattagtatttttgataaagtttgttaaggtagtagtttttagattttatttttagatatgtgaaggtttgggtgaggcgtaagaatttatatttttaataagtgttttatcgttgattttgagaagtttgtattaaggatttgtgttgggagttaggagtttaagttttattttgtttagttttagttatagttttagtttttggtttggtattattatatttatgtgtggtttgtagtttatttttttattaggttagtgatttgttagaggttttttattatttttagtatatagattaagttttttttttgtttttgagtttaattatagttttgggtatttgaagttgtaaagggtaatttgtttatgtttttttttttttagtttttgatttttgagggtagatatgatttgtttttgatattagtagggtgttgggtagagtaggtgttgggtagcgtttgtggaatgaaagtattaggttggggagttgttgggttgttggttgggtaaggttgggtttgggaggaaaggaggatggagttttaggtggggaagtggttatttgttttttgtagtcggagttgatattatgtttatatttgtttaggtgaacgtgttttttttattttttttggagttgtttttttattagaagtttttagttgattagatattgtttggggtggatatttagtagagtgcgagtggagagagagagatggtgtttatttagaatttgtttttggagtatattaattagattatttaggtacgttttaggtttatttatatgtggaggagggtggaagtgggttgggttgtgttttgttggggttagaggaggaaagatttagtagggtttttagaaataaggagtttttgtttttgttttggggtttagttttttttagaagaggttttgtgtgtagagagatgagggttatttaattttatttgttttatgagtttaaaattaggtgaggggttagagtgtgggaaattagggaaggttttttgcgggaggaaggatatgaagtttgaatattatttaattaaggaagggaaatacgttgatagttaggttaaaagaaaggtttgatgggtgggatagagtatttgaagtagttgcgaaggatagttttggggtttgttaggttttaagtattagggcgagtattatggattaggttattaggtcgtagtgtggaggttaagtaggggttgttagtaaggagtgtgaaggagtggtttggggaagattttagagaggtcgggggtaggaggttgagtagtggagtcgaggcgttttagtttggtatttgggtagttgttggggttgaggttgtgggatggtgtatggtagtgtttgagtgtgatgtaggggttgttaggagatagaggagggtataggtggggtttgcggttaaggaatatagataaatggtttacggttgagaggagttgagggttgggttttgggggttattataggaggagtagtgaaggagggtagagtttaattagttagggtgtagggattgaagttttatgagttagggaggtagggatagcgggggaatggatggtattattttggttttttttttgtgtagatttttagtagtagtttgtggttttttaaggtggcgttggttttttgttaatttttgggagtttttcgttttttttaggagtattagtatttggggttagtagggttttgtgtgttttagaggttttggtttagagtttatttagaatggataaggttgtttggttttttataggtggtgtttttgcgggttgtggtggtcgtgtttgagttgtagttttttattagttgggtggattttgggatttgttttgtgagttagtagcgagttcgggaggtttatttgatgaatttgagcgggtgtcgaagttattggattatgttgatgggtatgttttattttgttatttatttatcgtttttttatagggttgtgttaagagaagattttttaggaaggggtttttgtgcgtcgtttttgtatgttggtttttagggtaggtattatttggaatttttgtagagtagttagttttttaattttatatgattttagggttgttttgttttgtagtgttgagtaagattagaggtataggttcgggggtgggtaaagtttttttgtgggagtatatggggttgtttgtatttatgtgtttttttttttttttggtgtaggttagtaggagttagttaaggtcgttgtggtttttagggtttttttaaatagtgggttgttagaagtacgattcgttaatgtatttttaatttttatcgttttgtaggttttttttattgttaggtgtagttttttttaattttttttaaattgtttatagagtttggattttttgtttaggtgttttttaattttagtttttatatgttttttataggagtagtgagttgtacgagtttacgatggtggtggaaggtgtgttcggtgagaagttttgtattttgcggtttcggggttaaggtttttatgatgagagatatatgttgttttattagttttgaggtttcgttttagtttttagttttaggttttagttggagaaaaaatattgtttagggattaggagtagttttttagtataaagatatagatttggggatttggggatttttgggtagtttttggaatggaagaatttttttttataatggttttagtttaggtttttatgatatgtttttagagttaatataaaggataggttatattatagtagagattattatattgagattattatttagtgtatagcgaagattagtatggtaaaattagttttggaaaaaaattatagttattaagataaatttatgtatttttattatgtttattgtattttttatttatggatttgttttgttttaagaattaattatggttttgtggtttgggtgatttaggttgtttttattttgtatagttaaagagggtttgatgggtggtttaatattttatttatttttatattatgttattagtgtttatattttttaaatgagttgaagtgttttgatttgtttattgtta

SEQ ID NO: 181 - DNA, 85734 bp, Artificial Sequence
  Chemically-Treated DNA
tggtagtggatagattaaggtattttaatttatttggaaaatgtgaatattgatgatatggtataggagtgggtggggtgttgagttatttattagattttttttagttgtgtaagataaaagtagtttgggttatttaggttataaggttatggttaatttttaaggtaaggtaaatttatggatgagaagtgtaatgggtatagtaaaagtgtatgaatttattttagtggttgtggtttttttttaagattaattttgttatattggttttcgttatgtattgagtagtgattttaatgtggtggtttttgttgtggtgtggtttgttttttatgttagttttgaggatatattatgagggtttaggttgagattattgtggaagggggtttttttattttaggagttgtttagaggtttttaggtttttaagtttgtgtttttgtgttgaagagttgtttttaatttttgggtaatgttttttttttagttggggtttggggttgagggttggggcggagttttagggttggtgaggtaatatgtattttttattataggagttttggtttcggagtcgtagggtgtaggattttttatcgagtatattttttattattatcgtggattcgtatagtttattatttttgtggggagtatgtgggggttgaggttaggaggtatttgggtagggggtttaggttttgtgggtagtttggggaaggttggaaggggttgtatttggtagtgaagaaaatttgtaaggcgatggaggttgggggtgtattggcggatcgtgtttttagtagtttattgtttggggagattttgaaggttatagcggttttggttggtttttgttggtttgtattaaagggaagggaagatatatgagtgtaggtagttttatgtatttttataggaagattttatttattttcgggtttgtatttttggttttgtttagtattgtagggtagggtaattttgagattatgtgggattgggggattggttgttttgtagaaattttaagtggtgtttgttttgggagttagtatgtagggacggcgtataggggtttttttttggggggtttttttttggtatagttttgtaggggaacggtgggtaggtggtagggtaggatatatttattagtatagtttagtagtttcggtattcgtttaggtttattaggtagatttttcggattcgttgttggtttataaagtaggttttaaagtttatttagttggtggagagttgtagtttaggtacggttattatagttcgtaggggtattatttgtgggagattaggtaattttgtttattttgggtgggttttgagttagggtttttgggatatatagaattttgttgattttaagtgttgatgtttttgaagaaaacgggaagtttttagaagttggtaggggattagcgttattttaaaaggttataggttgttattgggagtttgtatagggaaagggttagggtgatgttatttattttttcgttgtttttgtttttttaatttataaagttttagtttttgtattttggttggttgggttttgtttttttttattgttttttttgtggtggtttttaaggtttagtttttagttttttttagtcgtggattatttgtttgtgttttttggtcgtaggttttatttgtgtttttttttattttttggtagtttttgtattatatttaggtattgttatgtattattttatagttttagttttagtagttgtttaggtgttaggttagagcgtttcggttttattgtttagttttttgttttcggtttttttagagttttttttaggttatttttttatattttttattagtagtttttgtttagtttttatattacggtttggtgatttggtttatggtgttcgttttggtgtttgaagtttggtaagttttagggttgtttttcgtagttgttttaggtgttttgttttatttattaggttttttttttggtttggttgttaacgtgttttttttttttgattaaatggtgtttaggttttatgttttttttttcgtagggagttttttttgattttttatattttggttttttatttggttttgagtttatgaggtaggtgaggttggatggtttttatttttttgtatatagggttttttttaggggagattgagttttaggataggggtaggggttttttatttttgagggttttgttaggtttttttttttttggttttagtagaatatagtttagtttatttttatttttttttatatgtaggtgggtttggggcgtgtttgagtggtttggttggtgtattttaggagtaggttttgagtaaatattatttttttttttttattcgtattttgttgaatgtttattttaggtagtgtttggttagttgggagtttttgataggagagtagttttagggagagtgagaaggatacgtttatttgagtagatgtggatatggtgttaatttcggttgtagagggtaggtggttatttttttatttggagttttatttttttttttttttaggtttagttttgtttagttaatagtttagtagttttttaatttggtgtttttattttataagcgttgtttagtatttattttgtttagtattttgttagtgttagggataagttatgtttgtttttagaggttagaggttagaagggaagggatatgagtaagttgttttttatagttttaaatgtttagggttgtggttgggtttagaggtagaggaaggatttggtttgtgtgttgaggatagtgaggagtttttgataggttattgatttggtggggaggtgggttgtagattatatatgagtgtgatgatgttagattaggggttgaggttgtaattgaggttggataggatgaagtttggatttttggtttttagtataggtttttggtataagttttttagaattaacggtgaggtatttgttaaaaatataaatttttgcgttttatttagatttttatatgtttggaggtggggtttgggagttgttgttttaataagttttgttaagggtattaatttgttgggagtagtggtttatatttgtaattttagtattttgggaggttgagttgggaggatcgtttgagtttaggagtttaagattagtttgggtaatataatgagattttatttttgtaaataatagttgggtatggtggtatgtatttgtggttttagttatttgggaggtcgaggtgggagaattgtttgaattttttaggtagtcgaggttttagtgaattatgattacgttattgtatttcggtttaggtgatatagtaagatttaatttaaaaaaaaaaaggttattgatttattgttaggtttagaaattgttgttttaaattaagatatgggtgtagggatgaagaaaagagaatagtgttgggagaattttaggagggggtattcgtagggtttggtggtttggttagagatgggtttaggataaggggtgttagagttttgggtatgagtaagggggttggggttggtatttgttgagataaaatgttattataaaaaggaggtatagatgtggggtaggataaggtggggaggggatggggagtttattttggatagattgagtttggttttagagtttgggagataattttggttaggagttagaagtttgagtattgttagcgtatggagggtgagatgtagtattattaattatgtgatgttttttttttggaatttttgggtttttttagagttgttaaggatttttaaatgtttggtggttaatcgtcgtgtttttttggaagttttggtggaatggaatttttggttgtgttttgggtttttttatttatttagttcgttgaagggagtaaacgtaaagtgggttaagggtgttattttgttttttgtagattcgtgtgtgtttttgatttttatgatgaggttttcggggagtattattatttagtatagtatttagtatatagtaggttttcgttatatagtggagtatatattggatagaaataatatggttgtttattgaggttttggaaatggatgagataatttagaaatgtgtagagtgaggttaggatttggtagagtttaagggagtatagtataaagggaagtttttcgagaagaagaaagagggtttttgaagtaggaggggaagtaggagatagggcggcgttgtttatttttagtttgtttttgtatattttggaagtttattgtgtagatatgggtgtgcgtatatttagttttattttagttgttttagagattagaggaagttgatggtttttagtgaggttttgatatttttaagatttttttttatttaattaattttgaaaatttaggatttaattgttattgagaataagttagaagaggaaattttacgttagaatttggagtgttttataattatggtaattttatgggtttatttgagttgggatataaattttgagtttgtataggaggacggagtttgtgtgtgtgggaaggggaggtgtttataggaatgtattagtttttattagtattttagtagtggggattaagagggaaagggaagtttggggatatttatggagtacgtgtatgtatgtatgtgaatataacgtttggtgtggttatgtttatgtgagttatttgtgtagaggtgttgaatgtggtgtttttggtgggagtgtattttcgagtgtttatgtagggtatggtagggttaggtatgtagtttgcgtttgggtataagtatttgagggtggcgtgtaggggtgttgtttgtatatatgtgagggtgtgttatcgaggtaagggttgtagatttttttattgattagtatgtttttttgtgtttggagtattagttgtttgttcgttgaggttgttttttttttatatttttgtttttggttagggttaggagttttgtggttttggttcgttttattttgagaaacggagaagggtttggagattataagtcggaagtagtgtgggatttttgtagtgttggttagttttaggtggtgggtggttattagtttatttagtatttgggtagttatagaggtaggaggtagggaatgtattttgtttttttttttaattttatggttttagggtagggttgggagggttgggggaggggatttgggtttagattataaggtttgagttttataagggtatatagagatatttgaggtttaggtaagttggtagggttagagggtggtagtatatttattttagagtagggttgttcgggaatgaggttattggtttggtattggaattttatattgtcgtcgtagtttagttttatatttagtttgtttagtaataggtattgttggggtaagtcgggcgtttggggttttttggttgtttttattttgtttatttagtttcgggttagtttttttttgggtttttttgttgatttttttatttatgttcgtttttttgttttgagaattttgtttggttttattagtgtttggtgagggtgtattttatggggatgaaaggagatggggtattttagttgatttattgtgtaggttttacgtagttatgtaggtttagttttaggggttttatcgtaaagttttgtaggcgatgttttttttttggaatttttttttttatttattgagtttaagtttgattatagttgatttttgggttgagtaggtagtatgttatttaggagggagtagtggttgcggtttttattttaggtcggaagagtttattttgttgtttaagtttatgaaatttagggcgtagttagtatattttattttgtgtaggattttagggttgagtattataggggtgaaggagatgtagatggtattgttgtttttagtagggattatttggtatagatatagtagttttagtattgttttatgtttattggtcggttaatgtagatagtttttagtttatattttaatttattatttgtttggggttgatatagtataggtggtcggagggtatttttttatgtgtttgtaggatgattgagatgagtttttgtgttattttattgttggtattggagttgtttttaatttgttattaaggaattattgaggtttacgtagttattgaggtttaattagtttattggttatattttagtggtttttagtggttagtttgtttcgtttttttatttttgtttattgatgagttagttttatggttgaatttcgatgaattggaggggtttggggattagaggaggtagttatttttaggggtattagggtatataagtttattttcggtttggtttcgtagcgggaaaggtggtttataaaatattagtagttttattagtcggttttttttgttttttggaatataggttttttaatttaggcggatgtttggggtagatgtgtggagtagggtgaggaataagggaggagtagataatttttcggggtttttttttttttatatttttagatagagatgatttatttttttatatttaggtggagggggtgtttttttgtttttttaatgttatttttaggtaatttttatttaaaattttaaaaaggttttataggtttatgtcgtttggttttattatttgaagtttttatggttataagattaggtttttatgtttagatgtttgaatgtaggtgttttgtttttttttatagttgttttttttttcggtttgtttgtgggtaggttgggttttttaatttttatatgtttttttttttttttatttatttattagtttatgttagtttttacgtttttttttaggtagattagtttttgggggtcgttatgtttatttttgttttgttagtattttcgtatttttttttgtatttatttggtaatatttaattttgaaagaattgaattgtgtcgtttttttgagtattattgggggaagttttttagttgaatagattgttatttttattaatttgtttttaatttaagttggggttttttattgttttttttttagtttgtattatgataatgttaagttgtttttgtttttttttgatatttttatttgtttttttatatttagtcggtagttttattttattttttagaagtttttaagttgagaagtttttaaagttttgttttaaatttagatatttgtttgtatcgaatttatttttttttttttttttgtttttagttttgttcgtagttttttttaggggtaggtatggttagggttttttttttagtgttattagtttttttttttaatttttttttaggtttagagtattttttgtttttatatgtttttttggtttatatcggtttatttttttttttagatttagtttatattttgttttttttttataggggagtttggttttttaatacgtttttttagtatttcggttttttttttagttgtatgttatatattttatatattgtagtttatagttatatttgttttatttattaggagggaagtttttcggtagaaattttgttgttttgttttcgttgtatttttagtagtttttaggtaggttaggttttgtcggttggaggaatgagaaagggatttttttttattgtttgtttttttaaatagtaattttgatgagagtagggtatttgtgggtttatttatattttcgtaattataggttttttggatatttgggttttgtttatgggttatcggttttttttttatttttttttttagtttggtttattataaggtatagtttgtggtaagaatattgattttttttatgtatgttttattataggggttggagttatttaggcgaagggttcgggtaattgtgtttttttcggagatttgggtgtcgaatttggagggggatagattggatttagtatagttatagttagcgtatattttgtaggtagggaggagggttgggattgggggtttaggtagggggaaatattatagtggtttggttttattcgagaattaatgagatttggggttggtgttttttttaggcggtattaggtgagttgggttttggggttgttttgtgttttggtaatttatttatttgttttgagtagattatgttgattttagtttaattgtgttaggggttttagggttggtgttgatttcggattatattgattattcgttatttttgttttataaaattttttagagatgtttaggtggtggttacgttttttgaggttatttttttttagggaaattttggtttggaatttttttgtaggtggtattaatggttttaggttagttggagaataataagttaacgtgggtagtttagttcggaggtcggagggttttaggggttattagggagtagaggtttaggttgagtatggagtattttatggttggttttttttgggtttggttaatagtgtaggaggtggtttttagggagttgatggggtagtttatcgttgttatgtgtattgggatgattttcggtagtaggttttttatttgtaaatatattttagttttttgttatttttgttatcggttgcgattatattttttttgggtaaggtttttatttgtttagttagtttaggggttttatagtttggttttagttttattgtgtattattttgtttttttttttatttttcgttatttttatttttttttttagttaggtagtttgtataaagtttttagtttgaggatttttttttttttttttttttttagtagatatagggttttattatgttgtttaggttggttttaaattattggttttaagtaatttttttgttttagttttttaaagtgttggatttataagtgtgagttattgtatttggtaagtttgaggtttttcggtttttggtagtttttttgattaaatttttgttttttaaatgaaaagaattttattatttttttttgttaattaaaagtaataaattttatttttagaaaatataagagtgtgataattatttttaattttatttttgtagtatgatttattgttagtattttagtgtataagtgtttatattttttttgtgaagatttagatataaatggggagtatgttgtatatgtttttaataatttttttttttaataatataggattattattattattattattattgagatagagttttgttttatcgtttaggttggagtgtagtggtatgatttcggttgattgtaatttttaatttttgggtataagtgatttttttattttagttttttgaatagttgggattagagatatatgttattacgtttagttaatttttgtattttttgtagagaaggggttttgttatgttgtttaggttgtttttaaatttttgagtttaagatatttatttattttagtttttttaagtgttgggattataggtatgaattattgtatttagcgaataatataggattaatttttattaataaagagtttatagtattatataataggttgtgtagaatttttttagggatgtggtttaatgtttgtatttatttttttattgatagacgtggagaagggggtttaaagtatttttttttttgtatttttattaataatttttaaatttcgttaatgtgttaaaattagtattttgtggtttttttattttgtatttttttaattattagtggtggtgatagattttaatatgtttattggtcgtttgtttgtatttgttttttttggagttgtttatttaaattttgtttatttgggatatttttttttagttttttgttatttaagatttttttttatattaatatgattaattttttgttatatagaatatatataatttaaagtaaatatttattataattaatttgtttaatttattaaatagtttatgaaaattttttatttaataatttaacggtaggataacgtatgtaggttttatttttttagattaaattaggggtgttttgttggttattttatttatttttgtattttttatattatagcggtttatataggaatttatatatagtagatattttatttatgttgagtgttggagtaattaaatggatttttgggtgagttttattaagggcggggtaaggatttggttttgggaggttgttattgtttttttattttatattttttattttaagttttgggttttggtttaggtagtagtttattgttttttttttttttttcgatatggttttagttttgtattttttgggaaaaggtgtggaaagttttattgtttatgaggattttttttgtttgaaatgttttagttagaattttagaggttgttttagatacgaatgtttattttaagttcggtgggtatcgcgttttaatttggtgaggtttgagagtttgagggttaggtgttggaggggagagaggttgaaggcgagggttgggtagattttttattttttaggttattgtttttttgtgtatttttatcgtgtagatgaggttgttttagtattcgttttatatgttggtatagtttgtgatgttaatgtatagttgttggtagggttttagtatgttttgggaaaagtgagggaagaaagtagtttttttttcgtgggatagtatgttttttataaaatttgggaaagaatcgcgattgtgggggatttacgggtttggggttgggagtgaggtttaaattttcgtgtgtgagtaaagtattgttttcgataagttattttttagtttttttttggttaggttatatgtgttttttttttgggagtttggaatttagaggtaagttatttagggttttgcgtggttagtttttttattttttgagaggttgggtttttatgggagtttttttttatgagttatttttattttaaatggagtttaggttttgtgtatgagtttgtgttttagaagggaagtggttttaataggaagaggtattgttaggtggagcgttttggttatttgagagtagtttttggttttggtttcgttttttggtagttgttagtttatatttatagaaggttgtggttttggtcgtggtttgggtttcgaagttttattttggtggcgtttatttagttgttttcgtttggttaggtgtttttgtattcgtattgtttttagtagggtaggaggtatgttgggattttataagtggagatatagaaatagtattaagttagataagtttgttttaagatttgagttaggttttagagtaattagtattttattaggtgtttagtagaggaaggtggttttgtttgttttttttaggggagagttggttagtttttttttttatttttttttttggtttttgtttttattgtatttttattatttaaatatttttagttgcgggttattcgttagttgtagggattatttttttagaaatttaggcgggttttgaagtaggattttttgtttataggttttgtgttatggttatttttggatataaatttagtttagattttttatttttagtttagaattttgtaataggtttatttttagttttttttgttgatatttgtttagtattgggtatatattagttttttataatagaaagttaatgttttataaattgtttatgggtcgttttttatttatagtcgtggtttttaagttgggtttttttgttttattagattaggtggtgaggtgtttatatagtggagattttagaaaaaaaaagttttaaattataatgtttgattttaagttagagatttgtaaaatttttgaatatttaataattagtttttttgaattagtgttagttggttttggtatatttatgtgtatgtgtgtatgtgggtgtgtgtgtatatgagtatgtatgtatgtgtatatgtatgtatgtttatgtatatgtgtgtgtgtatgtgtatatgtgtatatatatgtgtatgtgtgtatatttgtgtttatgtatgtgtatgtatatgtgtatatgtatgtgtgtatgtgtgtatgtatgtgtatatgtatgtgtgtatgtatgtgtgtgtatatgtacgtgtgtgtgtgtgtgtgtgtttgtgtaagtagtattttagattttgtttttgtttttatatatagtagttttgttgattattgtttgatttatggggtattttattttattttttatatgttagtttaggtacgttattagtggtttttgaagattttttatttttgaattattttttttattttttggtttgtatagttttttttgtttatagtaattttttttttattataggtttatttgtttggtttattagaagtttttattttagtaggttaggttgaggaaaaggggtcgtaattttagttttttttatacgtttatttagggttcgggaggtggatagtaggagttattttttttttgtttgtttttatgtttatttgtaaaaatatatatttttattttttatatcgattagttattggttatttaagttatatagaggtttaatagggtatattttatttagttttatttgttttgggaagtgaaagaagtaagatttataggttggtttttttgtttaggttgttttgggggttttcgaaatatttaaatttgagggagaaacgggttcgtattggggagcgattggtgagaatgagttggcgagttatacgggtttttagtggtatcgttgagttaaagtttaggcggagtttttttgggtggtttggttattgttttgtgttgaaaatattgttttgtgtttattggtattatgtaatatattatttttggttttgtttagggagttattttgggtgggtatgtagaagttgtttagatattaggttttatttttagatttttgttttattgagttgttaattatagatttattttttttgtttatttatgatgttgagagaggttttaaattttgtataaatcgtttttggttagcggtatgttggtatggtttttagttgttgggttttatgtgggtaagtttagggtatttatagttttgttttttgttattttttgtttgttagggtattacgtttttaagtgtgtgtggggagattatatagagggtagggatggggtaaagggagttgtttttataggagtggtgagtggtcgtaataatattgtggcgtttttttgtttgtaggaattagatgggcgtagattgatattatagtgtcgtgttggttttgggcgcggttgttttattttttagtttattgttatttttagattattaattttgggtttatttgtaattagagttttttttagagatggtaatggttatttgtagtttttggggttttttagaaatgtttagaattagtggtttttttatgtttgatacgtgataagggagggttagatgggttagttttttttataagaaagtttatttaggggttagattaggtttggggtttttgaagatgagtttagatggtttttcgtagtataggggattgttgtggagttttgatttttggttaggtttatttttagtttttttagtgagtttagttagtcgattcgtttttagttttaggaagtttggttttttttttaggttttatggttgtttgagtttgttttaaatatttgggtatgtttacgtgaagggagattttttagagagggtttttggagaagttgcgtattttttttgatgaagttgttattttagaaattaaattttttttgagtaagatttgttttatatttgggtttgtttgtttgtcgttttagagtttaggtcggttatttttatatttgttagggggagttgagatttgagtttgtaagtttttgtaaggaggaagtttttttttttataagaattataaagggatagttaggaacggttttatgattgagtatattttattttggtggtttttagcgggaaatttaggtattagttagtttttttgggtagtatttggtatagtgtttgttgtgagtaatagttttgttttggatttttgggtaaattagaaagttgggtttatttgcggttatagagaatggtttggggagggtaaaaatttatgttaaaggttaggtatggttagtgggttttagggtatatttttaggtttattttaggttttttgattatgtgtttttagggagtagatttagtaggaatggggattttagatttaaatgtaagaaattttttttttatttataagaattagtaatgtggtttaagttagggtttttttggtggtataggtgcgtatggttggtagggtgttttttcggttatttaggttttatattgttttatttatttgggtatgagtagttaattttaatttgagttggtattttttatttgggtttagtaggttatgtttgggggagattgttattatgtagaattttgtttggtgttcgaggagttggtagatatatgagtgagtttgttgttatttattgggtttttagaatggattagtatttagagagtgtttagtattgttgtatgtaatgttggagattggtagattggggtttatagtaaaatcgatagggttgggtgtttatttttggggataaattacgggttttttttttttttttttttaattttggatggattttattatttgttgggaggttatttggataaaagaaattgtttttgaaggtttcgagggatggggagtagagggtagatgtttttggtgtatatggatgtggttttatgttttatgatatttagagttttttagttagttacgggtaggagtagtattataattgggttttaatagttatttgggttagttatgggttatgttggttgggaggttttagttatgtttattagaaatttttttttggttagggaattggaattttttagaggtagggtaagaaaaagttggattagatatgttgtttttttgaggagtttttatgtatattacgagtaagggataggttgtgggagggaggttgagtatttttgttttgtgaggatatttgggggataatgtttttttttatgtgggtttttgtggttgagggttgtagattgttgtttgatgttgtgggtttatttattttgttttagtggaattgggtaggtaggagcgtgttattgataagtgtgatggttgttttcgtgggtatatttaggtagagatttttaatttttatttggttgttttgtaggtatatatggggtttttgtattttagtatatataggaaggtagttggaatacgaggaaataaaaggtatattgattagaaaagaagaagtaaagttgtttttatttttagatgatatgtagtttatgtagaaaattttaaggtatttatatttttagaaattttagaattaatgagtgggttcggtaaagttttaggatataagattaatatataaaaatgaattatatttttatatattaataataaatatgtggaaatcgaaatttaaaatatagtattatttataattgtttaaaaagtagaaatttcgggtgtaagagaaattgttgtaagaatattttgggtttattttaaagtggtttattttattttttttttgggcgtattttagaatggttattttttttttttattttattttggttaaataagagagaattttttttttagtttttattatgagaatttattgagtttttaggatttttaaatttttaagttagtttatatttagttattaggaatttgttgaaattattatttaagtgtttttttgttttaggtaaattgatttgtatttttagtatttgtttatatttttagtttttggggtggttatttgttttgtaattttaattttttgatagatttaagaaaaattattgttttagtttgtttagtttttttttgttgtgagagtaggagtttgatgggtaagttttttatatgtttgaacggttgaaggtattttgtaggtatgattaatgtttataattagttaagtttaagtaaaggagattattttagataatttagatgggtttaatttaattagttgaaaggttttttttttttttttttttttttttgagatagagttttattttgttatttaggttggggtgtagtggtgcgattttggtttattgtaatttttgttttttgggtttaagaaattttattgttttagtttttcgagtagttgggattataggtatgtgttattatgttaggtaagtttttgtatttttagtagagatgaggttttagtgtgttggttaggttggttttaaatttttgattttaggtgatttttttattttggttttttaaagtgttgggattataaaggtgagttattatgtttggttattaaaaggttttaaaagtagaaatgggtttatttagataaagaaattttatgtgtttataatatttttattttgtttttaaaaatgttagtatgttttttttgaaaatttgttttatagattttaggtttgtttagttagtttttatagttgtgtaatttgattttttgtaataaatgttttaataggttattaagaaataaatattaagttttgattgatataattatattaagataaatttatatgtaaatataaagatagaataaatgtatttttgtttatttttttatttgatttaaagggtaattatataaattaataattgtaaaattgttttgataaatttataatgtataaatatgtaatttgtatgataataatagtataaaggaaggggagagaatagagttgagttatattatagtaatattttagattattgaaattaagttggtgttaatttaaattagattgttttgaaattaagatatattataaagttttggataattagtaagaaaataattttttaaaaagtaaaagaaatatggaaattaaaatggtatattagaaattatttatttaataaagaagaaggtaataatggaggaatgtaggaaatataaggaatgtaggaaatataaaatatatatagaaaataaatagtaaaacgggagatgaagttttattttattagtatttatattaaatataaagggattaaataatttaattaaaaggtagagattagtaaaatggattttaaaaaaatgatttaagtatatgttgtttataagagatattttagatttaaagatataaatagttttaaagaaaaaggatggaaaaatatatattatgtaaatagtatttaaaagagagttttaggagatatatgaatgttagataaaataggttttaagataaaaatggttattagagataatgaaggatattttataattataaaaagataaattagaaagatataataattataaatatgtatgtatttaataatagtattataaaatatatgaagtaaaaattgatagaattgaaggagagattagtaatttaataataatggttggagattttaatagtttatttttaataatggaaaaataattaattagaagataaatattgaaatagaagatttaaatagtattataaattaaatagaataggtaatattttatataataatagtagaatatattatttttttcgagtgtataaggaatattttttagaatagtttataaaataagttttaataagttttaaacgattataattatataaagtgggttttttaataataatagaattaaattagaaattaataatagaaagaaatttgtgaaataaaatatgtgtaaattaaataatatatttataaataagttaaataagaaattataagaaaaattagaaaatatttttatattaatgaaaatgaaaatatgatatatgaaaagttataggatgtaattaagggagtggttagaggaaaatttatatttgtaaatataattttttttaaataaataaaaaagaaagattgtaaattaaaaattttagtttttattttaagaaattagaaagagaagagtaaattaaatttaaagtaagtggaaggatagaaataataaagattagaaagtagagataaatgaaatagaaaatagaaaaatattatagaaaattaataaaagtaaaagttggttttttgaaaatattattaatattgataaatttttagttagattagattgattaagaaaaatttgttgaagatttaaattagagaaattaggaatgaaagtggggatattattattgattatatagaaataaaaataattattagagaatattattaataattatgtattaataaattatattatagataaaatggataaatttttaaatttttagagtgatgtaaattattaaaattgagaaaaaaaaaaaaatttttttttggggggatggggtggggtatatagagttttgttttgttgtttaggttggagtgtagtggtataatttcggtttattgtagtttttgttttttacgtttaagttatttttatgttttagtttttcgagtagttgggattataggtgtgtattattatattcggttaatttttgtatttttagtagaaatggggttttattatgttggttagtttggtttcgtatttttgattttaggtgattcgtttattttagttttttaaagtgttgggattatagttatgagttattgtgtttggttaagaaaaaagtttaaattgatttatataagaaatttagttataaatatattttatgttattatgttttgttttattgtattttatagatattgtgatttttataaatcgaaggtttgtgataacgttgtattgagtaagtttattaatgttatttttttaattgtatgtttttattttatgtttttgtgttatgttttgtaaatttttttgttatagttgttatggtaatttgtgattagtgatttttgatgttattattgtaattgttttggggtgttataaatagtaattatatacgataatgggtttaattggtaaatgttgtgtgtattttgattgttttatttattggttattttcgtttttttttttttttttaggtttttttattttttgagatataataatattgaaattagattaattgataattttataatagtttttaagtttttaagtgaaaagaagagtcgtacgtattttattttaaattaaaatgattaagttaaaaaatgattaagtttagtgaggaaggtatatttaaagttgatataggtagaaagttagttttgtgttaaatagataaattgtgaatgtaaagaaatgtaatatttagtaaatgttttatttgtgaaaattttgaagtaaaagataataaagtaaataaaatgttatgtaaataaggaaaagaaaataggagaaagaaataatgtgattaggttaattgataaaatagaggagaataaaattgttgtttgaaatttttgtataggttacgtgtaatgtaatttttaatgatggaatgagggtattaaagggcgggggagttgagtaaagtattgttgaagatttattggtttagttaggttagggttttagttttagagtttagagtaatatatggaagagtgggttgttttaggtatagaagttaaatattatatgattttatttaagtgggtgttaaaaacgtgtatatatggatatagagattggaatgatagataacggagattcggaagggtgagggtataggagggaaatgggtgatgagaaattagtttatgagtataatgtatgttatttgggtgatggatattttaaagttttgatttgattattatataatttacgtatataatataattgtatatgtattttataaatttgtataaataataaaaattaaaattgaaaattaagaaaaagattgggttgttatagtatttgtttttattgaagattgtgggtattacgttggagagaggttagggtagagtttgtagtaatattggattttttaattgttatgaggaggaaataattagaaagatgttatttttttatttttatttatgaatgaaggtacgaattgatttgtgtagttgtttagtatgggttttttttattgtttgtttagggttgttttttttaaaggtttttttttttgatggatttaggttagttgtgtgttttgagggtggtgatttatatgtattttattttttagaataggggtgttttttatatttatttttttttatttagaagaaatttataatattagttttttatgtaaattaatttttttttttatttaaaaataggattggataggtaaagattattagaagtagaagaaaatttaaaaagtaaagaagaattttaatatttgggaaaatagaaatttatttttttgggggaatttgagaggttgttgtattgataagattataatagattattatagaaaaggaaagacgtaagaataataaagtttgaaatttcgaaatatgattgttttttttggagatagattttttttgttatttagtaggggaaggggcgggtatatgatttatataagagtaagagtaattagggtttatttttgtaaagagttagattggtttttagagattgttaaggtgggagtgtgtgagtttggagttttaagtggtttttttttaaggtagagtgcgaagggtttttgttaataggggagagaagggtttataaaaaaagagtagtagatgggttggggttgggatggaggtagagaagggggaaagagggtagagaaagagaggaagtagaagattagataaagggaaaagtgttgggtttttggatttagtaaggtgggaatgtttagttacgtgagttaatgtttttttttttttgtttaagttggtaatgtttgtgtttttattatttgttattgtaaatattttgataatataaggtttttttaggagaaagaatagagatagaaaaggaaaggaaataagtatagatttaatagaaagttttttttttgagttgtaggtagatttagtttttatatttaatgttcgtaaattgttttgaaggattaatgtaaagatttatatttagatttgtatttgttattataggaggggatatttgaataattgttagatggttaagtatataaagtttaataatatttgttatggtgaaagtgtggggtaatggttagttttatatattgtaggtagaagtataaaatgatatagtttttttggaggataatttaagagtatttatagagatttaaatgagtatttaaatgtttttataatgaaatattaaatatatgtaaaaatgagtataaaatatatatatagtttaaatatatatatagtttaacgaataataaaataatatttatgtattatttttatataattttagaaataaaatattattattagttagtttaagaaaatgaatatatatatatatttatttattgtaatttttgtttttaggatttaagtgatttttttgttttagttttttaagtagttgggattataggcgagtattattatatttggttaatttttgtatttttagtaaagacggggttttattatgttgttaggttgatttcgaatttttgatttcgtgatttgtttgtttcggttttttaaagtgttgggattataggcgtgagttattatgtttagtaggaaaatgaatattttatttgaaaataatttgggaaggagtggggagaaggagataggggatatggatgaaatagtatttgtagtgagttgataattattgaagggaggaaagagtatgtggaggtttattatattattttttttgtttttatatatatgagaagttttttattagaaagaaagaaaaggagggaagtgggggagcggagggagaatgaagaagaaaaaaaggaatattattaatatttttgaaatttttagtatgttttttttagaatataatggtatgtgtttatttaaatatgttatattttttaaatgtttatttttttgttgatagatagtggttttttttagttttttttgtaggaatagtttagtttgagtattttaatatgagtatatattttttattgtgtatgtataaggatttttttgggagtatatttagaagggtaaatattagttgatgttaacgtagtttcgaaagtagttatattaatttatatttttttaatatatatattttagaaagatatatatataatattattagtggattatttttagggaatggattatgcgttattttgagttttttttttgtaatttataaattttatagaatattaattttttggatttaatagttttaaatttagaatatttttagataaatatataatatagataaatatattacgaatatgtatagtttgttgtagtggttttttttacggtatttttatttttaggtattattttttatttttagttttaggacggtttttagatgttggtagtgtagggtttttaaggtgatgtttattttgtatttttttagagagtgaagttggttattcgaaggtttaatgtcgaagggagatatttgtttcggagaatatttaggaggatgagtattgaggatatttggaattgtagaggaattgggggttggttatgtttaattaaagttatttttaagttgttttagtttttttaagagttatttgggatttagaaataggtaagtaggtgggggattatagttataagagttttaggattaagagtatagaaattgagtttttaagtaaaggaatatataagttagagggttttatgttttggtttagatttgagagatagaaggcggagggaggtgttttagggaaaatggggagagttggggagttagaggagagttggtgagttaaattaggggggtagttttttgagtagttttaattgaggaaagttattaggttattagattaggggaggggagagtttattgtggttagattttttttttgtatttacgtggttttttttttattttttttttttgttttttattgtaggtttagttttatttattcgtttttatttttatttcgttttcggtttgtttttttttttatgttaggtatatatataaagggagaggggaagggaaagagtaggaagaaaagtgtttttatttggggagggttttttatattttattttttttgttttgattgagagaggatatttgtttttgtaaggagttattttgttttattttgtttttgttgtttatgtgtattttttttggagttttgggggtggttgtagtttagggttgggttttagtagttttgcgttttttaatttgagattatttaataaattttaaattttaatattatttttgagagtttaaaagaatagagtgtagagaattgtagagagggaattattttataatattataatattggtaattatttttattataaaatatagttattttttatagtgggagaatattatagattgaaaattagataagagggattagatgtgatgtcgttatttattagtcgtatgattttggggaagttttgttttttttagttttttttttattaaatgaggaggttggttgaggtttgtaagtttttaattgtgttttggaaaattttaggaaatttttagaagtgtaggggattggaatgtggggagaagtaggatggggtagaggtgtttaataagggggtttttgggtggttggagtagttatagtttattttatgttttgggtttttgtataaagttttatttgaagaaagggtttttggttaaatataatgtggatattaaagatattgatgttattttgtttttagttttattttagtttaagcgttagttttagttttttgtggttttaggatttatggtgggagatggatgagttttgggagggaaagtattgaattttaagtttgtgtaataggtatttggtaatggcgttggtaatttgatgtatattgttataatttttaggttttagagtgtttagttataggttattaggtaaaggagcgaggtttttttggaatagaaaggaaagtttatttttttgtagaaagggaatgtatattagtaaaataaggtatatgtatggtttggattgttttttttgggttttttaatatagaaggaaaagtgtgcggtgttttgattcggagggtaagtgggtaagtaggatggggatttcggtgggaagtagttagaaggagagtgtggttattagatatggttagggttttatatgtgtagtttattagggagttgtagttatgtcgtggtgaaggggcggtgatgtacgatttattgcgggtattttgcgagtagttggtgatttgtgtgattttgttttgttttagatcgtttattgtatttaaatatgattatgataatatttagttgtttttttttttatttttatagtgaaaagtgttatttgagtcgaaataaattttgaattttttttttggagttttgggtttgggttgttagtttgtgattagatgttatttggtagtagatttttgggaggatttgaattttttagagagtggggaggaggtgggaatgcggttggagtagtagtagttttggaggttttttgtttaatttagttgtttatttttttttgttttagacggttttgagggagaaatttacgttttatttttaaattcgatggtagtgaaaggtataggaaatgttgatgggggattatatttggttgtagagaggagttgagttgttttagcgatggggagaataggaggtatcgttaggtcgaagttattaggtaggttttttttttattagtttcgaagttttgatttaaatatattagggtaagttttattagggtaagttaaacgggtttattgtgggggtattagaggaattagtagtgtttgatttatatttttaggttttttttggagggagattgggtttttttttatgcgttatgtggttgggagttggttgacgtttcggatttggatggagtttgtggttttttgttttaggcggagtagattaaattgaagggttgagacgttgatgatgagggtaggtttttgagatatttagagggtttgttattgggttatttggggatggtttagtgttttagttttgttatttttttgggtttattttattgtttagttttatttgtagtattttaaagatagttttaatgtgtaatattattggcgagggcgagttttcgattttatatagtaggttttggtttgtggggttagggatatttttagtaaagtttaatttaaaattttcgattttattgggttttgagaagagagggaaagggagaggtggagaggagaagtagaggtagtttttttttatgattgggtttagatatttggtttgtatagattttttattttttttatattttaggttttagttagagtagttataggatattaagagttttgtataagtttttttaattttgaagatttttttttgagttagttttaggtaggttataattttttttgtagtttttaaggtatttatgatttttgtgtcgggttttattttaatgatgtggtagtcgttgatttttttttataggtatttgatgggtgatttgttgttgttttatatttgaaagatattcgagattaggttgtttatttattgtttttttatgttaattttgtatttgttgaaggattgtaggattgtgggttcgtaaagagtttatatgatatttttcggttaatttttggttatttaaagttatgggttttttaatttaaaagtattttttttttatattgtagtgtttgtggttgatatattttgttaaggacgggaataggttttatagttttaatttttagaggattttgggaggttgataaaagaagatagttatgtttggtttatgtatttgtgtaagttaagttgggtttaaagttttgggaatggttttagtttttatgtagtggttgttattatttgttttttttgttatattttttttatatttgtatttatgttaatattgtttcggttagtttaggtaggggagagataatgatttattttaaaagttttttttatatttattttaatgtagtttttttttgggatgatgagggtatatggttttaagagaatttggaaaggttttattgagttttttatttcgatttttaggataattatattatttatagagtaggaggagtgttttaggtttttcgtttttgaattaaatataaatttatcgttagttaggagtcggtatatttggaagtatattttagagtgtttttgtttttgttttacgtttggttttgtgaaaaaaaaaatattgtttaatttatagtttttgagttttttaaattaaaggtattagttagtgtttgaaaggtgataagtatcgatggttgtgatagtggtttagtataaggattgggacggggtattgttttgttgtttttagggattatttgtagttttttagtttgggatttttgtattgggttgtttggagttttagtttgaaggtttatattatgggggtaaagttttttttttatatttattattatcgagggttttttagtttggttttttaagagtaataatgggtttggggtatagttttaaagtttttggggtggttttatagtgagtttagcgagtttagtgtgtttagtttattgtagggttgggttgttagggtaaggtaaaaaaaatgtttttattttttaaagtttgcggggattaggttgtttatttttttttatttgatattttttttaggagaatttttaaggtgggggaaggtttagttgtttattttttatttagggtttagttttttttattttataggttttgggattttttttagtattatttggagtatattgtgaaaattttttagttgtaaggtaaatatagtgttttgaaaatattattgcgttttagtaggttgttttggagaaggttggggtatggtaggaattttttttttttttagtttagttattagaaggattttttgaaaatttagggttgtttttttgttgtttttttttttttttaggaaaagtgaagttgttgttagaatatgagttaggatttaggggtttgttttagttgggtttgggtgtaagaagtaaaggtttttttgatgttgataaagttttttaacgtgttcgaagtattatatttttttaggatagataacgaggtagttggatgttgggattagaggtaggattatttattttagttttaaatttattaataatggtttcggagtattttttttatgtttagttcgaatttttttttagtttatcgtggtttatagggtttttttttatgttggggttagcgttgtgttaatttggttttcgggtttttgtattttattttttttaggggatgttgtggtatgggtggggatggtaatgttttttgttatagtagatatgtgggagatatttagagcggaggaagttagttaagggttttgttgtagatggggtgagtttgggattaggattagataaaatgagttgttttattttgtatattaggtgtgtattttaatttaatttagttaagtgttggtttgggtaggatagtatttcggtgggtttagttgtggttttagtgtgattgaggaatataggtggggggtttaaatatatgatttaattatgtgtggttattgagatgatattatttgaattttatgaggagaaaagtttaggatgaattcgtggtttgtgtgggggtttagaattttttttttgggtatgatggagaaggtagtttttttgtcggggtagtatttgatgttgtttatgttgaaggtttttttaggtatgaggggttgtaggttgggttttatgatttgttagtagaaggttagttttacgtgtttgtgggggtaacgtatttaaggttatgttttagttttgttgggattaggtttttttattttatgtttttttgttttgttttaagagggagtaggaaaggatttaggaataggaagaaattaggttagtttttatatttttttaatggaggattttttaatggaggaggggtagtaagtgggcgagggagtttaagatagagattatgtaagagagtttttcgttttttagttatggtagttggaggttggatttattatgatttaggggatatggtaagttaggaatttatgttttaattattaaagtggaagaggttatatattattttttaatattgggaagattttttgtagtgttttttattatatgagtttttaaggtttgttatattaattttatttttgttttttgttttttttgttatgggtttttaggagagttgtgtttagaaagatatgtgtttattggttgttaataggaatagtggtaattttatagtataggaggggtaggatttgtagttatttcgggggagagatgatagagttttgtgtaatgtttggggtttttagggtagttttggttgggaggttttttgagatttgttttggttttatggtagtgtttagaggcgggttaggaaataaatggtaaggagaatgaaatttatagattatagtttgtttgtttttgggatttggatggttttttttatataggtatggtatgttttttttggaaagttggggttggttagggatggtttaggatgatttggggtagtattatttaatataattttttgaagggatggagattttatagatttgtattgtttaatatgatagttattagttatatgtggttggtgttattgaggaagtgagtttttaatttaatgttaattgatttaaatttaagtagttaagagtggttattggtttttatgatagattgggttaatttggattttttaattgaatttggatatttattttgtgtttagttttttttaggtttttggaaggattttttgttttattgggattgagggttaggtaagtaagaagaagggttgggtattggggtatatataggggttatttacgtagtatttttaataattagttgttttttagtcgtggatcgaaggtttttaggtttaaatcgtatgaagtgttgggttgttaagtttgtgagttttttagggtttggttggttttttttattagaaatatagattagatttaaagtaattagttgtttaatttttgttaaagtagagtaagtgaagttagtgaaggtttattagggttgaaattaggttaaggttgttgtaggatttatgtcgttatttatatgtagttggttttgattatgatttttgtaagtttatattggagggaaaagggggatattcgtttataggttaatgtttttatatttttgaagattaaaaggaggtgattttgagaatttagtatatagtagatatttaattaatgaggaagggagagaagaagggagaaaaggagggagggaaggaggaaaagagggaaggaaggagggagggaggaagagagggaggggcggttaggggtattttgttacgatttttaggatgttttttttaattttgtagaaatttagaggtggttttggttgtttatgtgtgagttattggtaattttttaaaggagattaaagtgagttttaaaatgaaataatgaaagattttattttaggtttttagttgttttttgttagaaggttttttggattgttttggaggttatattggtttggtttttaaagttagattagagtaatgggtttgaaacgagattttggtatttggaggttgtagtatttttaatgtgcgtttttgatatatataggaaataggtgggttgtcgttaatgttattgtggttagtggtttttggagttggggtagtttttttagttttgtttttgggagtatatttaagtttatttatggttattagtttttttatttggtagttgtcgtatatgatgatgaaggtttgttttgttttttttaggttttttggggaaaataagatttgggggagagaagggttgtttcgttattttttattaaagggtttttatttttttcgttttttattttttttttttcggatatatatttttttttttgttttttattttttgtttttttttttgttattttttattttatttttaaggttaagtgttttattttagttttattttagagaaaagtagggagtaagttaaaaggatatgaagataaagtttatagagattaaaatataaatggtttttaaatgaatgataatatatatttttatttataataagagaaatgttaatgaaaattatttagaagaacggttttttattatttatattggtaaagagtagaaggtgagttgttataaatgtaatgatttgttttttattttttttttaatttttttaatttttaattttggtaattattattttattttttgtttttatgagtttaattatttaaggtttaatatataggtgtaattatgtagtatttgtttttttgtgtttggttttatataatgttttttagatttatttatgttgtcgtaaacgataggattttttttttttgtagggttgttattttattgtgtatatatattttattttttttattttttattaatagatatttagggtgattttatagtttgtttattgtgaatgatataatgaatataagagtgcggatattttttaaatggtattttttgagtttaggagttagaggatgtagtgagtaatgattatattattgtattttagttagattttatttgtatatatatttagtagtaggattgttgaattatatggtagttttatttttaattttttgaaggaattttatattattttttataacggttgtagtaatttatatttttattaatagcgggtaaggatttttttttttttatattttcgttaatatttattttttatttttttgataatagttattttaacgggtgttaggtgggagtttattgtggttttaatttgtatttttttgatgattaatgatgttgagaatgtttttatatatttattgattatttatatgtttttttttgaggaatgtttaattggtttttggtttattaaaaaaagtaggttgtttttttgttattgtattaagttttttatatatttttggagttaatttttttttagatgtgatagtatttttttttattttatagattgtttttttattttgttgtttgttttttttgttgtgtagaagttttttcgtttgaggtaattttatttgtttatttatgtttgtttttttgtttgtttatttgtttgttttgttttttgagataggattttgttttgttatttaggttggagtgtagtggtgtgattattttttattgtagtttttaatatttgagtttaagcgatttttttattttagtttttaagtagttgagattataggtgtatgttattatattcggttagttttttaaattttttatagagatggggtttttttatgttgtttaggttggttttaaatttttgggtttaagaaatttttttattttagttttttaaagtgttgagttatcgtatttggtttttatttttatttttgttgttagtgtttttgagattatatgtaaaaaattattgtttagattaatgttatatagatttttattatttttttttagtagttttatatttttaagttttatatttaaatttttaatttattttattaataagttaatttttgtatatggtgagagatataggtttagttttattttgttaaatgtaatgatattttgttttgattttgtttaaaataatttagaagagtagggtggggaatgtttgagggaaatggaggggtatagatgtaataagattggttaagggttgataattgttgaagatgagtaatgaatatatggatgattattattttttttatttttgtatatgtttttatatataacgtttatgaatagtttttaagttttataatatattgtattggtaaaggtgtaaagaaatagatatttttatatattgttgttgaaagtataaattggtataattcgtatggtaaggattttggtaatatgttttataattatgagggtataaagcgttggattagtaaatttattttaaggattgtattttgtgggtagatttatttttggatagagtgatgtatgtataatttatatataatttgtagttagagattagaaaaaaatttttaggttaattagtaggagattgttgaattaaattatggtttatttatatagtaggatattatgtagttattaaaatatatgagaatgatttttaagatatagagttaagtagaaaatataaggtaaagaatagagtatagagtgggtaattttgtgtgtgaagaaaaaaatgggggtaaaaatatgtgtagttgtttatttgggtatagattatttttggaagggtatttagaaaattggttaggtatggtttttggatggttgaggaattggggtgaaagggagtattttattgtttatttgtttatattttttgaatgttttatttttatttatttatttttaggatagggttttattttgttgtttaggttggagtatagtggtttaattatagtttattgtaaatttaaatttttggttttaagtgatttttttattttgattttttaaagtgttgagattataggtgtgagttattatatttggtttttttgaatttattttttattttaaaaattgtttatatagatagtatattattatgttgtttaggttggtttttaatttttagatttagtagtttttttgttttagttttttaaagtgttaggagtatagatttgagttattgtatttagttttttttttgaatttttaattatgtaaatgtattttttatttggaattatgaatatattttggaatagataaatttttaaataattagtaaataaaatacgtaagaaatgttaaggggaaagttttttttagtttttttattgtttttttaagagttttgttgttattttttttttttatttggagattttaggaggatgggatgagggggatgtttagggtagagtagttttaattttttaaagtttcgatgagtttgtgataagttttggattatattaagagaatagagaatttggtttgtgtatgggttttgtagatttaatttgttttttagtagtagatgaggtttgataaagtttttgaattggtttagttttaattttaagaattagttttttattagggattagatgagtagggatatgaataagagagttatattttagggttgtagaatttattgggtatttgaaattagaaagtagttgataagaggaagttttttttgatagtatggtagagtcgttgtggtagttgaattttaatttggttgtatattagtattttttgggggattttagaagttcggtatttaggttatagtttagtttagtgaatttagaattttagggatagggttttggtgttgtttttaggttttttaggtgattgtaatgtgtagttgagtttaagaataagggttgttggattttattatttggtgatatggtataggttaaatttatttttagaagttagacggtttttgtttttgaatgttaggggtttttttcggtaggttagtgtgaaaggttaagtatgtttgtagtagtttatatttagttatatgaagtggagttagatttttagattaggagtcggggagagtggtagtgtgttgtaatagggataggaagtattattattttttatgggtatttttggggattagtaagtaggtgtgattagttgaagggggtagtaaaaggggttagttaggaaaggagacgtttatagttaggggtagattattgagagtttttgtagaggtttaggatgaggcgtaacggagttgggttttgttgattatataaattgaggatgaagtaggaaagtgagaataaagttataataatcgtaataattaggtattagatgatagaggggtttgggggagggaagatttaagagagattgaagaattaagcgaagattttggaggtagtttggatattggtggaggtagtttttagattaaaggtgtggattagtaaggtttaggtttgtgatgtgatgttagggttatttgtatttgttttgtgaaaatgtttataagatagttaaatgatatttgatattattttatagaatgtaagaatatgcgtttatttagaagttattaaggttgtgatatgggatgggattggatatttgagttatgaaaatagagataaatgtaagtatgtaagtagttgaggaaatatatgttaatgtttgattatttatttttattaatatagtatgtttcggggttagtttaaatatcgaaggtaggattttaaaaggaggttgtttaataaagtcgacggttgtaatggttttaaagaaaagtagattatttaatagtgtggaagatattgtaaaagttagtatttagattgtaaattttttttttttaaatatttattttgtaatgtgaaggaatttaaggattatttagttatatggtaatgaaaaaattgaggtttatttatttagtaggtatttatttagttattattaggtattaggtgaggttttgaaggttaaggagagtaagttttagaatatttgtgaagagttgattattgataggaggtataaggaatattattattaagtgattgggatataaagtgataagcgtgtgagaaggttttatttaggaggtgagttgagtgggtttttttttgggtttttaaagtatattgttttttttttatagtaatatttagtgttataggtgttagtatatgtgtttgtttttaattttgatttatttttggttataagtttttgaggtacgagagttgtagttttagtgtttatataagaagttatttagtatgttagggatataaatttatgtttataagattttggttagtaatagaaatgagtgaaatgttttttttggaatattttgaaatgttattttttagatgtattttttgttttttgggtataaataaatatttttgttatgagaaaaataatggtgtgagtatgttaatggatggtgttagtgttgatggatggtgtgagtatgttgatggatggtgttagtgttgatggatggtgtgagtatgttgatggatggtgttagtgttgatggatggtgttagtgttgatggatggtgtgagtatgttgatggatggtgttagtgttgatggatggtgtgagtatgttgatggatggtgttagtgttaatggatggtgttagtgttgatggatggtgtgagtatgttgatggatggtgttagtgttgatggatggtgttagtgttgatggatggtgtgagtatgttgatggatggtgttagtgttgatggatggtgttagtgttgatggatggtgtgagtatgttgatggatggtgttagtgttgggatgtttttgggattggtggagttgggtatttaggataaggtatatagggtttgtttttagttttggttaataggtttatagtgaattttggttttggtttttatattttttagttttttaaaggattggaaatgtagaattttatataaaatttttattttttttttttttttgagatggagttttattttgtcgtttaggttggagtgtagtggtgcgatttcggtttattgtaatttttatttttcgggtttaagtgattttttttttttagttttttgagtagttgggattataggtatatgttattatattcggttaattttttatttttagtagagacggtgttttattatattggttaggttggttttaaatttttgattttaggtaatttgtttgttttagttttttaaagtgttgggattatatgtgtgagttattgcgtttggttaaatttttttatttttaaatgttggtttagaaaatgttaagtgttgtgttaaataaatattagtagaatttggttaaagggtagttaatttgtaatttttgaattatttagttatttgttataataaagaaggattgaatgagtgaatgtagttatatttgagttagggtttgaaggataagagaggtgatatcgtttgtttagtatggtataggtattagtgatataattagaattataatattggatttttatatatttatttttattcgggttgtggtagttgtatagagagtttataatattttgcgttttgtgtgtttttaattataggtatattttagtaagtttttttgggggttattttttttgatggatttgtaatttttttagttagtaatttgtgattatttattttgaaatttagtggtggttagtttgttttgggtataatgtagaatttgttaatattgaaatttatatttttgtagatgaatttggttattttgatttttttaatgaggtagtaattatagtttaatatcggtgatattgtagttataggagaatatgtgtaagagaaataataggttatttttaataggttttattgttatgttttttttgaggtatagttagagattaggatagttggttttagtttagtattttatgtagagaggatgagtggggatatgttttgattttatatttatttgggttttgtttaggttgttgttggttatatggtaatagtgttatgggattttatttatttttggttagagtagtagaagttagtgtttattgtggatttatgtttagttagggttatttagtatggtttttgggggttatggtagaagtaagggggattacggttttaaattttagtttatgtttagttgtagaagtttgtcgttgagggagtttagttgaagttagttttgttaaggatttttatttttatagttacgaggataacgacgatttgttaggattttttagggtgtataggtattttttttttgtttattgtggtataggtttttttagggatgtttataagttagtaaaatttatggtggggttagttggattgttggttttattttttgttgtgagttaatttttattgagaaaatttaaaagtaagtagaataattatggtttgatattgtggatggttatagaagttgttagtagttttttttgtaggatttacggtttttgtttaagagagttaagttgtgtgttgatataaagggaatttgagaggtaggtagtttttatggggattttttaattttaattgaatttgtgggaagttacggtgtatatttatatgttagtacggggggcggttttcgggtttgtagggggattagaagtgtgtgggttgattgggtttttattaaaataaaattattaaaatttttaaggtagtcgggaaaaaattggataatgtattggtaggttattttaggagttattattttatttttttttgggaatatttttgtgtatgataaaagtgataagtgaggattttgggagtagttagttattagggtttgagtttagttggtatagattttagttttgttagggttggttttgtaagtgttttttgggttaaagttacgttgatggtaggaaaagggtatgcgaggggagtaggttgtaagggtggcgattttaggtaagtatgttagagtttggggggaaatgatattatttatttagaaaggttaggtggggttatgtttggttttatggtttagaatttttttggtggatagtagagaaatttttgagatttttgaacggggtgatatgattagagttgtttttaagataaatattgtgatattaaagtaggaaggttggttggggggttgttgttgaggtttaagtgaggaatagagagggtttgattgaggagaatggtagtacgaggagtggggagatagtaggattagtgtttgggtggaggcggttaggagaaaggagttgttaaggttttgaggatatattgttggtggagtatgaggagtttttaaggattgttgatggggggagtttaggtttaggttgtagatttagggcgggagttagtaattggtagtaagtttagtaagtgattttgaggtaatttttaaagtagtagtagtattgttattgttattgttattattattattattatttttttattattattattattattattattattattattattattattattattattattattattattattattattattattattattattattattattattattattattattattattattattattattattattattattattattattattattattattattattattattattattattattattattattattattattattattattattattattattattattattattattgttattattattattattattattattattattattaatattattattattattattattattattaatgaatttataaatattgaatttatttagttttagagcgaagtatggcgtggaaggcgggaggattcgtaggtagcggttggtcgtggtggtgttttgtagcgtaattattatttgttgaaaggtaagatgattttttttagatagtaatatttatagacgaaatgatacgatgtttaggatttattttaatatgagaagggggtagaggtagaaatgaaataggtttggttatatgttggtaattgtcgaagttggttgaggggtatatggggatttattatgttattttatgtatttttgtttgttttgggaagtttttatagtaaaaaataaaatataggttaggtgtggtggtttacgtttgtaatttcggtattttgggaggttggggtaggcggattatttgaggttagaagtttgagatttgtttggataatatgaagagattttttttattaaaaaaaaaaataaaaaaattagtttaaaattttaaaaataaataaataaaatataaggtaaaaatgaaggtaggaatagatttgttagaattttgagtttaagttaagttattgtattttttgtgatttgtaggtatatgtttagatggtttgaagtaattgaagaattataaaagaagtgaaaatgttttgttttattttaattgatgatattttattataaaagaagtgtaaatggttggtttttgttttaattgatgatattttattataaaagaagtgtaaatggttggtttttgttttaattgatgatattttattataaaagaagtgaaaatggtttatttttgttttaagtgatgatgtgattttatgaaagttttttttttggttaattttggtttaaaaagtttttttattgagtattttgtaatttttatttttgtttgttagagaataaattttttttgattgtaatttttttttatttatttaaattttataaaatagttttattttattttttttcgttgattttttttttagatttagtttatttgtatttaggtgaaataaatagttttattgtttatataaagtttgtttggtggtttttttatacggacgtatatgaaattatttacgattttaggtttttagatcgatgagtttaagaaatattttattaattttaaattcggtaagcggtttttttttatttttttttttaattttttttattattttttaatttttttttttttttaattttggtgttattttttaatttttttttttttttaattttaattttttttattttttggtagagataaaggagatacgttttatttgtggatttaaaatttcggcgtcggttacggattgggaaggtagttttttcgtagtgtttaattattgtagggatatttttttgattatttatttacgttttaaaggtgttagattacgtagggaggtttgttttggttttttatttttagcggtaagtttcgtttttttgggggaggggtaagtattttaattttttttttttatgtttttattttttttttgtttttttgggggaggggtaagtattttaattttttttgagtttttattttttttttgtttttttgggggaggggtaagtattttttaatttttttttttttatttttagcggtaagtttcgtttttttagggggtaagaatttttaattttttatttttatattttaattttttatttttgtgttttaattttttattttcgtgttttgattttttttttatttttttggagggttaagaatattcgaatcgggacgggtttcgcggggttcgagggtaaggagtagtcgtttgttttggttttttaaagtgtcgagattgtagtttttgttcggtcgttatttcgtttgggaagtgaggagtgtttttgtttggtcgtttatcgtttgggatgtgaggagtttttttgtttggttgtttagtttggaaagtgaggagcgttttcgttcggtcgttattttatttaggaagtgaggagagtttttttttagtcgttattatatttaggaagtgaggagcgtttttgttcggtcgtttatcgtttgagatgtggggagcgtttttgtttcgtcgttttatttgggatgtgaggagcgtttttgtttggtcgagatttcgtttgggaggtgaggagggtttttgttcggtcgtttcgtttgagaagtgaggagattttttgtttggtaattatttcgtttgagaagtgaggagttttttcgttcggtagttgtttcgtttgagaagtgaggagttttttcgttcggtagttattttatttgggaagtgaggagtattttcgttcggtagttatttcgttcgggagggaggtgggggggggttagtttttcgttcggttagtcgttttattcgggagggaggtgggggggttagtttttcgtttggttagtcgtgtcgttcgggagggaggtgggggggttagtttttcgttcggttagtcgtttcgttcgggaggtgaggggcgtttttgttcggtcgtttttattgggaagtgaggagttttttagttcggttagttatttcgttcgggagggagatgggggggttagtttttttattcggttagtcgtttcgttcgggagggaggtgggggggttagtttttcgttcggttagtcgtttcgttcgggaggtgaggggtttagttttttgttcggttagtcgttttattcgggaggtgaggggcgtttttgttcggtcgtttttattgggaagtgaggagtttttttgttcggttagtcgtttcgttcgggagggaggttggggggttagtttttcgttcggttagtcgtttcgttcgggaggtgaggggcgtttttgttcggtcgtttttattgggaagtgaggagtttttttgttcggttattatttcgtttgggaggtgtgtttaatagtttattgagaacgggttaggatgataatggttgttttgtggaatagaaaggcgggaaaggtggggaaaagattgagaaatcggatggttgtcgtgtttgtgtagaaagaagtagatatgggagattttttattttgttttgtattaagaaaaatttttttgttttgggattttgttgatttgtgattttgtttttaattttgtgttttttgaaatatgtgttgtgtttatttagggttaaatggattaagggcggtgtaagatgtgttttgttaaatagacgtttgaaggtagtatgttcgttaagagttattattaatttttaattttaagtaattagggatataaatattgcggaaggtcgtagggttttttgtttaggaaaattagagatttttgtttatttgtttatttgttgattttttttttattattgttttatgattttgttaaatttttttttgtgagaaatatttaagaattattaataaaaaataaattaaaaaaaaaaaaaaaaaaaagaatattcgaatttttttttttcgtgtttttacgtttttttttttttgtgtttgttttttttattatgggtaattttttattttttatttttttttttttttttttagtttgtgtttttaagaatttaaaagttttttaatttatatttgatttaaaatttaaatgttttgtttttttttgtaatatcgtttggttttaatataaattcgatagtagttttaaatagttggaaaacggtatttttaatttttttattttataagatttaaataattgttataaaataggtaaacggtttgaggtgtttgatgtttaggtatttttttatatattagtttttttttagtttttgtgtttaatgtaattcgttttaaattttttttttttttttttcgtttgtttttttagttttaattttaagtattattgagtttttttaattttttttttttatagatttatttgattttttttttttttattaggttaagttaggttttaatttttttttagtttttgtttttttattttataatttttttattattttttttttttatatttggttcggtttatagtttcgtttcgtgattagtttttttttatttgtttagtaatttatttttaaaaaggtggttggagttaaaggtatagttaaggttaatgtttttttttttttattttaaattagatagtatttaggtttttttattaaatataaaaatttagtttagtttatggtttttttagtagtaattttgagacgttttatagttttagattttaaaaggttaaagggttattttatttttaatatatattttattatttaattcgtttttgatattaaatataattttaaaaattaaattttagtttttaaattttataataggatttaattagttttatttttaaggtgtataataatagaaaaaagttgtaattttttgtttttattgtgagataaattttagttatatttttagtatacgagaatttttaaacgtttgaatcgtagtagttaggtatttttttagaatttttttttttaggagtttgttacgagtgttagaaatttgattattaggttaaggaatgtttgtaattcgggattttttttaagttacgttttatttgtgtgggattttattggaaatcggattgtttaatttatttggtagttatttttagagtttttggaattttggtttaaggttttttgattgatttttttttaggtttttttggtttagtgtttgaagattgatgttgttcgatcgtttttaaagttttttagattattacggatatcgagttttgggtaatttttatagtggaaggtaagtttgttttttttttaattaatacggaggttatttattttatattattttatttttaagggtttgttttttttgtttttataattgttgtgggtattgatagttaggtttttaaattttttaaaattttttaattttggtgttaatttagataatatttttttaagtattttttttagttatttttatttgtttagtttttttattaggtcgagatattttaattaaattatttgtttttttgattatttttggattatagttatattttattgttgtttttttttttaatttaaagttttttttgggttttttttttgtatttttttattttaatttataagtataagatatttttattttttttttggcgatcgattatgtattttttattattttattaaaatttaattatttttatttcgtttaatgttaatattttattttatagtatgttttgaaaggattaaagtttgttattattcgtttgttatagtatggttttttaaagtttataaattttttttataatttttttattttatttgttttaaaattagataagttttataagttagtttaggatttatgttttattaattaaattgttttgtttatttattttatggtgttaaatttatatatttttttgtttttaatatttttttttattatttattattttgttttggattttaaatatgttttttttattatttttttgtattttttattttagtttttttttgtttttatttagattgattttgatatttattaggtttagtaaattatttgggttgtattgtcgtaagattttatagatagattttattattttagttaagtttaaatttcgtttttatttgttatttatttcggtataatttttataaaaatatacgtgttttttttgttgattgtgtttaattaattttttaaattttaatttgttataaaataataattttttttttttttaggtatggttagtgtagtcggattttttatataagagttaggatcgtattttgtagtttttttgtttaaataatttgattttattgttttagtttagtttttatgtttgcgtgtagcggttgttgttgttttaatatttttagaagttttaaaaattataaattatgtttaatttattttttatattttttataatttttaaaatttatttttttttttatatttgacgtatatattttttgtttttcggtttttttagttgtatttattttttgttaagttttatagttattattgtttttggttcggattttaatttggttttttatattatttttgataatatatttgatttttatgattgtatttttttgatttatttgatatttattttatttttttatattttttttttttttgttttttattttgattatgtttgatttattgatggtagttttattaggtttaatcgttatatattagtaaaggtaggttatgttatagtataagttattagttcgttttttagaattttttattttttttttattgtggaaatttattttcgaggaaataattttttagtgttttatttgttattttattattttttagggattatttaggtttttttttttttttatatattaagtttgaagatttgtttttatttaggattggtaaattagttttatttaatatgttttgagttagataattaaaatattttttagtttaagtagatatttttattagataagtagaggttttttttatagggtttgagaaggttattttagtaatttttttttttttgttagatataattttttagtttagtttttttatttttatataatttgataatagattagtttttatttgttaaattagttaagtagttttttaggaaatttttatattttttacggttttttgtttttaagaaaagtagaatagattaaaggttttttaaaaataaattttattaagtttagttattaatttaaaaaggattggataatatttttattattttttttttttagaaattagatttgttttcggaatgttataaggtatagtttatttgagtttttttttattaggttttagttttattttagatattggattaatttagattgtgttttaaaaatatttgttatttttattattttttgtttagttatatttttattttttatttttaattatttatatatgttttgtttttgtttatattgtcggtttatattgtttttttaagttattatagttgatattttttcgtgttatttttaaattgttatttttaatttttgaagtaaataaataatttttgttggtaggattatgttgaatttttttaggtattttttaattagatgttttaggtttttttagtttttagattttttatatttgttttttttttttttttattttatttagttttttaatttatataaaattgtatttaggttattattaataattttatataataaatgttttttttaataattttataatattattttttattatagaatttttttttagtttaattttttttattttaggtttttacgttgtttttaattttgattaaagtagttttgagaaatatcgtttattatcgttttatattattttttaaaatttttgttgttttaatattttattattattttgttttattttttttattaatataagaaggtaggaatgttaggtttttgagtttaagttaagatattgtattttttgtgatttgtatgtatatgtttagatggtttgaagtaattgaagaattataaaagaagtgaatatgttttgttttattttaattgatgatattttattataaaagaagtgtaaatggtcggtttttgttttgagtgatgatattattttgtgaaagttttttttttggtttattttggtttaaaaagtttttttattgagtattttgcgatttttatttttgtttgttagagaataaattttttttgattgtaatttttttttatttatttaaattttataaaatagttttattttatttttttttattgattttttttttagatttagtttatttgtatttaggtgaaataaatagttttattgtttatataaagtttgtttggtggtttttttatacggacgtatatgaaattatttacgattttaggtttttagatcgatgagtttaagaaatattttattaattttaaatttggtaagcggtttttttttatttttttttttaattttttttattattttttaatttttttttttttttaattttggcgttattttttaatttttttttttttttaattttaattttttttattttttggtagagataaaggagatatgttttattcgtggatttaaaatttcggtgtcggttatagattaggaaggtagtttttttttgatgtttaattattgtagggatgtttttttgattatttatttacgttttagaggtgttagattatataaggatatttgttttggttttttatttttagtggtaagtttcgtttttttaggggaggggtaagtattttaattttttttttttgagtttttattttttttttgtttttttaggggagaggtaagaattttttaatttttttttttttatttttagtggtaagtttcgtttttttagggggtaagaatttttaattttttatttttatgttttaattttttatttttgtgttttaattttttatttttgtgtttcgattttttatttttgtatttcgattttttatttttatgttttgattttttatttttgtgttttaattttttatttttacgtttcgattttttttttatttttttggagggtaagaattttcgaatttttttttttcgtgtttttatttttttttttttttgggtttgttttttttattatgggtaattttttattttttatttttttttttttttttttagtttgtgtttttaagaatttaaaatttttttaatttatatttgatttaaaatttaaatgttttatttttttttgtaatattgtttggttttaatataaatttgataatggttttaaatggttagaaaatggtatttttaatttttttattttataagatttaaataatttttgttaaaaaataggtaaatggtttgaggtgttttacgtttaggtattttttatattttgttttttttttagtttttgtttttaatgcgattttttttaaattttttttttttttttttcgtttgtttttttagttttaattttaagcgtcgttgaatttttttagttttttttttataggtttatttgatttttttttttttttttaggttgtttatggttaggttgagttaagttttaatttttttttagttttcgtttttttattttataatttttttattattttttttttttatattcggttcggtttatagtttagttttgcgattagtttttttttattcgtttaataatttttttttagagaggtggttggagttaaaggtatagttagggtatatgtatttttttttttattagattttttttaaattagttagcgtttaggtttttttttattagattttattaaatatatataggaattttgatatttaattttgttttataatttaatttggagtgatttaaatgttattttgatttttattttttttttagatgaataggaaagagttttttttttagtttaattttatgttgataatcgtcggttttatgaatttgatttttaggaaggtattagagtagttttttaagaggatttttaatggaattattagataaattttttaggtatagttaggtaagattatatgattttttgtttagttgaaaggtttaaaaaggtagtttataaagttgttaattttgataagtttaaagaaattatttaaggtaaagacgaaaatttagtttagtttatggttcgtttaagtagtaatttttagacgttttatcgttttagatttagaggggttagaaggtcgttttatttttaatatgtattttattatttaatttatttttgatattaggaaaaaattttaaaaattagaatttggtttttaaattttataaataggaattaattaattttatttttaaggtgtataataatagagaggaagtagttagatggtaacgtatttttgagttataattatttgtttttgttgtgagataaaatttagttatatttttagtatataagaattttaaaatgtttaagttgtagtagttaagtatttttataagattttttttattaggattttgttttaagtgttagaaatttggttattaggttaaggaatgtttgtagtttaggattttttttaagttatgttttatttgtgtaaggatttattggaaggtagattgtttagttcgtttagtagttatttttagagtttttaaagttttagtttaaggttttttgatcgatttttttttagatttgtttagtttagcgattgaagattgatgttgttcgattattttagaatttttttagattattatagatgttgagttttaggtaatttttatagtggagagtaagtttattttttgtttaatcgatataggggttatttattttatgttgttttttttttaaaggtttgtttttttagttttaataattgttgtaggtattgacggttaagttttaaaatttttgaaaatttttttattttggtgttaatttgggtaatatttttttatgtatttttttttagttatttttatttgtttagtttttttattaggtcgagatattttaattaaattatttgtttttttgattattatagtcgtattttattgtcgtttttttttttaatttaaagttttttttgtgtttttttttcgtatttttttattttaatttataagtataagatatttttattttttttttggtaattgattatatgtttattattattttattaaaatttaattatttttattttatttaatgttaatattttattttatagtatattttaaaaggattaaagtttgttattattcgtttgttatagtatgggtttttaaaatttaaaaattttttttataatttttttattttatttgtttaaaaattagataagttttatagattagtttaggatttgtattttattaattaaattgttttgttatttattttgtggtgtttaatttatatatttttttgtttttaatatttttttttataatttagtgttttgttttcgattttaaagatgttttttttattatttttttgtattttttattttagtttttttttgtttttatttggattgattttgttatttattagttttagtagtttatttgggttgtgttgtcgtaaggttttagggatagtttttattattttagttaagttttttttcgtgatttattttttttttattttttcgttttttattttatttaatatattgatgatttttttttttgtagttttttttttgaatttttttaataagatatatttttgtttttttaatatttattttttaaaggatattaggtatttttttttaaaatttaaatgttttttttatttattatttatttcggtataattttttataaaaatatacgtgttttttttgttaatcgtgttcgattaattttttaaattttaattttttttataaaataataattttttttttttttaggtatggttagatattttcgtttttagatatttggttttgttattttaataaaattattatataaatttataaaaggaaatttagttgattttatagattttaaattttttttttatttttttttttgttttttgaagatagttttagagattgtttttattttagttttttttgatttattttaattttttttattatatatagtcgaagtgtagggttgtgtagttagaatttttatataaggattaggatcgcgttttgtagtttttttgtttaaataatttgattttattgttttaggttggttattatgttttcgtgtagtggttgttgtcgttttaatatttttagaggtttttaaaattataaattatgtttaatttattttttatagtttttataatttttaaaatttatttttttttttatatttgacgtatatattttttgtttttcggtttttttagttatatttatttttcgttgaattttttatagttattattgtttttggtttggattttaatttggttttttatattattttagatattatatttgatttttatgattgtatttttttgatttatttgatgtttattttatttttttatattttttttttttttgttttttattttaattatatttggtttattgatggtagttttattaggtttaattgttatttattagtaaaggtaggttatgttatagtattttttatatttattattgaggttattattttgtttttttttattattttttagtaagttagattagttgttttaatttaagtttttatttttggaaaaggattatgcgttaatatttatattgattttaaatatgttttttatattttgtattattatgtggttatataggttgaaagaggtttttttattatataagggttttttattattaatgtttttttaataaaaattttatttaaggtttttttatttttaaaggaggttaaggttatttattgtaagaggtattaaaaggcgttagattttattgttttaagtaacgtttatgttgataaggtggttagataagtagttagttttttaatttttgttttttagggttagttttttttttttatatcggttatttttatttattttttcgttgaaatttttatttattaatttttttttatataaggtaaatagtttttagattaaggaaaatatttttttttagttttataggtttattttattttgtcgttattttataattttttttatgtaggttataagtcgttagttcgttttttagaattttttattttttttttattatggaaatttatttttaaggagattatttttaaattaagtaagtaattgcgttgaatttttttaggtattttttaattaaatattttaggtttttttaatttttagttttttaatatttattttttttttttttttatttagattttgtatttttcgtttagttttttaatttatttaaaattatatttaggttattattaattattttatataataaatgttttttttaataattttacgatattattatttattataagatttttttttagtttttttttttttattttaggtttttacgttgttttaatttcgtttgaagtagttttaagaaatatcgtttattttttttttttatattattttttaaaaattttcgttattttaatattttaatattattttgttttattttttttattaatataagaaggtaggaatgttaggtttttgagtttaaggtaagttatcgtattttttgtgatttgtatttatatgtttagatggtttgaagtaattaaagaattataaaagaagtgaaaatgttttgtttcgttttaattgatgatattttattataaaagaagtgaaaatggtcggtttttgttttaagtgatgatattattttgtgaaagttttttttttggtttaaaaagtttttttattgagtattttgcgatttttatttttgttcgttagagaataaattttttttgattgtaatttttttttatttatttaaattttataaaatggatttattttatttttttttattgattttttttgtggacgtagttcgtttgtatttaggtgattaaaagtttttattgtttatataaagtttgtttagtagtttttttatacggacgtgtatgaaattgatttattgtttaaaataataattattatttatgagtatttgttttgtatttttttaatttcgtaataattaggaaaggtgggaattgtttttattttatagttgaagaaattggagtttaaagaggtattagttaggtttgagtttaggatatttggttttaaagttttgtttattttattttttatttattgttttttttaatacgtatttttgaattattttttttatggatataaagagtgttatggtatttttatgttaggatgtaattgggttttttacgtaatttatttattttttttaagttttatttttttttttgttattttagattgggagatttttaagggtaaggtttagatttaattttttaattgtatttagtatagtgtgtagtatattaatataggtatatattttttgttaatattttgtgaaatgttatattagaaaataatgtataaattataatatgatagaagttatgtttttattatttagtttaagaaataaaatattatagataaagttgaaattttttattagttttttattagataaaaattgatataaatatgaagtatgtttttttatttttatttatagatttgtatttttaaattagtatttatattaatttttggttaatattatatattatattaatttatttgtgaaatagttggtgggaattagggtgtgagtattatgggatggtattgttataattattaaggtttttattagtggttaattgaaatgaggtgtaggtggaaggttagggagtgaaatatggtagttgtggtggttgtaaggtttgggatagtgattattataaggattgtggtatggattggttttttttaatagtattggaagttttggaggaaaaaaataataggtttagtagagttaattgttaatttaaggtttgttgtgaagatattttttgcgtttttgggttttaaagaattggttgcgtgtgtgtgtgtgtgtgttgttttttattgtttggtttggtttgttgttttttatttagtatttttgtatttatgtttttaagattggtatatatttttatttggtgttaaggtaattaggtttattatttaataatgatggtatattttttttttttttagtttttgaaatagttttataaaatagggaatagttcgaatgttttataatttgtgtttgtaaaatgatttgggtttggtgtttttttttgtggaaagttttgggtttttttaaattgtttttttttaagttggatagttatatggtttaaagagttagagttcgataaggttttgaaaatagaatattgttttttttttttggttttattttgttattttttattttttaaagataaatatttttttattttttagttgattattttggtatttatttttatgtttttaaatagtatattatttttgtttagttttaggtattaattatagatggaggatatggatattttttttttttttttttatatttgatttattatatgatacgttttttttattttttatgtttttaatatagttatattatattattggttagattagtaatttatgttatatttaagttattaagtaattgttatttatagttgagtatgaggtgatttttttttttgttttgtataatttttggtttttttggagtgaataattaattaattattttgtttgttttgtgtttattaataatttaatttttttttattattttataaattttttttttatatgtttaggtgtattagggattttttttaatgttatttttataaattaattttttttagagttttttggttttttttaatttgggttagttgtttattatatttattgttattatataggataatttttagagtagttttaagatatatttataagttttttgatattgtttttattagagatgaagtttaggttggatattggtttacgtttgtaattttagtattttaggaagtcgaggcgggtgggttgtttgagtttaggagtttgaaattagtttgggtaatatagtaaaaattcgtttatataaaaaatataaaaattagttaggtgtggtggtttgtatttgtagttttagttttttgggaagttgagttgggaggagttgtttgagtttaggaggtagaggttgtagtgagttaagattatgttattgtattttagtttgggcgatagagttagattttattttaaaaaaaaaggttttaaaaaaaaagaaatgaagtttatatatttttttttgaatttggatgaattttagtgatttgtttgtaatttacggtatgtagaggatgtagtgttgtgtaatttataagattaggttataaaatgtgatgtaattttttttttgtttgttaggatatttatttagaagtgtagatatttggttaggtataatggtttacgtttgtaattttaggattttgggaggttaaggcgagtgaattatttgaggttaggagttcgagattagtatggttaatatggtaaaattttttttttattaaaaatataaaaaattagttaggcgtggtggtgcgtatttgtaattttagttatataggaggttgaagtgggagaattgtttgaatttaagaggtagaggttgtagtgagttaagattttgtaattgtattttagtttgggtaatagagtaagattttattttaaaaaaaaaaaaaaaaaagtgtagatatttatttgtattgttatgtaaaagtttgattaatttgagattgttatattgtaaggaagtatagtttatatagagaagttatgtggtgtagatattttggtagatagttttagttttttatttataatagtattaatagtattaattttaatttttatgttatttttaagtattgattttttttagtaatggttttagatattgtggaataagttatttttattgtgttttttttgaattttttatttaaagaatttgtaagtatgataaaatgattgttttaagttgttgagttttgggaaattttgttttgtagtaatattaattgtaaaattttttaagagttattaatttggagattttttttattttttttttatgttggattttttggtattatattttatgtttttttttttattggtttttttatttttattaaagaagtatgttttttgggaggttttagagaaagggtatatgggatataaatttttaaagattgaaaatttgaattgtttttatttttatattttatagtttagtcgggtaaataattgttatgaatattaaagggatgagaattagataagtaggtaaagattagaggaaagattgttttatagtagtttatgtttattttatttatagttttaggatttttaggttttgagtataggtttttatagtaggtatttgaaagttttgaagaagaatattttttataagtttattagtagtttttttttttttttattttattttttaattgatatgattttagttttttttttttgggtgtttgttagtttttataattgtttttaaaacgtgatggttagatatagaagttttagatatagaagtataaaagataatatattattgttaagtttagggagtaagtaaaatgttttttttaatgtttagtatatagagttattatattggtttgttttttgttatgagtggttgagatattttttaagaattatggataggtaagtgttttttaaattataaaatgtaatttatgtgtatgtgaagggattgttattattaggtttagttgtttttgtatttggtgagtagagttggtgattgttaagtttggttttgatttgattttttaagaaggtgggaagtttttaaaagaaagaagttgggaaaaaggaatgaggaaagtttttgtttttgtaggaattattggatatattgttaagatgtagaggatagtaagaaggaaagggggtttaattatatatatatatttgtttatggtttaaaaagaaataatggaagaatgtaaattaatagaaatagttatttatagatattaggagagtataagaaagaggaggaggtaggaattaaagttagagggaaagttttattttgttttttaaatggaaaattaagttaataaatgtagatggaataatagaattagaaattattattttgtaagttttgattgaagaaaaaatggatttggataatagttatttggtagttatttaggttgttaattattaagtgaaagtttgataagaattttatagagaatgaattagaattttaatatttgatgttatttataattgattatgggaaatttagattttatgtttttttttgatggattgtaataagaaatatatagtattattaaggaagtatttttgttaaaaaagaggaaaaatggaatttgaattttattaaatttttatatttaatgattagtttgtggaaaatatggaagataaaagaatacgtttaatgttattataataacgtaattagttaaatttagggtgtacgaaattgtagtttttttaataaataaatggtatttttaaaaagtaggaggtgggagaggaattattattaattaaaggagaattaagagatattttaattaaatgtaatgtttagattttgatgtaaagaaattaaatataaatggatttttttttaaaataaatgaagattagatatagatgggtattagttgatattaaggaattattattaatatggttgggtgtgatagtggtattatggttattttttaaaatttttatttgttagagatattaattgatgtattaattgaagaatgatatgatattatattttttttttatgattttagtatatatatgtgtatatagatgtgtatatgaagaggttgtaggagtaatagataaaattagattggtaaaatgtagataattgttgaagttgtatattgggtatatgaggagtagttatagttttttttttagttttgtgtatagttaaaaattttcgttttttttttttttttttttttttgtacggttttttttttttttttttttttttttttttttttttgtatagttttttttttttttttttttttttttttttgtacggtttttttttgatgtcgagcggaggttggattgtattgtcgttatttcgatttattataatttttttgtttgatttttttgttttagtttgtcgagtgtttgcgattgtaggcgtgcgtcgttacgtatgattggttttcgtgttttttggtggagacggggtttcgttgtgttggtcgggttggtttttagtttttgattacgagtgatttgttagttttagtttttcgaggtgtcgggattgtagacggagtttcgtttatttagtgtttaatgttgtttaggttggagtgtagtggtatgatttcggttcgttataatttttattttttagtcgtttgttttggttttttaaagtgttgagtttgtagtttttgttcggtcgttattttatttaggaagtgaggagcgtttttgtttggtcgtttatcgtttgggatgtgaggagtttttttgttcggtcgtttagtttgggaagtgaggagcgtttttttttggtcgttattttatttaggaagtgaggagcgtttttgttcggtcgtttatcgtttgggatgtggggagcgtttttgtttcgtcgtttcgtttgagatgtgaggagcgtttttgttcggtcgcgatttcgtttgggaattgaggagtgtttttgtttcgtagttatttcgttcgggaggtggggggtagttttcgttcggttagtcgtttttttcgggaggtggtgggggagtttttgttcggtcgtttcgttcgggaagtgaggagtttttttgttcggtcgttatttcgtttgggaggtgtatttaatagtttatggagaacgggttatgatgtcgatggcggttttgttaaatagaaaagggggaaatgtggggaaaagaaagagagattagatttttattgtgtttgtatagaaagaagtagatataggagattttattttgttttgtattaagaaaaatttttttgttttgggatggtgttaatttataattttatttttaatttcgtgttttttgaaatatgtgttttgtttatttagggttaaatgaattaagggcggtgtaagatgtgttttgttaaatagatgtttgaaggtagtatgttcgttaagagttattattattttttaattttaagtatttagggatataaatattgcggaaggcggtagggttttttgtttaggaaaattagagatttttgtttatatgtttatttgttgattttttttttattattgttttagattttgttaaattttttttttcgagaaatatttaagaatgattaataaatattaaaaaaaaaaaaaaaaagaaaaaaaaaagaaaatttttataataaagattttttaaaaataagaaagtagatggggtgggagttgtaaagaaataagatgtttattttataaattggattaattttataatttgtgaaaaatttaattggtggtttagttagaaatattggagtattagtataattgtgggatgaaaaaagagggggagaaaggttgttagttttatttatataatgaaatagtaggtagtgattgattaatgtaaaaataaatatataaagattattaaagatatttataatatattatttgttggggggtttttggattttattgttaatgtaggttataaaataattttatagtatgatttaatttttgtgaagatataagtagttatatattttatttttaatatgtataggaaaaattttatatgtttaaatattaataagtaagtgggtttttaatataggtattttaaatattagttttttttaattttttttttttttttttttttttttttttttttttttttttttttttttattttttttttgatagggttttattttgttatttaggttggagtgtagtggtataattttggtttattgtagtttcgatatttttgtgtttaggtgatttttttattttcgttttttaagtggttgggattataggtgtatgttattatatttagttagtttttgtatttaattttttttaataaaaaatattagttgtttaataaagaaatgttaatagttttaggtttattaaaattatgaatttatgaagtaatttattatttttataaggatagttattgatatataggtaaaggtatttttaaagaaaaattatagtttatattaattatttataattaattaaattttaaatgttgttattatttaagatttatgtttttaacgggattgtttttatttgatttagattgttttaatgtaaataaagggttaatattaatttttattttttaagatttttggtaggttagaaaagtataaatttaggattttggggaaggtttaaaggttatattagtgggtgattttgtagttttgttttgttttgatattgttattttgttttataagtttagggatttttatagttagattaaacggaggattatttaggttaatttttatgggttaggttttttgagagtttaagttagagaaagatatatttttgttttggttttgtattttggaatttttttatcggtgttggtttttttggaggaaaaataagagatttgtttttatatcgagtgttaggaggaaaaaaacggggattttttaggaagtggtttcgattttttattttggtaagtagaagtttgtttagttttttttgtggtatacgtaagtggtttatttagtttttattttttggttgatttgttttttttgaaatatataaaagtatagagttaatgataggtaaagggattgtgtttgttgatattttgattaattgtatgatttatagatggttaatataagttttattttattttgcgatggatttattatagttttttatgttatttgaatgtttttttttttattgtttttttgtttttttaaatattgttttgtatagttttttaaattgattttgagaggttttttggttttttttttggttttaggagttaaattttatgttaggttgtttatagtgtggtttaatttattttcgaatttagtaagtttttttttgtatgaatttttaagttttttgtttagtttttttttttggacggaacgttttttatagttaaatgttagttttgaatatttaggtagggagatgtttatagtattaaggaaataaattgaattattgtaataaggtgaggaggtgggtatttttaagatgattaaataaaattattaaagttatagttagtttgattttttttttaaatttttatatttattatattagttataattgttttttaatatatgaattatttttggaatttattttatgtatttaaaatggttatgtgtggtggtttatatttattattttagtattttgggaggttaaggtgggagtattatttaagtttaggagttgatattagttttggtaatatagtgagagtgagattttatttttataaaaaataaatttaaaaatttgttgggtgtggtagtgtatgtttgtggttttagatgtttaggaggttgagtggggagaattattttagtataggaggttaaggttgtagtgagttatggttgtgtttttgtattttagtttgggtaataaagtaagattcggttttaaaaataaataaataaataataataaaatttaggattagagtgttaaaatattttttaatatggttaaagaatatgagtagattattgttatatatatatgtttgtatatatattttatatatgagtatgttttttgaagagtttatagaaggaatgaaagtttgtatgagttttttatattgttaagattattttttattttttggttaagcgtagtggtttatgtttgtaattttggtaatttgggaggttgaggtcggcggattatttgaggttaggagttggaaattagtttggttaatatggtgaaattttgtttttattaaaaatataaaaaaattatttaggtatgatggtaggcgtttttaattttagttatttaggaggttgaggttgaagtaggagaaacgtttgaatttaggaggtagaggttgtagtagattatattattgtattttggtttgggtgataaagcgagattttgttttaagaaaaaataaataaataaataaataaataagaaaattatttttttaaaggttaaatgagaatatttattgttagtaagaatgtaattaaatggatattattataaattttttagtataatgtttggttaatttttaatatatgttagttttatttttattgatttgtataagatattgagtttttaattaattttaaaatattaagtggtggtcgggtgcggtggtttatgtttgtaattttagtattttgggaggttgaggtgggtggattatttgaggttaggagtttgagattaatatggagaaattttttttttattaaaaatataaaattagttaggtgtggtggtatacgtttgtaattttagttatttgggaggttgaggaaggagaattgtttgaatttgggagatggaggttgtggtgagttaagatcgtgttattgtattttagtttggataataaaagtgaaattttgttttaaaaaaaaaaaaatattaagtggtttagtattttatgatatttgattttgttattttttttttgttttatttttttacgtagtttagattattagtggaattttttttaggagtatttttaattttttagattttaatttttttattttaaatatttttttagtttttaagttttagagaattaaatagttttttaattggagttatgggagagtttgttttttgagtttagtatgttaggtaatttcgataattggttatagaatttatatagggatttttttttgtttacgtgtggatttttttataagtttaattcgttgtttaagtttatattatagttttttattttatttatttttagaatattttgttttttatattataggaaattggtttaatgttatatatatgtatatattttttttgtttttttatttaggtttttttttattttgaaaggatgagaagttgttttttttttgtatgggaaaatttataagtttttgttttaatttattaggtatacgtttttttgtttttttatgtttttagttttttttttttttggtttaattgtaattttaagtatttatataatttttggtattgggtagtagatgtgggtattatagtttatatggagaagtttggattttagttatataggcgggggagtattagtaagaaattggtatgtttagatgtttagatttgatttttttaatagttattatcgaaattaaagaaaaggtgaaaaaaatttttgagtaaggaaatggtagtagaggtggttaacgtggttttattgaattttttttaaatggtattagaggttttgagagtatagaagtattatttttaggtgtagagtgaaacggtattgtatcggtgtagtaattttttggggagattaaatgatgttttcgtagtaattcgttgtttatatattatttggagatattttttattttatagaagggaaggggagaataaggtgtttttagttagattgattttgaagaatttatatttaaattttttttattcgttaagtttaaattatttaataaaatttttttttagaaatttgtgggaatgttgagatttaagaaatttattaagtatttattagttatttaaaagaggttaattattgggtaaagttgtgttgtattatttgagttaaaatattgttatagagaagtttataagaaaatagaattatgagaaatatggtagattgaataaaaggttttagttttttatttttgtttatatttaggtttttgattatgtgattttgtagtgtttgttattagagatagtgtatttttttatttttgattgtggttatgtgacgtgttttggttaatgagatgttagtaaaggtttgaaatgtatttgtgtagttgagtttttttttttgtggttttgttattattgtgataagagtttttttgtttttttattttagattttagggggaatttagagtagatttgagtttgatttacgaaggagatatgtttagttggatttatagtttggagttagtttagttagttaagtttagttagttcggttaattttttattgatttgtagatataggagagagaaaattttaagagaggaaaggtgataattaacgtttatgggtgatgagtttagaaatagtagtaaatatattattatttatataatatataaataatattatttataggtattttaaagaattaaaattagtaatggttatttttggtaagtggattgaggttgggagaggtgaggtggaaaaggtttttttaaaaatagattttatttttagattagttataggtttgtagtaaaattgagaggaaggtataaagattttttatatagtttttgtatgtatagtttttattattattaacgttttttattagagagatatatttgttattattgaagaatttatatagatatattattattatttaaagtttatgtttatattataggttatttttggtggtgtatattttgtgtatttgtataaatttataatgtataggtggaggttttttattttttattagaagtttttttaaattatttgatttttaaaaattatatatatttattattttgataaaaattaaagaaaaaataggaagaatataagatttttttagtttttatatagttttattattatttgttaattattgataggtaatgttggtttgggagtgggtatttttatattgtaaataagatagtcgtttagtcgtttgtatcggtgttggtttgaggtagggatagtgtagatatatttaagagtaagcggttatgtttggttttgcggggtaatttagagtattagaaagtggtgttatataggggattaggattgggtagagagagtattgaaaaattttatttttttttattttattttttaatagatgtttttaggtaagaagatatgggagtgtttgtaagagtgaatggagtaagtaaatattattaggagagtttttggatatttttagggatgtgtaatttaagtatattttataatattttagatatattaagaggaataaagaataatatagtgggtcgggtacggtggtttatgttgtaattttattattttgggaggttgaggtaggcggattacgaggttaggagatcgagattacggtgaaatttcgtttttattgaaaatataaaaattagttaggtgtggtggcgggcgtttatagttttagttatttaggaggttgaggtaggagaatggcgtgaatttaggaggtggagtttgtagtgagtcgagattgcgttattgtattttagtttgggtaatagagcgagattttgttttaaaaaaaaaaaaaaaaaggaataatatagtgagtatttaagtatttataagttattgttaagatagttaatttttattatgttttattttagaaagattatttttaattttgtttttagttggggaaattatttattagagtacgtatgtattatttttatgtacgtttatatttttgaatagttatagatttttaaaaataaataaaatttttgtatgttttaaatataatatgttaaatgttattatattgtatgtgtttcgtttgaattttttttttttgcggattatttttatttttgtgagatttatttatgtgatttatgtagttttttttttttttgagatatagtttcgttttgttatttaggttggagtgtagtggtatgattttagtttattgtaatttttgttttttgggtttaagcgttttttttattttagttgtttgagtagttgggattataggttcgtgttattacgtttagttaatgttttgtatttttagtagagacggggttttattatgttggttaggttggttttaaatttttgattttaggtgatttgttcgttttggttttttaaagtattgggattataggcgtgagttattgtgtttagttgtgatttatgtagtttaaataattgatttttattgttttttagtatatgatagataataatttatttatttatttttttaatgatgtatttttgagttgtttttaggtgtttgttattttaagtttttgaatatatttttttgtttgtatatataagaagtttttaattggatttgttgttattaaggaggtttataaaaaggtagtggtttcgtttattggtttttatttttttttttgatattattattattattttgatgggtgtgaaaggatatttttttggttttaatttgttgattattaagaatgagtatttttatttatttttttatttttgtaaatttttagttatggtttttgtttttttttaagtgagttgtttgttatttttttgttgatttttaattttttatatattttggatattgaatttgttcgttatatttgtttttgtggattttgtttttattttttttttaagatgaaagttagtttattaataaagtaaaggaataaaagaatggttattttataggtagagtagtttgtttttattttttattttaaaataaagaagtttaaaatttaatgtagttggtcgggtatggtggtttacgtttgtaattttagtattttgggaggtcgaggtgggtagattatttgaggttaagagtttaagattagtttggttaatatggtaaaattttatttttattaaaaatataaaaattagttaggtttcgtggtatatgtttgtaattttagttatttaggaggttgaggtaggagaattatttgaatttaggagagagaggttgtagtggatttagattgagttattatattttagtttgggtaatatagtaagattttgttttaaaaaataaaaataaaattaaaaaattaaaaattattaaatttaattatagtattgtttttttttgagatagggttttattttattatttaggttggagtgtgatggtacgattttagtttattgtaatttttatttttttagtttaggtgatttttttattttagttttttaagtagttgggaggcgtatgttattatatttagttatttgtgtgtgtgtgtgtgtgtgtgtgtgtgtgtgtgtgtgtgtgtgtgtgtgtgtgtattttttgtagagattagattttattattttgtttaggttggttttaaatttttgggtttaagtgatttatttaattcggtttttcgaagtgttgggattataggtttgagttagtacgattagtttgaattttttaatgtttttttttattgggtatttaggattttgttaaagaaggttttttatttttagagttatgaagatgtttttttatagcgttttttaggttttaaaatatttagagtttatttgttgtgtggtgttggtgagggttttaattttttttttcgtaatttagataattagggttatttagttaatagagttttagagtttacgttgtttttcgttgtttacgtttttattgattgttttgtttatttgtttattttagaattatattttttttttaggattattttttttttgttggaagtacgttttttagtgagttttttgagttttatttttttgagttttttgttgtgataaattttgttttttatttggaaatgtttttattataagtagatttttgaataattatttattttaatgtttgattttaagttgatggtgaagagttttaagttatatttattgtattatatggttttcggtttttattgtggttgttataaagtttatttttagttttagtatttgttttttgtaatttgtgttttttttttggttgtatttaagattttttttttgtatttggtgttttgtagttttatgatgatatggatgtggatttttgtgttttttgtttttgtgtatttaggtttttataatttatagaaaatttttggttattgttattttaagttttatgtttttatatttttttgtttaaatgtgtgttgtgttttattttgatttttatattttttatgttttatgttttttatttttttggttttttagtttgtattttttttgatttttttttttatttattaatttaaaatttttagttaaaatgggtttgttgttaaatttatagttttatttattgtatttgttatttttagacgttttttttgatttttttttagtttgttaggttattttagtggttttgtggtttttggtttaggttgttttttttttttagtttgtaaatattttaagtatttttagtttaatttaggatgttaaaggttgggttttttgaggtttagtttcgttgtggttttgttgatttattcgtggtggttttttttatatgtgtttggtaattttatttgtgagtttatgtttagttggttttaatttggggaaatttagagagatttgggtgtgttgggagtagttatttattatgtatgtttttattaagtttgtaaagaatattatttttttaatttgggttattttttagggttgtgtttatagtaagtggtttagaggaatgaggttatgttttttttagttaaagtgtaggtttgttgattgtttattgaaaaagtagtgagttttttaattttagtatgtatcggttatgatattagttttattgtttgtatagtatttgtttgggttttttgtgttattttttgggaaatttgtgttagtaagaggtttatgttgtttgttgtgttttaaggatttaggaattttatgtttttagttaatatttgtgaaatattgtaggttagtagattagtttgtaaatagagtagaagttagatttagaaaaacgttagtgtttttaggcgtttgtacgttgtttttatggaggtaggagagttttttagtgtgagtttttttagattacgtagttgttattaatataaattttaaatttttgtttttgtttttgtttgtttgtttgtttttttgttttgtttttttttttagtatttattgattatttttgggtgtttttcggagagggggatttggtagggttataggataatagtggagggaaggttagtagataaataagtgaataagggtttttggtttttttaggtagaggattttgcggtttttcgtagtgtttgtgtttttgggtatttgagattagggagtggtgatgatttttaaggagtatgttgtttttaagtatttgtttaataaagtatattttgtatcgtttttaatttatttaattttgagtggaaatagtatatgttttagagagtacggggttgggggtaaggttatagattaatattattttaaggtagaagaattttttttagtatagaataaaatggagttttttatgtttatttttttttatatagatatagtaataatttgatttttttattttttttttatattttttttttttttatttaataaaatcgttatcgttattatggttcgtttttaatgagttgttgggtatattttttagacggggtggtcgttgggtagaggggttttttattttttagaaggggcggtcgggtagaggcgttttttatttttcggatggggcggttggtcgggcgggggttgttttttatttttcggacggggtagttgtcgggtggagacgttttttattttttagacggggcggttgtcgggcggaggggttttttattttttagatagggcggttgggtagagatgttttttattttttagacggggtcgcggtcgggtagaggcgttttttatattttagacggagcggcggggtagaggtattttttatattttagataatgggcggtcgggtagagacgttttttattttttagatgggatggcggtcgggaagaggcgttttttattttttagattgggcggtcgggtagaggggttttttatattttagacgatgggcggttaggtagagacgttttttattttttagatggggtggtcgttgggtagaggttgtaatttcggtattttgggaggttaaggtaggcggttgggaggtggaggttgtagcgagtcgagattacgttattgtattttagtttgggtaatattgagtattgagtgaacgagatttcgtttataatttcggtatttcgagaggtcgaggttggtagattattcgcggttaggagttggagattagttcggttaatatagcgaaatttcgtttttattaaaaaaatacgaaaattagttaggcgtggcggcgcgtttttgtaattttaggtattcggtaggttgaggtaggagaattaggtagggaggttgtagtgagtcgagatggcggtagtatagtttagtttcggtttttataattttggtggtattagagggagattagtgagagggagagggggaggaggaggcggagggggagggagagagagggattttaaatttttgtaatgggaagttatgtttatatattttaggggagttttggttattttaatgtaagattttagataaatttttttttggattttagtggacggagattttattatttttgagggcgtagttttaattttatattttatggtttaaggttttagttttgcgttataatttgttgtttataggaggtagcggtttttgttattggttgatgtatttaaggttagttaggggtgtggggtttttttcgtaataaacgtttttagaggttacggttttggttttagtttttttttcgtttttggttgttgggagattttttttgtttatttgtggtttaattatgtatttattcgaattattttagtaatatttaaagttattaaagatgtagttatttttatagagaaagtagagtttgttgtgtaggtattcgtggtttcggtgtggttttagtttgttttttatgttgaggttttatatttttattaatagggagtttttggttattaggtattgtttattatggttatattttatattgggtatggatgaaattatttttgagaagaaggatttattgttgggattttgaggttttttaaaaaatttggagtgtttgttgtatagggtcgaggagtttatgttgtttagttaatggtttttttgttattattgtagataagtatattgtattggtatgagtggaatttggttgttataatgatttttgttagttgttttaggttagtaggtttgatgtttattacgttaaaatgtttatgtgtgatttttaagtgttataaattaatttttaggttattgatagtgttgtaattttaaatgaattttgaagttatttatttttattatttaagttataattttttgtttttttattttattcgttttttttttataattttatagttttattatttgtagagagtagaaaatgagtagtgttttgttgtaattatttaattttattttttgtttaatttttagatttttttaatagttaaattttggtttatgatttttaaaggtattgtaaatattatatttttttttagaatgagggcggtttttattttttagttttgttgaaaaacgattttatcgtttttgttttttgttataggatttttagagtaattaaatttaatagtggaaatgatatttgttgtagagtgaggttgtgtagttttttggttatttattgatggtcgttaaagttttttttggttttttttttgtggtagatttttagttatgtttttttcgatggttttattgatttgggagaagtattattggaatttattgttttttggtagtagtagtttttagtttttgttacggtagtaggtagtagggataggtggggttgggtggggatcgcggtggattagggaggaggtttttgcgttattgtcgttgagcgattagtttcggttgttattagcgttcgaatagaagatttgttggaagtttttaaattttgttgtttgttttattagttaatattattttaagatatgttgttagttaggtgaggtagtttacgtttgtaattttagtattgtgggaggttgaggtgggcggattgtttgagtttaggagtttaagattagtttgggtaatatagtgaaattttatttttataaaaaatataaaaattagtgggtgtggtggtgttcgtttgtggttttagttattttggaggttgaggtgggaggattttttgggaggtggaggttgtagtgagttagtatggggttaatgttttttagtaaaaaaaaaaaagagagagagagatatggtgtttttgaatggtttttttttttggaggttttttataattaatttattagtgaagatatgtatttttttattatatatgtttattgagagttttattaggaaaatagaaattaatttatgtatattaaatattaaaggttttaatataaaggattgaagattgagggaaataatgttagggaagttatttgttatagtttaggagtttgtttttttaaattttatattgaaatttttttttaaagttggaggtggggtttaatgggaagtgttgggttatgggagtggattttttatgtgtagatgaatgttttaggtgggggtaggtagggagtgagtttttattatattagtttatttggtttttttaaaatttttatttttatttgttttttcgttatgtgatatttgcgtggtttttttttgtttttttttatgagtggaagtagattgaggtttttattagatgtttagtattttagtttgtagaattatgagttaaattaattttttttttttataaattatttagttttaggtatttttttatagtaatataaatgaattaagatattattattaataattttagttagtagtattgaagtagggtttttttaagacgttatttggaaatttagtttgggtaatatggtaagattttgtttttattaaaaatataaaaaattagtcgggtgtggtggtatgtgtttgtggttttagttattagggaggttgaggtgggaggattatttgagtttaggagttaggggttgtagtgagttaagattgtattattgtattttagtttgggtgatgaagcgagattttgttttgaaaaaaaaaaaaagttatttggaagttgtttttaaatttatagttatttaattatttgtttattattgttttttgaaataaatggtttttttttttaaaatttattaagggttttttattagttgatttattttggaagtataagtgggaggtgttttttgggaaatgtattttttggtttttttttggtaatagagattttagtaggcggtaatagtaatgttaagttgatataaattagtttagtttttaaggattttggtgatggtttatttaaaatattaaaagataagatttttatataaaggataaaggttatgtgataagagatgtatttttttttttttgatataattttttttatagttttgttttaggttatgggtggttaggtgttgtgtttgtaggagttgttaggtttgggtatgtatttcgagttttggaaaagtttgttttggttttgtgattatttttttttttttgggaagggtgggttttttatattaatattgtggtttttgggtatggttttgcgaggttttggataatgtggataagtttttagtaagggataagaatgaaagtataagatgttttgtagtattttgattttttttttttattttggagaatttatatgtgtttgttattttgttatatttttattagtaaatatagaaaggttgtttttatgttttaaataagaaatttttaggggaatgtttttattgttagttatttgagttataaaaaaaagttattttatttttttttgagaagtagatatattagaggggtatttatggaattggattagtgtgtttatttttttattttttaaaagaaagatatattattagtagagatttgagaaattaggatagataatggttgattagaatttaatattatttttgggtaaaaataaaatgaaagttattgaaaaattttttaaattgatatttgttttttggtttttaatgttttattttatttttattaaaaaaaaaaatttaaatagttaattatttaattttttttaatttttagttaataataataaaaaagggatagtagttgatttttaggatttagggaatattaggtaattagtaaagattttggatatttgttattaataatttttgtaaaatttatattatttgggttattattgagggaggggtttttgtagttatattgtgttgtggtggagggggaaataggaagagatatagaatttgtgtttgagtgttattgtttaatgggatttgagttttagaggtttggtaggtttgatgaaggatagggtttttgttgtttagagttatattttaagagaagttattaatatttttgagatattatggtttattaataatttttttttttttcgatagaagaaagttatgggttttgatagtagatatatttaagtttaaatttaagttttatttttttttaagttgtggggttttagggaagtcgtttgattatttaagtttagtttttatatttgtaagatagaaagaaaatttattttatagggttgtcgggaggatttagtgggataatttatgtaaagtatattagtatttgggttttagtaggtttttataagtttaaatgttttttaaggtattgtattttttattttttttttttttagatttttttttttaggttatagatataataggttttttaaatatattgttttttttgtttattgtattggaaaatgataatttttaagaatttttaagatttttaagaatttaggagaataggttaaggtttttgtggggagtggtggagggaataaaaggaattagcgttttttgaagaaatggttgattttagatttggggttagaaatatttaagatggtttggaatattttattagtttagaaagtaaggaagttattaaagatagttgattgttaaatgaattagtagttaattggaaaaggttttttgttaaagatggaataatttgagtattaaaaggataataaataatttgtagttatgaaatttaagcgtgtataatgatattaaaataattaaataaattttattagttatttttggtagatgttaggggaattaatttattattttaaatattggtaaataaagggaaagaattaatgttgtttatattttggggtaattaaagtagtttttgaaaagtttgtttttatagaagtagtttagttgataaataaataaagatagaattattattattattagtattttattataatttgtaatttttaataaaataataaaataaaaaggttgttagtattatgaaaggagagatagtaattatatattatgtattttttgagggaaatatatagtattatttatgaagtgttttttttttattatttgattattattgaatttaaattttataaagtttttagaattaattatagatttataggaaatataaggaagaataggttaaatgatattatgatgttgatattagtaaaatttagattatggataagtttataggaaaaataatttaattttgattataggtagttaattgttttttaagaatattattaatattttgatatataaatttttagtttttttttatgtatttatattataaaaatgggattattttaatattgttttgtgatttttttgttaaattaataaatagtagatagttatttatatttataatataggtataatttatttttttaaataattttgtagtattttatagtgtggatatattataattaataaagttaatttatttttgtatagttgtatttttaaaggattattttttaaatttttgtattaagaaaagaatttttagtgaatgttggtggtatggcgatggagttttgatgaggaataagatattggtgtaatttgagaatatttttttataaaatgttaattaattataatttgatttggagaatttaatgtagaaaattttggtagatattaatttatttaggggatggaggttaatattacgtgatttttttgttgtgttgtagtgagatgaataaggaataattttatgtggttttgttgtttagaatgtttgtttaagtttggttatggggaagtattagatagaattatttttattttatagaatataagtttggttaagaattgttaggaagatgaaagataagaaaagattaaggaattgttttaaatgaaggtattttaaaaagagatatgataattgtatgtgatatgattttttggataggattttgggtttgagggggggaaaaagttatagtaggatagttagtaaaatttgaatgggatgtaaaagttgtttgaattaaaatggagttatttgtgttaaaaaattttgataaatggtgttggggaaggttatgtataagtgtttgataataagaattattataaaagatgttttgtattagtttatttttatattgttatgaataaatattcgagattgtgtaatttataaagaaaaagaggtttaatggatttatagttttatatggttggggaggttttataattatggtagaaggtgaaggaggagtaaaggtatgttttatatgagcgaaggtaagagagtgtgtgtaggagaattgttttttataaaattattagattttattagatttatttattattatgagaatagtaagggaaaaatttgtttttatgatttaatattttttattaggttttttttatgatacgtggggattacgggagttataatttaaggtgagatttgggtggggatgtagataaattatattacgttataaaaattataattttatataaaggttattgtaattttatatatatatataaatttgtttagtaatcgtttgtttaattttagattggtattatttttgttaatgattttttagttaaggataattattttaaaattattgtgtaattttttttattttttttttaaaaatttttgtttttttttatttttttgaatatgtatatagtttataatggtatatgtatttttattgtagtgtttattatttttttttagagagtttttttttgttatttaggttgataagtatttgtgggttagaggttagtgttgtatagaaattgatttttaggttgtgggggttatatgttggttatgtaggagagcgtttttgttttgaagatatatatatagaagtgttttgtggtaatgaaatatttttttgtggtaatatttatattattatgtttgcgatttgttttttaaatatttagaaaaagtttagagagtgggtaatggagtaaatatagtgaaatattaatagttcgggaattgggtaggtatgtgggagttttttatatatatttggaggtaatttgataaggttttcgaggttttgtattttagtttggtttatgattcgtttatttttcgtaatagttcgtgtttgggtttgagtgatatgtttttttaatattttaaatttatttagtcgttgtttatagagttttcgaatttggtagggggatgattaaatgtatagaaatatggtgagattatttattattatttagttttatttagttttattttaggattagggtttttagtgaagtatagaatagttagagaattattttaattatttggtttgaattattagatttgaaaattgagatttatagaggggaatggtttaaaggtttttatagtaaggttagtaatagatttgagtttggttatttgttttttggttttataataaagagagttgttatttaaatagtgaaatattaaatataagttagtatattttttgtggtgttatttagatttacgtttaaggaaggatttgttttttagttatagggaacgtcgttagtagatagtttttttatagtttatttaagttgttgaaaaggagttatttgagattatgttttttttgtagtatttatattttgtgattgagagaggtaggggtataaagatttggttattttgatttaaagagagaaattttgataggtaatattttttttagagtaatatgttgtatttgttaaggtttgttgggtttttattatagtttagtttttttcgtggtttatttttttttttatttttttttttttataggtgttgatagttaataaatatttgtagtttaaattttgttatagtatttgcgtttagagagtttatttggatgtttaatatattttttaagattaattattgattgattatttaattagttaaatttttgatttatattttttggtttagatttttcgaggtaagaagtagagagtttattggtataggtaatatgaaagatagtttgtattagttaggtatggtggtgtgtatttgtagttttagttatttggtaggtaagagaatcgtttgagtttaggagtgtaagattagtttgggtaatatagtgagattttgttttttttttttttttttttttttttttttttttttttgagatagagttttgtttttgttgtttaggttggagtgtaatggtatggttttggtttattgaaatttttgtttttcgggtttaagtgatttttttgttttagtttttgaagtagttgggattataggtgttcgttatgatgtttagttaattttttgtatattttttagtagagatggggttttattatgttggttaggttggttttgaatttttgattttagatgatttatttattttagttttttaaagcgttgggattgtagttatgagttattgcgtttagttttattttttttttttatttatttattttttagaattggagttttgttttgtggtttagtttggagtatagtggcgtaattatagtttatttttgtttgttatttttggggttaagggatttttttgttttagtttttaagtagttgggattataggtatatattattatatttagttaatttttaaatttttttgtagagatggggttttaaatttttggatttaagtaatttttttattttagttttttaaagtgttgggattataggtataagttattatgtttagttaattttattttttttaaagaaaaaaaaaaatagtttatgtaggaagatagtgttttttattgtatttttaaagttggtgggatcgtaaagatttatttagttatttttttaataaagatttattgtgtatttaggcgtggtggtaggtatttgtaattttagttattcggtaggttgaggcgggagaattatttgaatttaggaggtagagattatagtgagttgagattgtgttattgtattgtagtttgggtaataggagtaaaattttattttaaaaaaaaaagatttattgtgtaattattatttatatttggggaaatgaattagatatggtttttgtttttaaagagtttatagtttagtaggaggggtttggtaaggatataaataggtgaaattaatttttaaaagcgttataatagtatatgaatgaggatatatggaaggttaagaagaagtaattaaatttttttggagttaggaaatgttttttaggagatagtggtttgggatagttttttaaatataaagtattatgttttgtgttatgtgttttattatttgggtttgttgataatttttgattttaatttttggatgtaggaattagtatttagtttaaataataagattaattattatttattgagggtttattatgttgtaaatgtttaatattgtaaatgttttattgtattgatttatttaatttttaaaataattaatttatggggtgaatattattattatttgtattttatagataaggaaattgaggtttatagaagtaaatattatttaaggttttatagatggtatgtgtaggagttaggatttgaatttagggtgtatggttttagagtatttgtttttaattattagattatgagatatttttataggtgggtttggggaagattagttgttaacggggttatttgagggaaaaatttaggtaatgtagatatttatacggaatagtgattattgttttttttagggagaatgaatttgagttttgtatagatggttatatggtagtgatatttagagacgagtgaggaaaagtaaagaatagatgacgaaaaaggaaagagggagaggaatataggtataagaatagtaatattgttgggcgtagtgttttacgtttgtaattttagtattttgggaggtcgaggcgggtggattacgaggttaggagtttaagattagtttggttaatatagtgaaattttgtttttattaaaaatataaaaaattagtttggtgtggtggtgtgtgtttgtaattttagttatttgggaggttgaggtaggagaattatatgaattcgggaggtaggggttgtagtgagttgagatcgtgttattgtattttagtttaggtaatagtgtaagattttgttttaaaaaaaaaaaaaaaaaaaaagttagtaatattatagaagtggaataatagatgtttgttttttttaaagtttttttttttgtaattataaaattaattcgtgtatattgtaaaatttagataatatagaaatgtgtaaagaaaaagttaaatgttttataagaatattgttaatattttgttgtgaaagtttttagttttttttttatgtatatatattataaaaaattaaattattttaatattgttttatggtttttttgttaaattaataaatggcgggttaggcgtagtggtatatttttgtaattttagtattttgggatgttgaggcgggtagattatttgaggttaggagttggagattagtttggttaatatggtgaaattttatttttattaaaaatataaaaattagttaggtatggtggtgtatgtttgtaattttagttatttaggaggttgaggtaggagaatcgtttgaatttaggagacggaagttgtagtgagttaagatcgtggtattgtattttagattgggtaatagagcgagattttgttttaaaaaaataaataaataaataaatggtagttgtgtttgtttataatgtaggtataatttattttttttaataattttgtagtattttatagtgtgaatatattataatttataaagttaatttatttttgtatagttgtatttttttttttttttttttttttgaaacggagtttcgttttgtcgtttaggttggagtgtagtggtgtagttttggtttattgtaattttcgttttttgggtttatgtaatttttttgttttagtttttcgagtatttgggattatagttatatattattacgttcggttaatttttggtatttttagtatagatagggttttattatgttggttagattggatttaaatttttgatttcgtgatttgttcgtttcggttttttaaagtgttgggattataggcgtgagttattacgttcggtcgtatagttgtatttttataggggattattttttaaatttttttgtattttgaaatttttgtaattttaaaattttaaatgtttaaattaaattttagtttttaaattaagatttttataatgtgggttaggtatagtggtttatatttgtaatatcggtatttggagaggttgaggtggaaggattaattgaggttagaaatttgagattagtttgggtaatatagtgggattttattttataatttttaaaaaataaaaatttaggttagatgtggtggtttatgtttgtaattttaatattttgggaggttaaggtgggtagattacgaggttaggagatcgagattattttggttaatatagtgaaattttgtttttattaaaaatataaaaaaattagttaggtgtggtggtaggcgttagttatttagaaggttgaggtaggagaatggtatgaatgtgggaggtggagtttgtagtgagttgagattgcgttatgtattttagtttgggtgatagagtgagattttattttaaataaataaataaataaataaataagttgggtatattggtgtatatttgtggttttagttattttagatgttgaggagggaggattagttgagtttttgatgttaaggttgtagtgagttgtgattatattattgtattttagtttgggtaatagagttagattttgttaaaaaaaaaaatttgtaatatgtattattttttttttttaaaaaaagggattattatttgttaatttagattttggtatagtggttatttatgggatagatattgagaagatagaatttagtgaattgggtgattggttatggggtttataggtttataatgttttatatattttggtttatgtgaatgatagggatgtgagtttgaagtttaagggtaaggtttggttgggtaggttgaagttttagtagagtgaatgtggtgatttacgaattatagagtataggattttagttaggggttttggttgtattttaagaagtttataattcgtggaggcggcgagattggttttgtaagtattttatatattgtataggtatttattttgttaatgtttatttattttagttaggttgaaagttatagaggataggttgcgtgtgtgagtgtgggtgtgttcgaatattggcgtttttatttattgttgaatttttattgtttagaatagagtatgatatttagtagatatttaataaatgtgttaagtgaaggaatgattgaagttaacgacgtgggatgtatgttatttaaggggtaggtagaggatagaatagaaaggagaagaagaagatttgagaggtaggaagtatatcggggtaaaggatcgggtatgggaggagtgtttataagtttaagggagtttttagtagtgtggttagtagaggtcgatttagtatagaggtcgcgagttagttggttttttttttgtatagatgaggaagtagagttgttgttttagaggttagatacgttttttaaaatttgcgtatgaatggtttagttaagattgtggtttgtgatataaaggtattttaaagtcgggtgatttttggttttattttttttatggaataattatttagcggtttgtcgtagtcgtttattgatatatgtaatatataacgtatgtgtttagagaaatatagataggtgttatagatatatgtcgtacgttgtgtggtatgtgtggtatttgcgtatgtgtgtgtatggatagagcgtttttttattagaatgtcgggtttatttcggtatgatgggttgttttttaattgtagttttagattttggaatagcgtttggtatttggtaggtgttgacgcgtgtcgagcgttgagatttcggtatcgttcgtagacgcgacgttatcgttacgttatttgttgtagttggtttacgaatttttcgtggcgtttattttcgttgtcgcgggttttgattaagtttgcgtttatttcgtcgtcgatgatttcggttgagtataagttgcggaagacgtcggtgagtaagtgcgagatattttgggtgcgtagcgaggaggggcgtagacgaagtagttgaggttcgggacgttgcgttagcgtaagttgcgtgaggcggcggggtcgggttgcgaagttgtagtggaaggttttagagtaggcgagggaggaatataaggaggatttttaggtgggttggttggggttgttggattcggttggtggcgaagttggcgtttatattgttttttggtattcgttggttcgggacgttaaagattttcgcgttttggagtttttggtttttatggtaatcgagacgtcgttaattttttgcggtatttcggttttcggttttatttttttcgttttgtttttttttcggatttcgttatcgttgtggttattgtaaatatttgtgtttttagtattgtttttttaaaagtgagtttattaagtgtgaggatttatgaagaaaggtttaattgatatagttaggtttatttgtaaaattttgtatttaattatttatttttatttattttttaatttgttaagtaattgtttatttatttattatatttattgtgtaaagattgtgttttaggtttgtgttgattgttgaagatattaaagaagtatgatgttgtttttgtttttaggaagtgtatagtcgtgtatgtgtgtgtttgtgatgatggcggtgggtgtggaggtaaaagtaaaataattgtattttagtgggttaaggttaaggtggagataaatattggttgttatggaattataaaggaggataggaatttagtttgtagaaggagcgattattttttggaataaatgaaaattaagtagagattttaaagaaggagtagattgaatattattagttattaaagaagtggaaattaaaattataatgtagtattatagttagtagaatgataaaaaataaaaaagtatttaaataagagcgtgtgtgtggtggtttatatttgtaattttaatattttgggaggttgaggtacgaggattatttgaagttaggagtttgagattagtttgggtaatatagggagattttatttttataaaatatttaaaaatgtgggaaggacggaatgaaatttaggaggagtggaatttaaagagtgtgagggtggaggaatgatattgataggttagggttagattataagtgggttggtaggttataatagggaatttggattttattttgagggtagtaggaggtttattaagggttttaagttggggtatgttatggttagttttgttttattaagattattttgattgttatgagaatagataggagaggtaagaggtattaggaagtttagttaggaaattagtatagaagttaggaaagagatgaagggagattggatgagagagagggaattggattggagatagatttaaaaagtagaattgataagatttgttggtggataatgggaggtaagaaataggtattaagaatgatttttaggtattttgtgtgtgtaattaggggggtgatgatagtattattgagatggaaaagaggattgtatttgtttagggtagtagtataatattatattgattgttgttatttgtatattatggtttttgtttataggtgatataattaattattttttattttatattgagtttgtttgttttatattttgaaatttatttttagagatgagtgttagtatgtttgtttatatatttgggttatttttatttttattttttttggttgggtttggtttttttttttgttttttttaggattttttttgttttgagagttgagaagttagggtcgtttgttttggattgtgtgtttgagaggtttatttttggttgtttttcgtatttttttttatagagtaagagattatagggttaagatgatgtgtttcgtgtttcgtttttaggtatatgggattttaaaagtatgtgtttatatgttttgagtttattttagggtttatgtaggttttttttttaagtttatttttttagggttgatttaaaagggtagttatggtggggggaggaggagggaagtggagggagttttggtaaataggtatttttttaattttttataagtatgtaaggtttttagtggtgtaggaaggagttgtgggtaggaagaggggtgtaatagtttgggggtttttattgttttaatgtggtaaatggagttttagttgggtggttttgttatttaggagtagtttcgtttgtggaggttttttggtttttttttttgttatagggaaggataggataatggatttttg

SEQ ID NO: 182 - DNA, 22709 bp, Artificial Sequence
  Chemically-Treated DNA
ttttttgtttatggagaggttttcggtgaatgttagatagtaattaaataattaaaaggtttagagagcgttgtgagtaggagaagatgcgggtagtttggttggtttaggagagacgagtggttagagaatgaaaggaaaatcgatgttttttaattgggtcgtttaataacgggagattaagtgggtttaggagaaacgtggcggggggggggggagttttttttaaaaaattggggttttttttttttgttttatatatggaaatttagttttgattttaaataaatattagatttaagaaggtgaggattttaaagaagatttaaacgcgagattaggaagatttacgtttttattattttttttaatatattttattaatttttttatagggatagtgttttaaaatacgacgatttttatatattaaggtgaagttgaatattgttgttgtttttttatcgtatgaaaggaattttttagaatttatttttagggacggttttttttatttcgaatttttgtatttgtagggaattttatggggtagaggagcgaagagggaataatgtttttaatttaaataaaattttaaattaagtttttagttttatcggtgggatagtttgcgggggaatttatttttttttttggtagtattgttttgggggcgagtagagagtggatttggagtttttttttttcgtttgatttttgttcgttcgagtagtattttcgggttagcggttgtagttattcgggcgtcgttaggggatgtagtggtttaaaggatcgagcgggcggtgtaggttggaattcgcggggcggattaatcgcggttcggttatagtttcgttcgttgattggtttttttaggtttcgttttcgttcgtttcgtttttttcgttggggcgtttcggagtcgcgtgtttttcgtttcggggtgtttattgcgtagagcgtggtttggagattcgcgagtcggggaaggtcgtcgtggagtttcgattagaggtcggggttggggtcggtgtagatcgagggttggtttttttgattgtgggagaaacgtcgggagtcggagtaagtagggtttcgggcggggcgaaaggaaaagttgggtttttagagtgaagatcgagttttttttgttcgtttatattgagcgtattcggggaatgagttagagttagtttttttttttttttttttttttttattttttattgttgttatttaagttaaaagtatatattgattataaatattaggtttggaaagggtagttgtaatagttgaagcgtgtttattttgggggtttgagagcgtagaaggttcgggaaagaggtgataatgataataaaattgacgcggacgttttagttaaaggtattttttttttattcgatgatttatttttttaggaagtcggttcgagaggtaaattttaaaatattttgatatgaaatattttgtttttttgattaatttaacgcgtacgtttttttatatcgatgcgtttttttaaatattttgtattagattttaataatgatttatgcgtgtttattttttaaaagtttgaaaaagaaaattttgtttatcgaaatgaattttatgaatggggtaggttggttgtatcgggacggaatcgtttattcgattcgaatgaattggtaggagtcgcggttatatttaaagggttagagcgcgcgttttttttcgttcgtttttaagtttcgcgggtttcgtttattttgttcgtcgttttttcgtcggcggtcgttttttgcggcgttttttttcggttagtggaggggcgggaggaggggcgggggtgcgcggggcggggggagaagttttggagcgggtttgggttgtagtttttttgtgtcggggattttgttttttattcgttagcgttaggtttttttttttcggcgcggatgatattagaatttttttaagttgcgtcgcgttatagttgtttgcgaatattgagttgtttggcgtcgttttgatatttttagaaagaatgtattttttgtaaaaaaaaaaaaaaaatattgagagagggagagagagagagaagaagagagagagacggagggagagcgagatagagcgagtaacgtaatttgatcgagtaggtcgtacgtcgtcgttttttttttttttttgtttttcgttatttaggttggtattggtgattttttttttttttaagtttgattttttgtttttaattatttgggaggatttaaattaattttaaaaatttaattttttttttttggaggttttttaggggttgagaggacggtttcgggatcggtgttttcgagggagggatttgttttttaagtcgtaatagttagttttgggatttgttttttaagttgtttagttagtttcggttttcgcgagtcgggttgtagggacgttttcgagagttttgcgggtttcgcggtcgtgttttcgcgttttcgtgcgggtttcgggtgcgttgggcgggcgggcggcgcgaggggaggttgtgttattttagtaatttaggggtttatttaggttttttatttttttttttgtaggtgattcgaggagggatttcgttttcgagcggttgaggatttcggtgtagaggagtttggttcgtagaattgtagagtcgtcgtttttttttataatttggtttcgttttattttgtcgtatttagtttttggatttttgtttttttttttttttttttgttaaacgatttttttaagataatttttaaaaaatttttttttttgtttatttttgttttttagtttttttatttttttatcgaaagtaaattatttaacgattttcgatttttcgacggtaggagtttttcgattttttaggcggatcgtttttttttttcgcgcgcgggtttcgggttcggcgagagggcgcgagtatagtcgaggttatggaggtgacggcggattagtcgcgttgggtgagttattattatttcgtcgtgtttaacgggtagtattcggatacgtattattcgggttttagttatttttatatggacgcggcgtagtattcgttgtcggaggaggtggatgtgttttttaatatcgacggttaaggtaattacgtttcgttttattacggaaattcggttagggttacggtgtagaggtatttttcgatttattacggtgagtgcgttcggggtgtcggggttttcgtcggtcgttttagtcgtttcggttcggggaggtcgggagggatttgagggcggggagaggttaagcgaaagtttttatttgtcgtttttggtttatttataaaaaaattggggttcggaaatgggcgaggaaggtttttggttcgtcgcgagagtgtgttttgaaagagtcgtagtaggcgtttttttcggttggtggttttggggtttggcgtttatttggcgggcgttaggtcgtagtttttcgtttttgcgcggttgtaggttttggggtggggggtttcgggatgtttttaagcgcggggtgttttggttttgttttcgcgggttcgggttttttgggttcggtagtcggcgtcggataagtacggttggaattcggtttttttaaaaaatttggcgttttttgttattcgttagttttttttaggcgggtgggcggggtggagggggttttttgttagcgttttttaattcgtatatttttagaaaggttttagagatttatttatttatatttttttttttgatttttttttagagttagtgtttttggtttttagataggttttttattttttggttttaggaatggaattttgatgttgaaggggtttgggggggaagatttttgttttaagtttgagggatttgagattttttagattttcggttgtatagaatttttttgcgtttttgtttttaagtcgtttttttgtttgtaatttttgttttattttgtttttgggtattgttttttattagttttttatttaagatgtaggatatattttcgtttaaataaaggtaattttagtattattttttttttttttttatttggagaagtttaggagagttttgaaatgtaaaaaaagaagattaggtttgtgtagtttgaggaaaaaagatcgaatattttttagttttaagtttgtttttaaagaagaaataggggtaaaatatcgggtagaaaaagtgtggggttttttgagtttagttagatcgaattttgttttgatttttttatttagagtttgttttgatacggatgatatagttttttcggtagtaggcgttttttattttgttgtcgttaggttttaaataatcgtttttgcggatggggcgttttttgtttacgttttgtgcggattagtagttaggtggaaatgcggtagaggtagatttaatattatttattatattattttttgtataatatgaattttgatttttggtgtttagagaattttttttttttttttatttttttttttttttttttttttaagattttagttttagtattgtttttaatggttgaatcgaatgttaaatgttgaggtaggtattggttttaaagattaagaagtgtgtggatttgtatttgttttttaaatgtattttttagagtgtatgagttatagttattttaagattgtgcgttttaaatgaaggttaattagattttgtgtttgagttattttttatttaaaatatatatattaattggaattttgtgttttaggggtttaggtgaaaatttatttatggtattggtgggattatagttttattgagggtgtatggggtttacgttattttttttttttttaggatttgggagggtgagaaaagtagagaaaatggttattttagggtttagttttgggaattttttttaatagttcgagtaatgaaaacgtttttgtaaattttattttaggttttttgcgggtagtttggtcgtttttgagtaagtattgggttaggttttcggaaattaattttgaaagttttttgatttttgttttaaggttttttttttttgtatttggtgttgggagttgggtttgattttagggtcgttttttggtgtggagtagttgtgtggtcgggttttattttttaggtttttttatttatagtcggtttttttattaggttggttgggattaagttcgagttagggaatttagggttattgaaggaaatttataaattaagttaggttttagagagagattttggggaatgtgatttaggcggtgtatttggagaggttaaataagtaaaggggtttttttttttttttgtagtaatttttcgggtgttagttataggttttttattttgttatatttgatgggatatttttgtgggagagatgggtgaaggattttgtttttagtttgatttttaggtgtgttaggtaggtatttcggggatcgttaggatgagagagtgggtttgagttcgggtttttgttgaaaaggaggtcgatgcgaggtagagattttttaggtgtttttgacggttttttagggttatatttatttttttttttttttttgtttttttttcgttgttttatagggagttaggtgtgtcgttcgtttttgttttatggatttttattttggttggacggcggtaaagttttgggtagttattatatcgtttttttttggaattttagttttttttttaagacgtttatttattacggtttttcggggttttttttcgtttatttttcggtttcgtttttttttttgtcggggggttacgttagttcgtatttttttattttttcgtttatttcgtcgaaggacgttttttcggatttatcgttgtttattttaggttcggtcggttcggttcggtaggacgagaaagagtgttttaagtattaggtgtttttgttcgatagtatgaagttggagtcgttttattttcgtggtagtatgatcgttttgggtggagttttttcgtcgatttattattttattattatttattcgttttacgtgttcgagtatagtttcggattttttttttttagtagtttgttgggcggtttttttatcggtttcggatgtaagtttaggtttaaggttcggtttagtataggtaggagttagtttttttttggagttttttttttttttttttttttttttttttaatttagggtcgtatttagagggattttttaggggagtcggggtgttttaaagtttgttgagatgttattttttttattttttttgtcgggaaggtattgtatgtttttttattttagtttacgtttggtttcggaagtagaggggaagtgggatttgatttaaaattttttaatgagttgggataggaaaaaagataaataaaaataaagttatgtttttttttgtttgtcgtaggatttttggattgggttggtaatttttagttagtttttaagattaaatggaaggtcgagggaataatttttgagtgttttatgttaaaacgaaatttttttaagtttaaataaatataggtttttttatgatttttttggtttttgttattttgattgtttttttcgtttagtttaaaggggattacgtagtgaggatagttttttattagacgtgtagatataaagtgtgtgtgtatgagtttggttaaagttgtacgtatattttttgcgtggaaaagggggtttttagttgaattgggagaaagcggtggttttgtattggggaagtagagttgaatgaaaattaaatgtcgtttggtttagttagttatttgtagcgttttttagagtttttagtgtagttaggggtaggaaatcgtattaggatatattgtttggttgagttgtagttagaggaggtagaaaggaacggaaaagtgttttaggtgtgtattttagttttttgtgttttgtttttttttaaaatgtaaacgttgtttagtagtacgttgtatttttatttagttggtgttattatttgtatgaagaaaaattttatataaaatattttggttttaaaaataaatcgatttattattaattttatttttaaataaagtaattgagttaaaagagagttagggattttttgatattgatttaattgtattattagatagggtttggtgaagattttgatgtttttttaggcgtgtttattttagagtgggtattttttttttgatcggttttaggtattttgttttcgttgtttttttatagattttatatagaaagtaatcgtgaaaattatttgttttttagggatgagatgagtagttttgaaatcgagtttttaaagtttcggtttgaaaaattttagagggagtattttgggagtttagtgattatgagattagtttttagggtttttttttagggtgatatttatttcgattgtttgagtaggattgtttttatttagttgatatgttttagttaatttaattatttttagattgttgtacgcgatagttgtattgtttattttgagttaggaattttaatagagttcggatgcggttaggttgatagaagaatttagatttgtatgtttagtatatgaaagtaggtaggagggagagggaggtaggttagttggtggagttaaaaagaaagtaagaggtcgggagagttggaggtataaagtggttacggtgtttggtaggggttgggtttgggggtggagggaaggattaagaagtggggtgtagtttgatttagaaatataggttggggagttgaatcgaaagagagtagatttatgtattttgaggttgtgatgggatttttttttttttttttttttttttaaagtttttttttttggtaaggttatgaggttggggagagttcgtggtatttgaggtcggcgtagtggtttgtgcggggggaggggatagagtgatttttttaagatattttggtttttttatttttattttcgtgtttgattttttttttttttgtgtatattttttgttttaagtttagttttttttttttttttatttttttttataagattttgaatatggaggggagaaagagagggtcgtggtttttttaagttagagttaggaatatcgatatatcgattttggtttttttggcgaggaggagaggaggttattttaatttggtttttttatttttttttttttaattttttttttatagtcgtgaaaatcgagaatagtatatttggtaggggcggcgagcgagttgggatttttgggagtgtggaggggaagtttcgagaagtttttttttttgtagggggtggaggtggtgggaattttttaggaggggatttttttggttttagtggttgtttttttttttttttttttttttttttttatttttttaattttttttttgtaaatgtatttgttgaaggaggatatagagaagagagagtttttggggttgtcgttggaaacggttgaagtcgtggttagggtatttattgttgttttaacgtttgggttttcggggttgggacgaagtttttgtaaataaaagatagagtttttgtgtttagggtcgttttttagttttattgttatttttttagttgggtatttttttttattgttatttgatcgagtttttgttttgttttttatttttttttatagtttggtttaagggttttaggttaaggcggagtaagaggtatttgttagtagttgttgaatgttaagaggtttcgtcgttttgtggtttttgttatttaagagagaggtgtttgtttgagtagtttataataggtaggggtgaggagaggggaggaaagaaggtaggagagagttagggtttttattaggaaaattggttgtttgttgaagtgatagattagaggtagtaaggaaaaaagaagaagaaaagtttataggaggtaatggtaattttgtcgagtgaattaagatagaaaattattttagtgtgtagaattttgttgaagaggtaatcgttgttagtttttaaggtgtttttgaaaaggaagttattattttttttattattttgtaaatgagaggaaattagattgattatgttaggttgggaggttttttagtattagggtgtttaggagtcgggtggtaattacgtttttcgtttttaattatagcggtttttttttatattgttttttgtttagtgtttaagtaggggaggagttcgagggggttttttgtttgggtagggtggggagtgggtttgtagttttagttgggatagggttagtgttgttttagaaggggttgatttagtagttattagcgatataaaaaggtaggtttgcggtttggtttgggttgtagtcggttattcgtttatttattttttattttttttttttagttttttttatatttagtttgttatattttttaggtttttgattttaattgaaaggtgtttgggtgtgatttaggtttgagttttttttaagaattgagaagagtcgttgggtatttaggaaggcgtttttggtatgtattgtagcgtgtttgtgtttaattttaggggttttggggtatagtaaaggttttttggggattttaggttaagaattttttggaatgtggagtaaaaaaaaaaattttttttatatttttattttttttttttttttaaaaaataaagtagataaaaattagtgggtattatttttgatttttaagggtgtaagatttttttttatttgtaaaagtttttaatttttttgaagaatttatttttggagagtattataggtttttaagtgtgaatttttttagtttttttttatttgatttggggttttttaaaggtttaataggttttatatttgttaaggtagattttttttttttttaggggaattaaaatttttaagtattttattgggttttttttttttattttagtggttcgggtaggttggaggttattaattatttttttaaaataaaatagtttttagagtttattttttttttttatttatttttcggggtttttttttgggttttttttttttgggggattaatttgagttaagttttttgtttttgtaaggaaggggagttttggttttttttgggtatttagagaattgggcgttagagattcgtgtgtttttgggttttttaaaattaaggagatttttttagaaagtattttttttttttttttgtaaagttgaaattagttagttaatttttttatgttttgaaatggtaatttaagggatttttttaaggagttttttgggtgggtttgggtcgttttttagtttgggttgagggagtgaatgttgtttagattttttatcggtttggttggtttttcgtttattttgtttgtttgtgtttttgggaaaagagaaattgtaggtaggttttggttattgagtagttatttcgttttgttaatttgtttttttttttgatttttttttgatcggttttattttgtttttttaaatttttttttttttttttttttttttttttttttttttaggttttttgtttaaagtttgtattttttttttgtattttttggttggggttatattttaattttagttttcgtaatagcggttggaaagttatggaaatttttgttgggttttaatcgttttttttttagttagggatatttgtagtttgattggaagtaaaatttaaaattttagttagtgaaattaattagtcgattgattaatttatgtatttatttattatttgtttatttatttagttattgatgaatttttttttttttttattttaatttttattatttaattaatttttatagatagatttatgatgataatgggttatttttgttttttttttttttttttgagggaaatgaatggaatgtttgttttttgttattatttagggtttaggatttttttagggaagtatttgtagttggaatttgtatttttttttggttttgttcgattttttttattaagtcgggtaagttaagaatagggttttgttgtaacgatgtatttgttttttttgcgggcgttttcgtgtgtgtcgggggaacggttatgttaggatagtattttttagtttaattttggagtattttggaaagaggtgggggtggatacgttttttaaaagaggagggagaaggaaaaaagttttttattttacgttttttttttagttttaaatgttgttagtttttttgcgtgttttttttttttaagtggtttatttgtgtttttgtttttagaaggtagggagtgtgtgaattgtggggtaatttcgattttattgtggcggcgagatggtacgggatattatttgtgtaacgtttgcgggttttattataaaatgaacggatagaatcggttttttattaagtttaagcgaaggttggtaagttttcgggaagggatggattttatgttgattattttgggttttttattttttttttttcggaaggatagttttttgtaggaaattgataggatagtttttaatcgtgttagttggtttgggatagtttttttttttttttttttttttttttttttttttttttttttttttttttttttttttttaaatttgatatatagaatagttttttttttttttttttttttatttatgttttttaagtcgtttgtgaatattttaaggagattgaatttttggttattaaatttgtagtgtatttttgaatagaataatggtatgaataggattagagtagttggtttaagtgtattgatgagtatcgtttgatagatagagatatttagtatgaggacggaatgttttagaaattatttagaatgggtttttgaagttgtggcgtgtggttttttaggaaggattatagatttagtgtaatggatggatttgttatgttaatgttttaaaatggttggagttgattaaatgaattttagaggttttattagtaattagtgagtttaatgttatttttttttttttttggttttagtatttgagaattttttataggtaatttttatgggaaacgtcgtgtgagtttttttatatttggtatttggtttttttttttttttgaattattattagtaaggtgatagttttttttttttttttttattatttttttaaaaattttttaagtatgagggatttttgagaaaatttggttttgttaagtatttataaggaagataatttataggggatatttatttgtaagtttttttttggaagtttgaatagtgaatgtatgtgatagataaataataattttagttatagttaagagattaaaatgttttatgtggtgttgatatttattaagtcgagatgggaggaggggaatttttttacgtagattaatggataaattagtatttattaatttttaaggaaggaaaaagaatatttttgtattttttttaaagaatattttgttttttttattagattgtagtgtaatttaatattttttatattttattttgaagaaggaaaaattttttttttttttttttttttttttttgagatagagttttattttgttatttaggttggagtgtagtggtacgatttcggtttattgtaatttttatttttcgggtttaagtaatttttttgttttagttttttgaatagttgggagtagggatattcgtttttatattcggtaaatttttgtatttttagtagagatagggtttcgtttttttggttaggttggttttaaatttttgattttaggtgatttatcgtttcggttttttagagtgttgggattataggtatgagttatcgtttttagttaaagaaggaaaattttttagggatggaaatgtttatatgattttaatttttgataattttggatatcgaggttttattttttttgatttttgtttttttttttaatttttttaatttttttttattttttttttagtagtttggtttttttttttttttttttttttttttttttttttatgtgtaaagttgattttttaggaaaaagttgtcggatatttgagtattggagataatttataaataataatttagtttttttaatttaaatattaagatgtttgaacgtattagaataagaagtgtttgaaaaaaaaaaaaaaaaaaggttagaggtgttagtgtagaatgaatatgattatattataaaagaatgttttgaattatttaaaaatttggttttagtaaaaaaaaaaaaaaaaaaagagagagagagagagaggaaaaaaaaataataaataaaaatttttttgttaaaatgtgttttggtattattatagttgttttttttgttttttttgttttttttttaataaaagtaaagaaggaaaaagagggattaaaagttttaaggtatgggttgattggtgagtaaaagtttatttgatatttttttgggttttttttttttgtttggttagattgtagaggaggatcgtaattttattttatgtaattttatttttatttattttttataggaaatttttagaattttgagtaataattgttttgaattttagagtttaatgattgttatatttttatttgtttttttttttttaattatttgtttttggtggtttgatgtttttagttttatagaatttataagttatagggaggtagaatataggatatatttagattttttttttttttttttttttttttttttttttttttagttttgagatgtatttgatttttgaatatttagaattttttgttttttttttttttgtattttttgattttttattttagttttagtttgttatttttgtttgatatatttgtagatttattgaagattatttagtttatatatagttagtttttttgtgagatgtgtatttaattttgaaaaaattaatgtaagaaataggagagatgatcgaagggaagatttatagatttttttttttttggtattgttaggatttttatatattttattattagtgagaggttgagttgtttgttttaatatattgtattttttgttagtgatttaaatagtgtggttttgagagattttaagtttttataaagtttgtagtattggaagtatttttttttgtttttatttagattgttgttaatagattgtaaaagattatatgttgtattttgttatttggagttttgattttattagttggtattatatgtttgtattttgtatatttagaattgttgggttaggaaatttaggtgtttgagtgatattaatttgttatatttgagtagtttttttaaaaaaaaaaaatattataggaagataataattatatataatttaattgttaaaattattaagtattggttttacgtagtatttttttttaaaaagtatataaatgaaatagttgtttaagtattaaattattatattttataaaggtagtcgggtagaggtatatggggttagattagtatttatggataatgtgaattatatttaagatggatagtaaaagatttttatttttttttttatgataggttagggtagtttttagtttttagttttttagaatatagaaaagaaagaatttttttaaaaaggttatatatattttgttatttatattttatagaagtatatttgtgaaataatttagtaattttgaaagaaaaagggttatttaggttaatttaaaattgttattgggttttttatatttggtagtttcgggtgttggttttaattttttgtttgataaaatattgatataaaattgtattagaattttaggtcgggtgcggtggtttatttttgtaattttagtattttgggaggttaaggcgggtagattatgaggttaggagatagagattattttggttaatataggtgaaatttcgtttttattaaaaatataaaaaattagttggggcggtggcgggcgtttgtagttttagttatttgggaggttgaggtaggagaatggtgtgaatttaggaggcggagtttgtagtgagtcgagatcgcgttattgtattttagtttgggcgatagagcgagatttcgttttagaaataaaagaaaatataataaaataaaaaataaaaaataaaaaataaaattgtattaggatttttatagtttttgttttgtgtttttataattatattagaattttttttattatagatagagattaaattttttttttttttattttttttttgataatatttttgatttaggaatggggataattttgtagttaaaattttttttttatgatggaaggtgaggaggagagagaggtttatattagaagtgatttaattttatttttttttaatggttttttttagttttatttttttaaagcgtgaatagagaatagttatttgattaatttaaatatgttaaaaagtgaaagaaaaattttttttttaaaggaaatgagggtagtaatataattaaggaattaaaatttaggttgaggttgatttttgatttgtaattatgttattttatgaatagtaagtaggaaatggttgattttatgaaggtggattggtattagaggaggcgagggatttagggtttttgatgagtggtaatattttttggttttttgagtttgtttgattggtgaattaaatttaggtgatagttagttaaagagagtgagggtggttgttttgtgaatgggaagtgattaagtttgaaagtatagattgtggtggtttacgtttgtaatatcggtattttgggaggtcgaggtaggtggattatttgaggttaggagtttaagattagtttggttaatatagtaaaattttgtttttattaaaaatagaaaaattagtcgggtatggtggtaggtgtttataaattttagttattcgggagtgtgaggtaggagaattgttttaagtcgtgaggtggaggttgtagtgagttgagatcgtattattgtattttagtttgggtgatagagcgagattttattttaaaacgagaaaaaaagaaagtgtaggttgtataaatttaggaggttttgttgatttaggatgttttatttggcgtttttttaggtgtgttatttatgtgtatgtgttatatatttgtatagatattttttgtagaatttgttgttgtgttggtatattgttttttttataatttagtatttttttatttgcgatttagagtgtttttggtgtttggttttgcgttttttttgttgtgaatgtattttgatggttggagtttgtttgaggatggatatttttgggagttgtgtttgaaaataattttttgtggttttggatttggtgaaaaaggtaattgaaagtttagttttaaaatgaggttggttaatttaaaattgttatttataaaaattaattttttggtgtattttgtgggttgagggtaggaggttaagattgttagggaggaggtttcggttttttgtttttatcggggagtagtaggtgaaattttgattacgttattgtaattttgatatgttttagtggagtggcgatattttttttttcgaggtagtttttggggatttgtattatttttatgtggattatttgttagttttgattttaatgataattttttttttttttttttttttttttaagtttgtttttatagtgatgataatatatttaatatttgttttgattttatttttttttttttttttatttttagtttgtagttaggagagtagggacgttttgtgcgaattgttagattattataattatattttggaggaggaatgttaatggggattttgtttgtaatgtttgtgggttttattataagttttataatgtaagtggattgggattagtaagaatagggttcgttttttgatggtgattagtaaatagcgttattattattttttttaagtgaatcgtttattatgggggtagatgataggttttaaataattgatgtaataggatttagtttggaaaattattttgtttagtatagtcgtgttgaggtcgagggggtttatagtttggtagttatataatttttttggtatgtattggatattttatatattatgtagtaattcgatgtgttgagtgggtttgtgtggtttataaggaaaaaaaaaaaattttttttttggaaaataaaaaaagttatcggttttattttgttgtttttttatattttaaattttttgtagaaagagagaatgaaagagaaaggtaaatagaattgtaatgtgtggtagggggtttggaaattaagaggatttatttggttattgagaggtaaaaagttttggttaaatttgtgttataaatttgaaatggattttttgtataaaagatatggaaaaaaatgtttgatagatttcgtttgatgtttttgttcgaattaatttttacgtgtagagagttagtttttgaggaaggtggttggtttgggggatgttattatattagggaaaataaattgttattttttttttttatattatgttagtagagcggtaattgttagttatttgaatttagttgtgttatttttgatttttttatttggggtttttttattttgtaatatattttaattttaaaaaattttttttttagtttttttttttttttgaaattattttggtttagaggttatgattttagtgaggttttaagtttatattaattttaaagataaaaatggttattttggtttttttttgtgttgtttttttttttttttttttttagttttttttgatttttttaaatttttttggttaatttgattttggtaaagttcggggttgaatagggaggagatagggatttttgtttgcggcggttttggtaatgaatttattttatttaggaatatttgggaattggggaggaagtttttttggttggattttttgagttataaagaattttttagggtgattttagtattttgttttttttttattttttgggagtaagttgttgtgatttcgaggagttttgtacgtttattttttgtttgtgttaattttttcgttgtggttttggtgtagtgaatgaaattagagttttattacgattttttatttttttttaggttttgggattgtggtttatatatatttattagtaatttaatttaagttttatttttattttggggaatttgtttgttgattatagtagagatagagattcgtgattaaaatttggaaggtttgggtttataagttattaggttattagtattagggtttattagttatttagttattagtattgtttatgaaattatttttgggttgtaatttatggattttaaagaatttttatgttatttgattatatttgagtttgagatagttttatgatgtagatagggtagaaattatttttattttagttttatttgagggagttatgatttagaaaagtaagtcgtttgtataaggtaacgtggttgagaaagtataagagttagggtttattttagagttaggaggtttttttgggaagttggtagtgttagaattaagaggagaattaggggaaagggaatgttttttttttttagagtataataaaattgtaataaattgtgtgtgtgtatattttatttttatattcgtggaagtataggaattataggagattaattagttatatgtttttttgaatagttagttgggatgagatatgattttatttgtgtttgattatatatatatatatttttgaagaatatgaattttttaaattaaagtaaagttgaggaattttttttatggtttatttttatttttttaattttaatgagtttggtttttatggttgggttttagtgaatgggagatagaaatttttttatttttaagagtggtttttttgttttttttggtttattaggaatttgtaaaaggaggcgattgatgtgtattgaataataagagataataatttattaatattgttattacgttgcgttttgttttgtttttttagatatttttatatggatgttataagttttttttttttatttaggtgttgagataattgtttatttcggtattagtattttttagtggtgttgtgattggttatttggggttgtgtggttattggtgtaattagatattatatttagatatttggttatgtatagttagatatcggtattagagttgtgtatttggatattattttggtgaagatttgatgtgggagtagatttttgttatttttgtaggttgtatttttattttgatgataattttgaagaaggaatttggagatgtttttttggtagtgatttttttgggtttttttgttatcggttacgttgtttttttgggtttggggaaaataaggttttagttttagtgtggggttttgtttttttttttaggtgattttttttagtttagtttcgggaagttgggtgttggttgtttttagtaggttggttatttgaatttttttttttttagttgtgattttttggttttgggaatagataggtaaaatttagagttaagggttttttatttttgagaattgtggcggaaggcgatgtttttagttcgggaagttaggaatggttaggatattgatatttattttttgagtttgtttgttatttttttttgggaatatggttagatgtggagtttgttttttcgggtagatgtttgttgttggggttaatttgtttttgtttttttgtggggagtaatttttgtttattttgtaaagtttttttttttgattttgggtttttaaagtaaatgtatttttaaaggtaaatgaggtttattaagaagagagaaatggtagatgttttcgagattgaagttttttgattttgagagtagggtttggtttttgtttttttattttagtatatttttggttttttttttttaagatgagtgtttttttgtgttttgtattttataggtggttattaaatatatgttgattggttggttggttgtttgtttggttagaagtggagagttagagttaggtggaaatagtatttgtaattattgtagttgttgttggaatgatataggtaagagattatttttgggttaggcgcggtggtttatgtttgtaattttagtattttgggaggtcgaggtgggtagattataatgtcgggagttcgagattagtttgtttaatatggtgaaatttcgtttttattaaaaatataaaaattagttaggtgtggtggtaggcgtttttagttttagttatttaggaggttgaggtaggagaattgtttgaattcgggaggtagaggttgtagtgagtcgagatcgcgttattgtattttagtttgggcgatagcgggagatttcgttttaaaaaaaaaaaaaaaaaaaaaaaaaagattatttttaagaaaggtatggttttataaaatataattcggttatatataaattttagcggaagattttatggtattttttaaaggttaggtagaagagaggtaatcgaaagttatttagtagaatagtatagtttttatttttttaaggtagatagttttaattatttagaggttgatggtttggggagtattttttaagttttgaagtagatttgttaaagtagttaaaatggtattttttttttgaagattttttattatttcgatttttatgaaatagtttaaggaagttttaaagaaataagataagtgaattttattttcgttattagagaaatataatcgtattagacggggttgtaatttggtaattgtatgtattttagttttttagtttttgggaaggagataggagaaggtgggagggaggaaggggttagttgaaatggaaatagatttttgattcggggcggttagtggaattttttttggtgtgcgagagtttgtgtattttagaggtagtaaaaaagtaaaaaaaaaaaaaaaaaattgatttttgtttagattaatagatttttgattatgaagaaggaaggtatttagattagaaatcgaaaaatgtttagtaaatttaaaaagtgtaaaaaagtgtatgatttattggaggatttttttaagaatagttcgtttaattcggtcgttttttttagatatatgttttttttgagttatatttcgttttttagttattttagttatatgttgattacgtttacgtcgatgtattcgttatttagtttgttttttggattatattatttttttagtatggttatcgttatgggttagagttttgttcgatgtttatagggtttttagcgagagtttttgtagtttttttcgatttgtatttttgtaggagtagtattatgaagtttaaacgcgatggatatatgtttttgaaggtagaaagtaaaattatgtttgttattttgtaaaggagtttattgtggtgtttgtgttttaattattgaatttggattttatttgtgaataagttattttgatttatattttttatttaatagggtttttagtgttgtgaaaaaaaaaatgttgaatattgtatataatttatattgtaagaaatattgtataatgattttattgtatttgggtagttgtaaggtatgaaggatgttaagaagtttaaggaatatgggagaaatagtgtggaaattaagaagaaattaggtttgatatttaaatggataaattgttagttttgtttttttttattggttatagttgtttgatgtattaaaagaaaataaaaaaaagaaaaaagagaaaagaaaaaaaaagaaaaaagttgtaggcgaattatttgtttaaagttgttggtttttgtaaaggaaatattagttttgggtaattagtgttatcgtttattagttgtcgttgagggttttagagagtttttttttaggtttatatgttttgtgaataagtttttgtaattgttgtttgtatgtataatttaaagtattaaaataagaaaagatgtagatttattttattatattatatagatcgaattgttgtataaatttatttattgttagttttaagaattgttttttttcgtttgtttgttttaatatttttttttttttttaatttttggttgaataaattagattatatttagttggtttaaggtggttgtgttcggagggttttttgttttttttttattttgtttttggatgatatttattaaatagtttttaagagttcggcggtatttgttttgtttttatttttgtagtttgtgttgagggtagtagtgtatgagttattagcgtgtatgttagcgattttggttcgataggttacgttttgtaatcggttcggttgttttttcgttttgtcgtgttttgtgttagtgattattgtttttaatatagtttgttggaataatattataagtataataataaagtgaaaatattttaaaattataaaatgatatcgtatttacgtggtggtcgagtttttttagaatttggtagttttagttaattttagagaaaggagttaaaagaaataatttaataattagatatgttaagttatttattaggaatcgatgttaattttagagagttaacgtttattttggggggagttgggaatatttggagttttatatgcgatttggagg

SEQ ID NO: 183 - DNA, 22709 bp, Artificial Sequence
  Chemically-Treated DNA
tttttaggtcgtatgtagaattttaaatatttttagttttttttaaaatagacgttgattttttggggttagtatcggtttttagtgaataatttaatatgtttggttgttaagttgttttttttaatttttttttttgaaattagttagagttattagattttagaagagttcggttattacgtggatacgatgttattttgtagttttaaaatatttttattttattattatgtttataatattattttaatagattgtattaaaggtagtgattattaatatagaatacgatagggcgaagaggtagtcgggtcgattgtaggacgtggtttgtcgggttagggtcgttgatatgtacgttggtagtttatatattgttatttttagtataggttgtaggaatagggataagatagatgtcgtcggatttttagaagttatttaataaatattatttaaaaataaaatggaaaagaaataagaaatttttcgagtataattattttaggttaattgaatgtaatttagtttatttaattaaaaattgagagagaaggaaaatattgaaataaataaacgaaagaaagtagtttttaagattagtagtaaataaatttatataatagttcggtttgtataatatgatgaaataaatttatatttttttttattttggtgttttgaattatatatataaataataattatagggatttgtttataaagtatgtaggtttagaaaaaggttttttgaaatttttaacggtaattggtgaacggtaatattgattgtttagaattggtattttttttgtagaggttaatagttttgaataaatgattcgtttataattttttttttttttttttttttttttttttttttttttttatttttttttaatgtattaaataattgtggttagtgaaaggaaataaaattggtagtttgtttatttgaatattagatttagtttttttttaatttttatattattttttttatattttttaaattttttggtattttttatgttttatagttatttagatgtaataaagttattgtatagtattttttataatataagttatatgtaatgtttagtatttttttttttatagtattagagattttgttaaataggggatatgagttagaatggtttatttatagatggggtttagatttagtggttggaatatagatattatagtgagtttttttgtaaagtggtaaatataattttgttttttgtttttaaaaatatatatttatcgcgtttaggttttatgatattgtttttgtaaaaatgtaagtcgaaagggattgtagggattttcgttgggggttttgtgagtatcgagtagggttttaatttatggcggtgattatgttggaggggtggtgtggtttaaaggataggttggatggcgggtgtatcggcgtgggcgtggttagtatgtggttggagtggttgaagggcgagatgtggtttagggaggatatgtgtttggagagggcggtcgggttaaacgagttgtttttggggaagttttttagtgagttatgtatttttttgtattttttggatttgttagatatttttcggtttttggtttggatgttttttttttttatagttaggggtttgttaatttaaataaagattaattttttttttttttttttatttttttgttgtttttgaaatgtataggttttcgtatattaagaagggttttattgatcgtttcggattagggatttgtttttattttagttggttttttttttttttttatttttttttgttttttttttagggattgaagaattaaaatatatatagttattagattatagtttcgtttagtacgattgtatttttttggtaacgaaaatagaatttatttgttttatttttttagaatttttttagattattttataagaatcgaggtagtgaagaatttttaggagggaaatgttattttggttattttgataaatttgttttagaatttgaaaagtattttttaggttattagtttttaggtggttaaggttgtttgttttgaagaaatgaggattgtattgttttattgagtaattttcggttgttttttttttatttggtttttaagaggtgttataaaatttttcgttagaatttatatgtagtcgggttgtattttatgaaattatgttttttttaaaggtgattttttttttttttttttttttttttttgagacgaagtttttcgttgtcgtttaggttggagtgtagtggcgcgatttcggtttattgtaatttttgtttttcgggtttaagtaatttttttgttttagttttttgagtagttgggattagaggcgtttgttattatatttggttaatttttgtatttttagtagagacggggttttattatattgggtaggttggtttcgaattttcgatattgtgatttgtttatttcggttttttaaagtgttggaattgtaggtatgagttatcgcgtttggtttaaaagtgattttttgtttgtgttattttaatagtagttgtaatggttgtaagtgttatttttatttagttttgattttttatttttaattagataaatagttaattaattaattaatatgtatttaataattatttatggggtgtaaagtataaaagggtatttattttgaaaaggaaagattaagaatgtgttagagtaaagagatagagattagattttatttttaagattaagagattttagtttcggagatatttgttatttttttttttttaataaattttatttgtttttaaaaatatatttgttttgggggtttagaattaagaaaggaaattttataaagtaaatagaagttattttttatagggaggtagaagtagattaattttaatagtagatatttgttcggaagagtaaattttatatttggttatgtttttaggggagggtggtaaatagatttaaggagtgaatgttagtgttttggttatttttgatttttcgggttgaaagtatcgtttttcgttatagtttttaagggtggagaatttttggttttgggttttatttgtttgtttttaaagttagaaaattatagttaagaaaggaagaatttaaatggttaatttgttgagagtagttaatatttagtttttcgaagttgagttgggagaggttatttggagaaggaaataaagttttatattggagttgagattttattttttttaagtttaggaaggtaacgtgatcgatggtaggagagtttagaaaggttattgttagaggaatatttttaggttttttttttaaagttattattaagataaagatgtagtttatagagatgataggaatttatttttatattaaatttttattaagataatgtttagatatatagttttgatgtcgatatttagttatatatagttaggtatttaaatataatatttagttatattagtagttatataattttagataattagttataatattattgagagatgttgatatcgaggtaggtagttattttaatatttagataagaagaaagagtttatggtatttatgtagagatgtttggaagggtagagtaaaacgtaacgtgatgataatgttaatagattattattttttattgtttaatatatattaatcgtttttttttataaatttttggtaaattagagaagatagaaaaattatttttgaggatgaggaagtttttgttttttatttattggagtttagttatgaagattaagtttattaagattgaggaggtagaagtgagttatggagaggattttttagttttattttgatttgagaaatttatgttttttagaaatatatatatatgtgattagatataagtgagattatattttattttagttaattatttaaaaaaatatatagttagttaattttttataatttttatatttttacgaatatagggatgaaatatatatatatataatttgttataattttgttatattttaaaaaaagagagtatttttttttttttggttttttttttagttttgatattgttaattttttaggaaagttttttgattttgaaatgggttttgatttttatatttttttagttacgttattttgtgtaagcgatttgtttttttgagttataatttttttaagtaaaattgaaataaaaataatttttgttttgtttatattatgggattattttaggtttaaatgtaattaagtaatatgaaagttttttgaaatttataaattatagtttaaaaataattttataggtagtgttgatgattggatagttaataaattttaatgttaataatttaatagtttataagtttaagttttttagattttaattacgaatttttatttttattgtagttagtaagtaaattttttaaagtgaaaatagaatttggattgaattgttgataaatgtatatagattatagttttaggatttaagggagaataagggatcgtagtaagattttagttttatttattgtattagggttatagcgagagagttggtataggtagggaatgagcgtatagggtttttcggaattatagtaatttgtttttaagaagtgaaaaagaagtagggtgttggggttattttgagaagttttttatgatttaaaaaatttaattagaaaagttttttttttaatttttaggtatttttgagtaagatgagtttattgttagaatcgtcgtaagtaaaagtttttgttttttttttgtttagtttcggattttgttaaagttaggttggttaagagaatttaggagaattagaaagagttaaaaaggaaggagagagagagtaatatagagaaagattaaaataattatttttgtttttagagttaatgtaaatttgaagttttattagaattatggtttttgagttagaatgattttaggaaaaaaaaaaaattgaaaaaaaaattttttaagattaagatatgttataaaatgagaggattttaaatggaaagattagaaatgatataattaaatttaggtgattggtaattatcgttttgttaatatgatataaaaggagaaaatgatagtttattttttttggtatggtaatattttttaggttagttattttttttaggagttagttttttatacgtgaaagttggttcggataaagatattagacgaaatttgttagatatttttttttatgttttttatatagaggatttattttaaatttgtagtatagatttagttaagattttttattttttagtaattaaatgggtttttttagtttttagattttttgttatatattataattttatttattttttttttttattttttttttttgtaaagagtttaaaatgtaaggaaataataaaataggatcggtggttttttttgttttttaaaaggaagattttttttttttttttataaattatataggtttatttagtatatcggattgttgtatggtatgtggagtgtttaatgtatattaagggggttgtgtggttgttaggttgtgagttttttcggttttagtacggttatgttagataaagtagttttttaagttaggttttattgtattaattatttggaatttgttatttgtttttatggtgagcgatttatttggagagggtggtggtgacgttgtttgttggttattattaggaagcgagttttgtttttgttgattttagtttatttatattgtgaagtttgtagtagagtttataggtattgtagatagggtttttattggtattttttttttagagtgtggttgtggtggtttgatagttcgtataggacgtttttgtttttttggttgtagattgagagtggggagagaggagagggtgaaattaaaataaatgttaaatgtgttgttattattatgaagataggtttgaaaaaaaaaaaaaggaaggaagaaattattattgaaattaaaattagtaagtggtttatatgaaagtaatatagatttttaaaagttgtttcgagaagaaaaatgtcgttattttattggagtatgttaggattgtagtaacgtggttagagttttatttgttgtttttcggtaggagtaggaagtcggggttttttttttggtagttttagttttttatttttaatttataaagtatattagagggttaatttttatgggtggtaattttgaattagttagttttattttggaattgggtttttagttgttttttttattaagtttagggttataagaggttgtttttaaatataatttttaagaatatttatttttaaataggttttagttattaggatgtatttatagtaaaggaggcgtaaagttaagtattaaaaatattttggatcgtaaataaagaaatgttgagttataaagagaatagtgtgttaatataatagtaaattttgtaaagaatgtttgtgtaagtgtgtggtatatatatatgggtgatatatttgaggaagcgttaagtaggatattttaggttaataagattttttaaatttatatagtttgtattttttttttttttcgttttgagatggagtttcgttttgttatttaggttggagtgtagtggtgcgattttagtttattgtaatttttattttacggtttgaagtaatttttttgttttatattttcgagtagttgggatttataagtatttgttattatgttcggttaatttttttatttttagtagagatagggttttattatgttggttaggttggttttgaatttttgattttaagtgatttatttgtttcggttttttaaagtgtcggtattataggcgtgagttattatagtttgtgtttttaagtttggttattttttatttataagatagttatttttattttttttagttggttgttatttaaatttgatttattaattaaataaatttaaaagattaaggaatgttgttatttattaggaattttggatttttcgttttttttgatgttagtttatttttatgaaattagttattttttatttgttgtttatggagtagtatagttgtaggttaaaggttagttttaatttgaattttgattttttggttgtgttattgtttttattttttttaaaagagagattttttttttattttttgatatatttaaattgattaggtgattattttttgtttacgttttaaaaaaataaaattgaaaaaaattattggaagaaaatggagttgggttatttttaatgtaaattttttttttttttttattttttattataaaaagaaaattttaattgtaaaattatttttatttttggattaaaaatattattaaaggaaaggtaagagaagaaagagtttagtttttgtttgtgatgaagaaaattttggtatggttataagaatatagaataagaattatagggattttggtatagttttgttttttgttttttgttttttgttttgttatgtttttttttgtttttgagacggagtttcgttttgtcgtttaggttggagtgtagtggcgcgatttcggtttattgtaagtttcgttttttgggtttatattatttttttgttttagttttttaagtagttgggattataggcgttcgttatcgttttagttaattttttgtatttttagtagagacggggttttatttgtgttagttaggatggtttttattttttgattttatgatttattcgttttggttttttaaagtgttgggattataggagtgagttatcgtattcggtttgggattttggtatagttttatattaatattttattaagtaaaaagttgaagttaatattcgaagttgttagatatggagaatttagtgataattttgaattaatttgagtgatttttttttttttaaagttgttaaattgttttatagatatgtttttgtgggatgtaaataatagagtatatatgatttttttaaaaaaatttttttttttttgtgttttaaggaattggaaattaaaaattgttttggtttattataagggagaagatgggagttttttgttgtttattttgaatgtaatttatattgtttatgagtgttgatttaattttatatgtttttgttcgattgtttttatgaaatatggtaatttaatgtttaaataattgttttatttgtgtattttttgggagaaagtattacgtaaaattagtgtttaatgattttgataattaaattatatgtgattattatttttttatagtgttttttttttttagaagagttatttagatatagtagattaatattatttaggtatttgggttttttagtttagtaattttgaatgtatagagtataagtatataatgttaattggtaaagttagagttttagatgataaggtatagtatgtaattttttgtagtttattgatagtaatttaaataaaagtaaaggaagatgtttttagtattataaattttatgggaatttagggttttttaaagttatattgtttgggttattagtaggaggtatagtatattaaagtaagtagtttagttttttattagtggtgagatgtatgaaaattttggtaatgttagggggaaaagaatttatgagtttttttttcggttattttttttattttttgtattagtttttttagggttaaatatatattttatagaagagttagttatatatgggttgggtggtttttagtgaatttgtaaatgtattaaataaaaatagtaagttggaattggaataaagggttagggaatataggaaagaagaaaataaagggttttaggtgtttagaagttaaatatattttagggttaaaaaaaaaaaagaaagaaagaaagaaagaaaaagaaatttgagtgtgttttgtgttttatttttttgtagtttatgaattttatagaattaaaaatattaaattattaaagatagatgattaagaaagaaaagatagatgaaaatgtgatagttattgaattttaaaatttaaagtaattattatttagagttttagagattttttatgaaaggtgagtggagataaaattgtataaaatggaattacgatttttttttgtaatttgattagatagaggaagaagatttaagaaaatgttaaataaatttttgtttattaattagtttatgttttgagatttttaatttttttttttttttttttatttttattagaaaaaaaatagaaaaaataaaaaaaataattataatggtattaagatatattttaataagaaggtttttgtttgttgttttttttttttttttttttttttttttttttttttttttttttttattaaggttaggtttttgagtgatttaaaatatttttttgtggtgtgattatatttattttgtattaatatttttagtttttttttttttttttttttaaatattttttgttttgatacgtttaaatattttggtgtttaggttggggaagttgagttgttgtttatgagttatttttagtgtttagatattcggtagtttttttttaggaagttagttttgtatatgagagaaaggaaaaaaaaaaaaaaaaaaaaaaaaattaaattgttggaggagaggtgggggaaggttgagaaagttggagaagggggtaaagattagaaagaataaagtttcgatatttaggattgttaaagattaaagttatgtggatatttttatttttagaaagttttttttttttggttgggagcggtggtttatgtttgtaattttagtattttgggaggtcgaggcggtggattatttgaggttaggagtttgagattagtttggttaaaaaggcgaaattttgtttttattgaaaatataaaaatttgtcgggtgtgggggcgggtgtttttatttttagttatttaggaggttgagataggagaattgtttgaattcgggaggtggaggttgtagtgagtcgagatcgtgttattgtattttagtttgggtgatagagtgagattttgttttaaaaaaaaaaaaaaaaaaaaaaagaaagtttttttttttttaaaataggatgtgaaaggtgttgagttgtattataatttgatggggagggtaaagtattttttaaaaagaatatagaggtgttttttttttttttttagaaattgatggatgttaatttatttattaatttgcgtggggaaatttttttttttttatttcgatttggtgaatgttagtattatataaagtattttgattttttagttgtggttagagttgttatttgtttgttatatatatttattatttaaatttttaaagaggagtttgtaaatgaatgttttttataagttgttttttttataaatgtttgatagagttaggtttttttaaggattttttatgtttaaaaagtttttaaaagaataatgagagaggagagaaaaaattattattttattggtagtagtttaaagagaaaagaagattaaatgttaggtatgagaggatttatacgacgttttttataggaattgtttgtggaaagtttttaaatgttgagattaagaaaggaggaaagtggtattaggtttattggttgttggtgaagtttttgaaatttatttaattagttttaattattttgaagtattagtataataaatttatttattgtattgagtttgtaattttttttgggaagttatacgttataattttaggaatttattttggatggtttttggaatatttcgtttttatattaaatgtttttatttgttaaacggtgtttattagtgtatttaaattagttgttttggttttgtttatattattattttatttaggaatatattgtagatttgataattaagaatttagtttttttaaaatgtttataagcgatttaagaaatatggatggggaaaaagaggggaaaagagttgttttgtgtattaaatttgaaaaaaaaaaaaaaaaagaagaagaagaaaagaaagaaagaaaaaggaaaaaaaaaaaaattgttttaagttagttgatacgattggaggttattttgttaattttttgtagaaagttgttttttcggaagagaggaaatgagaaatttagaatggttagtatggaatttattttttttcgagaatttattagttttcgtttgggtttaatgaggggtcggttttgttcgtttattttgtgatagagttcgtaggcgttgtataggtagtgtttcgtgttatttcgtcgttatagtggggtcgaggttgttttatagtttatatattttttgttttttggaaataaaagtatagataagttatttagggaaggaaaatacgtaggaaagttgatagtatttggaattgggggagaaacgtaaaatggagaatttttttttttttttttttttttttggggagcgtgtttatttttatttttttttaagatgttttaaagttgagttggggaatgttgttttggtatgatcgttttttcgatatatacggaggcgttcgtagaaggggtagatgtatcgttgtaatagaattttgtttttggtttgttcgatttgatggagaagatcgggtaggattaaggaggaatgtagattttagttataaatatttttttgagaaaattttgagttttggatggtggtaaaaggtaaatattttatttattttttttaaaggaaaaaaaggaagataaaggtgatttattattattatgggtttgtttatagagattgattaaataatgaagattaggatgggggaaaggaaggatttattaatggttagataggtgaatagataataaatagatgtatagattgattaatcggttgattgattttattagttagggttttagattttatttttaattaaattgtaaatgtttttggttggaaaggaagcgattaggatttagtaggggtttttatagttttttagtcgttgttacggagattgaagttaaagtatgattttagttagggggtgtaagggggaaatgtaaattttaggtagggaatttggaagagggggagggagggaaaaaggaaaagggaaggtttgggaggatagagtgaagtcgattagaggaagattaggagaagaggtaagttaataaagcggggtggttgtttagtaattaaggtttgtttatagtttttttttttttaaaaatataaataaataaaataaacgaaaaattagttaggtcggtaggaagtttgagtagtatttatttttttagtttaggttggaaagcgatttagatttatttagaaagttttttggaagaattttttaaattattattttaagatatgggggagttggttaattgattttaattttgtaagaggaagagaaagatgttttttaggagaatttttttggttttgggggatttagggatatacgggtttttagcgtttagttttttgggtgtttagagaaagttaggattttttttttttgtaggaataggaggtttaatttaagttggttttttagagaggggaggtttagaggaggatttcggagggtaggtagggaagaaaaatgagttttgaagattgttttgttttaagagagtaattaatgatttttaatttgttcggattattggggtagaagaagagaatttagtagggtgtttgagaattttgatttttttaaaaggaggaaaaatttgttttggtagatatgggatttattgggtttttggaaagttttagattaagtaggagggaattaggggggtttatatttgggggtttgtgatattttttaggggtaagttttttaggaaagttaaagatttttgtaaatggaagagggttttgtatttttgaaagttagggatggtgtttattagtttttgtttattttgttttttaaaaaaaaaaaaaaaatgaggatgtaagagaggtttttttttttgttttatattttaaaagatttttagtttagggtttttagagagtttttgttgtgttttagaatttttgagattaaatataaatacgttgtagtgtatgttaaaggcgtttttttaagtatttaacggttttttttagtttttgaaaaaggtttaggtttgaattatatttagatattttttagttggggttaaaagtttgagggatgtggtagattggatgtgggggaggttggaaggaaagagtgaagggtgagtgggcgagtaatcggttgtagtttaagttaggtcgtaggtttgtttttttgtgtcgttggtggttgttgggttagttttttttggggtagtattggttttgttttagttaggattgtaggtttattttttattttgtttagataggggattttttcgggttttttttttatttgggtattgggtagagggtagtgtgaggagaggtcgttgtggttggaggcggggagcgtggttgttattcggtttttgggtattttggtgttgggggattttttagtttgatatgattagtttgatttttttttatttgtagggtggtggggagggtgatagttttttttttagaaatattttgaaagttagtaacggttatttttttaataaggttttgtatattagggtaattttttgttttgatttattcggtaaggttgttattgttttttatgggttttttttttttttttttttttgttgtttttggtttgttattttagtaaatagttagtttttttaatggaggttttgatttttttttgttttttttttttttttttttttatttttgtttgttgtgagttgtttaggtagatattttttttttaggtgataagaattatagagcggcgaggttttttgatatttaatagttgttggtaaatgttttttgtttcgttttggtttgaaatttttaaattaggttgtgggagggggtagggagtagggtaggagttcgattagatgatagtggagggagatgtttaattggaaaggtggtagtggagttaagaagcggttttggatataaagattttgttttttgtttgtaaaagtttcgttttagtttcgaaagtttaggcgttaagatagtaataggtgttttaattacgattttaatcgtttttagcgataattttaaaaatttttttttttttgtgtttttttttagtaaatgtatttgtaaagaagaggttaaaggggtaaaaaagagagagagagagagagagagagtaattattaaaattaagagaatttttttttgaagaatttttattatttttattttttgtaaaaggaggggtttttcgaaattttttttttatatttttaaaagttttagttcgttcgtcgtttttgttaggtgtgttgttttcggtttttacgattgtgagaaaggaattaagaaggaggaagtaaaaaggttaaattgaaatggttttttttttttttcgttaaaaaaattaaaatcggtgtatcggtatttttagttttggtttagggaaattacggtttttttttttttttttttatgtttagagttttatggaaagaaatgagaggaaagaaaagattaaatttaaggtagaaagtgtgtataagagggggagaaattaaatacggaaatgagggtaaagaaattagagtattttggaaaagttattttgtttttttttttcgtataaattattacgtcggttttagatattacgagttttttttaattttatagttttattagaaaagagaattttaaaaaaaaaagaaaaagaaaagaaattttattataattttaaaatgtataggtttgttttttttcgatttagttttttagtttgtgtttttgagttaagttgtattttattttttaatttttttttttatttttaagtttagtttttgttaggtatcgtggttattttgtgtttttagttttttcggttttttgttttttttttgattttattagttagtttgttttttttttttttttgtttatttttatgtattgaatatgtaggtttgggtttttttgttagtttaatcgtattcggattttattaaagtttttggtttaggataaataatgtaattgtcgcgtgtagtagtttgaaaataattggattagttaaaatatattaattaaatagagatagttttgtttaggtagtcggagtgaatgttattttggaaaaaaattttgaaaattgattttatggttattgggtttttagagtattttttttgaagttttttaaatcggagttttgggagttcggttttaaggttgtttattttatttttaaaagataagtgatttttacgattgttttttatataggatttgtagagagatagcggaggtaagatatttggagtcgattagagaagagatgtttattttgaaatggatacgtttaaggagatattaaaatttttattaaattttgtttaataatatagttaaattaatattagagaatttttagtttttttttgatttaattattttgtttagaaatggaattggtgatagatcgatttatttttaaagttaaagtattttgtgtggggtttttttttatgtaagtaatgatattaattgaataaaaatgtagcgtgttgttaggtagcgtttgtattttggaaaggaatagagtataggaagttgagatatatatttggagtattttttcgtttttttttattttttttggttgtagtttagttaagtaatatgttttaatacggttttttgtttttgattgtattgagagttttaggagacgttgtaggtaattaattgggttaggcgatatttgatttttatttaattttgtttttttaatgtaaagttatcgtttttttttagtttagttgagagtttttttttttacgtagagaatatgcgtgtagttttggttaggtttatgtatatatattttgtgtttatacgtttaataaaggattgtttttattgcgtggttttttttgagttgagcgagaggaatagttagaatgatagaggttaaaggggttatagagggatttgtgtttgtttaggtttgaggaggtttcgttttagtatgaaatatttaagaattattttttcggttttttatttggttttggaaattgattaaaggttattagtttaatttagaagttttgcgataggtagaagagggtatgattttgtttttgtttgtttttttttttattttagtttattggggggttttaaattagattttattttttttttgttttcgaggttaggcgtgagttaggatgggaggatatgtagtgttttttcggtaggaagaatgggaagaatggtattttagtaggttttgggatatttcggtttttttgaggggtttttttgggtgcggttttggattgaggaaaaggggaggagggaggagaaaaggttttagggaagagttggtttttatttgtgttggatcgggttttgggtttggatttgtattcgaagtcggtgggggagtcgtttagtaggttgttgggggggaagagttcggagttgtattcgggtacgtagggcgggtaggtggtgatggggtggtgggtcgacgaggaggttttatttagggcggttatgttgttacgggagtgggacgattttagttttatgttgtcgggtaggggtatttggtatttgaggtattttttttcgttttgtcgggtcgagtcggtcgagtttggggtggatagcgatgggttcggggagacgtttttcggcggggtgggcgggaaggtgaagaggtgcgggttggcgtggtttttcgataaggaggaggacgaggtcggggggtagacggagaggggtttcggggagtcgtggtggatggacgttttggagaaggggttgagattttagggggaggcggtgtggtggttgtttagggttttgtcgtcgtttagttagggtagggatttatgaagtagaggcgggcggtatatttggttttttgtggggtaacggggaaagggtaggagagagaaggagggtgagtgtggttttgggaggtcgttagggatatttggggaatttttatttcgtatcggttttttttttagtaaaagttcgggtttaggtttatttttttattttggcggttttcggagtatttgtttggtatatttgggggttaggttggggatagaattttttatttattttttttatagggatgttttattaaatgtagtagaatgaagggtttgtggttgatattcgagaggttgttgtagagggggagaagggtttttttgtttatttggtttttttagatatatcgtttaaattatattttttaaggtttttttttagaatttgatttgatttatgggttttttttaatggttttgagttttttgattcggatttaattttagttagtttgataagagagtcggttgtgagtgaggaggtttgaaggatggagttcggttatataattgttttatattagaaaacgattttggagttaggtttagtttttagtattaaatataggaaggagaggttttgggatagaagttaggagatttttagggttagttttcggaaatttaatttagtgtttgtttagaaacggttaggttgttcgtaaaaggtttaaaatgggatttgtagggacgtttttattgttcgggttgttggagaaagtttttaaggttggattttgggatggttattttttttgttttttttatttttttaaattttaaaggagaaggagataacgtaagttttatgtatttttaataaagttatgattttattagtgttatgggtgaatttttatttgagtttttaagatataaaattttagttgatgtgtatattttaaatgaaagatgatttagatatagagtttgattagtttttatttaaaacgtataattttaaggtagttgtaatttatatattttgaggggtatatttaaaaagtaagtgtaaatttatatattttttgatttttaaagttagtatttgttttagtatttgatattcgatttaattattaagaataatattgaaattaaaattttaagggagaggaaggggaggggagtggagagggaaagagagttttttgaatattaagggttaagatttatattatgtaggaagtagtatagtaaataatattaagtttgtttttatcgtatttttatttaattgttgattcgtatagaacgtgggtaaagagcgttttattcgtagaaacgattgtttaaaatttggcgatagtagggtagaggacgtttgttgtcggaggggttatgttattcgtgttaaggtaggttttgagtaggggaattagggtagaattcggtttggttggatttagaaagttttatattttttttgttcgatgttttatttttgttttttttttaggaataaatttagagttggaaagtgttcgattttttttttttaaattatataggtttggttttttttttttatattttagaatttttttgaatttttttaggtgaaagggagaaagaggtggtattggaattgtttttatttaaacgggggtgtattttatattttaggtgggaggttaatggagggtagtatttagagatagagtaaggtaagagttgtaggtaaggaggcgatttgaaagtaaagacgtaagaaaattttgtgtagtcgggaatttgggaaattttagattttttaaatttaagataggggtttttttttttaaatttttttagtattagaattttatttttgaagttaggaggtaagagatttgtttaaaaattaaaggtattagttttgggaaaaggttaaggagaagggtgtgaataaataggtttttggggtttttttgaaaatgtgcgaattgagggacgttggtagagggttttttttatttcgtttattcgtttagaaagagttagcgggtaatagggaacgttaggttttttggaagagtcgggttttagtcgtgtttgttcggcgtcggttatcgggtttagagagttcggattcgcggaggtagagttagggtatttcgcgtttggggatatttcgagattttttattttaaaatttgtagtcgcgtagagacggagggttgcggtttggcgttcgttaggtgagcgttaggttttagggttattagtcgggagaggcgtttgttgcgatttttttaaaatatattttcgcgacgagttagaggtttttttcgtttattttcgggttttaatttttttgtaaatgaattaggaacggtagatgggggttttcgtttgattttttttcgtttttaggtttttttcgattttttcgagtcgggacggttgaagcggtcggcgggagtttcggtatttcgggcgtatttatcgtggtgggtcggagggtatttttgtatcgtggttttgatcgagttttcgtagtagggcgggacgtggttgttttgatcgtcgatgttaaaaagtatatttatttttttcggtagcgggtattgcgtcgcgtttatgtaggagtggttgaggttcgggtggtgcgtgttcgggtgttgttcgttgagtacggcggggtggtggtggtttatttagcgcggttggttcgtcgttatttttatggtttcggttgtgttcgcgttttttcgtcgggttcggaattcgcgcgcggggagggagggcggttcgtttgggaggtcggggggtttttgtcgtcggagggtcgggggtcgttgaatgatttgttttcggtggggggatgggaaggttgggaagtaaaggtgagtaaaggagaaggttttttaaaaattattttggaggggtcgtttagtaaagagaagaaggggaagataaaaatttaaaaattgggtacggtagaataaaacgggattaggttgtaaaaaggggcgacgattttgtaattttgcgagttaggtttttttgtatcggggtttttagtcgttcggaggcggagttttttttcgggttatttgtaagggagagaatgggagatttggatgagtttttgagttgttggagtggtataattttttttcgcgtcgttcgttcgtttagcgtattcgagattcgtacgggagcgcggggatacggtcgcggagttcgtagggttttcggggacgtttttgtagttcggttcgcgggagtcggggttggttgagtaatttggagggtaagttttagggttgattgttacgatttggagggtaagtttttttttcggggatatcggtttcgggatcgtttttttagtttttagaaaatttttaaaagaggagagttgagtttttaaaattgatttaggtttttttaagtggttgggggtaaaaaattaaatttaaaaaaaaaaaaagttattagtattaatttgggtagcgaagagtagagaggaggaggaggcggcggcgtacgatttgttcggttagattgcgttgttcgttttgtttcgtttttttttcgttttttttttttttttttttttttttttttttttttagtattttttttttttttttatagggaatgtattttttttgaaagtattaagacggcgttaggtagtttagtgttcgtagatagttgtggcgcgacgtaatttaaggaggttttagtgttattcgcgtcgggggggaggagtttggcgttggcgagtaggggataggattttcggtataaggaaattgtaatttaaattcgttttaggattttttttttcgtttcgcgtattttcgttttttttttcgtttttttattgatcggaaaggggcgtcgtagagggcggtcgtcggcggaggggcggcgggtagggtgggcgaggttcgcggggtttgggggcggacgggagggaacgcgcgttttggttttttaaatgtggtcgcggtttttgttaatttattcgggtcgggtggacgatttcgtttcggtgtagttagtttgttttatttatgaagtttatttcgatgggtagaatttttttttttagatttttaaaaaataggtacgtatggattattattaggatttaatgtagggtgtttgggagagcgtatcgatgtggggaaacgtgcgcgttaaattgattagaaaaataaaatgttttatgttaaggtattttgagatttgtttttcgggtcgattttttaagagggtgagttatcggataaaggggagatgtttttgattggagcgttcgcgttaattttgttgttattgttatttttttttcgagttttttgcgtttttaagtttttagagtgaatacgttttagttgttgtagttgttttttttagatttaatatttgtaattaatgtgtgtttttgatttgagtggtaatagtgagggatgagaaggggggaggggaggaagagattggttttaatttatttttcgagtacgtttagtgtagacggatagaaagaattcggtttttattttagggatttaattttttttttcgtttcgttcggagttttatttatttcggttttcggcgttttttttatagttaaggaaattagttttcggtttgtatcgattttaatttcggtttttggtcgggattttacggcgatttttttcggttcgcgggtttttaggttacgttttgcgtaatgggtatttcggggcggagggtacgcggtttcgaggcgttttagcgagaggggcggggcgagcgggggcggggtttggagggattaattagcgggcgaggttgtggtcgagtcgcgattggttcgtttcgcgggttttaatttgtatcgttcgttcggttttttgagttattgtattttttagcggcgttcgggtggttgtagtcgttggttcgaaaatgttgttcgggcgagtaggggttaggcgggaaaagaagattttaaatttattttttgttcgtttttagggtaatgttgttaggagagggagtgggttttttcgtaggttattttatcgatggggttgagagtttaatttggggttttatttgaattggagatattgtttttttttcgtttttttattttataaaattttttataaatgtaaaaattcgagatagaagaagtcgtttttgaaagtaagttttgaaggattttttttatgcggtgaaggaataataataatatttaattttattttggtgtgtgagggtcgtcgtgttttaaaatattatttttgtagaaagattagtgaaatgtattggaagaagtagtggaaacgtgaatttttttggtttcgcgtttggattttttttggagtttttatttttttaaatttgatgtttgtttgaaattagggttgaatttttatatataggatagaaagaaagaattttaattttttaaagaaagtttttttttttttcgttacgttttttttgagtttatttggtttttcgttattaggcggtttagttaagaggtatcgattttttttttattttttgattattcgttttttttgggttagttaggttgttcgtatttttttttgtttatagcgttttttaaattttttaattatttagttgttgtttaatatttatcggaaatttttttataaataaggag

SEQ ID NO: 184 - DNA, 5183 bp, Artificial Sequence
  Chemically-Treated DNA
gggggaagggatgtaagggtttattaaaaatattttattttaagggtggaatatattagaattttgtttgataatttaaaaagaaggaagaggagtggaataagggttttatttttataataattttatattggagttaattaaatgtgaattttttagtttttggtttattgatgtgaggaaagattgattgaagatagttttggtttttgaagggagttttgtttatatatacgttaatatttagttggaggtgaaaaggttagtatttgatttaggaagtatttatgtttgttttaaaaataaatttgttttataaatttttttattagtttttttttttattatgagttttgattataataaaggagttgttattaatttttatttaagaaaaggtttatttttttgaaaatatttattatttttttttttttttttttatgaaatgtgttaattttataggaattaataaattgtagtttagttaaatatacggatgtttaagtatatttgaaatttgagtatatttatttattatagatattttaagattcgtaaattttgttttggattatattattttaggattttagagttgtttatgattgtataggaaatggggaatattataggtttataaaggataattgatagaatttagtgtggtattttggggatattaaatattgtgcgatatgtaaaagattatttacgaataatataaaatatatatttattgtgttatttattatattaataattgagttgaaaatatattatatttagttaagataattgtggaaggaagaaattggtttgaataatatttttaggttttgaataatttagtataaattttaaatagagggtggttcgagaagaaaggggtagagattgggaaagatttagtataggaagtcgggtttttgaagtttgtgttttgtagggttttttaattgtaagaataaattaaggttattttttgaggtatttgattgggtttaaatgagggaatttttttttttatttataaaattgtattagtttagagagtttgtttattttgttttagtaatttaaatatttttagaaaatttgtataaagataaattttttaggataaagtatttataattagtaaatttatatatatgaaaatgatttaaattaagggatgaattaattgtgtaaatatatagtgtattttttttttttgagtttttggattcgtttttcgttatattttatttttaaggataagggaggggagagttgtatatatagttagataaaagatgagaagattttttttggtatgtttttgttggtaaagggaattattttttaaaaggttatttgaaaggaatagtaggttttgtgaatttttttaaaagtaggagggatgttaaggtttattagaaaatgtatgttggtatttaatttggatgaaggtgttaatttcgtattaagtttttggtttagaattatttgtaaatatattattttggttaggagttttttagataggattagaaaggaagaaagagattgtaaatggaaagaaagataagttaagtatgtgttttgggtaagaagttttagtttaaggagatgtttgggttgttgtttggggttggagtcgttttagtgggaggtagttagagtgtttgaggtagaagatttcggggaaggaacgtagggcgaagagttggatttttttgaggatttttcggttttttcgtcgttttttggcggggtggtcggagagatgggtaagagatttttttttttacgttttttttgttttattcggcggttttggaattagatttttatttgggtttcgttgagttgtagggatgtagcgatttttattttgcgggcgcgcgttaggtatttgttgaagtggaattttttttttagtttcgtgagttgtttggtagtgaagttggtgcgtatcgcgttgggttgatttaggtagtcgtattttttaattttttttggggtaaagtgggaagttatgagacggaaatgtaaaaatttttaaatcgatttgagattttttatacgttttatggtaatatttaggtaaagaaaagattaagaatttagtataaatcgggttgtggagggtgagtgatgaggtgtaaagtgttaatttgatgtaaattattagtatggttagatcggtgattaatggagttttaagatattaatagaatattatcgttataataattatttttatatattttttattttttaaatgtataaaatttttgaaaatatattaatttttgagatttttttgttttaatatttttgggtattttttttatgtattataatattagtttgatataaaagttttttaaaaaaaagattattattaatttttttggaaattaagtatattagttttttttagaataattaaggagtatttattaattagtaggattgatttgttttgggagggttttttttgatttttatttagttaaaagtttgcgttggagaagatgttttcgatgcgggggagcgataggttttttggtggttggcgtggagaggggataaggagttattatacgtagttagggttaggttttggtgtttttgtttatatgagtggtgaatgtattgaggcgagtttatcgcgtttttagtataattttggtggtggtggtgatgttggattatgggagatgagagatttttagagtaaatagcgggagcgtattgggggtatttattatttacgtttgttttttgatttaacgcgtaggggttgtaaggcgtattgaagttttgtgagttatagtttggattataatttgagtgggagtaggatatttttaggttttcggaagtttggtaggtagtcggttgggggtggcgatggtggtggtggtggtggtggtggggcgaatcgatttgtatttttttgtttattaggaagcggtcgtcgtcgtcgtaattgttggcgttgatcgcgtacgattggaaagttgtaattttatggttcgaggggtaggttcgggttgagtaggttttcgagtcgttattgttaagtatggggtattttaggaaggagtttatttttgtattgtttatttgttattgagtgatttggttttgcgaagttcggcgtgattgtgttaatttttttattttttttatggggtcggagaagaaaaatgatatgaatgtatagtgcgtaagagggggggcgggagggcggaggacgttggaggaggggtacgtgacggtgttagttaatggttgagttttttgtaaaagtttgtcggttttcgtagtgatggattatcgttttagtggtatttaaattttcggcgtttcgtcgtttaggtgacgcgtagtcgtttttttaggtagtttaggcggcggtagttgttgcggcgattgtaaaggtcgatttggagtgttggagcgaagaagagtaaaagttgcgttttgcgcgcgttcgatttcgttgttcgtttcgttaggttttcgggaggtgggggttgggaggcgtttttcgttttcgttttttttttatcgtttaatgaaagatgaattggcgagaggtgagaagggaagagggttttcggttttttcggggcgggaattagtgggttagagttcgtcgggtggtcgtaagtacgtcggtttagttcgtagcgcgtttagtcggaaggcggggaattcggttgatatcgcgtttcgggtttttaggttattttttttgttttgaggttgggttgggagatcgtggggttgtgaggagcgtatagaatcgtggtggagggcgaggttgggttatcggttttttaagttcggaatggagggggaagagcgtagagggttggttgggaggaattcgggtgggcgtgaaggagacgagggtaagaaaagaaatttttttttttttaggagggttttcgaaattttttttttatagtttttttcgttattagtatggtaatgaggagtttttgtaattcgatttggaggggcggatgagttttggaaatttagagttcgtcggaaaaggtcgggggcggtcgggttttttttttttattttttttttttcgtcgtttttcgttttttttttttttttatttagttttgtatcgggagtttttcgggatgcggagttattcgatcgtcggatttttaggggtaggaggcgggggagagagatgacgttggcggacgtggttagcgcgggggtcgggcggtgcgttgtaggttatttgtcggcgttttgagatttaggagttttcgcgttttcgcgtgggttttatagggtcggtttatagttttaatatagtagttgaatttttttcgttgcgtttttttttttttggaggggaatgttagaagagagagagagtttttttttataattttttttattttgttgtacgtttagagtgggtgtgggggttggtaggtgggaggggcggtggataaatggttgatggtggacgggatattttattttaacgatatttttttttttttttaattggttgtgtagttgtttatgagaatttttaagtttttttttagagagatatatgtaaatttgagttttattttaggttaggggttttgttttttattattttatttttttgaggttgttgaggtcgttaaattgttgtttattattaggttttacgttaattttgggtttgtagagagaaaaagttaaacggagattaagaattgatgtagttttgggtaggagaaatcgagagtttgtttaggaagttttgttgtataaattataagtaatgttgtataaattttattttaattatgtgtataatgttggaattagatgaaatttatagtgaatgaatgtatgtgggtttggggtttttatttttttttagttttttttttcgttagaataaggaaggtttttttttttttaaggaaggtatattttaaatatgttagttatttttttagttttttgtattttgttttttacgtatcgaagtttttttaaatttgtttttttaagagaaaaaatttatgttgattttggatttttttagtaataatgaaatattttttttaaatatttttttttagaatagtatttgtgattttgatttattttaagtatggttaagagggagtacgggtaggaaaggt

SEQ ID NO: 185 - DNA, 5183 bp, Artificial Sequence
  Chemically-Treated DNA
gttttttttgttcgtgtttttttttaattatgtttgggatggattaaagttataaatattattttgaaaggaaatgtttggggagaatgttttattgttattgagggagtttagagttagtatgggtttttttttttgagaggataggtttgggggaatttcggtacgtggagaatagaatatagaagattgaaagggtgattaatatatttgaaatgtattttttttgaaaaaaaaaaaattttttttgttttaacgggaggaaaggttgaagaggagtggaaattttaaatttatatatatttatttattataaattttatttgattttaatattgtatatatggttggagtaaaatttatatagtattgtttataatttatatagtaaagttttttggataagttttcgattttttttatttaagattgtattaatttttggttttcgtttggttttttttttttataagtttagggttgacgtgaaatttaatagtaaataataatttaacgattttagtagttttagggaagtagggtgatgaggaataggatttttggtttgggatgaggtttagatttgtatgtgtttttttagggaaggatttgaaggtttttataagtaattatatagttagttggaaaggggaggaggtgtcgttggggtaaagtgtttcgtttattattagttatttgtttatcgttttttttatttgttagtttttatatttattttagacgtgtagtagaatgaggaaggttataaaaggaagtttttttttttttttaatatttttttttagaaaaagaggaacgtaacgaagggagtttagttattatgttggagttgtggatcggttttgtgaggtttacgcgggagcgcggaggtttttgggttttagggcgtcggtagatggtttgtagcgtatcgttcggttttcgcgttggttacgttcgttagcgttatttttttttttcgttttttatttttaaaaattcggcggtcgagtagtttcgtatttcggagggttttcggtgtaaaattgagtgggaaagagaaaggggcggagagcgacgagagagggaaggtggggaagaagagttcggtcgttttcggtttttttcggcgagttttgagtttttagggtttattcgtttttttaagtcgaattatagaaattttttattgttatgttaatgacgagaggggttgtggggagagggtttcgaagatttttttggaagaagggaagtttttttttttgttttcgttttttttacgtttattcgagttttttttagttagttttttgcgtttttttttttttatttcgagtttgaagagtcggtggtttagtttcgttttttattacggttttatgcgttttttatagttttacggttttttagtttagttttagaatagaggaggtggtttgggaattcggggcgcggtgttagtcggatttttcgtttttcggttgggcgcgttgcgggttgggtcggcgtatttgcggttattcggcgagttttggtttattgattttcgtttcgagagagtcgggagtttttttttttttttatttttcgttagtttattttttattgaacggtggggagggggcgggagcgggggacgttttttagtttttatttttcggaggtttggcggggcgggtagcggagtcgggcgcgcgtagaacgtagtttttgttttttttcgttttagtattttaaatcggtttttgtagtcgtcgtagtagttgtcgtcgtttaggttgtttgggggggcgattgcgcgttatttagacggcggagcgtcggggatttaaatgttattaaaacggtgatttattattgcggaagtcggtaaatttttgtaggaggtttagttattggttgatatcgttacgtgttttttttttagcgtttttcgttttttcgtttttttttttgcgtattgtatatttatattatttttttttttcggttttatggaggaagtgagaaagttggtatagttacgtcgggtttcgtaggattaggttatttagtgatagatggataatgtaagaatgaatttttttttggaatattttatatttagtagtggcgattcggggatttgtttagttcgagtttatttttcggattataggattataattttttagtcgtgcgcggttagcgttaatagttgcggcggcgacgatcgttttttagtgggtaggggggtgtagatcggttcgttttattattattattattattattatcgttatttttagtcggttatttattagattttcgggaatttgggggtgttttatttttatttaagttgtggtttaagttatggtttatagaattttagtgcgttttatagtttttacgcgttaaattaggaagtagacgtaagtggtgggtatttttagtgcgttttcgttgtttattttggaaattttttattttttatggtttagtattattattattattagggttatgttgggggcgcggtgggttcgttttaatatatttattatttatatggataggagtattagagtttggttttggttacgtataataattttttgttttttttttacgttagttattaagaagtttgtcgttttttcgtatcggagatattttttttagcgtagatttttgattggatgaaagttaaaagaaatttttttaaaataggttagttttgttggttggtggatgttttttgattattttggaaggagttggtatgtttaatttttaaggaaattaataatgattttttttttaaaaggtttttgtattagattagtgttgtagtgtatggagagggtgtttagaggtgttggggtaaagaagttttagggattggtgtgtttttaaggattttatatatttgggaaataggaagtatgtgggggtggttattgtgacggtagtgttttgttaatattttgaggttttattaattatcggtttgattatgttaatggtttatattaggttaatattttatattttattatttattttttatagttcgatttgtgttgagtttttgattttttttttatttgagtgttgttatgaagcgtgtggggaattttaagtcgatttaaaaatttttatattttcgttttatggttttttattttgttttagggaaagttggagagtacggttatttgggttaatttaacgcggtgcgtattaattttattattaagtagtttacggaattggagaaggagttttattttaataagtatttgacgcgcgttcgtagggtggagatcgttgtatttttgtagtttaacgagatttaagtgaagatttggttttagaatcgtcgaatgaagtaaaagaaacgtgagaaggagggttttttgtttattttttcggttatttcgttaggaaacgacgagaaggtcgaggaatttttagagaagtttagtttttcgttttgcgtttttttttcggggttttttattttagatattttgattattttttattgaggcggttttagttttagataatagtttaggtatttttttgggttgggattttttatttaaagtatatgtttagtttatttttttttttatttatagtttttttttttttttttaattttatttggggagtttttggttaggataatatatttgtagataattttggattagagatttggtgcggggttaatatttttatttagattgggtgttagtatatattttttggtgggttttaatattttttttgtttttaggagaatttatagaatttattgttttttttagatgattttttggaaaatagttttttttgttaatagaaatatgttagaaggaatttttttattttttatttaattatatgtatagttttttttttttttgtttttgaaagtaggatatagcgaaaggcgagtttaggagtttaggaagaagagatgtattatatgtttatataattaatttattttttaatttaagttatttttatgtgtgtgagtttgttggttgtaaatattttgttttaagagatttatttttatatagattttttagaaatgtttaggttattaaaatagggtgggtaaattttttaaattggtataattttataggtgaaagaaaaaatttttttatttaaatttaattagatgttttagagggtagttttgatttgtttttatagttaagaagttttgtagagtataaattttagaaattcggttttttgtgttaagttttttttaatttttattttttttttttcgggttattttttgtttaaaatttgtgttgggttatttagaatttaaaagtattatttaaattaattttttttttttatagttattttagttggatataatgtatttttagtttaattgttaatgtgatggatggtataatgaatgtatattttgtgttattcgtgaatagttttttgtatgtcgtataatgtttgatgtttttaaagtattatattgagttttattagttattttttgtgagtttatgatattttttattttttgtataattatgaatagttttgagattttggagtgatatgatttagagtagagtttacgggttttaggatgtttgtaataaataaatatatttaagttttaggtatgtttaagtattcgtgtatttggttgggttataatttgttaatttttatgaagttggtatattttatgaggggaaagggagaagggtggtaaatatttttaaagagatgggtttttttttgaataaaagttaataatagtttttttattataattaaagtttataatggaaaaaaagattgatgaagaaatttatgaagtagatttatttttgaaataaatatggatattttttgggttaagtgttaatttttttatttttaattggatgttgacgtatatataaatagaattttttttaaaagttaaaattgtttttagttagtttttttttatattagtgaattaagagttaagagatttatatttaattagttttagtataaagttgttgtgaggatggggtttttattttattttttttttttttttttggattgttaggtagagttttgatatattttatttttgaaatggagtgtttttagtaaatttttgtattttttttttt

SEQ ID NO: 186 - DNA, 20899 bp, Artificial Sequence
  Chemically-Treated DNA
tgtacgatagtgagtttgagagtttggtttttagtttttttatttttttatgtatgtgattaggggacggagagaggtgtttatatttttaaggtttttttttttttttttttttttatttttttttgtttgtttttaggtgtttagttttttttttttttttggtagtttagtatttaagttagagagtggaatatttagaagattatgatttttaatgttttattgggattgtaagcgttataaggttaaagataaaatttaagtatgggattttgtcggaaatattagcgttaaaggagttgagttgagttaaatacgggtcgtaaggtggatcgaggcggtaggtataggtgatatttagtgtttggcgtgggggtttttaggtgatggtagaggaggggatttaagagggggttttttattgaagatattggggatacggggaggagataagatggagagttacgattaggtacggaggttagataggtagttcgggttaggatggttagtggtttaggggagagttgtaaatttggggacgtaaggggttggtcggtaagtgttttcgggaatatttatttcggcgaggtagaatataatattgggtgggtgggtgttttgacgaatgggtaggtaatttggggtgtttcgaagcgttttggattttaggttaatgtgggttttataattgtgataatttggttttttgggtttttgtttaatgtttcgaatggtttatttatagggcgtttgtcgagggattttttgcgattgaggcggattggtatggacgattttcggggttatgttagtttcgttattaggatttagaagttttaggtttttagattgttagtcgggttgcgtgtaggggggttgagttgggggtataagtgggggcgaggtaaattttttagaggtcgagtttttgtcgtagttttaggcgtcgcggtggtggttgttatggtattattagattcgtgggtttcggggtttaagtaatttggtcgatgggtagatttggtagtttttttgttttgtgggtttagattcgtttgatttttttatttttcggttttattttattttgtttttaagaggttttatagagtttcggattttttggagataaggtagggtgttgaggggcgggtaagatgttatcgagggagaggggagggttttttaagtgtgcggaaggcggttattttgttttagtttgatggaattttttgtttatatatttgttagttttttttttttcggttagttttaggttagttaggagtttttttttgtggttttcgagtatttttttgatatttgaggagattttgtttaattttttttttcgtttttaggatttttggggattagttattgtttttagaagttaggtcggatagtggttttttttatttttttttgatttttttaagggggtttagtggttagtgttttttaggaggttttatttttaatttaatttaagtaatagggatagatgaaaaataaaatttaattagggcgataaatggcggggggtaggacgtggtggtttttaggttggtttcgtgcgtttttgtttttgttattgtttttttgttatatggggggggggtttaatttggtttttgagcgtataaagttaaggaggggtaaaaaaaaaataaaaaaaaaaaaaaaaggaaaaatgttttaagaaataaagagggggaatagattaattgatatgaaatttgggggtttttaatttttttatgtaattttgtaagtttgttgttaatttttttgatttttttatttaaaatttttcgggattattttttattttagaatttttttcgtttagtttttattgttttttatttatttttttaatcgttagattttttatatttttcgtattagtgtacggttttcgaggattttatattttttggggggtttttaggagacgggtaaagatgatttttaggtgtgtttcggtgggggggtttttaagattttttttttaggagtatattagggagttaggttattcgtgggggtatgtttgtttagttatcgttatttttaatgtggttaaattttttttttattttggttgggttaatatatagtaagtaaggtgtatcgggaatgggtggggtatggggagtatcgtggtttacgttgcgggggtcgtggggataggcgttaaggaggttagttttataagggtatttttgttatggtggaaagatggaattaggtttgggatatatttcgtttattttacgggtgtattttaaatgtcgtcggtcgtatatttaggtcgtattatttgagtttttttttttgagaggtagggtatagatagggtcgaggggtagtggagatgggaataggagcggggtttagattatgaaaatattggagaattttagcgggattttggtttgatttatatagatatcgtagttgtttagatatgtttattgtttttatttaattttgtgggggtgtgcgtgtgtgtgcgtatgtgtgtgtgtaggtgggtgtttgcgtgtgtaacgtgtgtgttgcgtgtttgtgtgttgtgagttgtgtttatgtatgtgttgcgtatgagtgtgtgtgttgtgtgtgtatgtgtgtgttgtgtgtttgtgtgtgtgttgtgtttatgtgtgttgtgtatgcgtgtgtgttgtgtgtgtatgtgtgtgttgtgtgttgtgtttatgtgtgtgttgtgtgtgcgtgtgttgtgtgtatgtgtgtgttgtgtttgtgtgtgtgttgtgtgtgttgtgttcgtgtgtgttgtgttcgcgtgtgtgtgttgtgtgtgtatgtgtgtgttgtgtttttgtgtgtgtgttgtgtgttagtgtgtgtgttgtgtgtgtatgtgtgtgcgtgtgttgtgcgtttgtgtgttgtgtgttcgtgtgtgtgttgtgtgtgcgtgtgtgttgtgcgtttgtgtgtgttgtgcgtttgtgtgtgtgttgtgtgtgtatgtgtgtgcgtgtgtgtgtcgtgcgtttgtgtgttgtgtgtgtatgtgtgtgcgtgtgtgtgttgtgcgtttgtgtgtgtgttgtgtgtttatttgtgtgttgtgtgtgttgtgcgtttgtgtgtgtgttgtgttcgtgtgtgtgttgtgtttatgcgtgtgttgtgtgttgtgtgtgtgtagttgcggggatgtataaagtatgagtgttttttaggatgggaattgagatgtaagatttgggggtgagggtcgtgttaattatattttatttgtatggattttggtttttatgttttgttttttttttttttggttttattgggtttttttgattgttttgtgatttttagtgatggaaaagggagtgaggagttagtttgggttgttgttattttcggatggttagtttattttgaaaattttcgtgagaagggagatggcggtagtagcgacgtgtttatttgtgatttttggggttttttttttttttttgttggtttagggatttaagtttaggttaatttgatttaaagtttaagggagaagagaaagaggggggtggggagtgttaaatttttttattttgttaattgttttttagttaattcgtttttaatattttttttttttagttaattgattttttttggtggttgttttttttaaagttaatttttgagtttttgtggggtgtttttaaaaagttaattagttttaagagggttgttgtgggggggggggaagggggttagtttaatgttttgattttttatgtgtggggataattggggataatttggggggagggtatgtgaagggtgtttaaagttaatcgattttgtatatgtttgaagatgttgttgtgtttttttagttcgatggagggggtcgaggagagtagtttgtttcggggaggcggggtacggggattgggttaggagaagttttagggggacgtggaatcgagagattttcgggatggaatttgatggaaacgttcgtggttaggaggaggttgtaggatggtggcgtcgggttgtagatttgcggtagttttgtttattttcgattgttggttatttttgggggggcgttttcgtgggcggggttttgggtgggtagagtaattaggggacggtgacgtttggtttttttgaacgtttcgagttttttggcgagtacgtgatttcggcgggtacgtaggagggtaggtaggtttttgcgtaggcgttgggtggattgtttttaggtgttatattggaagaatttgtttacggggtatttggggaagttgttttgggaggggaaggggttggttagtaggtgtttgttttttacgttttttcgtttgagtcgttcgtttgatttgataggttatttttgtgattgattagtgatttgagttaatgtttacgggtagagggatagaaggagttagcgtttgagttgttttcgggttatatagtaagtaaggaagttacgggtttttgtttttggttaagaggttttagaggttataggaaacgttgggcgttcgaagttttatttttttgtttttagagagtgggaaaggggtttaggatttttatcggaagtacggtcggaggggtcgatacgtttttttcggatttggcgggggtagtatagtacgtttttaggagggttaggttatagttgcggaaatagtattttttaacgatgttacggttgcgacggtttatacggtttgcgggtttgtttggaagttttatagtatagagagagtcgtgttagtatcgtattgattttagttttcggaggttgaagggggagtaaattatttttgtttttaggttaggttttggaaggacgtagttattttgcgggttaggggagggaagtgagagttggtaggtagaggcgttttaggaagaagagaggtgagaggggaggtgagtgggatttagattagttcgtggtttttgttgtttttttttttagatgaaaaatgggtataagtttttggttttataattagagggatattattaggattaaaggtttataatgggagtggtttggaaaatgtgtgggatgtgagtttagtttaggggtttttataggagggattgttgtttttgagtttggattttggtttggtattatttaggaggttggaggggtttatattatttttggagttgttgagatagggagataagggtaggagaggagaagacgggaggagaggagtgaggaggcgtgatggaattattttttttttttttttcgtttttttttttttttttatagtaatgtttagttggaaggggaaggtcgttgggggttttattttggggtgttaaagggtaggtgttattagtcggaggagggagtaggagttttattacgggggttttttaagtgggggtttggtttttttttttttttaggaaagtttggtgtagggaagtttttttttgggtaaggattggttggtattaggttttgtagtgttattttttatttttaaatggggtaggtaagagagagggtataggagaggttagggcgggtaggggtttttagagttaagtagtaggaattttttagagagaagttttgaagtgtatttgtattttgtgagtttattttatagcgtgagtaagtagtggtggtaaagatgttacgtggtgagtgttaggtggaataagtcgtgcggtttttgttagtaaggagcggttttttttttgttttattaggtatgtttaggtattatgtttgtttttgtatttatttagtttttttatttgggggtggggttttaaggataatgggttatgtatttatttgttagtttttaggttggagaattaagagagaaatatgaggaaaggttgaagcgtttttgaggttagtaggtgggtattttttacggtagttttggggtttaaggaggcgtatgtatcgtttatttttgttatttattaattgtatttgttttattgattttaattatataaattattttattgattttaattttgattatttatcgaacgtacgttttttgttagaatgtttaaaaggtgtaggaagaaaggtaggttttttttttagagtttgaagttttgtattaggcgtgcggtgttttaggagtaggagttttacggtttttaatagaaattttgatgtttagggagatttttgtgagtgtttttgacgtttagggggtatttttggtttatttttcgaaggaggcgtgtgatgggaaaggtagttggtgtggatgttttgggatatcgtacgtgtttagaaacgcggcgggaaggttaaagttttagagtaagcggttgggttgttgatttaggagtgtgtttttttggtttgaggttgggcgtttttatcggttattttaggggtttgattaggtttgaggaagttttttttagttatttattgaagtagaagtcgcggtttttatagacgaattggagggtgtttattagtttttcgtcgtatagggttttattggggcggtaagtagtaatgtagtacgaggcgaaggttaagaaggtgagaagtattagtatcgatttttttattgggatttttattggtgtttgggggcgggagagaagtggcgtgagcggggtagttaggttaagttttaggttagaggtgttttttttaaattaaatttgttaatttataaatttagttgaaaattgaaagtacggtttttttataaatattatttttattataaaagtaatatataggttataatgtcgaggtgagggcgtagggttatgtgtagaatgaagcgtttagaagtatatagaaaaggtttagttttttttatttgtaagaagtattagtaattttatacgaggggtgattatttttacggttattattgtaggagtttagcggtatttatagttgtaggggtttaggttggatattcgatttggttttcgttttatgatattatgggggtagggttagtttagcgttatatcgttattttttaggtttttagcgttagttaagatggtagatagttttatttttatagagtatgtgtatttaggaggattagtttttttttttttataatttttagttgagtagggggggtttaggaggattatcgtttttaaagtagtaggttagttttgttgggttagtttcgtttttttttttggtttttttatttttttagtttgtagttgagttaggtttgggttaaggattttaatggttaatataattacgttatttatgttttagaaattttgtttttttagttatttagttttttaattttagtttgttttgggtatttttaaatatatatatatacgtttagagttttttttttaggttttaaatcgaattagtaaggttaggggtttttagaatatttttttatttgcgttattaaatttttttcgtgggagttggagagattagtttaggttatttgggaagttcgatattaggttttttagattataatttggaaggggaggttagttttaggatatattttttttataggttgtagggttatagggtcgggttaatttattcgggggtgggaggtcgggagttattatagtaagttggttttgtttttgtagaaggtggaattttttaggcgggtagttttagttttcgtttcgtagatttaggggagtttttgatgtaataaattatgtgagcgattgagtaggtagtgggatagaagtataattttgtatgttttttttaaagattagtgggtagttgcgtcgaggatttgaaagtttttttggttatttttttgattggattttggttagtttttttatcgttttttttgttatttttttttaaattttaagagtatatttcgttagttggttattttagttttcgtcgcgttttcgtaataagttttattattttgaatttggaggttcgggttaggggatcggtagaaagtaggataggaagtatgtagcggtgcggagtaggtgagggtttaggaaaagttttgagttgggtaaggagggggtcgaagggaaggaatagaaagggaaggagtaggtgagggagtagagattaggtgggggtaggggtagaggaaaagaggggaggggggtgttgttcgagaggtagcgggttggcggttgtagggttcgaggtttaggcgtgggtcgtgttttttgttgttttgttttaggttggagtgggatggtagcgggggtttttattttatagttttggttatttatagtttagtagaaggttcgttggggtaggaggaggaggaggaagaggaggaggaggaagttggaagttttttttataggagaagttaatgtttagtttgtaggttggttagtgttttagtttttatgtgtgagtcgattttttttagttcgggttttattttattttttatttttttttttgttgattattttttcgcgtttttgttttcgttttttttttttttttagttagtttttttttttttgtatttttaatcgggagttttggattatttcgtagcgaagtgttatgggtttttattttgtattttcggtttatttttgtatagggtagtgaagggggggggggttttttttttatttttttgtatggaaatttttacgttgtttattgggtaggggtcgcggttttttttcgggtcgaaggttttgttttttttagttttagattagtagtttttttttttttttttcgggatttttgtttggaaatgttgcggatagagttagagggggtgtgggggagatgtcgcgaatgtggcgtttgttatgatttttgttaattcggtttttttttattttggtttcgtttattttcgtttttttttcgcggtttcgttggtatcgcgttaatatattagggtgggtttttgcggtttcgcgttttttttcgttatttagtatttcggaggttagggttcgtaaggtacgaattatatatgtgaggcggtattttttgtatttatagatcgatcgggaagtcgtttttgtagatattttatatttttttcggtttttttcgacgtttttattttatttttagtttcgtcgttagggtgagcgcggggtttcgcgtagggaacgggattcgtagtcgttcgttttttttttttttttttttttttttttcgggtttagtcgtttcgtcgagtttcgtaggtttcgggtcgggagcgggcggaggaagggtcgggcgttcggcgtaagttcgcgtcgttttagtttcggtttcggttcggttcgtatacgtcgtttatttggaagtcggcgacgttgtcgtttatttttttgttgcgtgtcgtaaatcgaatagcgggcgttggtttttttgtcggatatttttttgttagcgtcgttttggtcgagtcgcgggggtcgaatgtgcgacggggtagagcggggggatggtttttttttggggggggggggagaattcgtttgattgtttagggaggacgggttgttttcgggttggggcgggttagatgttgtatttttcgggggggaaaaggtatcgggaaatgaggttagttgttgtattaaggatagaggggggtagagatagtgggagagatagagtgaacgtgaaaggggggggtcgaagagagggcgagggggagagaggatagcgagaggcgggtaggcgtatagcgggagagaatagtacggagagaaatagaaagcgtgtaattaatttattttggttcggcgaaggcgagagggcgggcgtgagggggggagggagtcggaggttaggagttgggggggacgggagggagcgaagggaaggttgcgggagaaagagcgggggtcggggttagacgttaagaggggcgcggggagtatagagaagcggagggaagggcgttacgtcgaggggtcgggggaggcggtgattggggggcggagtggaggttgtattcggatcgcgggcgtttagttcggtttgggtcgacggagttttttgtcgtcgcgagttcgggtttcgggagggggataggcggtggcggtatcggggtcgtttcgggacgtagcgcggaaaggggagcggttcgaggttgcgcgtcggggggagggttggagggggagcgcgggggggggtgataacgtcggcggtttgcgagtcggattgtttgcggggggaatcgttttttcgggcgaagcggggatggggggagttgaggtagatgaagaggaggcggcggggaattcgtaggttcggcggagcgcgatttcgcggacggcgttcgggacgggagttagtagcgaggtagcgggcggcgtcgacgcggggtcgttttgttcgatggaggcgttggtgggtagagcgcgggtaggcgtgggttaggaggcgggggcggtcggaaggggggggtcggggtcggtcgggttttacgtagtttcgtcggagagtaggcgaattgcgggcgtttacgttcggtttttatagtcgcgttagttcgcggtttagggttcgcgcgggtttcgttggtttcgcgttcgcgttaatgggcgttcgcggagttttcgtttcgttttcggttcgttttcgtaattcgagttaagagcggggcggggggtgcgggttgggggttttggggtttcggggggggggcggcggtcgtaggggttggggggtgcgcgggggcgaggttgggtggggggtagggagtcgtagagcgttaaggttatgttgaatgttcgttttagagaatttaggggttttatttcgggtttttggggtgttcgggcggtttgtgttcgtgagttggggttttcgggtaggtaggggtaggcgggtttttagcgttttattaggaggttgtattgcgggtgcgtttcgtttgagtgtagatgtaggtggtttggggttgagtcggggggtttttgttggttgttgcggttgagggggtttttgggttcgggcggggcgcgtagtcgttatttgttttagtaggaggagtcggttacgcggcgtttggagttttagttagatttcgagcgtttttcggtgtcgcgtcggagtttcggagttttcgttaggtgcgggacgcgcggaaggtcggttgcgtcgggtcgaatttgggttaggtttggagtttacggaggtttcggtcgttagaggagagaggattagggcgggaaatatagtttaaattttatttgtatggtcgagtttatcggggtgcgtttaagtagttcgtttttgcggtttatttaaaatatttggataatggttatttcgtttttagtgcgttggatttgtatagacgcgagttcggtttcgggggttattacgataatttgggggtttggggaaattattttttggagagtttgaacgatgtaagaaagtattgtgatttttattaagttaaaaattacgtataaaatttcgtatttcgttagtttttcgtcgtttaagtttagttaaggggaaggggtcgtcggcggaatttcgcgtttttttggtttttttcgtttttttcgtttcgttattaattatttcgttcgcgtttcgcgcgcgtttttcggcggagttttaggttcgcgggttagaggtattttatcgttcggcgggagcgtttttttttcgcgtttttcgttttagttttttgttcgttttattttgggattttttagtcgttttttttataaatgagatttttgtaatgagtaaacgaaagtggcgcggatttcggggcgtttagtaggagcgagcgtagtcgttagtcgtaagttcgtagtcgtgtttcgcgttttacgtcggttttttcggcggtagtcggagacgagcgttagtatcggcgggatagtagtagatgcgggtcgagagtcggttaggggcgtagaggcggaggggatcggcgcggcggggagtttatcgcgaagttggaggttgcgttcgcgggcgtattaggagtttaggtagcgagcgatcgaacgttttgtggtaggcggtggacgttgttgaaggtgagcgagatttcggggttagtttttagtgttcgggagtaacgtttagttcgttggaagattcggggataatgtttaaatttgggggagattgggggtaatgttcggtcgtttttttggatacggggaagttttttttgtttacgttttgagggcgcgcggtcgatttaagtgtgtttgggtaacgttagagagaaattttttaaattcgagttgttttggggatttcgtaggagatagagaggttcgaaattagtgttcgttgtgcgcggggttggggaagttgtagtgggtggtcggcgagtcgggaataatgtttaaattttggggaacgtaaggtagagttttttttgttttgcgggtttagcgaatgggtgttttggaggaggggatttcggggatttcgttaatgtgggaatcgtgattaatgattaaattcgagattttagaaaaatagattataggtttgggggatgagagaagttgttttatgtaattgggaatatagagaaagaggttttaaataggggttagttagtttgggggattaatttgtgaggaggggtagttaaagaaaattttttatatgaaattgggaattttgtcgtagagttatattacgtaaaattggtagatgaaagtaaggaatatattttggggatttaaatatatttttggtgtgttagggggaagttgagattaatttttatattttaagaatataagttagtggtttggacgttggtagtagtcggggaaaaaataatttttataattattgtggttttagggaaaggttttaatattttttagagatggaagaaagtattgtttagattttgggggagtttggagtgtgattagtatatttggggaaagtaaaataaaaaataaaaaaataaaaaattagtattatttttttatgttaatttttaaatgatttttattagtttatttttggtaaataagaaaaagattatatatttttttggatgtcgtttgtatttgggggagttttagtgaaatatattttaagtttttgggatatatggaaattatttaatggagatttgatatttaaatttttggaaatttagttagtagttaggaaatttataggtcgtaggtttttttatgtttgggattttttgggatttagggatattttttagtgtgttttgggggtttatggaatattttttaaatgtagggggatttagggtagggattataaagttaggagatttataaattagtattaaaaaaaaaaaaattttaattgttttgtgaagggaaaaaaattttaatttgttttggaaggttgggagataatatcgtaatttgggggttttaggaaaatcgtttttgaatttaaagatttagggaagttgtttagagtttttggaggatttgggggtttatatgtatattttaaagaaaggggatttagaatttttaggttttaggatttaggaatttttagattttgtgatagggagtgtgtagtgtgtttgaaggaaatattgtttaattttgagatgatttagtgggttgtttggagtttaagaaattagtgttgttttgtgattcgagggtaatgttgaatgtttttagagggtttggagggtagcgtttagaatatttaagtatgggggattaggaaaagggtttagtgtgattttggtcgttggggttttagattaatgtttgaattttagaaaagtaagatttttgttatgaagtttttgggatttagagaattgtttaatagttaatatgttgtgatgtagagaaagtgttcggaatgtttgggaattggggtcgttagtaatatttggtataatagaaataaaagtaggttttgtttaaggggtttttttgtgtttggtgtagtttagagggattcgggagattttgtgtgatttggggggatttggagaattttgggttatatttgagtattttttggtaattgtttagtgtgttttagggatttgggtggtattgtttatattttaagggatttgattcgtggttaggtagtatatagagttatagacgttaatgttttaaagttttgtgatttatatatttataatatttttaatagttttggggaattattggggaaatttttttattttatgaaatttaggtaattagagggtaggtcgtttatgatttagaaaaggatttaatatgttttgggtgtaatgatcgaatttgggggaaggtatgggaagtaatttttatattttgagggttttaattttttagttttgttgagtgttatgagggatttgggatttaacgtgtaaagtttagggaatttaggttagtgtgaatagatttgcgggatttaatagtaaatgttttatgttgaggtgaacgggaaggggcgcgggggtggggtgggggggcgcggaatggggcggacgtgtgtcggaaatagtaagtttaggagattttggagttaatatttaaaattatgcgggaaagttttatttgttttggaaataatgtttaaatgtggaaaaggtattgtttatattttggggagttaggtaaattggttagcgcgattattacggattaagggtttcgtttttaaaattagggaagtcgggttagtggtttgtaaatttgtgggatttggagggggtgtataaaattgtttagagtttgggagaaagtatatttggggttttaggttatatagtgtaagtttggaaaagttcgtcgggattgatgtgttttgacgttttcggaaattaacgtttaagaaaattattgtgattcgtcgaaatggtgagtatatttagaagatttgggaagtaatgtttaaatttagaggattttagaaaaagtaaaatgttcgagttcggggaaagtagggaagttgtttcgtggattggaatttttcgaggattaagggttaattgttgagtttaagtttttcgggtagcggaaggaaggcgttgtcggggatttattttggttggggcgcgcgcggagtattggcgtttttttcgggaattcgagcgcgggcggcgcgggtaggtagcgcggagcgttttggcgcgtacggtcggttgaaattttgtttttcgttttttggggttttttttttttttgtttttatttttttttttttttgttttttttatacggagagcgcgtttgtggcggtagttcgagtttagcgggcgttcgggtgtaaggaagaaatttaagggtcgcgagggagcgattaggacgttgtttttcgggcgttttcgggatttttagatatttgttcggttttcgcgtgggaggttcgtaggttttttttcgttattgcgttttattcgttttcgcgttgcgagtttaggcgaagtcgcggtcgagtcgttatcgggggtaggttagttttcggtttggtttgggggttcggagtattttcggtggttattttcggtttgtttcggagttttgcgcgcgtcgttcgggttttcgttagtattaaataagggtgaaattagttttgtttgggtaatattgaagagtagaggaagtggggaggaaaatgagaaatacggggttcgggaggaggggggtgtagggttgtacgtcgttggggtgttaggggttttttttcgttttttttaagcgaatttttagggaaagtttgtttatttcggttggggaaagtttagttttttataggtaaatattaaattcgtatgtaggcgtttaacggttttgtcggtaggaataaggttattttttggcgttgggtaatgtcgggcgatggggtagtggttttaaggggatttgtggggtgggtgggggtattgttagagagggggtatcgttggggattagtagaatggtgggggattttggggtaattatagtgggtattgtttgtttttattgttattttataggaggatttcggttagaaggggggtattttaaagtttgatattggggaggtagaagttaatggttttggataggtgtggggagttgggtaggatgaggtattttttttatattagtttggtaagatagggagaattcgtttttattatgaaaaatagtttattttttatttatagaataagatacgtgggaatgttttttttaaatttttgtttgtattaattatttttatgttttattttaagaatatttggtttatttttttttatttattattgtttttttttttattagttttttgtagttttttcgtgtttttagttttttggttttttcggttgtgtttatagaagggggagtttttagtagagaatttttggttgtgttgatgtttttttttgtagggtgatttgtaaatttgggggtgaggagtatttgaaaggtgtttgtttgtaaatttggttttcgggagagcggattaggttgtcgaggttttcgttatggataaaattagggtttttagggttagttttaggttttttttatttttttttttacgtttgttttttaggttggggataggttgggtatcgggggtgagttttagtttcgagttgtgggttttttttttttttgggggtgttggggataattatattagtgatttgtttgggggttttttttttttgttttgttttgtcgaggtgtttttttttagggggttatcgtttatgtttgaaaatgtatgtttggattttttaaggtaggaagaaggttgagggttattttggggtgtttatagtagggtgtagtggttttgtagggagggaggagtaggtgggggagtgggggtgtatatatgttttttttttttcgtggggttgtttgttgagtgttttttttatttagttagaagtgattagggtaggttggaggttggggtagacgcgggttattttgaggttcgaaaagtatatcggtttttttttagttaagattagtatcggggtttttttttaagattggttttttttttattatttttagttttcggaggtaggaagggtttcgttagtagtttaagggtgttgggagggggttagggtttttttttatttagagtttggtcggtaggaattttagttttaagtagcgttcgttttttagttttgaattagtattttattagggtaacgttggttttttttttattggtaaatttatattttatagaggatgaatatttttttaaggatttagatttattttatggagtttggtttatgttttagtttcggtttgtggttgttttttattttttcgtttattagttttgaagtgggttttttttatttttattttttttttagttttggttttgagtttatcgtttcgtcgttcgtgggattaagtttagtattttataaatttagtttttttttttaagggtttttagagcgttttttcgttattttttgtagggcgtcgtagacgaggcgttgattttgcgtttatttttttcgttggggaaggatatattcgttggcgttagttcggtcggtttgggaagtaggattaaggattcgaattgtaattttttatattagatagtatagattattttaaggttgtttaatttgtttaaagttaaaagtacgtgggggatatgggtttaggttggggtgtttgggagagggttttgggagaggggtttagacggtgtatattttaaaggattgaggcggcgttattgtgttattattttattgagtgtttaaggtaaagatatttttgaaagaatattttcggtttttatttgggatgggtaaattagtttgaagagttatttgttggatttttttttgtaggttttgtcgtggggtaggtatagggattttaatttatgtgtttttagttttaacgttttttaagttttggagttttttttgttattttagtgtttgattagtgaatgggtgttgtttttattatagagttttttttggttgaggtagaggttattggttgggtttttttagttattttttattttttttgtatacgggaagtttcgtaggtttttgattataatgggattttgacgtcggagttttttaggttttttgtttagaaggtttttggttattattttaattttgaatagttaggaggtttgagattgttatttattttgataaatatagatcgatagaaaggttaggttattggtgtaagattttatggttagtagtttggggcggggagaattcgggggttttatagtttttagtagagtttagttttttttgggtttttaggtttttttttaatgatattttttttttttttttttttatttattttttgttttttatttttttttttttggttgttcgttttttttttgtttttttttttttttttgttttttttcgttttttaggagtttttttgttaggatttcggtgtcgtggagattgcggggaatttgttttgtttatatttgttttggtttttagacggaagtatttggagttaattacggaattttagattttagttgtgtgattgaatttacgttagtttttttgagttaaagttgtttgtagaagggggagattttagttcgaagattttcgcgtagagtttgtggttttttttgttaggttttagggtgtttgagatatttatttttttgtttcgtagttggggttgaggttggggttggttgttagttttagttttgggagcgttggggtcgtttgggttataggttatagtagtttattttaggattgggttttttggtttgttggggtttaggttgtggggtaggttgggtagggggttgagttggtagcgatttagagttttggggttgggggttggaatttatttttttttatataagttcggtggtgatttttcggtttttggggaaaaataaaaagatattgttgagatgattttttttaaaagtaaagtttttttttttatatattttaagtttgagttttgttttattttttttttcgggtttttttaggttattttgttaggatttgggtagcggtttttttttttagttttttttttgtttagagtttttttttttaaagtataagggagggaagaagtggtgagaagtttgtttagaaagggtttttcggtgttgatggagaggtcgagatttttttgttggataggttgttttgtttttgggtgaggatgggtttttgtttggtattgggggtggagggtgtatacgaatggttcgttttgaggggttatggtacggaatatgaaagttttttttatttttaaatatttttattttggaaggagataaggagggggttttagtaaaagttattggatatatagttttgtttgacgaggttagtgagggacggcgtggttgtgttttttggggaaatgaattttttttttatagatattattttgggtggatcgaggagtttgggtttagggtgtaatagagaaaaattttatgtatgaatgagtatttttagggaaattgttttggttttagggcgtttttttgtgttagggaggttgggagagtagtaagggggattaggtgcgttattaggaggagagaagttaaatttaggggggatatggagggcggttgttgtttttttcggtatttttttttagttttttgtttaattttttgttggtggttaggaggtatagggaggtaggagggaaggaagttttatttgtaaaatggtgtatatatgtataaataaaatttttgcgttagaatttcgggtttttggtttttttgtaaagttttttgtttgtttttgggaatgggatgggggatgtaacgggaggaaattttttatatagaaagatttttttttttatatttgtgaagatagttgtgtgttttcgttgggaagagcggtttagttttttttttttattttttttattttgtttggtgaattagttaaggaaaatttattttttttgtaaaagttttagtggttttgtgtagttttaaaggagaattttttttataatggttttttttgtatattttatttttgaagttgaggttgtttttaggaggtttttttgtattttttagtagtagaagtttttttttttttttagaaattaggattttggtagttgttttaagttttcggtttatttacgtttgaatatttaaagtgtagttttttttttatatttaagggatgggagtttagttatttgtattttagtttttgcgtagttttcgtagtttttggatagtggataaagaggatcggggagttattggtgtttaaggttttttgtcgaaattgtttggacgatgattcgtcggtttggttaatattagtagttattattaaagtagggggtgttttggttgtggcgtttagattttttggttaggttgacgtggaggaggagagggataaagttgaggttggagaaacgaagggtatttttagagtgtgtatgttaatacggtttttatagatgggagagttttattttcgttgagtatggtatttgtttaaatgttaattgaaatgatgggtttattttttatttttttattttttttattcgtttttttgagttttttcgaatttggggagttttgtgttaatttggtagtgttgaggtcgttggggtagttggtttaggtattttttagtattagggtatggtatattagcgggtggaggtttggtttatttttgatttggtagaaaggcgtttgtgggcgtgggtataagttagaagttttttgttagttaggaggtgggggttatgtggaggtggtggggagtgggtgtagttttatttagagtgatatttggtagttatttgatattttggaatgttggtggacgtggtattggtaaaatggcggggggggggggaa

SEQ ID NO: 187 - DNA, 20899 bp, Artificial Sequence
  Chemically-Treated DNA
tttttttttttttcgttattttattagtgttacgtttattaatattttagggtgttaagtaattgttaagtgttattttaagtaaagttatatttattttttattatttttatatagtttttattttttagttggtagggagtttttggtttatgtttacgtttataggcgtttttttgttaggttaggggtgggttaaatttttattcgttaatgtattatgttttggtgttggaaagtgtttgagttagttgttttagcggttttagtattattaagttggtataaagttttttaaattcggaggggtttagggaaacgagtggaggggatgaggaggtgaggggtaaatttattattttagttggtatttgagtaggtgttatgtttagcggagatgaggtttttttatttgtaggggtcgtattaatatgtatattttaaaagtgtttttcgtttttttagttttagttttgtttttttttttttttacgttaatttggttagagggtttggacgttatagttagggtattttttgttttggtggtgattgttaatattggttaggtcggcggattatcgtttaggtagtttcggtagagagttttgggtattagtgatttttcggttttttttatttattgtttaggagttgcggggattgcgtagggattagagtataggtaattgggtttttattttttgagtgtgagagaaaagttgtattttaagtgtttaggcgtgggtgggtcgggagtttggggtagttgttaggattttggtttttgaaggaggggaagaatttttgttgttggagggtgtagggaagttttttgagagtagttttaattttagggatggggtgtgtaggaaaggttattgtggagagggtttttttttagggttgtataaagttattgaggtttttgtaaggaaaataggttttttttgattaatttattaagtaaaatgggaggggtaggggaggagggttaggtcgttttttttagcgggaatatatagttgtttttataagtgtgaaaggaagagtttttttgtgtgaaaagttttttttcgttgtattttttattttatttttagagataaataggagattttgtagaggagttaggggttcgagattttggcgtagagattttatttatatatatatatattattttataggtaaagttttttttttttttgtttttttatgttttttgattattagtaagaaattggataggagattgaggagaaatgtcgggagaggtaataatcgttttttatgttttttttaggtttagtttttttttttttgatggcgtatttggttttttttgttgtttttttagtttttttggtatagagaggcgttttggggttaaggtagtttttttgggaatgtttatttatgtatgaagtttttttttgttgtattttggatttagatttttcgatttatttagggtggtgtttgtggggagggggtttatttttttaggaagtatagttacgtcgttttttattggtttcgttaagtagagttgtgtgtttagtggtttttgttggggttttttttttatttttttttaaggtgggggtgtttggaggtggaggaggtttttatatttcgtgttatgattttttaaggcgggttattcgtgtgtattttttatttttagtgttaggtagaagtttatttttatttaggaatagggtagtttgtttaatagaagggtttcggtttttttattagtatcgggaagttttttttaggtaaattttttattatttttttttttttttatattttgaaagagggagttttaggtaggggaggggttagagggggaagtcgttgtttagattttgataaggtgatttgaaggaattcggggagggggatgggatagggtttaggtttggggtgtatggggaggggggttttgtttttaaaagaggttattttagtaatatttttttgtttttttttaggggtcgaagagttattatcgagtttgtgtgggaggaggtggattttagtttttagttttagggttttgaatcgttgttagtttagttttttgtttagtttgttttatagtttgagttttagtaggttagagagtttagttttgaggtgagttgttgtggtttgtggtttaggcgattttagcgtttttagaattgaggttggtagttagttttagttttagttttaattgcgaggtagagaggtgagtgttttaggtattttgaggtttggtagagagggttataggttttgcgcgggagttttcgaattgggattttttttttttgtaagtagttttggtttagagaggttggcgtggatttagttatatagttgggatttggagtttcgtggttggttttaggtgttttcgtttaggggttagagtaggtgtgggtagagtaggtttttcgtagtttttacggtatcgaggttttggtaggggagtttttgggagacgaaagagggtaaagaaggggagaggggtagggagagagcgggtagttaaaggggagaagatggggggtagaaagtgggtagagagggaaaaagggaaaatattattggggaagaatttaaaaatttaaggaaagttgggttttgttgggggttgtgagattttcgggtttttttcgttttaggttgttggttatggggttttgtattaatggtttgatttttttgtcggtttgtatttattaaagtgggtgatagttttaggttttttggttgtttagaattgaggtaataattagaggttttttgagtaaagggtttaaggggtttcggcgttaggattttattgtggttaggagtttgcggggtttttcgtgtgtaagaggggtgaaaggtggttagaaaggtttagttagtggtttttgttttagttagagggagttttgtagtgggggtagtatttatttattggttaggtattggggtgataggggaggttttaggatttggggagcgttggagttggaggtatatggattggagtttttgtatttgttttacgatagggtttgtagggagggatttagtaggtgattttttaggttgatttgtttattttagatagaagtcgggagtgtttttttaaaggtgtttttattttagatatttaataaaatggtaatatagtggcgtcgttttagttttttggagtgtgtatcgtttgaattttttttttagggtttttttttaagtattttaatttggatttatattttttacgtatttttggttttgggtagattgagtagttttggggtggtttgtgttgtttggtgtggagggttgtagttcgggtttttagttttattttttaggtcggtcgggttgacgttagcgagtgtgtttttttttagcgaggggagtgagcgtaaggttagcgtttcgtttgcggcgttttgtagggggtgacggaggggcgttttgaggatttttggagaaaggagttgggtttgtaaaatgttgggtttggttttacggacggcggagcggtgagtttagagttagagttggggaggaaatgggaatgagaaaggtttattttagggttggtgagcgaggggatggggagtagttataggtcgaggttggggtatgggttaggttttatggggtgagtttgagtttttgaggggatgtttattttttgtggaatgtgggtttgttagtggagaggagattagcgttgttttggtgaggtgttggtttagggttggggggcggacgttgtttggggttaaagtttttgtcggttaagttttgggtgggaggagattttggtttttttttaatatttttggattgttggcgggattttttttattttcgggggttggaagtagtgggggaggagttagttttgaggaagaatttcgatgttggttttgattagaggggagtcggtgtgtttttcgagttttagggtgattcgcgtttgttttagtttttagtttgttttggttatttttgattaaataaggagagtatttagtaggtagttttacgagggagggggaatatgtgtgtatttttatttttttatttgtttttttttttttatagggttattatattttgttgtgggtattttaaggtgatttttagttttttttttattttaaaaagtttaggtatgtatttttaagtatgagcggtggttttttgggggaaggtatttcggtagggtagaataaagggaagggatttttaaataggttattggtgtaattgtttttagtatttttaaagaggaggagaatttataattcggaattggggtttattttcgatgtttaatttgtttttagtttgggaagtaggcgtggaggagaaggtggggggagtttagagttggttttgggggttttggttttgtttatgacgggagtttcggtaatttagttcgttttttcggggattaggtttgtagataggtattttttaaatgttttttatttttaaatttataagttattttgtagaggaaaatattaatatagttaggggttttttgttggaggtttttttttttataggtatagtcggagaggttagagagttggggatacggggaggttgtagaaggttggtgggaaggggggtagtgatgggtggggagagatgggttagatgtttttggaatgggatatgggggtgattgatgtagatagaaatttgaaggggatatttttacgtgttttgttttgtgggtggaaaatgggttgttttttatggtgggggcgggttttttttgttttgttaagttaatgtgaaagagatgttttattttgtttagttttttatatttgtttaaggttattaatttttgtttttttagtgttaggttttgagatgttttttttttagtcggggtttttttatggggtgataatggggataagtaatgtttattgtagttgttttaggattttttattattttgttggtttttagcggtgttttttttttggtagtatttttatttattttataggtttttttagggttattgttttatcgttcgatattgtttaacgttaaggggtgattttgtttttgtcgatagggtcgttgggcgtttgtatgcgggtttaatatttgtttataaggaattgggttttttttagtcggagtggatagattttttttgaaaattcgtttggagagaacgaaaagagatttttggtattttagcggcgtgtagttttgtattttttttttttcgggtttcgtgttttttatttttttttttattttttttgttttttagtgttatttaaataaaattggttttatttttgtttggtgttggcgaaggttcgaacggcgcgcgtaaagtttcggggtaggtcggaggtggttatcgggggtgtttcgggtttttaagttaagtcggggattagtttgttttcggtggcggttcggtcgcggtttcgtttaggttcgtagcgcggaggcgagtggggcgtagtggcgagggggagtttgcggattttttacgcggggatcgagtaggtatttgggagtttcgggagcgttcgggaagtagcgttttggtcgttttttcgcggtttttgggttttttttttatattcggacgttcgttaagttcgggttgtcgttataaacgcgtttttcgtgtggagaaggtaaagaaaaaaaaaaataaaagtaaaaggaagaaaaattttaaagaacgaaaagtagaattttagtcggtcgtgcgcgttagggcgtttcgcgttatttgttcgcgtcgttcgcgttcgggttttcggggagggcgttagtgtttcgcgcgcgttttagttaaggtgaattttcggtagcgtttttttttcgttgttcgggaagtttgagtttaataattagtttttgattttcgggggattttaatttacggaataatttttttgtttttttcgaattcggatattttattttttttgggattttttaaatttaagtattgttttttaagttttttaaatatatttattatttcgacgggttataataatttttttggacgttaattttcggggacgttaaaatatattagtttcggcgggtttttttagatttatattatgtggtttggggttttagatgtgtttttttttaggttttggatagttttatatattttttttaggttttatagatttataggttattaattcggtttttttaattttaaagacgaagtttttggttcgtggtggtcgcgttgattaatttgtttggttttttaggatgtggatagtgttttttttatatttaggtattgtttttaaaataagtggaattttttcgtataattttgaatattaattttagggttttttaagtttattgttttcggtatacgttcgttttatttcgcgtttttttattttattttcgcgttttttttcgtttattttagtatgggatatttgttgttgggtttcgtaaatttatttatattaatttgggttttttaaattttatacgttgaattttaagttttttatgatatttagtagggttggaaggttggaatttttagagtatgaaaattgttttttatatttttttttaaattcggttattatatttagagtatgttgaatttttttttgaattataaacgatttgttttttgattgtttgagttttataaaatggagggatttttttagtgattttttaaagttattgagaatgttgtgggtgtgtgagttataaagttttggggtattaacgtttatggttttatatgttgtttggttacgaattaggttttttaagatgtagatagtgttatttaggtttttggagtatattgagtagttattaggaggtgtttaagtgtgatttaggattttttaggtttttttaaattatatagggtttttcgggtttttttgggttatattaagtataaaaggattttttgggtagagtttatttttatttttgttatgttaggtgttgttaacggttttagtttttaaatatttcgagtattttttttgtattataatatattgattattaaataattttttgggttttaggagttttataataagaattttgtttttttaaaatttaggtattggtttgaaattttaacggttaggattatattggattttttttttggttttttatatttggatgttttggacgttgttttttaggttttttaggaatatttagtattgttttcggattataggatagtattgattttttgggttttaaataatttattgagttattttaaagttaagtaatattttttttaagtatattgtatattttttattataaaatttgaaaatttttaagttttaagatttaggaattttgaattttttttttttaaaatgtatatatggatttttaagttttttaaggattttgagtaatttttttagatttttagatttaaaaacgatttttttggagtttttaaattgcggtattgttttttagttttttaaagtaaattgagatttttttttttttataaaataattgaggtttttttttttttaatattgatttatgagttttttgattttatggtttttgttttgggtttttttatatttagaaaatgttttatggatttttaaagtatattaaaaaatgtttttgggttttaagaaattttaggtatggaaaaatttgcgatttataagttttttagttattaattaggtttttagaaatttagatattaaatttttattgggtaatttttatgtgttttaaaaatttgaaatgtgttttattggggtttttttaaatgtagacgatatttaggaaaatatatagttttttttttatttattaaaaataagttaatggaaattatttaaaaattagtatagaaaaataatattgattttttatttttttattttttattttgttttttttaaatgtattgattatattttaggtttttttaaaatttagatagtgtttttttttatttttgaagggtgttaaaatttttttttgaagttatagtaattatgaaggttatttttttttcggttgttgttagcgtttaggttattaatttatatttttaagatgtgaaaattaattttagtttttttttaatatattaagaatgtgtttggatttttaaaatgtgttttttgtttttatttgttaattttacgtaatatggttttacggtaaaatttttaattttatatggagaattttttttaattatttttttttataaattggttttttaagttagttggtttttatttgagatttttttttttatgtttttaattgtatggagtaattttttttattttttaaatttgtaatttatttttttggagtttcgagtttagttattaattacggtttttatattaacggagttttcggggtttttttttttaggatatttattcgttaagttcgtaaggtagaaagaattttgttttgcgttttttaaaatttgggtattgttttcggttcgtcggttatttattgtagtttttttaatttcgcgtatagcgggtattggtttcgggtttttttgttttttacgaagtttttagagtaattcggatttgggaaatttttttttagcgttgtttaaatatatttgggtcggtcgcgcgtttttaggacgtggatagggagggttttttcgtgtttaggaaagcgatcgggtattgtttttagttttttttaaatttgggtattgttttcgggttttttaacggattgggcgttgttttcggatattgaggattggtttcggggtttcgtttatttttagtagcgtttatcgtttgttatagagcgttcgatcgttcgttgtttgagtttttggtgcgttcgcggacgtagtttttagtttcgcggtgagtttttcgtcgcgtcgatttttttcgtttttgcgtttttgatcggttttcggttcgtatttgttgttgtttcgtcggtgttggcgttcgttttcggttgtcgtcggggaggtcggcgtggggcgcgggatacggttgcggatttgcggttggcggttgcgttcgtttttgttgggcgtttcgaaattcgcgttattttcgtttgtttattgtaaagattttatttgtggggaaagcggttggagggttttaaagtggggcgggtagggggttggggcgagggacgcggaggagaggcgttttcgtcgggcggtaaagtgtttttagttcgcgggtttaggatttcgtcgggaggcgcgcgcggagcgcgggcgaagtgattgatggcggagcgaggggggcgaggggggttaggggggcgcgagatttcgtcggcggttttttttttttggttaggtttaggcggcggggggttggcggggtgcgggattttgtgcgtggtttttgatttggtaaaaattatagtgtttttttatatcgtttaaattttttaggagatggtttttttagatttttaaattatcgtggtggttttcgagatcgaattcgcgtttatgtaagtttaacgtattgaggacggggtaattattatttagatattttgggtgggtcgtaaaggcgagttatttagacgtatttcggtgagttcggttatgtaggtaggatttgagttgtgtttttcgttttgatttttttttttttggcggtcggagttttcgtaggttttaagtttggtttagattcggttcggcgtagtcggtttttcgcgcgtttcgtatttggcgggggtttcggggtttcggcgcggtatcggggggcgttcgggatttggttgaggttttaagcgtcgcgtggtcggttttttttgttggggtaggtggcggttgcgcgtttcgttcgagtttaggggtttttttagtcgtaataattagtaaggatttttcgatttagttttaagttatttgtatttgtatttagacggggcgtattcgtagtgtagttttttggtggggcgttgggagttcgtttgtttttgtttgttcggagattttagtttacgagtataggtcgttcgggtattttagaaattcgggatggggtttttgaattttttagaacgggtatttagtatggttttggcgttttgcggttttttgttttttatttagtttcgttttcgcgtattttttagtttttgcgatcgtcgtttttttttcggggttttagggtttttagttcgtatttttcgtttcgtttttggttcgggttgcgggggcgggtcgggggcggggcgagggtttcgcgggcgtttattggcgcgggcgcgaggttagcgaggttcgcgcgggttttgggtcgcgggttggcgcgattataagagtcgggcgtgggcgttcgtagttcgtttgtttttcggcggagttgcgtgaggttcggtcggtttcggtttttttttttcggtcgttttcgttttttggtttacgtttgttcgcgttttgtttattagcgtttttatcgggtaaggcggtttcgcgtcgacgtcgttcgttgtttcgttgttgattttcgtttcgggcgtcgttcgcggggtcgcgtttcgtcgggtttgcggatttttcgtcgttttttttttatttattttaattttttttattttcgtttcgttcgaggaggcggtttttttcgtaggtagttcggttcgtaggtcgtcggcgttgttattttttttcgcgttttttttttagtttttttttcggcgcgtagtttcgggtcgttttttttttcgcgttgcgtttcggagcggtttcggtgtcgttatcgtttgtttttttttcgaggttcgggttcgcgacggtagagggtttcgtcggtttaaatcgagttgggcgttcgcggttcgggtgtagtttttatttcgttttttagttatcgtttttttcggtttttcgacgtggcgttttttttttcgtttttttgtgtttttcgcgttttttttggcgtttggtttcggttttcgttttttttttcgtaatttttttttcgttttttttcgttttttttagtttttagttttcgatttttttttttttttacgttcgttttttcgttttcgtcgaattaaagtggattaattatacgttttttgttttttttcgtgttgttttttttcgttgtgcgtttgttcgtttttcgttgttttttttttttttcgtttttttttcggttttttttttttacgtttattttgttttttttattatttttgtttttttttatttttgatataatagttgattttatttttcgatattttttttttttcgaaaagtataatatttggttcgttttagttcgaagatagttcgttttttttggataattagacgaattttttttttttttttaaaaaaaagttattttttcgttttgtttcgtcgtatattcggttttcgcgattcggttagagcggcgttggtagaggagtgttcggtaggagggttaacgttcgttgttcggtttgcgatacgtagtagggaggtgggcggtagcgtcgtcggtttttaggtaagcggcgtgtgcgggtcgggtcggggtcggggttggggcggcgcgggtttgcgtcggacgttcggtttttttttcgttcgttttcggttcggggtttgcggggttcggcggggcggttgagttcgggggggaggaggaggaggaggaggaggacggacggttgcgggtttcgttttttgcgcggagtttcgcgtttattttggcggcggagttgggggtggggtgggggcgtcgggaagggtcgagggaggtgtgaggtgtttgtaggggcgatttttcggtcggtttgtgggtgtagggggtgtcgttttatatgtgtgattcgtgttttgcgggttttggttttcggggtgttgggtaacgaggaggggcgcggagtcgtagaagtttattttggtatgttgacgcggtgttagcgagatcgcgagaggaagacgggggtgggcggggttaggatggagaggggtcgagttggtaggagttatggtagacgttatattcgcgatattttttttatattttttttggttttgttcgtaatatttttaaataggagtttcgggagagggggagaggggttgttggtttgaggttaagaagggtagagttttcgattcggagagaggtcgcggtttttgtttagtgggtagcgtggaagtttttatataaggaggtgggaaggagattttttttttttttattgttttgtgtagagatgagtcgggggtgtaggatgggagtttatggtatttcgttacgggatggtttagggttttcggttgggggtgtaggagagaagagattggttgggaggagggagagggcgggagtaaaggcgcgggggagtggttagtagggagaggggtggggggtagggtggagttcgggttgggaggagtcggtttatatataaaagttgaggtattgattagtttgtaaattggatattagttttttttgtgaaagagatttttagtttttttttttttttttttttttttttttttttgttttagcgagttttttgttgagttgtaggtaattagggttgtggagtgaggattttcgttgttattttattttagtttgaggtagggtagtagggggtacggtttacgtttgggtttcgggttttgtagtcgttagttcgttgtttttcggatagtattttttttttttttttttttttgtttttgtttttatttggtttttgtttttttatttgttttttttttttttgtttttttttttcggttttttttttgtttagtttaggattttttttgggtttttatttgtttcgtatcgttgtatgttttttgttttgttttttgtcggttttttgattcggatttttaagtttagagtggtggggtttgttgcggaagcgcggcgagggttagagtggttagttggcggagtgtgtttttagaatttggaagggggtggtagagggggcggtgagaggattggttagggtttagttaaggagatgattaaggaggtttttagattttcggcgtagttgtttattagtttttagagagggtatgtaaagttgtgtttttgttttattgtttgtttagtcgtttatataatttattgtattaaaaatttttttgggtttgcggagcgaaggttggggttgttcgtttggagggttttattttttgtaggggtagggttaatttgttgtggtggttttcggttttttattttcgagtgggttaattcggttttgtggttttgtagtttgtggagggggtgtgttttaagattggtttttttttttagattgtagtttggggaatttggtgtcggattttttaggtggtttgagttggtttttttagtttttacggggagagtttggtagcgtaaatagggagatgttttggaggtttttggttttattggttcgatttgaggtttggaaaggaggttttgggcgtgtgtgtgtgtgtttgggggtatttaaggtagattggagttggagaattgggtgattgggaaaataaggtttttagagtatgggtggcgtggttgtgttaattattggagtttttgatttaggtttggtttagttgtagattggaaaggtggaaaagttagggggaggggcggggttggtttagtaggattggtttgttgttttgagggcgatggtttttttggattttttttgtttagttgggggttgtggggaggaagggattggtttttttggatgtatatgttttgtaggggtggggttgtttgttattttggttggcgttggaggtttgagaagtggcgatgtgacgttgggttggttttgtttttatggtgttataggacggaggttaggtcgggtgtttagtttgggtttttgtagttgtggatgtcgttgagtttttgtaataatgatcgtggagatggttatttttcgtgtaaaattattagtgttttttgtaaatggaaggaattgggttttttttgtgtgtttttggacgttttattttgtatatggttttgcgtttttatttcggtattatgatttgtgtgttatttttgtaataaaaataatgtttataggaaagtcgtgtttttaatttttaattgaatttgtaggttggtaaatttggtttgggaggggtatttttggtttggggtttggtttggttgtttcgtttacgttatttttttttcgtttttagatattaatgggaattttaatggggaagtcgatgttggtgttttttatttttttggttttcgtttcgtgttgtattgttgtttatcgttttagtgagattttgtgcggcggggagttggtggatattttttagttcgtttgtggggatcgcggtttttattttagtaagtagttgggaggggtttttttagatttggttaggtttttagagtgatcggtgaggacgtttaattttaagttaggggagtatatttttaggttagtagtttagtcgtttgttttgagattttgattttttcgtcgcgtttttgagtacgtgcggtgttttagggtatttatattagttgttttttttattatacgtttttttcgaagggtgggttagaggtgttttttagacgttaggggtatttataggggtttttttgggtattagaatttttgttgggggtcgtgaggtttttgtttttgaggtatcgtacgtttagtgtagggttttaggttttggaggaagagtttgtttttttttttgtattttttggatattttgataagggacgtgcgttcggtgaatgattagaattaaaattaataaagtgatttatataattaaaattaataagataagtgtagttggtgggtggtaggggtgagcggtgtatgcgtttttttgggttttaaggttgtcgtggggggtgtttatttgttgattttaaggacgttttagtttttttttatgttttttttttggttttttagtttgggggttggtaggtgggtgtatggtttattgtttttgagattttatttttagataggggggttgggtggatgtagaggtaggtatggtgtttgggtatgtttgatggggtaggggaggggtcgttttttattggtagaggtcgtacggtttattttatttgatatttattacgtgatatttttattattattgtttatttacgttgtgaaatgggtttataggatgtaaatgtattttaaagtttttttttgaaaagtttttgttgtttgattttggaagtttttgttcgttttggttttttttgtgtttttttttttgtttgttttatttgggggtaggaagtggtattgtagggtttggtgttagttagtttttgtttagggagaagtttttttgtattaggtttttttgagaggaggggagggttaagtttttatttgggggattttcgtgatggggtttttgttttttttttcggttgatggtatttgttttttggtattttaaggtggagtttttagcgattttttttttttagttgagtattgttgtgggggagagggggaagacgggaggaaagaagggagtggttttattacgtttttttattttttttttttcgttttttttttttttgtttttgtttttttgttttagtagttttaggggtggtgtgggtttttttagttttttaggtggtgttaggttagagtttaagtttagggatagtagttttttttgtgggggtttttgaattgggtttatattttatatattttttaaattatttttattgtgagtttttggttttggtggtgtttttttggttgtgggattaagagtttgtgtttattttttatttgaggaaggaggtagtagaggttacgggttggtttgggttttatttatttttttttttattttttttttttttgggacgtttttgtttgttagtttttattttttttttttgattcgtagggtggttgcgtttttttagggtttggtttgagggtaggggtggtttgttttttttttagttttcgggggttggggttagtgcggtgttaatacggttttttttgtgttgtgggatttttaggtaggttcgtaagtcgtgtgagtcgtcgtagtcgtggtatcgttgaggagtgttgttttcgtagttgtgatttggtttttttggagacgtattgtgttattttcgttaagttcgagagggacgtgtcgattttttcgatcgtgttttcggtgagggttttgggttttttttttattttttagagatagagaaatagggtttcgggcgtttagcgttttttgtggtttttgggattttttggttagggataaggattcgtgatttttttgtttgttgtgtggttcgggagtagtttagacgttggttttttttgtttttttgttcgtggatattagtttaagttattgattagttataggggtggtttgttaggttaggcgggcggtttaggcggaagagcgtggagagtaggtatttgttgattagttttttttttttttaggataatttttttagatatttcgtgggtaagtttttttaatatgatatttggaagtagtttatttagcgtttgcgtaggggtttgtttgtttttttgcgtgttcgtcggggttacgtgttcgttaaggagttcgaggcgtttagggaggttaaacgttatcgttttttgattgttttatttatttaagatttcgtttacgggggcgtttttttagagatggttagtaatcggaagtgagtaaaattgtcgtaagtttgtagttcggcgttattattttgtagtttttttttgattacggacgtttttattaggttttatttcgaaaatttttcggttttacgtttttttggggttttttttgatttagttttcgtgtttcgttttttcgaaataggttatttttttcggttttttttatcgggttgaggaagtatagtagtatttttaaatatgtataaaatcgattggttttaaatattttttatatattttttttttaaattatttttaattatttttatatataaaaaattaaaatattaaattaattttttttttttttttttataataatttttttaaaattaattggttttttagaaatattttataaaagtttagaaattggttttaaaaaaaataattattaaaaaaaattaattggttaaaaaaaaaaagtattaaaaacgaattggttgagaaataattggtaaaataaaggaatttggtattttttatttttttttttttttttttttttggattttgagttaaattggtttggatttgagtttttgaattagtaaagagaaaagaaggattttagaaattataggtgggtacgtcgttgttatcgttatttttttttttacgggaatttttagggtaaattggttattcgaaaatagtaataatttagattggttttttatttttttttttattattaaaaattatagagtagttagagggatttagtaagattaaaggaggggaggatagagtatgaaaattaaaatttatgtaaatgaaatgtaattggtacgatttttatttttaaattttatattttaatttttattttaaaaagtatttatattttatgtattttcgtagttatatatatataatatatagtatacgtatgaatatagtatatatacgagtatagtatatatataaacgtatagtatatatagtatatagatgagtatatagtatatatataaacgtatagtatatatacgtatatatatgtatatatagtatataaacgtacggtatatatacgtatatatatgtatatatagtatatatataaacgtatagtatatataaacgtatagtatatacgtatatatagtatatatacgagtatatagtatataaacgtatagtatacgtatatatatgtatatatagtatatatattagtatatagtatatatataaagatatagtatatatatgtatatatagtatatatacgcgaatatagtatatacgaatatagtatatatagtatatatataaatatagtatatatatgtatatagtatacgtatatatagtatatatatgaatatagtatatagtatatatatgtatatatagtatatacgtatgtatagtatatatgaatatagtatatatataaatatatagtatatatatgtatatatagtatatatatttatgcgtagtatatatatgaatatagtttatagtatataaatacgtagtatatacgttgtatacgtaagtatttatttgtatatatatatgcgtatatatacgtatatttttataaaattggatgaaaataataagtatatttaagtaattacgatatttgtatggattaggttaaagtttcgttaagattttttaatgtttttatggtttgagtttcgtttttgtttttatttttattgtttttcggttttgtttgtgttttgttttttagaggagggggtttagatggtgcggtttgagtgtgcggtcggcggtatttgggatatattcgtagggtgggcggggtgtgttttaggtttaattttatttttttattatgatagagatgtttttgtgaggttggtttttttggcgtttgtttttacggttttcgtagcgtgagttacgatgttttttatattttatttattttcgatatattttatttattgtgtgttggtttagttagagtgaggaaggagtttggttatattggagatggcggtagttgagtagatatgtttttacgagtagtttgattttttggtgtgtttttggaaggaagattttggggatttttttatcggagtatatttagggattatttttgttcgttttttggggattttttaagaaatgtggagttttcgggggtcgtgtattgatgcggggagtgtgggaagtttggcggttggaggggtgggtggggggtagtgggggttgggcggggggagttttggggtaggaagtggtttcgggagattttggatggaaaagttaggaggattgatagtagatttgtagaattatatagagaaattaggaatttttaaattttatgttaattgatttattttttttttttgttttttggggtatttttttttttttttttttttttgttttttttttatttttttttagttttatgcgtttagaaattaaattaaattttttttttatgtaataggggggtagtgataaaagtaagaacgtacgaagttagtttggagattattacgttttgtttttcgttatttatcgttttgattggattttgttttttatttgtttttgttgtttgggttgagttgagggtggagttttttggggggtattggttattgagtttttttggagaagttagaggggagtggagaaggttattgttcggtttggtttttggggatagtggttggtttttagaagttttgagggcggaggggggggttgggtagggtttttttaggtgttaggagggtgttcggaggttataggagggggtttttggttggtttgaggttggtcggaggggaaggggttagtaggtgtgtaaatagagggttttattaggttggggtagggtggtcgtttttcgtatatttgaggaatttttttttttttttcggtgatattttgttcgttttttagtattttgttttgtttttaggaggttcgaagttttgtgggattttttgggggtaaggtggggtgaggtcggggagtagggaggttaggcgggtttgagtttatagagtaggagagttgttaggtttgtttatcgattaggttgtttgggtttcggagtttacgggtttggtgatgttatagtagttattatcgcggcgtttagggttgcggtagggattcggtttttgggaggtttatttcgtttttatttgtgtttttagtttagtttttttgtacgtagttcgattagtagtttagaggtttgaggtttttgggttttggtgacggggttggtatgatttcgggggtcgtttatgttagttcgttttagtcgtagagggtttttcggtaagcgttttgtgagtgggttattcggaatattggatagaagtttaaagagttaaattgttataattgtggaatttatattggtttgagatttaaaacgtttcgaggtattttaaattatttgtttattcgttaggatatttatttatttagtgttatattttgtttcgtcggagtgggtgttttcgggggtatttgtcgattagttttttgcgtttttaggtttgtagtttttttttgggttattaattattttggttcgggttgtttgtttgattttcgtgtttagtcgtggttttttattttgtttttttttcgtgtttttaatgtttttagtggggggtttttttttgggtttttttttttgttattatttgaagatttttacgttaaatattgaatgttatttgtgtttgtcgtttcggtttattttgcggttcgtgtttgatttaatttaatttttttaacgttaatattttcggtaaaattttatgtttgggttttgtttttaattttgtaacgtttgtaattttaataaagtattaaaagttatgattttttgagtgttttattttttgatttgggtattggattgttagagggagggaaggggttgagtatttggaagtaggtagagggggatagaagagggaaggggaaggaaggttttaggggtgtggatattttttttcgttttttgattatatatatggagaaatgagagagttggaagttagatttttagatttattgtcgtgta

SEQ ID NO: 188 - DNA, 51912 bp, Artificial Sequence
  Chemically-Treated DNA
ttttaattattgttttaaaatttaaaaaatgttgttggttaagtaaaaatagtaatagataaaatttgttttgagtaaatagattatatattaataaatgaatatttagtttaagcgattttttatgagatttatgaagtatttttaattgaaatttaataagttataatttaatagatattttaatttttatttttagaagggaaatgtgatattttatgtagacgtagttttttaaatttagttggaagatagcgtgatagtgaagttgtgtgttgtaattttttaaaattgttgaagtgttatggtttgttatttcgtatttattgaaaaaatgtaaatgttatatttaatagaatggtagtaattttgttttaatttgaagatttaattttattaattatggtaatatatgttggttggagttgggaatattttataaaatattggaataaatttgtgtttatattttaggggaattaataaaagtatttttatttgtaatatttaaaatgttattgtttttaaatttgtattaaataatgtagggaagatagattattgggggagaatggatgtatttttgtgaggattttggttatttaatatacgtgtacgggtgaggaaattaaggtacgatttattgggtagggaggtagggatattagtaagattttttatttgtttgggttttttgtttttgagttatttttgcgtagttttttattggattttataagtttttgaggcggtagggtagataggatatttttattttatagaggaggaaatttaggtttatagaggttttttgttttaaattataaaggtggagtttagatttttttagtttttattaattgtatttcggttagttataattttatttatttatatttaaatggatattgtggttttgtaatttttgttaaaagggttttttggtaataggaaaaacgttatggttttattgtattgtagaggatgggaatgggtgtttcggttaaatttttttttttttttttttttatagtttagatggtaaatgtgcgatttagggatttttcgttttagtagatttgtgcgtataattttgtatagattatttgttaagttagagtcgaaaggtaatatagatgttaaaggataataaaggtgaatgagatttatttaaaattggaaatttggtgtttggttttttaggagaataattaacgattgtgatttgaagtttattagggtattttgagagatttaattaaagatagagtgttggtttgaaattattaaaaggtaatagtaaaagggagagtaaaattttagttttaacgtaatttataaatttattttgtttttttcgaaagaggggcgcgggtgggcgcgttttttcgcgagtattttatttaagggggaattttttttagcgtacggcgaagttttttttcggttgttttatttggtagtttttttaggatttcggttagtttttaattggttttagtaatgtttagtcggagtttttttgggttttcgagtgggagaaaagtgagagtaggtgtttttttagcggcgcgtttcgttagggttcggtaggatttcgtttttaagtcggggaaagttggtcggcgtttttttttttcgacgaagtcgttttagggttgtttttagaggacgcgcggtaggtaaagagaatgaatttgagcgtttacgaaacgttttgtacggttttcgggagttgggagaaataggtgttttttttcgacgttcgcgggcgacgtttgtcgtattttgttcgttgtcgcgtttttttcgggtatttttcgttttcggcgtttttgttttcgtttttagtgttagggcggaggtagtttcggttcgtaggtaattattgttagcggagttcgtcggggagcgggggtgggcgcgtcggcggtgggcgggcgggcgcggcggggcgcgggtataaaggggcgcggcgcggggtttcggagtttggttttcgcgtagtatgttcgttagcgtttcgtcgcgtcgttcgcggtcgtcgtcgtcgtcgttgtcgttgttgttggtgttgttgggtttgggcggtcgtcgtttgcgtgcggagtcgggcgacggcgcgtagatttgggttcgtttttcgcggttttttgttttcgaggtcgcgggttttttttagggtatttttttcgacggttttttttgggtcgtgggtagcgtcgtttattagatcgagggcggttggtagtagtacggtaagggtgcgtttatttgggatacgtttatttattattttttggtattttcgggagattttcggaacgttagtttgtcgttgggcgtttcgtcgtcgttgtagttcgttatcggggacgtagttagcgatagttataataacgtttttcgcgatacggaggcgttgcgcgagttcggggttatttattatcgtttttttatttcgtgggcgcgagtgttttttaatggtagcgcgggcgtttttaatcgcgaggggttgcgttattatcggcgtttgttggagcggttgcgggagttgggcgtgtagttcgtggttattttgtattattgggatttgttttagcgtttgtaggacgtttacggcggttgggttaatcgcgttttggtcgattattttagggattacgcggagttttgttttcgttatttcggcggttaggttaagtattggattattatcgataatttttacgtggtggtttggtacggttacgttatcgggcgtttggttttcggtattcggggtagttcgcggttcgggtatttggtggcgtataatttttttttggtgagtgcgaggggttaggcggagggttacgtaggggagatagagggtttttataggggttagggggaagtgtgggaattgagttttttttagacgaggttttatttggatacgtgtatgtggttatcgggggaaattgagtagttttgattttttttggaaggcgtggaattaggagagaaattttttagtgggtatacgagtgagtgttttttggagtttatttgtggaaaggaagcggtgataggttttcgtagtgaggaaagaaatttttttttttgggtgtagaggaatttttagaggtgagggcggggaggatttgttaggagtaattgtaggaagagaatgagtagggtggatgaaagaaatacgtttgtttttaagtcgtatagatagtattattttttggagttgttacgagtttagtgttaatttaataagatttgttttgtttgtggtataagtttatattgttgtgaaagtgttaaaatataattttcggagagttagatttaaattgtgtttggaggttttttttgcggtagggtagggaattgtatttattaattttatttatcggggtgtgaagatcgttttatataattttaaataaagttagttatagaaatatagaaataattgtagggtgatatagattgttttattatatttatatttttatagtgttttttatagttgaaagggttttttatttatgatattgttagtttgataaaattaattgtaatatttttgtgtaaaatattttattaattttgatagtaggaaatattgttatgttatggtaaagttgttttaagtatttttttttttttttttttttttagtgtttaaatttaggtattattgttttggggatttatttataattatgttagttgttagtatattttgtatagagttttgtattataataaaatattttatgtatatgtataaatattttaataaaagtgtttaaatgtataatttttggtatttaattttgattatttgtgggtttattggaagatttatttttaaatttagaatttagttatatattttgaataaagttagtattaaaattatttttaaatatttttaattaaagttatagataatatgggtagagtagtattgggttattgaggtgatttagtgttttgagttgttggtaatgttgtaataatggttaaattagattttatgttagttttataaaatttgtttgttgttattggttataaaagaatgttggatttgtttggaaatatattgtgatttttgtgattttatatttatgtatgtttttttataaggatgttttagagcggtgatttttatatttttttaatttttttatggatttgaaaaattttaaagattattagtgtatggttggtgatagaaaaattatgggaagaatggttttattttttgaagaaaatataagtaagttattagtttatattggaagtaaataaatggattagttggaggatttaatagattatgtttataaaatttttattttagatttaaattttataagttttatttttagagtttttaggataaatttgtatatataaagtagttaattgttattatagtgatttataggattattttattataagataaagatttgcgtgttttttggtgttttggtgttttaaataattaatatgttttagatttttttgtttatttatggttttttgattaattttttagttatattttttaatgtttatataaaaaatttgttaaatattaattattttttttagaaatgtagtggattttgtatttagggaaattagtaataggtgaatgttttatttgttgatgttgtaaataaattgttagttggtgtaaagtattaattttgtttttatattttttttggtttggtgtttagttatttttgtattttatttagaagcgagtttttattgttaaagaaagtattttgaattaattttgttgtatgagatatttttattttgtttttaatgatttttttcggtgtgtatataggggttgggggaagcgagaatagaaaaatttgagtttatttgaaaaagataaaatattttgtagattttgataaaagggtattttagttggggtttagatattgttgttgtatagatataggggttagttgtgtttcgggatttgatgttggtgaaggataaagattggttagtattttttttttattttttttgtgtttttattaatttataaatgggttaaggagattttttgggatgatgggaagtttgattttttttagagagttaagaattattgatggtttggaggataggaggtagaataaataaatagtaggataaataatggaggttttgtttagaatggaggttttggtgttttttgtgggttttttatattggagtgagttttggtaaaaatggtgtgtgtgtgtgtgtgtgtgtgtgagagagagagagagagagagagaggagatagaagagaaggagaagaggggagaggggaggagggatagagagagagaggttttttataaagagtttggagtttaggttgttttgtttatttgagtgtaatttaggaggatgtattttttttttcggatttgaagattaattgtttagtttttatagtttttgaaataaagtttttaatgttttttgaaattagtattagggattgtagttggggagtttagttttagtagtgtttttgagtttttgttttgtatatgggttttaagaggattagaattaagttggaaatatacgtgtttttattttttatttttaattttttttatcgtttgagatttttgtaaatatttgtgtaaggaatttgtgaaaaagattttttttacgtaaggaagtagggttaggagatattaatttgggtattgttgagtattagtattagtgtgtaggttttagtttatttgtttgtaatgtttgttgaagttattattttttgttttttgaatttttttttaatttggattttaggttttggtttttttttgtttttttttttagttttttggcgatttttttttagttttttttgtttgtttttttttattttgtttgtaaatagtggagggtttagggttttgtttagatttattttaggttattgttttgaatattgttgtatttcgatgattggagattttgagtttttatttaggttttttcgagtattagattggtatagataatcgttttttttacgtggatgtttaatgggtatgttatatcgaatatattttaaattaaatttttgtttttttttttttattatgatgattttttatttttttagttgttggatttcgaattttaattattttttttttttatgttttgtttttaatttattaataaattttgtagttttatttatttttaggatgtgtttagaattaaattatttttttttttatttatgattacgatggaggtgtaagatattatttaattttgtttgggtaatgggaatagttttattgttggggtttttatttttgttttgttttttgtagtgtgttatgatggatgttttatagggtgatattatgtgtggataagatagagtttttgtttttttaaattttatttgtttttttggagttagttaatacgtttttttgggttttatgtttgaatgttattttttttttttatggtattttgtataggatttcgttttgtttagatgttttttttcgcgtttttttttttatttaattatttgtttttattttattttttcgttatttggggtaattttgttttttttatttgtatttttgaaaatggtattttgtttttttttggtgtttagaaggtggtttttggtttatcgaatagtttgattttatttttataaatttatgttattagaattttttttttttgttagtttttttagttattttttaatggaatagagattattaaattttaatttgataaggaaaaataggtaaatataacgtggtagattttgatatttgtagtgaaaatttaaggtttattattaaatgtatgattttattgtgaaaatgtttagttaaaagttatttgtagttattatgtagtattatgaagaagtttttagaataagggtaggtggtaaagttttttggttagttttaggagtatatattggaaggggttttgttagttgattgaatttttattttttaagtaattagtatgagcgatttgtttattgtatatatgtttaaattatatatattatgtatttttgagaaatattttataagttttttttttattaaaatgtatttggggtcgggcgtagtggtttatatttgtaattttagtattttgggaggttgaggcgggtggattatttgagattaggagtttgagaatagtttggttaatatggtgaaatttcgtttttattaaaaatatggaaaatttattagacgtggtggtaggtgtttgtaattttagttatttgggaggttgaggtaggagaatcgtttgaatatgggaggtagaggttgtagtgagttgagatcgtattattgtattttattttgagtaataagagcgaaattttattttaaaaaaatgtattttgtatataattagaataattaattggattgaaagttaatataaattttagaatattattgaatttaatagtgtatttagttagaaatagttaaaatattttttaaatagtttgaattatttttttttgaatatattgttttttgaaggttatagttaagtttaagaaaaaattttaaaataggaaaagaattaattaaattattttaaaattatagtagtgttttaataatgttaattattttgagttgaagaaaagaaggaaaatgtaaattatgtatttaagtaatgttaatgtatttttttaggtgtaaaatgaatgaataattaattgtgttagttgaatatgtagtaattacggtttttgtatatagaagttttttgaattattttatatttttaaaaatattattgttttaaattagaattttattataattaatttgtgtaaaagttgttttttttttaatgaatgttgtttttttgaggtataaaggaaattttaggtggaggaggagaatagaatatatgtttattgggaggataagtaataataggtgagtaaaaatatatagtttattgaattgttttagatttatattttttttagaaatgtaaagttatatttgaaatttatatttaaatagataagtagaatgtgatttttatatgttttattttgatgtattttgagtatgaagataatttgaaggatgttttttttttttttttattttggggtaaatttttatttattttttagagatttgatttaaatatttttattttgtaataattataggtagaatggattatttatttagttgtggtttttttaagagtatagattatttattatatttattttaaaatttgtagtgtttattttagtgtttggtatagaggaaagaaatataatttttaataaaggtataagtggagaggtaaaatatatatttttggttttaacgtgtttatatttttttttgtaaatggaatattgcgtttgtagtttgtttttatataatatttgggaaggagttttaaagagtgaggaagaatagtaaagatttttttaggtagatacgttatgtgatttttgttgatttttagagtatataatattttaattttatttagtggataggaaaagagaggaagagggaaaaggtggttttttaagtgtttgatttggaagttgtatttattattgttttttgggtagaatttagttatatggttaaaaggagtttgtaaataattgttttttgaggagtcgggtgtttagtgaatgattttattaagttgaaattagatgggaatagattatttaggataattagtaggttttattatattgtttaatttttaggtatattgtgagaattaaaagtattttatatatgttaacgtgttttgaaaaaatataaaaagttttataaaagtgagttataaatttattattaataataatagtaataatagtaaaatatttgagaaatggtttttttgagttgtttagaaggaattatataaatgtattagatatggtagttttatttaattatttaatttgttttttttttgaaattattttaatagtatttgattaaaaattattaaattatttttgaaataacgtatttttatataaaatatattattaaatatttttttggatttagtttggtggtaaaaagatatatattaaagtttatgattgatataattttatatattgattaaattaaagataaatattgattgaatttttgtggttttagttttaatagatttttttattaatattttttgtttgaagtatagatgttacgttatttatgaatcggtattattatagtttgataaaatatttaaattgaaagtagtgatgtatattaattttaaatataatggttaagtaaatgttatttttatatttataagtgtattttatttgataattagaatgttagaattagaaggaatttggaaaattttaggttatatttttttttaggacgaattttttatagtggtttttttggggttagttagtttttgtttgattttttgaagtaggaggaatttagttttatttaagttgtttttttgatttttttttttatattgaatttgttgttgtataggattttttcgtgattgtttttttgtttttttaaattttaaagaataaagtaagttattttttgataagatattttttatatatttgaaaagatattttttatatatttgaaaagattagtacgttttgttttttttagaatttttttttttatgttaatgtttgttttaagaagatatggaggtgattggatatttagttaggaatattttttgagagtttattttgtggtaggtaggtgtaatgttgaattttgagaatatgaatgtaatttttgaataggtggttttgttttttgacgttttaggataaggtggaggagaggagaggggaaagtcgatttatttttttagcggggagggtttagggttgtttgtgggatttgtttttgttttattatttattattattgttttgttgatgggtgtagaggattgaggacgagtggttggagttttttttgtgtcggattttgtagagagtttagagttttggtttttaaaggaggtatatttgtagggtttttttcgtgagggtttagaggacggttgtaaagttgtaggggaggatgggggtatgggaggtaagttcgttgttttgttagagttttttggggatgttgttttttttcgtttgtttttttttttttttgattttttattatgtggtttttttttttttgttttttttttttttcggtgttttaagtttttttatagagatttgtgtttttttgtttttattaggtttttatgttagttttgtataggtgcggggatagtggtaggggcgttttattttcgatttaattatatttttttagaaattgtttgtagttaaatataatttagcgtggatattgtttattaaaggtatattgtttgggttgtacgagagatttagtttttttttatttatttggtatgggttgtgagggggtttttaatttagggggtttttttatttttttttggttagagttgttatttttaagtttttgtattgttagaaaagagggataaggtaagatttttgtttttatgttatagattagtaggggagaggtaattgttaaataattatagtaaaatgtataaatgttttaagagaaataagtatttgtttaggaatttattttaagaaaggagagataggttagcgttttggggaggtagtacgggagtagttagggaaagtaatatttgtaagattagaggttggtaatttttttttgtagagggttaagttttggattttgtagattttatagtgtttgttgtaattattatatagttttgtggttgtagtatgaatgtagttatgggtaatgtgttaatgaatgggtatagttgtgttttaataaaattttatttataaaaataggtagtgggttttgttgttgggtttggtttgttgggtatataaagtgagaagggtattgtgtttttttaggaaatattttttgtaaagttagtataggtgagatagtgtggttatttttattatagtatgaggttttttgaatggttgaagcgttaggtgggaaaggatgaggagttgaagaagaaagtttgggaatttttaaggttttttttaatatttgttgtgtagaattaagtagtgttttaggtgtttagagtaggttttagcgattatattttttgttagatattgaattttgtttatgtcgtttaagattgtattaataattttggttgttattttatcgcggatttaaattagtttgtagttagttaaaattttttaggttttttttttttagtttgtgaattgttgtgaagttaaatatttttgttatttttttggtagtttatttttaaatttttaattttattaaattttatttttaatgtgtaaagataagaggaagtttatcgttgatggtggtttattttttaaaattggatattagttaaatgtgttaaggtaattcgttagaggaatgttggtacgtttatatagtggaatattaattggttattaaaatgttgatgtatgattattaaaaggtagtttatgttatgttttttttgtatgaataagtatgtaaaaagtatgtaaagattattgtatagtttatgggtgggattgggttttttttagtttttgttttttattttttttgttagtgtttttttttttgtagtgttttttttttggttgtatatttaagattggatttgtttagttaaattttattaatttatagaagtaagaggaaaaaaataaatttttattagtttaattttttaaattgggggcggtttattttatagtaataggtaattgacgtaaaaggaaaggaaataatgaagtaattttagaaaattttttatagttggaggatatgtatttttatattgaatgggaagaatggggtgggggggttatatttttgtgttattgtagggttttggtttttagggatttaggtatttttttagttagtgaattatagtttggaaaattggttaagtcggggaattgtataaggggttattattttttatgtagttatgttttatgaattatttttataattttttggtttttggtagttaagtattatttattatttggtttttgtaattttaatttttgattattttcgtgggtggtaataagtttagttttgtgatatttttgttattagtagttttggtttggagagcggtgtttttattgaatgttttagtgagattggtatttttatgagtatatttttgagggtgtagtgaatgttttttttttttatttgggatttttgggaaatattgttttttggtgggttgtttgattttatataatatattggtttttgtatgttagtttttttttgttttttgatttttttattagttgttagggtaataatgttaggtattttcgtttgtttagtattgggtatttttttttataggttttttagagttattttagtagtaattttatcgcgttttttggggtttttgttggatcgtgaaaatatattttcggagaaagtgttttttagataatgaattattttttgttttgtgttaagttttagttttttggttaaggattttagcgttattttttaggatttgtagtgtatgtttaattttgaagtaatgttgggatatagtatttttttttttttattaggtttagttgtttttaggtgggttatattaggatttaattttcgttagtgtcgggttagtttttgaggggtgtatttgttgttttttagggacgaggtttttttagtataaagaagtgttattttttattagggaagaatgggttatttttgtaagttttaaatatttttaggtttttttaatcggggttttgattttggtataattgatttgttttggttgagtatttaaatatttttaaatttttgtaagtttattaggttttaggtttgttgttaagtttttttatttttttattgtaggagagaaggttgtggtttttatattgagtttttaattgtttgttattggtttttagttttttattagttttttgtagagttttaatataatatattagaaagtatttaattttatttttttgtaggtagggaatgtttaaattattgtatttataatgatattttttattaggatattttttaggttattgttgttgaaatatttagtaattgaagtattatttgtgtaaggggattatttgtttttatataatatttagaatggtattttttttgttttttagaaagtgaatgagttggttttttaattttttttgtgttagtttgagttttgaaagaagtaaatgttaagataggattagatgtataagaaatttattggggaaagaattgtgaaggataaaggggaaggagttaggggaggtattgaatttttggattatgatgtgtgtttaataattatgaaggagagtgggtagggagaaggatgggttgggaagagttttagttggtattgtgggttttagaataatttaggtataggttgatggggacgttttgagttaatgttgtttattggcggagtttatattttgttgaaatgggtttgtattagtttttttgttatgtttagttatttgggagtagtcgatgagaattatgattttaggattaattgtaatggtagatttaaaggggtagtaattgatggttttagttaattgtgttttttatagtaggaatattgagtagtgtattttttggttattataaagattagtgaggagtgttttttagagaagggaatgaaaattatttttagtttagaatttgatatttatttaaattgttaattatttatgagagttaaagttttaaaaaataaattttttataaatttttttttaggaagttattggagggtaatcgttatataatatgaggaagataaggaggaagatatgggatttatgaaagggtaggtttaatttaggaaaaggatgatgaattgtagatttatgatgttagatgtgtagtagattaagattagttagtgtagaatgggggagattttagaagtgtgtttttttaaaatattggaggtttatgtgatttttttggggaagtttttgttgagaggttattggaaattgagggaagaattagttatagttttaaagaaaatagagttaattaaaaagtaatgtaattatgaattttaaagaaaataaaaataagaaggaaaatagttttatttattatattataaggtttagttgtgaatgatatttatgttggtagaataatgttaatattaaatgtcggttaaatttaaaattattgtataattaaattgtttgtgtaagagagttaaatttttatttagtataataggaagttagtggatattttttgaagtgtggatgtgtggagatgtaaattttaaaagaaaacgttttaagagttaaaagtggttgtttttagagagaattgggggaattgtagggtaatgtaggatagggaattgtgattttttttgtaagttgttttgatattttaaattatgaatatatattatttgtatttttaattttaaaaagatataaatattttttttattattttaaatattaattttgttagttatagtatatatttatagtattatattttgtagagtttttttggatttaagttttggagaatttttaaagttttagattaatgtttttgtgagtttttatttttttgatgataataagttataaagaaatagggttatgaataaattttgtgggatattgttagttatttttttttaagtcgatttgttttatgaattaatgttttaaatattgattagtatttgatatttaataagtaacgagtaagtttttgttgaattaatgaatatttttaaaatatatttttttaagtggtaatagtattattttatttgtattttatttttttttttgattttaagaatgttataaaaatgtttagtaattgttaagattattatatatagagatgattattgtgtttttagatatgttgtatgttttagtttattttgtatagttataagagtagttgagattaggttatttatttatttatttatttattttttgagacggagttttgttgtgttgtttaggttggagtgtagtggtataatttcggtttattttaagtttcgttttttaggtttacgttatttttttgttttagtttttcgagtagttgggattataggtatttgtcgttatgtttggttaattttttgtatttttagtagagacggggttttatcgtgttagtcgggatggtttcgattttttgattttgtgatttatttatttcggttttttaaagtgttgggattataggcgtgagttatcgcgtttggttttattttttttttttttaaaggaatttatttttttatagttttgttggttgggaagtttaagggtaagtttttggtatttggtgagagattttttgttgtttttttttatggtggaaggtgagagggtaagagagagataaaaggaggttgaatttatttttttataaggaatttatgtttgagatattgaatttatttttatgataatagtattaatttattgatgaggatagagattttattgtttaattggtttaaagtgagattttttaaaggtttcgtttaatattattataatggtaattaaattttaatatgagttttggaggggtaagtatttaaattatagtattatataatataataaaaattttttgagttaagtttggtaaatttattttaggaatttatgttgttttttagttatttttttttttatagtattgatgtatttttgttaattattatttaattttgtttgagtttattatttttgaaatttatattatttttttttttaaagttgagaaaatttttattttttaagcgttttattttttataattttttaaagtaattgatggttgttgtatgattataagtgtaaattattttgttagattatatttggagatgatgaatttggaatggtatgtagattttcgatattaggagttttgttttttgtaataattaggaatttaggtttaaaagggagtaggtataatagaagggtaaggggtgataatgttggtgaaagatatttgaggaaagttattaatatgaaatagaataaaataaatagaaaagtaaattagggaaaataaattatgtaggaattaaatatatatataaattgaaataggaattattagaatatataaaaaatttttgaatattagtaatataatagttgaaataaaatatttagtaaaatatttgaaaagtaaggttaaagtaatgttgtaaaagtagtataagatgataaagaaatagaatatatttttgaaagggaaaaagatttaaaggatatttataaagatttaatattagattaatagaagttttggaaagagagaataaggaaatataggttaggaaatttgtaaagaaataatataataaaatgttttagaattgaagaatatgagtttttaattttaaagagtcgattgagtttttagtttaatgaatgtatagatatgtaagggtattgaaagtttatttttagtgttatgttttttaagaagttaatggaagatatgtattagtaaaattgtagtaaatatataggaagaaatagtatatagaaaaagtatggttttaatttataagaaataaaggaaatttttaggacgagagtagtttttgatagtatttagtttaaattggatttggaggttggaaatttttagtagggaaggaagagttttgggtgaaaaagtagatttaatagaatagatacgattatagaaaatatgatagagaattattaatatattgaaaaaattatatatagaatattttgtacgtttaataatgaggttattatttatttaagggaaaattaaaagttgtttagaaaagggaaatgttatagtgttttatttggttttaaaatgaatatttatataggaatttttatgtaaatattaataatgatttaaataagaatagatatttcggaaaataagggaagaaaatggggtatgtaaaagagttaattttttattattttaatgaattattaaattttataatagtatagtatttagaaatatgatagttattacgagaagaaagagttaaaaggttgttagtggggagtaggagtgagggttagagacgggattgggggagatgtttattgtttttatgataagtttttggtattatttgattttaaattatataaatgtatttattaatttaaagtaatttaaaaaatttatattattggataatgtttgataatttttagagttttttttttttgtattttggggtaggtaaatttattgagagatttagagagtttagttgatttttttgtgggtattaagggttagagttggggttaaaatttaggttttttgaatttttatttttagtgtatattttatgattttaggttgtttttcgtattgtataggttatatttaggggtgtgttagtaaatgtttagattattttcgtttatattagtatttgaaatggataagaatgttagttatgatttgttattaacgtttttaattttaattgatatttgagagtgttattattatattattataaaaatattaatttagatatatttgtttttattattatttttgcgtaatttttttagatttaattgttttaaataattattttatttggtttataaatttatgggttaggattaggggagggtttatttacgtagtttttttttggttcgtagttatttgaagtttgaacggggtggggtatgtaagacggtttatatatgtgattcgcggttgagtttggttgtggattagagtatttttgttggtttcgtttatataagtggttttagattagtagtttttgtatatggaaattagtttttttttcggtaagtattttaagagaattaggaggaagtggtatggatttttttttttttttttttttttttttttatttatttttgatattatgtagttttatttttattagagtagttatatgtttatagatttaagggggagggtttatagattcgttaatgggaggaatagttaggttatatcgtaaaagattatggggtatgggagatatttatttattttttgtaaaaaatatattttgttatagtattattggttttttagtttatagtgatttgtttggaatgttttttttcgtttttttaggatttatattttttaatataaggtttagaaattattttttataggaagatttttttgattttttttagtaagaaagaattttttttttttttgaatcgttattgtattaaaaaaaaaatttattttttggcgtttttatttttagatttatattgtaattattttatgtatttatgtttgattttttacgatgtttagtataataatttgtttattgagtaaatatttgtttaatgaaataattattatatgataatttaaatagtagttttgaaaaagtgtattttaatttagattttttttttttttttttttataatttttattttcgaaaaatgaaagaagttagaggattttttatgaggagttatagtataatttatgcgtggttgttttttgtgtttattgttatttagtgagaaatacgggagatgggagagtgaaaaattatgttatttataatttgattaaaaagttttttattttttttttttacgtttaagttttgtcgttttaaaaatttttttttcgttataggggattaagtagtagttaacgttgtagttttttgttttggaaatatttttaaaggtgttttaatatattttgttttaattttgatttttgtttcgttgttttacgttatttagttatattgaaggttttgtatttgtgttttggggtattatttttttttatttttttttttgtttggaaggttttttttaatttgttttatcgttatagttatagaattaattttttattttttttaagtttatggttataagtttttttttaaaggaggtatatttttaattatttttatttggtgattttttgttttttggaggttttcggaattagttttttttatttttagtaatttattttacgagtagcggagaagattgattatttttgggggtttcgaggagataggaagttattaaatttataggtgttgtggatgaaattgtgtgataatgaatttattgggtttgtttttttagtttttgaatagaagaattaataagattatttttttaaaaaagataaaaatagataaatataaattttttagtataaaagtatttttttttaaaaaagatgaatatatatttttagattgtttttttttgaaaaggtaatttgagattttttatgaaatttttagatagaagttgtttttttgaatttaatatgttgtatattgtagagttaagaggtttatagagtgttaattaatattttttgttaaatatttgtaaatgaatttggttaaagtttaaggaaattaggtttttttgtgtgataaaatataatttttggagattatttatgattataaagggagattgtatagaaaatttttttagatttggaaatgaggtaggattattggtgtttatttggattgaggttttaggtaggtttgtttagttaattttatttttttatttttattttttgggggtgaagaaggtagtgtatttttgtttaatttgttgtttattatggattagggtattttaaattttgtaagggtagtttttaatttgtagaaaattgatagcgatgggaaggatttttgtttaatagggatataaacggattttgttttgtagagatgtaaatgaaaagatgaaaattataatatatttaatgaaaggaaaataaagatttttgtgagtgttattaaaaaaaaaaataaataaaatgtatttttttttcgtggtattttaggttttttttattttattttatttttttatagtatttattgttttagaatattttttataatttatatttattatgtttgttgttggttgtcgttttttttgttaaaatggaattttcgtgagggtacgggtttttttttgatttgttttttgttgtgttttaaagtgttagaattatgttaggtatataatagatgtttaataaatatttttggaatgaaaatttttttttatttagattagtgagttttaaatttttttgattttgatttatagtaagaaaggtattttttatgttgaatatatattattgaaataaaatttttatagaaaaaatttattattattataggtagtgtattgtgatattttttaattttttttattttgatttttaaaattgttgaggttatttataggttgattttataagtggagtttgtgttatgaaaaattttgatttaatattatgtcgaaattgttattataaaaaggtaaatgcgaaagaagggggaaagagtaggtcgatgatttttcgttatttattattttataaagtatattttatttttttgtaattgtattttgtttaatgatgtagaaatttttatatatttatatgttattttttttttgggtgaaaagcgttttttattgtaagatgaattgagttattttaaaagtaaagagttataaatgagtttgttaaagaaagttttaaggagagtttgttggtatttgttgttgataatttaaagtaggagaattagataaggaggtagaagtagaatgtttagaaaataaaagtgattattatagaggaaaaattgtttgttttagttttgttgatattggagagtagtttttttatgagggtattgtggaattattggtaattatattaatagatgtttattgaaaaaattttatttgattgatgaattatggaatatttttgttgattttgtggaaaatattatttatttgagttttttatttttttgtttttttttttttatttagtttatgtttttttatttgtttttttatggtttttattttgttgttattagaaaaatagagatataaaaattaggaattggaatttttttgtgtttttagtaataattttgtgattaatgggttagatggattttggttataagttggatattttgttaataatttagcgttaatgatttggaatgatttttatcgtagtatgatttagtattgaatagaatgatttaattaatgttaattagttttgtatagataaattaatgaagtaagaagtttaatttttgatttattgatgtatttatttagtgtaagttatgaaattttttttattttatttgaaggaagtttttatttaaatataaataaataagttttttattgttatttattttggaaaagtttagataaaataattttaagtaataaaattttaaaattataatatgatttttaaaaattattttgatttttgttttgtttggttgttatagtgtatttttaattaaacggatttttatagaattttaagtttggttatatttgtattaaggaattttatatttgtatttgattagttttaattaaaataagtttaaggaagaaaagggattttacgataaggataaaggattgaagaagaattttagggattttagatgttaataattgtatttgttattaaagtaattattattgttaaggtgggtttttttttttttttattaaatatatgtatatatattatatatatatatatatattatatatatattatatatatgtatatatattatatatatattatattatatatatagaaatatatatagatatatatatatgtatttatgtttgggttagtttggtttttattattttagagagtttttttttatgttagtaattttagatttatttttttttttaatataggatagttatatgtttttattttagtaaaataattttagggaaggtattttattggtttggtttgggttatttaatttgaagtataagaagagaaaatagtatttttttatttttatagattttttgtaaaattagtggataatggtaaaaattttatgatagtaggtgttttattttatttatgtttattatttttagaatttagtatgatagtttataataaatgtttattaaaataattattaaattgtatatttaaaaattaaaagagtaaattttaagttgtgtatgttttattatagtaaaataaaataaaataaatttattattgattttattgtttattttttaaaagtagtatacgttataattttatgtgatttttaaaggagatttaattttaaatttagtttttagagtaaaataaaaggttttggtaattatatatagtagtagattttattttgaagatttaataaaggtttgaaagtaaaatgttatgatattgaatatattaatgtttgagggtttgtgaaaaggttttaatataggaattatatatttttttttagattgtgttttggggaatattgggggttagtttttttattagtgttagtatgtagtaagtaatggtatatatttaagtttgagattttgtttatttttgtatttttagtatttatatatttaatatataataggtgttggataatatttgttgaataaatgattaaataaatgttttggtatgagaattatgttatttataaaatcgttatttttaaaaaaaataataaagatttttgaatttgtagatttagttagaaagtaagaaatatttttatttttttagattgatttattttttggtttagttgtgtattatgtatgagttgttaattttaatattttattttttaatgtttaggtttagtgagttataatgtgatgtagattgattgaattaaaggttttaatgttgttttttttttattgtatttatgttttttgttatgtaattttgtagtgttttttattttaggtgtttatttagtttattttttgattttggttttttttttttttgattttggttttatttatgtgatttattttagttaataattataatgttggtaaatattgagaaaatgtttattagtgtttgtttagttttttgtttttttgtaattgttatgagaaaatgtttaagttagtatattggaggatgagatatgtggggtagaagtaatttgttttatttgttttagttaatattattttagattaattagatgagattagagtagaagatatgtttagtggagtttaatttagtttacgaataatatttttttatgagtatgtgagtaatgtgtaattaatgtattatgttttttttattttgtatttttaaatattttttagattgttttgttgttttgttttttagtagttattatttttgtttagaattttaattgtatttgtattttggtagtattttgttaattttttatatttagttgtttatattttaatgtattttgtaatggatgattttgagtatatgattgattattattgttttagaaatttatgttaatttattgtgatttattttgttaaatttaaataattttatatttaaaattttttatattttggttttatattgtttattgtaattttattttttaaaagttataaattattaattttgtagtttaattaggttgatattattatttttataatacgttgggtaaatttttatatttgtttttttaattatagtttttatgtttagatattttattgttttttttaagtattagttagagtttattatggggggatattttaaaggttttttttttttaatttatttgttttagaggtggtataggttagaaaagatagtttaattatttggtttaattatttggattttatagtttttttgggagagttttagatgatttgatgaaatgtaatatggttaaaaatattttggtggagaataatttaattaattagattatttggtgaaaaataaattttagttattagattttttagtattaataattttggtatgttaggaatttttaaaatatttttaataaatttttttagaaattagaatgattgaaaggtataataataggaaattaggaaattaataagtaattattgaaaagtgagtgattgaattagttggaataatttatgttatttattttgtgggggaaaaaatgaaaatagttaaataagtagagtagatattattaatttagaaaaataatatagtaaataatttgaattagaaaattttttaaaattgaaaattttagttttaaaaaatttgtgtttttttatttaaaaagtaatatatatttcgttatataaaagttagaaaattagagaagtagaagaatataataaatgtttattgttttatttaatagagattataattgttatttttgtataaattttttaaaattttgttttatgtgtatttattttatatttgtatatatgattttaaaattaggtaatattgtacgtggtttatttatagttaattatagtttgtaatttaataagttatatttgtttatggtgattatttattgtttataaaattaataaattataatttatttattaatattgattatttgttgttaataatttattttatttaatgttttatttttgggttattttaattaatttttattgttagttttttaggttgttttaattaatttaagaattataaatggtttatagtagttatttaataaatatttgagtgaaaggataaatgaatgaataattttatattattggatgtttaagttgtttttatttaattttattgttgtgggggagtataatataattttggtgaagagttattaatttaggaagaattatgaagaagtatgttatttatttttgtttgtgggtggggtgtattgggaaaggaatgtttaaatgtacgtggggagttaaataagattttataggggagatgggaattgagttaaatttggaagaagtgagaatttttagttgataattggggaagatagtattaagagtaagtggggtttattaggaattattttttagaagaggtaagtttagaatagaaggtagaaagggatatggatatgaaggaaaagtagaatgtaattttagggttagtaggttggtatttaacgtaggtatagttttggatgaggagtaatgagaaattgatttggttgtagtaaaatagttaggttgggaagtgatgttgtttatatttatatgcgattttattggtttttttgttattttgtagaagattgtaaggtttggtgtttagagttagaaatgtaatttatttgatttgttaagaagtttaaagtaggtaggggtgttaagttgttgtttgtttatatatattcgtttaattgggtgttagggaaagtagatatgagtttttttgtattggttaaattttgagtaatttttaaggaattgtatatagagattattggttattttttgtggataaagttgtagatagttatttttgggaaattatttatgtgttttattaggtggttgttttgtgggaggttgtttgaaattttgttttaaggaattgtagtttataaattatagtgttgatagaaataagagaaataatttggtttgcgagtataaatattaggttagttggtatgtttatgtaaatattatatagtagtagtgatttttaaggaagtttttagataatgtaattttaatattttttttgaagttgaggtaatagggtgttagaaagaaaaagaaaataaatttttagtgttttttaaaatttttttaattttttgatttttttgaaaacggttatttttaatttagaattaaagtaatatttggagggttttttttttagatagggagaagatataaatgagttatttgaattattttttgtttatgggttgtattttattttttttattattggttttagtttatttaattaagattatttgtaggattaaattaattttttaagaattattttattttaatttttaaaaaatttaatgaatgatagataataaaaagcggtttatttagtattatttttgaaatatatttgggtgattggtgatattatttatgtttttttaattttagttttatatatttagttgagtattaggtatttttattgaaagttagatttgtgatttaaatagaatttgatttttttttttttttaattttttattttttgttttttttgagttttttgatttttttttttttttttatatgtaatatgtaatatttaatttattagtaggttttatagattttgtttttaataatagtttaaatttagttatttgttattattttttttggtttaaattattatgattttttgtttggattattgtaatagttgtttaattggtatttttgtttttattttgtttttttagattttattttttacgtagtagttattgatttttggaaatttattaattattatttagatataatgagtatatttatatagttgtttgattttatttatataaagttttataattattttatgtattgggaattataatagtggttttttatgttgagaattgattaagagttataaggaaataaggagtaatattttattgtattaatagattatattgtttatatatttttttgtaaatggatatttatgttgtttttagtttttttgttattgtgattaaagttattaggttggtgttaaagtaattgtagtttttgttattattttttaaatggtaaaaattgtaattattttggtattaatttaatattgtaagtatttttgaatttattaattaaatattattataatatttgaataagaaatatttttatagtatttataattttaagtgttttttatgtattgatttagttaatttttataaggatataattatgaggtgttattattatttttattttatagatgaggaaatagaggtatagattttagataatttgtttaaggttttatagttaataagggggtagaattaggaaagtttggttgagtttatgtttttattatttgtttaattttgtttggaatgtttttttcgtattttttatcgtttttgtttaatttttcgggttttttgttttttttatatatttttattttaggttttagttttttttagtattttttattttttttgttatagatttttagataatgtttttttgaagaagatttgtttgtttaaattgtttttttattttaatttttgttattttttattttttttttgttttgtttttatttgttattttttttttttttaagaatgtaagttttataagaataggattatattttgaattttttagaaaagtgtttagtgtaatatttgttgaatgaatatgatttttgtaattaaaagttaaatatatatatttttttaattaatagattattgtagtagttttaaagatgaatttatgtttcggagaaaattagtatttttttgttatataaattgtaggtaattatatttttatatttgaatagttttgttaatgattaagatattaatttattatatatttattaatttatagatttttaaaattgatgtatatgttttataagtaatttgatgaattttgatgattatatatatttgtatgtgtatggatatttgtaataaatatttaagtaaagatatagaatatttttattattttagaaagtttttttgtgatttttaattaatttttattttcgtaggaaatcgttgttgtgatttttattattatagattgattttgggattttatgtaaatggaattaaataattttgtgaatgtattttgtgtttgagtttttttaatttatataatttttttgatattaatttatattattgtttagaagagtagtttattttttgtattaatgaatagtattttattgtataaataaattatattgtttatatatttttttgtgaatggatatttgtgttgtttttagttttttgttattgcgatttaagttattataagtatttttttttaattgtgatggggtttcgtttttgttttttaggttggagtgtagtggtagcgattttagtttattgtagtttttgttacgtgggtttaagcgatttttttgttttagtttttcgagtatttgggattataggtatgtgttattatatttggttaagtttcgtatttttagtagagacggggttttattatgttggttaggttggtttcgaagttttgattttaggtgatttatttatttcggttttttaaagtgttgggattatagttttgagttattgtgttcggttagtatttttgaatatattaatttgtaagttttattttaatattgtataagttttttggggggtttatgttgttattttttttggtaaatatttaggtatgaatttgttagattatagagaaaatttatttttaattttataagaaattgttaaatagttttttaaagtggtggtattatttatatttttattattaatgtatgaaattttcgttgttttacgtttttgttagaatttgttggtagtttttttttttttttgaggtagtattttattgtgttgtttaggtatataatggtgtgatttcggtttattgtaatttttgttttttaggtttaagggatttttatgttttagtattttaagtagttgggattatagaggcgtgttattatatttagttaatttttgtatttttagtagagatggggttttattatgttgtttaagttggtttcgaatttttggttttaagtgattcgttcgttttagttttttaaattgttgggattataggcgtgagttattgtatttagtttgttgttagtatttttagttgtaggtattttagtgggtgtgagtgttcgttggggttttaatttgtatttttttgatagtgttgatgttgaggatatttttatgtgtttattgagtattggtgaagatttttttgtgaaatatttatttaaatattttgtttatggtgggaaggggagttattttttttttattattgataggtaggtttacgtatttatttcggatataattattttgttaattatatattaattataaataaaaattgataaattggacgacgttaaaattaaaatttgtttattaaatgttagcgaaatgtaaaggtaaattatatattgaggggagatattttaatatatgtatatttatatagtgttttttgtgttttaagaagtatttttttattttaagataaagagattatttttttatattttgttttataagttttatagttttagtttttagttttggatttatgatttgttttaaatttttatgtaagattggggtttaatttttttatatatttttttagttgttaaggattatttgttgaaacgttttttttgttgttatataattgttttgatgtattcgttagaaattagttggttgtgggtttattttggaattttttgttttgtttttttgatgtatttgtttatttttatgttaatattattttatattaaataattatagttttataataagttttgaaattaggtaatgtgaatgttttaattgtgttttttttttttttagttattttagttgttttatgtttttattgtatatattttagaattaatttatttatttttataaaaagtttattgggattttggatgagatggtgttgatttagtaggttaatttggggaaatttgataataatattgatttttttaatttatgaaaatggtattttattttttatttatatattttttaatttttgttagtaatgtgttataattgtagtaaatttgtatattttttgttaaattattttttaagtattttacgattttggtattattgtaagtggtattgtatttaaaatttattttttgtttgttttttgtttatatataaatgtaattgatttttttttttttttttttttttttttttttttgagatagaggtttattttgttatttaggttggagtgtagtggcgtgattagtatttattgtagatttgaatttttgggttgaagggagttttttattttagttttttaagtagttgggattatgggtgtgagttagtgtttttggttaaatgtagttgatttttgtattgatattgtattttgttaatttgttaaattaatttattcgttttaatagtttttttgtttttttaaaaattttaggatttttatatagataattatgtttttaatgaataataaagtttgtttttttgtttgtttgtttttttttttttaattaatatgttttttatgtttttatttgttttattgtattggttaggatttttagtataattttaatagtaatggtgagagtgtttaaatgtatttttgtgtatattttatttttttggaatttattataaatggaattgtttttttaattttttttttggattgtttattgttattgtatagaaatataattgattattgtgtgttgattttgtattttgtaattttgttgaaatcgtttattttttgtaatagatttttgtgaattttttaggattttttatatgtagaattatgttatttgtgaatagggatagttttattttttttttaatttggatagtttttttttttttaattgttttggtaagaatttttagtataatgttagagagtaatagtgaaagtaggtattttttttttaattttgatgttaggggtgaagtttttagttttttattgtaatgttggttgtggatttttataattttttgtttgtttgtttttttgtttgagacggagttttttttgttgtttgggttggagtgtagtggcgtgatttcggtttattataatttttgttttttgggtttaagcgatttttttgttttagtttttagagtagttgggattataggtgtttgttattatatcgattaattttgtatttttagtagagacggggtttttcgatgttggttaggttgttttcgaatttttgattttagatgattcgttcgtttcggttttttaaagtgttgggattataggtatgagttattacgttcggtttataaatgttttttttaattatattaaggaagtttttttttagtcgtagttttttgagtgtttttattatgaaagatttttagatttttgtaaaatgttttttttgcgttaattgagataattatatgggttttttttttttttattttattgatgtaatgtattataacgattttttttaatgtttatttatttttgtatttttggaataaatattagttgattgtgttgtataatttttaaaatatgttgttggatttgttttgttagtatttggttgtatttttttgtatttatatttataagggatattgatttgtaattattatttttttgtggtggttttatttggttttggtattaagataatgttggttatattggttaagttagaaagtgtttttttttttattttttgaagagtttgaaaagagtcgtgttaatttttttttaaatatttggtataatttattattaaagttattagttttgggttttttttagtttgaaagtttttgattattaatttaattttttttatatttagattagattttgtattttttttttagttatttttggtaatgtgtgtgttttcgggaatttggttaggttatttttgttatttaatttgttggtatttaaatgtttataatgtttttttgtaattttttttattatagaaatgatatatagaaaaggttagttattatttttttttatgattgtattaatttgttttttttttttttttttttttagttagttttgttaaaggttggtttgttttgttgattttttttaaagaattaatttttgattttgttgattttataatttttttgttttgtattttgtgtatatttattttaatttttattagtttttttattttgttagttgtgagtttagttggttttttttttttatttttttaaggtggaagattaagttattgagatatattttgtttttttttttgatgtaggtatttaaagttataaaattttttttgagtattgtttttgttgtaatttataagtattggtatgttatatatttagttagttttttatatatatatttaagtttttgttaatttattttgtgatttttttattgatttattgtttgtttgagtgtgttaataatttttacgtatttgtgaatattttagttttttttttgttattgatttttagttttattttattgtggtaagaaataatattttttatgattttaatagtttaaaatttattaagatttattttttggtttaatatatgatttattttggaaaatgtattatgtgtatttgagaaaaatgtatattttgatttttttaggtgggtggtatgttttattaatatatatgtttgttagttttaggtgaattatagtgatgtttaaagtttttattttgttattaatataattatgttagatttttaatgttgtttatttgtataatatgtttttttttatttttttttttttatatgattattttatatttatagtatattttttgtatatagaatgtaattgaaatttatttttttaaaatttatttttttttttttttttttgagatggagttttgttttgttgtttaggttggagtgtagtggtataattttggtttattgtaatttttgtttttcgggtttaagtaatttttttgttttagtttttcgagtagttgggattataggtatttgtatttttagtagagacggggttttattatgttggttaggttggttttgaatttttgatttcgtgatttatttgttttggttttttaaagtgttgggattataggcgtgagttattgtatttagtttttaaaatttgtttttatagtatttgttttgtatttggaatatttagtttatgtgtatttgaatatttattgatatgtttgggtttatgtttataattttgttatttgttttttttttgttttatgtgttttttgttttttatttttgtattttttggaaaaattagattttttggtaatttattttttttattttattggttttttagagaaattttttaatatttttgtgagttttagggattatattatttatttttattattattttatttagaattaatattgttaattttatttaaaaatttgtttatttcgttttttagttttagaatttttatgttttttttagttgttgtttttttgttgttattttttatttgtttattatatttattttttttttgaaatttttaaaaatatttataatagttattttaaagttttttgttaattttaatgtttgggatattttggtttttgttgatattgaatatttttttttttttttttaattaagggttttatttttttgtttttttatatatttagtagatttttattatgttttgtgtgttatgaatgagatattataggaagtttggttaatattgtttttttttaaagggtgttgtatttagttttgttaagaagttaaattattagatttatttgatgtggttttagtttttgttagagttggtttatttttgttttgtttttattttttaggtaatgatttttttgagttttagttggatgtttgaagtgtttagttgtatttttttattttggttattttgaaatgtaatattttttagatttatttaatttttggtatttattttttagatttgtggttgtttttttttgttgagttttataaaattttgttttgtgtatggatagttaaggatttttgggaaattttatgtagatttttaggttttttttttgtgtagattttttttttttagtacgttgatttgttttagagtttttattattgttttttttttttttagtttagtaatattgttgtgtattgtgtgggttttatttgttttagttatatttagaatataatttaaggtagaaagttggagtggatttgaggtttattatttgtttttttttatttattatttaaaagtagtttatttgtgtgaaattttttgttgggttttgtgggggatacgtataggtaaatgatagggagtttataatttagttaaagagaaaatgtttatatgttttgtggaatttagagtatttttttcgatttttaaaattatttttttcgatttttaaaatttggggttattagttagttggtaggaaggaattttagatttattttttttttagattttttttagattttatgttttaaaatttagatggaaggtaagaaggaagtaaggagggtattatatacgagagagatttatattttaaagtggattattagtatattatgagataatatggtattatttttagaggtttgttatataaaattttttttaatttattttttaatggtatgtgtttgaaagttttttgttttttatgattttgaaagtaaaataagaattagagtagtttatgagagagtttttttgttttagtttagaaaaatgttgtttttgttttagattttttgatttggtttttagtgttagtttttatttttttagatttgtttattgaatattggttttgttgtagagattttgttagaatttgagagataaaagatttaatgtttttaaaatatttataatttagatatttaaataaatgtaataatatatggttaaggttttggatagaggattattatagaaatatatagaatagatatttagtttatgttagggagagggaagatgttaaggaatgttttttggaggtggcgatatttaagttgagttttaaagtgggtgtaagagtgaaggaattgggaataggtaaaatatattttagagagttgtatttttaaagtatggaaggttagataattttagaattttaagtggggtttaatgtgtttgggatttggattttaggtagagattatagggtaagttggagaataggtgggtagggtgagatgaagtagagatttttaataattattaaataggtttgttatttaattgttattagttattttttttttttgaattttatttttttaatttttagagtaatatatgtttatggtaggaaatgaaaaaaatatatagatgggtaaaatgaagtgaattatattatttataattttgttgtaaaataggttttaataagttataaatttttttagattaaagtgttattaaattttatttgttattttataatttttttttgtttagagtattttagaaacgtttttatatgttaattgatatttttttgtattattttgaataatggtatttttttagttatattattatgtattaaaatatttatatatggtaaatatatttgaatattagatattttaattgtttttaatgtttggttattaaaaatagtatttagatgaatgtttttggttatatagttaataattttattgagtttttgttaataattttattaaattttaattttaagataataagtttataagattaatatattaggaataattagaaagtattgtaagattatatgtaattatttttttgttaattatttttatttgttgtaatattttaaatagcgatttttttatattttgttttataatatttaatttgttaaatgtattattcgtaaagggagtgaattggttcgtgaagaggtggtgaagttggtttaatttagtttaatagataatgagggttttcgtgtgttagggagggagtgagggaattttatagggagtttattttggggagggatgttttttattatttgtagtaaatgatattagagaagtatgtgtgagatttttggtgtttagaggaggggtatgtagtatagtatgggggtttatggggttgtagcgattttttagagacggtgttatgtttgggatgattattaagttaggatgttgtaaagagtaattaaataagttttaatagggttttggtatgaggtgagtagttaatttaaatgatatttgaaatgttttttaatgttgtaagtgtatttttttgtaaaataattaattatttaaaagatatttttatttgtattatgttatttaatttttatagtgtttttacgggataatagatgttatttttatttgtatagagtagtaagtgaggtttatatcggttatagttagaggagtagggaatttaaatttaagttttttttattttaaattttaagttttattagtatgttatatcgttattgtgggttgaattttttagtaggggttgttttttttatttgtaatatttttttttttggtttgtttattttttagagagagaagggatacgtatttatggagattttattgttgtaaattttgtattaggagttttatatgaattgttttatttagtttttataatagttttgtgaggtataggaaagttagatttatttgtttaaattaaggaatgtggttaatttaagagtgacgaaggttaggtgcggtggtttatgtttgtaattttagtattttgggaggttgaggtgggaggttgaggatcgtttgagtttaggagtttaagattagttagggtaatatagtaagatttaatttttattagaaataaaaaagaaattagttaggtgtttgtagttttagttatttgggaggttgaagtgggacgattgtttgagtttgggaggtagaggttgtagtgagttatgattttattattttattttagttagggtgatagagtgagatttagttttaaaataaaataaaataaaaaagagtgatggagtaggaattttatttgttattagagattatatatgtttttttttatggtttaggttatttattatgtttttgttaaatttttttttttgagttttgttaaagtttttaaggttagaagagtggtttataattataaaaaattttattgtatgattttagttatttgtaaaattgatcgagattaatgtattttttgtttgtttttatttttttattttttgtttagcgtttattttatagaaaggtgtttggtagatttaggatatgattgtttataggttttaaatgcggttaaattaggaaagttttttggtttttggttttaagaggttaattgttgagtattagtttggattgtttaatggattttatgtttaattgttgtgtttatttgtttgtttgtttttgttttgtgagatatatttttttttgttatttgggttggaggttagtggtgtgaatatggtttatcgaagtttttattttttgggtttaagtgatttttttgttttagtttttttagtagttgggattataggtatatagtattatgattggttaagttttggattttttggtagaaatggggttttattttttgcgtaggttagttgtgaatttttggtattaagggatttttttaatgtgttgggatttcggttttttaaagtgttgggattgtaggtatgagttattatgtttagtttttgtttaattgttaatattatgaggtttttttttaatgaggaagggaggtttggggaggtgtgatggggaagatggagaagggtaggagatattataaaattgatagaagtgtggtacgattaagattttggttttttagattatataagtaagtgttattatttttttgattaatatttgattttttattttttttttagtatatagatagttgttttaggtcgtgaaaaaatatatttagtgaaatgaaatatagtagatatgtttattaagaaattaaaaagaaaagttagttataaattattttattttattgaaatgtttggttgaatttataagaatgttgatgaggttatttttggatgtttgtattgaaatgaattacgagaggaatatttaggatatgttgaagaggttgtttggtttaatgaataaaggagtttttgtaggtttagggagtggaatgaaaattggtatgattattttggagaatatatggagttaaatagagaatttgaatggagtttttaaagaggatatgttaggggaataaaggttgataaataatatttgtatttgtaggaaaatagggagagtaaattaaggaatttaaagagaaagagaaatttattttaagtaggggagaaaaaatttttataatttttatttttttttgtaaataaaaaggaaataaatgaaaataagatattagaagttagtaagaatttatgggagtataaagttggttttatggatgtaaagttttttttattgttgtacgaaatttttggttgtatgttaataatggataattgatttttttgtagttgtattttgttgttttttgtttttggtttggatttagtattttgggtttgtgggaaattagaattgttttagagttttggagggtaggttaaggttagatgttggagtgggttttttaatttattgtattgattttttttgggaagaaagaagattgtttgttagaattttagttacgagagatgattatgaaatagtaaattaattttaacgatttgagttattttgaaaatttttagttttaggataaaaaatataattttatttagaaatttttggtgtgattatagatgtagtattggttttttttatgaaattcgtaaattaaaaagtatataatttaaagttaattaaatagtaagttattataataaatttttttattttattagttttttaaaatgtggataattatatatttaatttaaggaatttatatttttttattgattgttaaagattaatggaaataattttagttttcgtagtattttattgtggggtgatttatttttgaaataatgtattggttttagttgatttttatattgttagttattaagttaggtttgatgagaaatagatataatttgatttggggatttaagtattatattgtatttttttttataattagagataaatttgttatggtttttttttttataggtttatgttaaagtttggtatttttataatattttttttcgttttatttagggaggttaggtgtttattgttttaagtttttattggattaattttcgaagaatgatcgattatagtattaaagaatgttaaaaatttttggattttgtattaggttggtttgttaaattcgtatttattgatggtgattatttcgagagtatgaagaataattttttatttattttgtttgattttattgaatttgagaaaaagtttattaaaggaattgttgatttttttgttttttgttttggatttattttgagtttttaatttttggatttttatatgaagtttcgttaattggaattttttaatttgaggtaattgtttttttggattgattttgaatttaattatttttaaatatttattgtggaaaatggttggtttgttttagggattattaagagagatgatgttaaatatatgtattattttaaaaagtttattatggaaattttaaaaggtatgattgtgggtaaagtttttattttttgttaaaattttttggaaaaaaatttttaagattatttaatataaatgatgtgaatttatatttttaaattttaatggagatatttattttggtaatagtagaatgtatttatttaatattttttttatttggagttttgaggaatttgaattaatttttaaaaatttatttgtaaatgagaaattgggttataatatttgtaattatttaatttttagttattaatttagatttttagattaaattgaatataaaataaattttaggatatttagttttttgtatatgttttttagtttttgttattttggttgaataaaatattttaaagaaaaaggaatgtttatgttttttagagaaaatagtataaatagattatgtttttaaagtttttatttatttatttattgtattagatataaagttgggtgtttaggatggaaagtggtataagatatttttttagttttgtagaatatttattataaataaggaattatttttttaaggtgtttagaaatttaaaaaatatattagataggttaattttgagggtatttatttgtagagttatataggtttgattagagtttttcgttaagaagaaaaattattggtttattaaacgagaagtattatattttatttatttaagtaggaaacgtttagttgtttttgaattatgatgtaagtgtttagcgaagggttatgttgtttttgtttttttttttttttgtagttattaagttggatggggtggatgttatcgggtatatcgtatggttttttatggatggtttcgagtggtatagaggttatagtattaggcgtggatttttttatgttgattttttaagttaggataagatgttgttgttaaagtttttagttttgttttattaaaagttgatagagaaaaatggttttttttttttatttgaaaattagtttttagaagggatatttttttgtgattttgtttggggagttgttgataattatatttaagtaagttagttgataaaattaattagtagttttattaagttttattattagtaagtagtgttttttttttaggttgattgttatggtatattgttcgttttttgagttaaaaataattttttatgagtatattaagggtataatttggaatgttgtatttttttttttaaaatttttttaatttttattttgtttaagttagatttaaagataaataaatttaaagtatattaatatttaagattcgattaagatagtaaaaagataaaatattttttttttatattgtggtttttgattttttttaaggtagttgagtttttttatgaataggatttaatatagaattttaaagtttttgagttttagtggtgttgttgagattgaggtaggaatattaggtagagttttttagaggtataattgtgggttttataaatgtgtagaaatattttaagaaagtaaattttagatttaatgatttattggttagaatgttttttttagtaatagttattgaaatgatacgaaatttttttagaatgattaattaatatttattgagtatttttttagtagtaagtttttaatatttttttagattttttaaattttgaaggggtttgttttttagtatttgattggatattttagtaagtatttattggatgtttagtgtgttcgaagttttgtgttagttgttcgggtcgtttggttaaggggagtgtaggtagagggtatattgagatgagtaagggtaatttttgtttttaaaggagtaaaggagtttattgagcgaaaataatgtatgtataaatgatgtaatggagtgaagcgggtatggtggtaagtaataagggcggggttgggggattgttgttgatagagttttaagtgtgaaaatagtttttaagatagagatagagtttagtgtttatagataagtagttggttttgatatgttgggttatggtagttaattaattggttttgtaaattatagtttgaaaggaaatatttggaagaatgtgaaatgggttgttgtttttttgtaaatatttaattgaaattttttatttataaggaaataaattaatattatttttagtatattttttgttggttgggattattttttttttttagattatttagtttattttataggtagttttagatttaaattttcgttttttatttaaaagatgattggtttacgtttgtaattttagtattttgggaggtcgaggcgggcggattatgaggttaggagattaagattattttgaataatacggtgaaatttcgtttttattaaaaatataaaaaaaaaaaaaaaaattattcgggtgtggtggcgggtatttgtagttttagttattttggaggttggggtaggagaatggtatgaatttaggaggcggagtttgtagtgagtcgagattgcgttattgtattttagtttgggtgatagagtaagagttcgttttttaaaaaaaaaaatgattggatgtgttattttttatgttaggatatgtgagtttaggagaaaggtttttgagtttttttttgttcggtgtgtaattttttgttttgtttcgatttttttttttttttttagttttttgttatttgaaatttttttattttaatttttttttttagagtggattttattgtggggtttagagaggatttgaggtgggagaagtgaggttggtgaggaagaaggggaggagaaagggaagaagattttcgtagtttttttttttttttttttttattggggttggggatagatcggatggtttttggtttttgttttattttttgattttttgtttgttttttgttgagtacggatttttgatagtagtttgagtttggtaggtttagttttttgtatgcggtataattttttagttagtattgttgtgtagattatgggaacgaatgtagaataagagtgggggtgtcggagggagttttattttttttgttttattttttattagggggttgtgcgttggttttgggaattggtaaatagtgagaaagttttaagggtatattttatttttttgagggagaagagaaaacgttggttagaagtaataagtatagtagtgaatagtaagggagatgggagataatttttttttttattatattttagaagttattgttttagaatttgatttaaggttagttattaattggttttagaggttttttttttagattatacggtttttttttttttattagtttggggattttatttttttttttggtagtttttttttgtgtagaatttaataaatataaaattaagttatttttaaatttatagtagatgagagtttttttggaagttttttggtggggaaaggttgtaattgttattttttttttttggtttttattttaggttttgtgttatattgatagtattttttttaagttaattttttaattgatttgacgtagttaaaataagttttttgtatgttagttttgaggtgtgtgtgtttttatttataaatagtattttatagttttaagatattatattaaagttttgagaagtgatttttaaattattgaattttatttttttttttttggttagtattttagatttttagtgtttgaggtatgtattttatttgaataatttgaaaaataatattttaagaagtatataatttgattttaggtttatttatatggattgttattttatttggatttattttttcggttgagaggtttgtttttttataattacggatgtttatagttaatataaatattgaatttattatgtagtgaggatatagagtttttttaatattggtttttgttaggagaaagttttttttataatatattaaatatatgttttaatagtcgttttttttgaaaggtttaattttattattttatttttttagtaaaattttagttaataaattaatggaggttaggtggaattttgttttaaaagttttgtattttttttttttttttttttttttttttgatagagttttgttttgtcgtttaggttggagtgtagtggcgtgatttcggtttattgtaagtttcgttttttaaggttacgttatttttttgttttagttttttgagtagttggggttataggtgttcgttatcgtattcggttaattttttgtatttttagtagagatcgggttttattgtgttagttaggatggttttaattttttgatttcgggatttatttatttcggttttttaaagtgttgggattataggcgtgagttattatgttcggtttgttttgtatttttaagaaatttttttttttttttagaaatgatattttagttttttatatttgtttttagatggattgaataaaagttgttgttttggaataattacggttaaaaaaaaaagttatgaatttagttaatttagagttttataaaaataatttaaaaaatttttttaaattttgaacgttttaaaagagcgtgtaaatattttgttttttaaagttaaggaaatatgatttgtggggtgtattatagtggaaaaatattttgatagtatttttatagtattaggggaagtgtatgtgtgggtgttttgtaagggataattttttagaaaaggtaatttttttttgatatgttgtttttaatgatttttttttataaatatatttatttttttagagaaatagtagtgtatttgtaataggttcgtaaaatgtaataaaatttttgttatggtttttgatttttgtttttatatagagtattagattaaggaatttgttttaataggattattttagaggggaatataggtttagggtgtagattttttagttggattttttattttgtattttttttatagtagatatatgaaggaatgattttgtgattttgattttataatttgtatattttttttaaatattttttttaaatttttatttgggaggattttatagtatatgattgagaattataattattattattgttatagaagaataatttagaaaaattttttaattacgttaaaaattttattatgggtggatgataatattgttttttttttttatattttttttttttagatttttttttttttttttttattttttttttgagatgaagtttcgttttgttatttaggttggagtgtagtgttatgattttggtttattgtaatttttgtttttcgggtttaagtgattttttcgttttagttttttgagtagttgggattataggtgtgtattattatatttggttattttttgtatttttagtagagatggggttttattatgttggttaggttggttttaaatttttgattttatgatttgttcgttttggtttcgtaaagtgtcgggattataggcgtgagttattgcgtttggtttttttttcggattttttattattagttagattgaatttgttaaattttgttattgattttaaatttaataaaaggtaagagttatgtttatttagtattttttttatttatagtaaattttaatttagagcgtaattttaagtataatttaattataaatatttttttatttttttatttaatttatttagttttttaaatttttttttttgagataagattttgttttgttattgaggtcgatgtatagtgatgtgattatgatttattgtagttttgattttttaggtttaggtgatttttatattttagtttttcgagtaattaggattataggttcgtgttattatgtcgggttaagacggggtttggacgtgttgttttagttggtttttaatttttggttttaagtgattttttcgtttcggttttttaaagtgttgggattataggtatgagttatcgtatttggttaatttatttatattttaagtttttttttttttttatttagttttttttttttttaaatttgaaagttttatgatattaatgattttttatattaaaagaaaaatatttaaaaatattttgtttatataatatcgataagtagtgtgtaagatttattagtatttgttatttgaagtgattaaatttagatttttgggggttatattaaagaaatagttgaagagttagaattatgggtaaagcgagtgtgtatattagaaagtggaatattgttttttttaggagttgataatttatgaaaaatagtttatatttttagttagaaaggtttttatttttgtttatatttttggttagttttgttgaaataattgttttgaattatttttttaggattgtttaggtgacgttaatgtttattttgttttttataggtagatattattttgttttagtttatcgatttgaatgtttatttgtgggatgtttattatagtaaaaggtttattaaagtggatggggttgtgattaagaagaggaaattttattgtgttgattttgttgttatttagttttagatcgttttattttaggaaatgtacgttatatattttcgtttttttttggattgggttttgattttttttttgggtaattagttttaggtgaattatattattttgtagtattatcgttgtatggttagcgagtttgttcgtgttaatattattttagtggtggttttgtggtagtttatggtttcgaattaaggattgtcgcgttttttggttaggtagggcgtttgggagaatttttatattgttttggtttttgtagagtatgttcgattgtgtttttaagagttcggttattacgttaagttttggataacgatgaatgagtcgtatataaggaatatgatatatagtgttggttataattttttgaaggtttatgttttggtttggtatgtgtataatgaaaagtttaggtatgtttagaatgggaaaatatttatagttttgtaggttgattggatagaatttgtttgtttttttttttaaaaggataaagaggtggttgagagagttttggaatttgatattggttggttggttgagtttattttcggttttggagattatttatgggtgatgagggattggttgaattaaagaaataattttttttttttttattttattgaagatgaaaaaaagttaatttagggtatttttgattttttggttttaagttattatattattatttttgtagatttagaaaaagaagatttaataaaatataatgattatttagaagtgtaagaaatgatcgatattacgtggtttaatttttttagttaggtggcggtagtgttttgggggttgcgtaaagtgttgaattggttgaagtttaagtacggagatttttttatgtatataatatttaatggaatcgatgacgggttgtatgttgaggacgattagttgagggtgtattatatgtagaattatataaacgaagtttttaaaggtaaggagttttagttgcggttattttttgaaggttatgttattagagggtatgatatttgattaaatttttaatattaatatatattgttatttttggaatggagggttatttattttgtgttttattgaaatagtttaagagatatttagtatttttttaaggataaaggagtgtagttaaaagtagaagattagaaatttttagtttttattttggatttatgtaagtttagatttttgttttttattttggatggttttatagtagttttaattgttttatgtatataaagtagtatataaagatttaattttgttgggtatggtggtttatatttgtaattttagtattttggaaggttaaggtaggaggattgtttgagtttagaagtttgagattagtttgggtaatatagtgagattttgtttttattaaaaattataaaaattagttgggtacggtggtatatacgtttgtagatttagttatttgggaggagaggcgggaggattgtttgagtttgggaggtttagttgtagtgaattatgattatagtattgtaatttggtttgggtgatagagtaagatattattttaaaaaaaaaaagattaagtatggtggtttatgtttgtaattttagtattttgggaggttgaggtaggtggattatttgaggttagaagtttaagattagtttgattaatatggtgaaatttcgtttttattgaaaatacgaaaattatttaggtgtagtgatgtatatttgtaattttagttattcgggaggttgaggtagaagaattatttgaattggggacgtggaggttgtagtgagttaagattgtattattgtattttagtttgggtgatagagtaagattttattttaaaaaaaaaaaaaaaaaaaaaaggatttaatttaagtatattatagtagattgaattatgtaaaatatttatttaataattaggtttaggtttgttttttttgtgtagtaaattaattattgtgatataggttttgtaaaagagaaaagatttatttgtaaggggattaagcgagggggtgggagaataatttttaattttgtttttttgaagataaggtttaggaatatgtatgggttagggaatgggtggtttaaggtatggtgaagagtgattggtagggggggaaaatgaagtaataggttagatatatgtatagaaaatggtggtgttagtatgatttgagggtagagttttgggttttttgacgttaaaagattattttttaggtatttgtgtaggtttagtggaagggttagtggttttaattagtttgaattggataggagttgttttaagtttttggaaaaataattgaagtgattattgttatggtaatttatgaatgttattagtaaagtagttagtgaaggttaagttttagtatataatgggataatttttagttttatggaaaaaggaaaaaaaaaaaatatatatatatacgaaaagtaagtgattaaaagtaagtaggataggtagatttgatttaattaatttttgggttttaattttgttaaatgtagtttaatatttgttttgataatttgtttatttggttttatataaaataaagttttttttgatgaaatttaattgagtttgaagttgtattaaatggtatcggaaattttttagtaggaaggttacgtaaaagtggtcgggcgtggtgatttacgtttgtaattttagtattttgggaggttgaggtaggtagattataaggttaagaaatcgagattattttggttaatatggcgaaattttatttttattaaaaaaaaaaatataaaaatttgttaggtgtggtggtgtttatttgtagttttagttatttaggaggttgaggtaggagaatttgttgaatttgggaggcggaggttgtagtgagttaagatggtgttattgtattttagtttgtgtgatagagtaagatttcgttttaaaaaaaaaaaaaagtgatgtgttgtgtgtaaaatacgtaataattatttttttatttttttgtttttttagtttatatattggatggtattaatttttgcggatattttgtttattcgtttaacgatcgtatagtttcgaggtttggtttttatcgttatgttgtagattagtttgagtttaaggtatttatgaaatattataggaaaattattgatagtaatggtttttcgggtttagaaattttggaaagattttgtttagaagaatttatcgtgtgtattgagtgtagttttttttatattcgaaagtttttattggtttttatagtttttttattttttgtttttattattttttttttttttatattttattattcgaagaaaggtagaagaagttataaatagttttgaatatttttttatttatttattttgaaataattatgtagatatattagttgttaattatttgtatttttaagtgttgtgaaattgtaaattttatatatttgatttttagaaaatatttttgtggtttatgatagaggttttgaaatgggtataggtgatcgtaaaatattgaataatgcgaatagtgtttgaatttgttttttttttgggtgattaaaaaattgataggtattataatttttgtaatatattaataaaagtatgaaaaataggaattatattaatgtaatatttgtgtagaaatttgaatgataagattaggaatatttttttttgtatttatttttaaatttaatgtttttttggaagtagtaattgtaagagttcgaatagaaagttatgtattaagtaattattttttagttgttataataatgtttagtggttttttttttgttaaatttagttttttatggaaaagaagatggtagatataggagagacgatagagggttttaggttggaatgtttttttcgaaagtaatgtttttattaaatattagtattaatttatgtatttggttaatgatatatttggagagtaaattatggaaatgtgtattttatatgatttttgaggttttgtttaaattttgtgtttttgagggatttgttttattggtattttgttgagggttttgtatataggaaatttttgataagtatttgcggaaaaataaatatgaattttgtgatattgggttttttaggaagtataaagtaattgtgaaatatagtatatcgtagtggttttaggtggaggaaaggaggaaaaagtgtttattatgtgtaatattatgattaatttgattatatattatttttgagtagattttggaatgaatgatatgatttttttttagagaataaggatgaaataattatttattttatgaatagtgatattattttttattttttagttgtattgtaatttttttgagttgatagttttataaatttttaataggtttaaaagtaatttggtttgaataatattggatttgtttttgtgatttttgaggtttattttatgtttttgttgttatttttgtggaagtagttttgaattagttttattttgaatttttacgttgaaatatgttagtgatatttagaaagggttaattaggttttattttttaatgttttttaaataagttttgttgatttttagatagggaagtttttttattatattggagttgttttatagataagttaatattgtattaggtaagataaattaatgttataataggtattgttaattttattgatatagggttatagtgtataataatatattgtattatataatatattatttttagaggtatgatttttttatgaaagataagtttttggtaatatttattttaaagtggatttattaaaattggatgttagagaattaagtttattttatgtatatatttttttgattataagagtaatatatgtttattgtaaaaatttttaaaatatagaaattatatgtaaagaaaaaataaaaattatttataattttagaatttagaaatagttattattaatattttttacgtattttattttatatagattatattgtatatagttagtatttttattaatttttattatgaaatttttttttgttattattagtttttaaaagtatgatttttaatagttgttgagtattttattataggaatgtattataatttaatcgttttcgtttgttagattagttttttattaatgttgatgaatgttgtttaaaaataattttgttgttatatttattttaatttttttgattgtaaagagaagtaattttgttttttgataaagtattatattaataataaatttgtttgtaattttttgtttttttttataattatatgagtggttgttagttaatttttttgtaattaaaaaaatttgagttgattaagttatttaagatgtgatgggagtagtggagaaatgggtgtgattgtaagaggtttgatttacgcggttggaagatggtaggggtgggagggcgatttaggttaggttatgtgtggagtagagagaattttagagatgagatagcgaaa

SEQ ID NO: 189 - DNA, 51912 bp, Artificial Sequence
  Chemically-Treated DNA
tttcgttgttttatttttgaaattttttttgttttatatatggtttagtttgggtcgtttttttatttttattattttttagtcgcgtgggttaggttttttgtagttatatttatttttttattgtttttattatattttaggtggtttagttaatttaagtttttttaattataaaaaaattagttagtaattatttatatgattatgaaagaaggtaaaaagttgtaggtagatttattattaatataatattttattaaggagtaaaattatttttttttatagttaaggaaattaaagtaaatgtagtaataaaattatttttaaataatatttattaatattaataagaaattagtttaataaacgggaacggttaagttgtgatatatttttgtggtggaatatttaataattattaaaaattatgtttttgaagattaataatgataaaggaaagttttataataaaaattaataaagatattaattatatataatatgatttatgtaaaataaaatacgtaggaaatgttaatagtggttatttttgggttttgagattatagataatttttattttttttttgtatatagtttttgtgttttaaaaatttttataatgaatatatattatttttataattagaaaaatatatatataaaataaatttgattttttagtatttaattttaataagtttattttaaaatgaatattattaaaagtttattttttatgaaaaaattatatttttaaagatgatatattatatagtatagtatattattatatattatgattttgtgttagtgaggttggtaatgtttgttatgatattggtttattttgtttgatataatattgatttatttataaaatagttttagtgtaatagagagatttttttgtttgaaaattagtaagatttatttaaggggtattaaaggatgagatttaattagttttttttagatattattagtatgttttagcgtgaaagtttaaagtaaaattagtttaaagttatttttatagaagtagtagtaaaaatataaaatagattttagagattatagaaataaatttagtgttatttagattagattgtttttgaatttattaagaatttgtaaaattattaatttaaagaaattatagtatagttaaagaatagaaagtagtgttattgtttatagaatgagtgattattttatttttattttttagggaaaggttatgttatttattttaagatttgtttaaaaatggtgtataattagattaattataatgttgtatataataagtatttttttttttttttttttatttagagttattgcggtatattgtattttataattgttttatgttttttgaagagtttaatattataggatttatgtttgttttttcgtagatatttattaaaagttttttatgtgtaaggtttttaataagatgttagtgagatagattttttagggatatagggtttagataggattttaaaaattatataaaatatatatttttataatttgttttttaagtatgttattaattagatatataaattaatattagtatttgatagaagtattgttttcgaaaggaatattttagtttaggattttttgtcgttttttttgtatttgttatttttttttttataggaaattagatttgatagaggggaagttattaggtattattatggtagttgagaaatggttatttggtatataattttttattcgaatttttgtaattattatttttagaaaaatattaaatttagaagtgggtgtagaagaaaatatttttaattttgttatttaaatttttgtataaatgttgtattggtgtggtttttattttttatgtttttgttagtgtgttatagaaattatagtgtttgttagttttttaattatttaaaaagagaataaatttaggtattattcgtattatttaatattttacgattatttatgtttattttaaaatttttgttataagttataaaaatgttttttagaagttaaatgtatgaaatttatagttttataatatttagaggtgtaaatggttaatagttgatgtgtttgtataattattttaaaatgaatgaatagaaaaatgtttagaattatttgtaattttttttgttttttttcgagtagtaaaatataagggagagagaaataatagaagtaaaaaatagaaaagttatgaaagttagtaaagattttcgggtgtgaaaaaaattgtatttagtatatacggtgaatttttttggataaaatttttttagagtttttgggttcgggaaattattgttgttaataatttttttgtaatgttttatggatgttttgggtttaaattgatttgtagtataacgatagaggttaaatttcggagttgtgcggtcgttaaacgaataagtaaagtattcgtaaagattgatattatttagtatgtgggttggaaaaataaaaggataggagagtagttattacgtattttgtatataatatattatttttttttttttttgagacggagttttgttttgttatataggttggagtgtaatggtattattttgatttattgtaattttcgttttttaggtttaatagatttttttgttttagttttttgagtagttgggattataggtgagtattattatatttggtaaatttttgtatttttttttttagtagagatgggatttcgttatgttggttaggatggtttcgattttttgattttgtgatttgtttgttttagttttttaaagtgttgggattataggcgtgagttattacgttcggttatttttacgtagtttttttgttgggaagttttcgatattatttaatataattttagatttaattagattttattagaaaaggttttattttatgtaaagttaaataggtaaattattaagataaatattgagttgtatttagtagggttgaaatttaggggttaattggattaggtttgtttgttttgtttgtttttggttatttgtttttcgtgtgtgtatgtgtttttttttttttttttttttatgaagttgaaggttgttttattgtatgttgaaatttaatttttattggttattttattgatgatatttataggttattatggtaatggttattttagttgtttttttaagaatttggggtagtttttgtttagtttaaattagttaagattattgatttttttattgggtttgtataagtgtttgagaggtggttttttgacgttagagggtttaaaattttgtttttagattatgttaatattattattttttgtgtatgtgtttaatttgttattttattttttttttttgttaattattttttattatgttttagattatttattttttaatttatatatatttttaagttttgtttttagagaggtaggattggaagttatttttttattttttcgtttggtttttttataaataaatttttttttttttgtaaaatttgtgttatagtgattgatttattatatagagagaataaatttggatttggttgttaaatgggtgttttatataatttaatttattatgatatatttgggttaaatttttttttttttttttttttttttgagatggagttttgttttgttatttaggttggagtgtaatggtgtaattttggtttattgtagtttttacgtttttagtttaagtgatttttttgttttagtttttcgagtagttgagattataggtgtgtattattatatttggataattttcgtatttttagtagagacggggttttattatgttggttaggttggttttgaatttttgattttagatgatttatttgttttagttttttaaagtgttgggattataggtatgagttattatgtttggtttttttttttttgaaatagtgttttgttttgttatttaggttagattgtagtgttgtgattatgatttattgtagttggattttttaagtttaagtaattttttcgtttttttttttaagtaattgaatttgtaggcgtatatgttatcgtgtttagttaatttttgtgatttttagtagagataaggttttattatgttgtttaggttggttttaaatttttaggtttaagtaatttttttgttttggttttttaaaatgttgggattataggtgtgagttattatgtttagtaaggttaaatttttatgtattgttttatgtatatgaaatagttaagattgttgtggagttatttaagatggaagataagaatttaggtttgtatagatttagagtaggggttagggatttttggttttttatttttagttatatttttttatttttggggaaatgttagatattttttggattgttttagtgaggtataaaatggatagttttttattttaagggtggtagtgtgtgttgatgttggagatttaattaagtgttatgttttttggtgatataatttttaggagatagtcgtagttagggttttttatttttgagagtttcgtttatgtaattttgtatataatatatttttagttggtcgtttttagtatgtagttcgttatcgattttattggatattatgtatatggggaggttttcgtatttgaattttagttagtttagtattttgcgtaatttttagggtattatcgttatttgattgggggagttgagttacgtgatgtcggttattttttgtatttttaggtaattattgtattttattggattttttttttttgagtttataaggatggtggtataatggtttaaagttaaaaagttaaaggtattttggattagtttttttttatttttagtgaaataaggaagaagaaaattgtttttttggtttagttagttttttattatttatggataatttttagagtcgaaaatgggtttagttagttagttaatgttaaattttaaaatttttttagttatttttttgtttttttgggagaaagggtaggtaggttttatttaattagtttgtaaggttatggatatttttttattttgagtatgtttaaattttttattgtatatatgttaagttagggtatgggtttttagaaggttgtggttagtattgtatgttatattttttgtatacggtttatttatcgttatttaaagtttgacgtgatggtcgagtttttgaaagtatagtcgggtatattttgtaaaggttagggtagtgtaggggtttttttaggcgttttgtttggttaggaggcgcggtagtttttggttcggggttataggttgttatagggttattattggggtgatgttgatacggataagttcgttggttatgtagcgatagtattgtaggatggtgtggtttatttgggattggttatttagagggagaattagggtttagtttagggagaagcgaaaatgtgtaacgtgtattttttggagtaaagcgatttggggttggatggtagtaaagttaatatagtaggattttttttttttggttataattttatttattttaataagttttttattgtggtggatattttataggtaaatatttaggtcggtaaattgagatagagtggtatttatttgtgaagggtagagtaaatattagcgttatttgggtagttttgaggaagtaatttaaagtaattattttagtaaaattagttaggaatatgagtaaaaatagaagtttttttagttgagaatgtgaattattttttataaattgttagtttttgaggaagataatattttattttttgatatgtatattcgttttatttatagttttaattttttaattgtttttttaatgtgatttttaaaagtttggatttggttattttagatgataaatgttaatgagttttgtatattatttgtcggtgttatgtaagtagagtatttttgggtgttttttttttaatgtaagaaattattaatgttatgaggtttttaaatttaaaaagaaaaaaaattagatgaaaaaaagaaaaaatttaaaatgtgagtgagttggttaggtgcggtggtttatgtttataattttagtattttgagaggtcgaggcgggagggttatttgaggttaggagttggagattagttggggtaatacgtttaaatttcgttttggttcggtatggtggtacgggtttgtagttttagttgttcgggaggttgaggtatgaggattatttaagtttgggaggttaaggttgtagtaagttatgattatattattgtatatcggttttagtgatagagtaagattttgttttaaaaaagaagatttaaaaaattgagtgagttaagtaagaaaatgaaaagatatttataattaaattgtgtttaaaattacgttttaaattgaggtttgttataggtagaggaagtgttaaataaatataatttttgttttttgttgggtttagggttagtgatagaatttaataaatttaatttgattgatggtagaaagttcgagagagaggttaggcgtagtggtttacgtttgtaatttcggtattttgcggggttaaggcgggtagattatgagattaggagtttgagattagtttgattaatatggtgaaattttatttttattaaaaatataaaaagtagttaggtgtggtggtgtatatttgtaattttagttatttaggaagttgaggcgggagaattatttgaattcgggaggtagaggttgtagtgagttaggattatggtattgtattttagtttgagtgatagagcgagattttattttaaaaaaaaaatagaaaaaaagaaaagaaagtttaaggagggagaatgtggaaggaaagaataatattgttatttatttatagtggaatttttaacgtagttaaaaaatttttttaaattatttttttgtaataatgatgatgattatagtttttaattatatgttataaaatttttttaaataaaaatttaaaaaaagtatttaggaaaagtgtgtaaattataaaattaaaattataaaattatttttttatgtgtttgttgtggagggaatgtaaagtgaaaaatttagttggaagatttgtattttaagtttgtgtttttttttgaaataattttgttagaataggttttttggtttgatgttttgtataaaagtaggggttagaaattatagtagaggttttgttgtattttacgggtttgttgtaaatgtattgttatttttttggagagataagtgtgtttataaagaaaagttattaaaaatagtatgttaaagggaaattgttttttttggagaattgttttttgtagaatatttatatatgtattttttttaatgttgtgggaatgttgttagagtatttttttattgtgatgtattttataaattatgtttttttagttttgaaggatagaatatttgtacgtttttttgaagcgtttagagtttgaaggaattttttggattatttttatagagttttgagttgattaaatttataatttttttttttaatcgtgattgttttaaaataatagtttttatttagtttatttgaaaataaatatgaaagattagggtattatttttggaggaaaaaaaaagttttttgaaaatataggataggtcgggtatggtggtttacgtttgtaattttagtattttgggaggtcgaggtgggtggatttcgaggttaggagattgagattattttggttaatatagtgaaattcggtttttattaaaaatataaaaaattagtcgggtgcggtggcgggtatttgtagttttagttatttaggaggttgaggtaggagaatggcgtgattttaggaggcggagtttgtagtgagtcgagattacgttattgtattttagtttgggcgatagagtaagattttgttaaaaaaaaagaaaaaaaaaaaaagaaaatataggatttttggggtaaaattttatttaatttttattaatttgttaattaagattttattaaaaaaataaaatagtgaagttggattttttagaaggaacggttattaaaatatgtatttagtatgttatgggagaaatttttttttaatagggattaatgttaaagaggttttatgtttttattatatagtgagtttaatatttatattaattatgagtattcgtggttatgggaaaataaattttttagtcgagaaagtgggtttaagtaaagtgataatttatgtgaatgagtttaaagttaggttgtgtgttttttaggatattattttttaagttgtttaggtgaaatgtatgttttaaatattgaaagtttgaaatattagttaggagggaaaagatgaagtttagtggtttaaaaattattttttaggattttaatataatgttttaaagttgtagagtattgtttgtaagtgaaaatatatatattttagaattgatatataaagaatttattttgattacgttaggttagttagggagttagtttgagaagggtattgttaatataatataaagtttgaggtgaaaattagaagaagaaaatagtaattgtagtttttttttattagggagtttttagagaagtttttatttgttgtgggtttgagagtgatttaattttgtgtttgttgggttttgtataggaggagattgttaggaggaggggtggggtttttaagttgatgaggaaaaaaggatcgtgtgatttgagagagagatttttggggttaattagtggttgattttaggttagattttaaaataatagtttttagagtgtagtaggaaaaggaattattttttattttttttgttatttattgttatatttattgtttttgattagcgttttttttttttttttaaggaaataggatgtatttttaagatttttttattatttattaatttttaaagttagcgtatagttttttgatgaggaatagaataggagaagtagggtttttttcgatatttttatttttgttttgtattcgtttttatgatttgtatagtaatgttggttgggagattgtgtcgtatataaaggattgaatttgttagatttaggttgttattagagattcgtgtttagtagggagtaggtagaaggttaagagatagaataaggattagggattattcgatttatttttaattttagtaaagaggaggaggaaggaaggttacggaggtttttttttttttttttttttttttttttttattagttttattttttttattttagattttttttgaattttatagtggaatttattttgaggagggaaattaggataaggagattttaaatagtaggaggttgggagagaaggagagagtcggggtagggtagaaaattgtatatcgagtaggagggagtttagaagttttttttttgggtttatatattttggtataaaagatgatatatttagttatttttttttttaagagacggatttttgttttgttatttaggttggagtgtagtggcgtaatttcggtttattgtaagtttcgttttttgggtttatgttatttttttgttttagtttttagagtagttgggattataggtgttcgttattatattcggataatttttttttttttttttgtatttttagtagagacggggttttatcgtgttatttaggatggttttgattttttgattttatgattcgttcgtttcggttttttaaagtgttgggattataggcgtgagttagttattttttaaatggaaggcgagggtttaagtttgagattgtttgtaaaatgaattgggtggtttgaaaaagaagaataattttaattagtaaaaaatgtattaaggatggtgttaatttatttttttataaataaaagattttaattggatatttataagaaaatagtaatttattttatatttttttaagtgtttttttttaagttgtgatttgtagaattaattaattggttattataatttaatatgttaaagttaattgtttgtttatggatattgaattttgtttttgttttgagggttatttttatatttgggattttattagtagtaattttttagtttcgtttttgttatttattattatgttcgttttattttattgtattatttgtgtatatattgttttcgtttagtagatttttttgtttttttgaaagtaaaggttatttttatttattttagtatattttttatttgtattttttttaattaagcgattcgagtaattaatataaggtttcggatatattagatatttaataagtgtttattagagtatttagttaaatgttggaaaataagtttttttaaaatttaggaagtttgaaagaatgttaagggtttattattgagaagatgtttaataaatattggttgattattttgaagaaatttcgtattattttaatgattattgttaaaaaagatattttgattagtgaattattggatttagggtttatttttttagggtatttttgtatatttgtggagtttatagttgtgtttttggaggattttgtttaatgtttttgttttagttttagtagtattattgaaatttagaggttttggagttttgtgttagattttgtttatgaaaaaatttaattgttttaaaaaggattaaaaattatagtatgaaaagagagtgttttatttttttattgttttaatcggattttaaatattgatatgttttaaatttatttatttttggatttaatttaaataagatgaagattggaagagttttggagagaagggtgtagtattttaaattgtgtttttagtgtatttataaggaattgtttttggtttaaagaacggataatgtgttatgataattagtttaggaaggaagtattatttattagtgatagggtttggtgagattgttgattggttttgttagttgatttatttgaatgtagttgttaataattttttaagtaaagttatagggaaatgttttttttaggggttgatttttaggtaaaggagggaagttatttttttttattagtttttggtagaataaggttgaagattttggtaataatattttgttttggtttagaaagttaatatagaagagtttacgtttgatgttgtaatttttgtgttattcgaaattatttatgagggattatgcggtatattcgatgatatttattttatttagtttgatggttgtaaagggaagaggggataagagtaatatgatttttcgttgggtatttgtattatggtttaagagtagttgagcgttttttatttaaataaataaagtgtaatgtttttcgtttggtaagttaatgatttttttttttgacgaaagattttaattaaatttatataattttataaataaatgtttttaaaattggtttatttaatatgttttttggatttttgagtattttgaaaaaatagttttttatttataatagatattttatagggttggaaagatgttttgtattattttttattttagatatttagttttgtgtttgatgtaataaataaataaatgaaggttttaaaagtatgatttatttatattattttttttagaaaatatggatatttttttttttttaaagtgttttatttaattaaaataataagaattgaaaaatatgtgtagagagttagatattttgggatttgttttatgtttaatttaatttaaaaatttagattaataattgaaagttaagtaattataaatattataatttagttttttatttataaatgggtttttaaaaattaatttaagttttttaagattttaaatgagaaaggtgttaaatgaatgtattttattattgttaaaatgaatgtttttattaggatttaaaaatataaatttatattatttatgttagataattttagagatttttttttagaagattttggtaggaaatgagaattttatttataattatattttttaaggtttttatgatgaattttttgaggtaatatatatatttggtattattttttttggtggtttttgagataaattagttattttttataataaatatttgaggatggttaaatttaaggttaatttaggaaagtagttgttttaggttgggagattttaattggcggaattttatgtgagggtttaaaagttgaaaatttaaggtgggtttaaagtaaagagtaaaaaagttagtagtttttttgatgaatttttttttagatttagtaaaattaggtagaatagatgaaaggttattttttatgttttcgggatagttattattaataaatacgggtttggtaaattaatttagtataaagtttagagatttttgatattttttgatgttgtggtcggttatttttcgaggattgatttagtgagagtttagggtaatggatatttgatttttttgagtgggacggaaagaagtattgtagagatgttagattttggtatgagtttatgaagagaaaaattatggtaaatttatttttagttgtgaggagaaatgtaatataatatttgaatttttaaattagattatatttgttttttattaagtttaatttaatgattaataatataaaaattagttagaattaatatattattttaaaggtaggttattttatagtgaggtgttacggggattagagttatttttattggtttttagtagttagtggaaaaatgtagattttttgggttgagtgtgtagttatttatattttgaaaagttaatgaaataaaagaatttgttataatagtttattatttaattgattttggattatgtattttttaatttacgggttttatgaaaagaattaatgttatatttgtgattatattaggaatttttaaataggattatattttttattttgagattgggagtttttaaaatgatttaggtcgttggagttaatttattgttttatagttatttttcgtagttaaaattttaataagtaattttttttttttttaagaagaattagtataataaattaaagaatttattttagtatttaattttggtttattttttagaattttgggatagttttggttttttatagatttagggtgttaggtttaagttaagagtaaaaaatagtaaaatatagttgtaaggaaattagttgtttattgttagtatgtagttaggagtttcgtatagtagtgaaaagggttttgtatttataaaattaattttatatttttataaatttttattgatttttaatattttatttttatttgttttttttttatttataaggaagagtgaaaattataggggtttttttttttttatttgaagtgagtttttttttttttttgaattttttgatttattttttttatttttttataaatataagtgttgtttattagtttttatttttttaatatattttttttgaaaattttatttaaattttttgtttgattttatatattttttaaaatgattatgttaatttttattttattttttgggtttgtagaaatttttttgtttattaagttaaatagtttttttaatatattttaaatatttttttcgtggtttattttagtataggtatttaagaatggttttattaatatttttatgggtttagttaaatattttaatgaaataagatagtttgtggttaatttttttttttagttttttggtgaatatatttattatgttttattttattaaatgtatttttttacgatttgaagtagttatttatatgttaagaaggaaatagagaattaaatgttgattaaaagaatagtggtatttgtttatgtggtttaagaaattagggttttaatcgtgttatatttttgttagttttatgatgttttttatttttttttattttttttattatatttttttaggttttttttttttattgaaaggaaattttatgatgttaatagttaaatagaggttgggtatgatggtttatgtttgtagttttagtattttgggaggtcgaaattttagtatattgggagaattttttgatattaggagtttataattagtttgcgtaaagagtgagattttatttttattaaaaaatttaaaatttaattagttatggtgttgtgtgtttgtagttttagttattaggaaggttgaggtaggaggattatttgagtttaggagatggaggtttcggtgagttatgtttatattattgatttttagtttaggtgatagagaaagatatgttttataaaataaaaataaataaataaataaatataatagttaaatataaaatttattgagtagtttaggttagtatttagtaattaattttttgagattaaaaattaggggatttttttaatttgatcgtatttgaggtttatgaatagttatgttttaaatttattaggtatttttttgtagaataagcgttgaatagggaatgaaagagtgaaagtaaataaagaatgtattaatttcggttagttttgtaggtagttgaagttatataatggaattttttataattatagattatttttttaattttgaggattttaataaggtttagaggaggaggtttagtaaggatatgataaatgatttgggttataaggaaagatatatatggtttttgatggtagataaagtttttgttttattatttttttttgttttgttttgttttaagattgggttttattttgttattttgattggagtgaagtgatgggattatggtttattgtagtttttattttttaggtttaagtaatcgttttattttaattttttaagtaattgggattataggtatttggttaattttttttttatttttagtagagattaaattttgttgtgttgttttggttggttttaaatttttgggtttaagcgatttttagttttttattttagttttttaaagtgttgagattataggtatgagttatcgtatttggttttcgttatttttgagttggttatattttttaatttgggtaggtaaatttaatttttttgtgttttataggattgttgtgaggattaaatgagataatttatgtaaaatttttaatgtagagtttgtaatagtaggatttttatgaatgcgtattttttttttttttagaggatgaataaattaaaaggaagaatattgtaggtggaggaaataatttttgttaaggaatttagtttatagtagcgatgtgatatattgataaaatttggggtttggagtagaagagatttaggtttagattttttatttttttaattatgatcggtgtgagttttatttattgttttgtataagtgggaatgatatttattgtttcgtagggatattgtgaggattaaatgatataatgtaagtgagagtgttttttaagtagttgattattttatagaggaatatatttgtagtattagaaagtattttagatattatttggattaattgtttattttatgttaaaattttgttgaaatttatttgattattttttatagtattttaatttggtggttattttaggtatggtatcgtttttaagaaatcgttgtaattttatggatttttatattgtgttgtatgttttttttttggatattaagagttttatatatatttttttaatattatttattgtagataatgaggggtatttttttttagaatgagttttttgtggagtttttttattttttttttggtatacggaggtttttattgtttgttaaattgagttgaattagttttattatttttttacgagttagtttattttttttgcggatggtatatttgatagattaaatattatgaggtagagtgtgggaaggtcgttatttaggatgttgtaataaataaggatgattaatagggagatggttatatatagttttgtaatgttttttaattatttttggtatgttaattttataggtttgttgttttaagattgggatttaataaagttattgataaggatttagtgaagttattaattgtatggttaagaatatttatttaaatattatttttaatagttaaatattgaaaataattgaaatgtttaatatttaaatatgtttattatgtatgaatgttttaatatatgatagtataattaaagaaatattattatttaggataatgtaaaagaatattaattaatatgtaaaaacgtttttaaaatattttgaatagaaaaaggttataaaatagtaagtagagtttagtagtattttgatttggagggatttataatttgttaaaatttgttttatagtaggattgtgggtggtataatttattttattttatttatttatatattttttttattttttattataaatatgtattgttttagagattaaaaaaataaaatttaaaaagggaaaatggttgatagtagttggatggtaggtttgtttgatggttattaaaagtttttgttttattttattttgtttatttgttttttaatttgttttatggtttttgtttgaaatttaagttttaggtatattgaattttatttgaagttttaagattatttagttttttatgttttggaggtgtagttttttaaggtatgttttgtttatttttagtttttttatttttatatttattttaaaatttagtttagatgtcgttatttttaggaagtattttttgatattttttttttttttagtatggattaaatgtttgttttatgtgtttttatgatggttttttatttaagattttaattatatattattgtatttatttaagtgtttggattgtaggtgttttgaaggtattgagttttttattttttagattttagtaaagtttttgtaatagagttagtatttaataaatagatttagaggaatgaaggttggtattaagaattagattaaagggtttaggatagaagtaatatttttttgggttgaagtaggaaaatttttttataagttattttggtttttattttgtttttaagattatgaaagatagaaaatttttaggtatatattattaaaaaataaattagaaggaattttatatggtaggtttttgagaataatattatattattttataatgtgttaatgatttattttggggtataagtttttttcgtatgtgatgttttttttgttttttttttattttttatttagattttgaaatatggagtttgaaaaaaatttagaagaaaaatggatttggaatttttttttattaattagttagtagttttaaattttggaagtcgaggaaaataattttggaagtcgaggaaaatattttgaattttatagaatatatagatattttttttttggttaaattataagttttttgttatttgtttatacgtattttttatagaatttaataaaaagttttatataaataagttgtttttaaatggtgggtggaaggaaataggtgatgagttttaggtttattttagttttttgttttgggttgtgttttaggtatggttgaggtaaatgaagtttatataatatatagtagtattgttgagttgaaaaggaagaaagtaatgatgaggattttgaagtaggttaacgtattggagagaagaaatttatataaaggaaggatttagaagtttgtatgagattttttaaggatttttggttgtttatgtataggataagattttgtgaggtttagtaaagagaagtagttataggtttgggagatgaatattaaaggttgggtaggtttggaaaatattgtattttagaatagttagagtagaaaaatgtagttgagtattttaggtatttagttgaaatttaggaaggttattatttgagaagtaagaataaagtaggaatagattagttttaataaagattaaagttatattaagtaaatttggtaatttaattttttggtagaattaaatataatattttttaaaaagagataatattgattaggttttttataatattttatttatagtatatagagtataataaaaatttattagatatgtgaaaaagtaggaaaatgaaatttttaattaaggggaaaaaaagaagtatttaatattaatagaagttaagatgttttagatattgggattagtagaggattttaaaatagttattataaatatttttaaggattttaaagaaaagatagatataatgaataaatggagaataataatagagaaataataattgaagaaaatatgaaaattttagaattgaaaagcgaaataaataaatttttgaatgggattaataatattaattttaaatggaataataataagaataaataatgtaatttttaaaatttataaagatattaaaaggtttttttaaaaagttaataaaataagaaaaatgaattattaaaaaatttgatttttttaaaagatgtagaaataaaaaataaaaaatatatggaataaaaagaaaataaatagtaggattgtaaatataaatttaaatatattaataaatatttaaatatatatggattaaatgttttaagtataagatagatgttatgaaagtagattttaggggttgggtgtagtggtttacgtttgtaattttagtattttgggaggttaaggtaggtggattacgaggttaggagtttaagattagtttgattaatatggtgaaatttcgtttttattaaaaatataggtgtttgtaattttagttattcgggaggttgagataggagaattgtttgaattcgggaagtagagattgtagtgagttaagattgtgttattgtattttagtttgggtaatagagtaagattttattttaaaaaaaaaaaaaagaaagtagattttagaaaagtaagttttaattatattttgtgtgtaagaaatatattataaatataaagtgattatgtaaaagaaaaagaatggaaagagatatattatgtaaatggatagtattaaaaatttggtatggttatattaataataaaatggaggttttgaatattattataatttatttagagttaatagatatatatattaatagaatatgttatttatttaaaaaaattagaatatatattttttttaagtgtatatgatatattttttaggatagattatatgttagattagaaaataagttttaataaattttaaattgttgagattataaaaagtattgttttttattataatgaaatgaaattagaaattaataataaaaggaaaattagaatatttataaatacgtggaaattgttgatatatttaaataagtaataagttaatgaagaaattataaggtagattagtaaaagtttaaatgtgtatataaaaaattaattgaatatgtaatatattaatatttataaattgtagtaaaagtaatgtttagaggaaattttatagttttaaatatttatattaaaaaaaaaaataagatatattttaataatttagttttttattttaagaaaataaaaaagaagagttaattaaatttatagttaatagaataaaggaattaataaaaattagaatggatatatataaaatatagagtagaaaaattatagaattaataaaattaaaagttggttttttgaaaaaaattaataaaatagattaatttttagtaagattgattagagaaaaaaagagaaaagaagtaaattaatgtaattataaaagaaagtggtaattgattttttttgtatattatttttataataaaaaggattataagagaatattatgaatatttggatgttagtaaattagataatagagatgatttggttaaattttcggaagtatatatattattaaaagtggttaaggaaaaaatataaaatttaatttaggtgtaaaagagattgaattagtaattaaaaatttttaaattaagaaaagtttaggattagtggttttaatagtgaattgtattaaatatttaaagaagaattaatacgattttttttaagttttttaaaaaatagaagaaagaatattttttaatttagttaatgtggttagtattattttgatattaaagttagataaagttattataagaaaataatagttatagattaatattttttatgaatatagatgtaaaagaatgtaattaaatattaataaaataaatttagtagtatattttaagaattatatagtataattaattagtatttattttaggaatgtaaagatgggtaaatattaaaaaaaatcgttgtaatgtattatattaatagagtaaagggggagaaaatttatatgattattttaattaacgtaggaaaagtattttataaaaatttgaaagttttttataataaaaatatttagaaaattacgattagaaaggaatttttttaatatgattaagaaaagtatttatgggtcgggcgtggtggtttatgtttgtaattttagtattttgggaggtcgaggcgggcggattatttgaggttaggagttcgagagtagtttgattaatatcgagaaatttcgtttttattaaaaatataaaattagtcggtgtggtggtaggtatttgtaattttagttattttggaggttgaggtaggagaatcgtttgaatttaggaggtagaggttgtgatgagtcgagattacgttattgtattttagtttaggtaataagagaaatttcgttttaaataaaaaaataaataaataaaaaattatgaaaatttatagttaatattatagtgaaaggttgagagttttatttttaatattaggattgaaaggaagatgtttgtttttattattgttttttaatattgtattagaagtttttgttagagtaattaggaaggaaaaaattatttaagttagaaaagaagtaaaattatttttatttatagataatatgattttatatatggaaaattttaaagaatttataaaaatttattgtaaaaaataaacgattttagtaaaattgtaaggtataagattaatatataatagttagttgtatttttgtataatagtaatgaatagtttaaaaagaaaattaagaaaataattttatttataataagttttaaaagaataaaatatatataggagtatatttaaatatttttattattgttattaaaattgtattggaggttttagttagtgtagtaaggtaaataaaaatataaaaggtatgttgattgaaaagggaaaaataaataaataaaaaaataaattttgttgtttattaaaaatatgattgtttgtgtagaaattttaagatttttaaaaaaatagaaaaattattaaaacgaataagttaatttagtaagttggtagaatataatgttaatataaaaattagttgtatttggttaggaatattggtttatatttatagttttagttatttgggaggttgaggtgagaggttttttttagtttaggagtttaagtttgtagtgagtgttgattacgttattgtattttagtttgggtgataaagtaagtttttgttttaaaaaaaaaaaaaaaaaaaaaaaaaaaagaaaattaattgtatttatatatgaatagaaaataaatagaaaataaattttaaatataatgttatttatagtggtattaaaatcgtaaaatatttagaaaataatttaataaaagatgtgtaagtttgttataattataatatattgttaatagaaattaaagaatatgtaaataaagaatgagatattatttttatggattggaagagttaatattgttattagatttttttagattgatttattgaattaatattattttatttagaattttaataaattttttgtagaaatgaataagttgattttaaaatatatataataagaatataaaatagttaaaataattagaaaaaggaaaaatatagttgaaatatttatattatttgattttaagatttattataaagttataattatttaatatagggtgatattggtataaggatagataaatatattaaaggagtagaatagaaaattttaaaataaatttatagttaattgatttttaacgaatgtattaaagtaattatgtggtaataggaaagacgttttaataaatgatttttgataattggaaaagtgtatgaaaaaattaaattttaattttgtataaaaatttgagatagattatagatttaaagttaaaagttaaaattataaaatttatagaataaaatgtaagagaatagtttttttattttggagtaggaaaatattttttagaatatagaaagtattatataaatatatatatattaaaatatttttttttagtatgtgatttgtttttatatttcgttaatatttgatgagtaggttttaattttgacgtcgtttaatttattagtttttgtttatgattagtatataattgataaaataattatattcgaaataaatacgtaagtttatttattagtagtaaaagaaaaataatttttttttttattatgagtaaaatatttgaatagatattttataagagaatttttattaatgtttagtaaatatatagaaatgtttttaatattaatattattaggaaaatgtaaattaaaattttaacgagtatttatatttattaagatgtttataattaaaaatattggtaataggttgggtatagtgatttacgtttataattttagtaatttgggaggttgaggcgggcgaattatttgaagttaggagttcgagattaatttgggtaatatggtgaaattttatttttattaaaaatataaaaattagttgggtgtggtggtacgtttttgtagttttagttgtttgggatgttgaggtatgaaaattttttgaatttgggaggtagaggttgtagtgagtcgagattatattattgtatgtttgggtaatatagtgagatgttgttttaaaaaaaaaaaaagattattaataaattttggtaaggacgtaaaataacggaaattttatatattgatggtgggagtataaatagtattattattttggaaaattatttgatagttttttataaaattaaagatagattttttttataatttagtaagtttatatttaggtatttattaagagaaatgataatataagttttttaaaagatttgtataatattaagataaaatttataaattgatatgtttaaagatgttggtcgggtatagtggtttaagattgtaattttagtattttgggaggtcgaggtgggtggattatttgaggttaggatttcgagattagtttgattaatatggtgaaatttcgtttttattgaaaatacgaaatttagttaggtgtggtggtatatgtttgtaattttaggtattcgggaggttgaggtaggagaatcgtttggatttacgtggtagaagttgtagtgagttgagatcgttgttattgtattttagtttggggaataagagcgaaattttattataattaaaaaaaaatgtttatagtagtttaaatcgtaatagtagaaaattgaaaataatataaatgtttatttataggagaatgtataaatagtgtggtttgtttatataatggaatattatttattaatgtaaagagtgaattatttttttaggtagtaatatggattaatgttaaaaagattgtgtagattgaaagaatttagatatagagtatatttatagagttgtttgattttatttatataaagttttaaaattagtttgtggtgatgggaattataatagcggttttttacggaggtgagaattgattagaagttataaagaaattttttggggtaatgagaatattttatatttttatttggatatttgttatagatatttatatatatataggtgtatgtagttattaaaatttattaaattgtttataaaatatgtgtattaattttaaagatttatagattaataaatatataatagattaatattttagttattggtaaagttatttaggtatagaaatataattatttataatttatgtggtaagagaatattgatttttttcgaaatataaatttatttttgaaattattatagtaatttgttagttaaaaaaatatatatatttagtttttaattgtagggattatatttatttaataaatattatattaggtatttttttaggggatttaaaatatgattttgtttttatggagtttatatttttgggaagaagagagataataaatgaaaataaagtagagaaaggatagaaggtaatagggattgggatgggaaggtagtttagataggtaagttttttttaaggaagtattgtttgaggatttgtaatagaaaaagtgaagaatgttaaaaaagattgggatttgagatgggggtgtgtggaaggagtagagaattcggaggattgggtagaggcggtagagggtacgggaagggtattttaggtagagttgagtaagtgatgagagtatagatttagttaggtttttttaattttgtttttttattagttgtgggattttgggtaaattatttgaagtttgtgtttttatttttttatttgtaaagtagggatagtaatagtattttatggttatatttttgtgaggattaattaagttaatatatggaaagtatttagaattgtaaatgttatggaagtgttttttatttaagtgttgtagtaatgtttgattggtaagtttaaagatatttatagtattaggttggtgttaaagtaattgtagtttttgttatttaaaaagtaatggtaaaaattgtaattattttggtattaatttaatagttttaattataatagtaaaaaaattgaaaataatataaatgtttatttataggagaatgtatgaatagtgtggtttgttaatataatggaatattattttttgtttttttgtgatttttaattaatttttaatataggagattattgttgtgatttttagtatatagagtgattgtgggattttatgtaaatggaattaaataattatgtaaatgtatttattgtgtttgggtaatgattgataagtttttaaaaattagtggttattacgtggaaaataggatttaggaggataaaatgggagtaaggatattagttagataattattgtaatggtttaggtaaaagattatgatggtttggattaaaaaagatagtaataagtggttagatttaggttattattgaaggtagaatttgtagaatttgttgatgaattggatgttatatgttgtatgtgaggaggggaagaggaattaaggaatttaaagaaaataaaaaataaggagttggggaagggaagggattaagttttatttaggttataagtttagtttttaatgaagatgtttggtatttagttgagtatatgaagttgaagttggagagatatggatggtattattaattatttaaatatgttttaggggtaatattgaatggatcgttttttgttatttattatttattagattttttaaaaattgaaatggaataatttttaaaggattaatttaattttataaataattttaattaaatggattgagattaatggtggaagaaatgaaatgtagtttataagtagaaaataatttaaatagtttatttatgttttttttttatttaagaaaagggttttttagatgttattttagttttgaattaaaggtgatcgtttttaaaaaggttaaaggattgaaaaaattttagaaggtattagagatttattttttttttttttttggtattttattattttaattttaagaagagtattgggattatattgtttgaggatttttttaaaagttattgttattgtgtggtgtttatataagtatgttaattagtttgatgtttgtgttcgtagattaaattattttttttatttttattagtattatggtttataagttgtagttttttaagatagaattttaaatagttttttataaaataattatttaatagaatatataaataattttttaaaaataattatttataattttatttataaaaaatagttagtagtttttgtgtgtagttttttaaaagttgtttaggatttaattaatgtaagggggtttatatttgttttttttgatatttagttagacgaatatgtgtgaataggtagtagtttggtatttttatttgttttggattttttagtaaattaaataagttgtatttttagttttgagtattaagttttatagttttttataaagtaataggaagattagtagaatcgtatataaatgtaaatagtattattttttagtttagttgttttgttatagttaggttagttttttattattttttatttagggttgtatttacgttggatgttaatttattagttttgaagttgtattttattttttttttatatttatatttttttttgttttttgttttggatttgttttttttaagaagtagtttttaatgaattttatttatttttagtattattttttttaattattaattgaaaatttttattttttttaaatttggtttaatttttattttttttgtgaagttttgtttggttttttacgtgtatttaggtattttttttttaatgtattttatttataagtaggagtaaataatatgtttttttatagttttttttaagttggtggttttttattaagattgtattatatttttttataataataaagttgaatggaaataatttgaatatttaataatgtggaattatttatttatttatttttttatttaaatatttattaagtaattattatgggttatttataatttttaaattagttgaaataatttaaagggttaataatagggattagttaaaataatttaggaataagatattaaatgaaataaattattagtaataaatgattagtgttgataaataaattataatttattaattttatgagtaataaatgattattatggataaatatagtttattaaattataaattatagttagttatagatagattacgtatagtattatttaattttggaattatatgtatagatgtaaaataaatatatataagataggattttaaaggatttgtatagagatagtagttatagtttttattgagtaggatagtgggtatttattatgtttttttgtttttttgattttttgatttttatgtaacgaaatatgtattgttttttgaataagaaaatataaattttttaaaattggaatttttaattttggaaaattttttagtttaaattatttattatattgtttttttaagttgatgatgtttgttttgtttgtttagttgtttttatttttttttttataggatggatggtatagattgttttaattaatttaattatttattttttaatgattatttattgattttttaattttttattgttatattttttagttattttgatttttgaaaaaatttgttagaaatgttttaaaaatttttggtatattaaaattattaatattgggaagtttagtaattgggatttattttttattaaatggtttagttgattaaattattttttattaaaatgtttttgattatgttgtattttattaaattatttggaatttttttaaaaaaattgtaagatttaaataattaagttaaataattggattattttttttagtttgtgttatttttggggtagatgggttaggggaaaagagtttttaaaatatttttttatagtggattttggttggtgtttagggagggtaatggagtgtttaagtatggaaattatgattaaaggaatagatataagaatttatttaacgtgttgtgaaaatgatgatattaatttaattaggttataggattaatagtttgtggtttttagaaaataagattataatagatagtatggggttagaatatgaaaagttttgaatgtaaagttatttggatttgatagaataggttataatagattagtataaatttttgagatagtgatgattagttatatgtttaaaattatttattgtagaatgtattagaatgtgaatagttggatgtggaaaattggtaggatattgttaaaatgtagatataattaaggttttggataaaggtgatgattattgaaaagtaaaataatagggtaatttgagagatgtttggaagtgtagaataaaaagagtatggtgtattagttatatattgtttatatgtttatgaagaaatattattcgtgagttgggttgggttttattgaatatgttttttgttttggttttatttggttaatttaggatggtgttggttgggataaatgggataggttgtttttgttttatatgttttattttttagtgtattagtttgggtatttttttatggtaattgtagagaagtaagagattaagtagatattaataagtatttttttagtgtttgttagtattatgattgttggttaaagtaagttatatggataaagttagagttaaaggagaagaaggttagagttaaaggataagttgaatggatatttagagtagaggatattgtaaagttatatgataaaaggtatggatataatgaagagaggataatattggggtttttaatttaattagtttatattatattgtaatttattagatttaggtattaaaaaataaagtattaaagttgatagtttatgtatagtatatagttagattaaaaaataagttagtttggaaaggtgaagatattttttgttttttggttggatttataggtttaaaaatttttgttgttttttttaaaagtgacggttttgtagatggtataatttttatgttaagatatttatttagttatttatttaataaatattatttaatatttattatatgttggatatataagtgttaagaatatagaaatgagtaaaattttaagtttagatgtatgttattatttattatatattaatattgatagaaaaattgatttttaatgttttttaagatataatttaaaagaagatatatgatttttatattaagatttttttataagtttttaaatattagtatatttagtattatagtattttgtttttaaatttttgttaaatttttaaggtaaagtttattgttgtatatgattgttaaaattttttattttattttaagaattaagtttgagattagattttttttagaaattatatgaaattatgacgtatgttatttttgagaaatagataataagattaataataggtttattttattttgttttattgtggtaaaatatatataatttaaaatttatttttttaatttttaagtgtatagtttgataattgttttagtaagtatttattatgaattattatattgggttttagagatagtaaatataaataaggtaaaatatttgttgttatgaaatttttattattatttattgattttataggaaatttataaaaataaaagaatattgttttttttttttgtattttaagttgaatgatttaagttaggttaatgagatattttttttgagattgttttgttggaatagagatatgtgattgttttatattaggagaggaagtgaatttggagttgttgatatgggaagagattttttgggatgataaaagttaaattgatttaagtataagtgtatgtgtgtatgtttgtgtgtatttttgtgtgtgtggtgtggtgtgtgtgtggtgtgtgtgtatgtgtgtggtatgtatgtggtatgtgtatgtgtgtgtggtgtgtgtgtatgtgtttagtgagggagaaggagaatttattttgatagtaatggttattttagtgataaatatagttgttaatatttaaagtttttggagtttttttttaattttttgtttttgtcgtaaagtttttttttttttttaagtttgttttagttagggttggttaaatgtaaatatagagttttttaatataaatataattaaatttgagattttataagaattcgtttagttaaaagtatattgtaataattaggtaagataaaggttagggtagtttttgaaaattatgttgtaattttggagttttgttatttaagattgttttatttggatttttttaaagtaggtgataataaagggtttatttatttgtatttaaataaaaattttttttaaatgaaataaaaaagattttataatttatattgggtaaatatattaataaattagagattgagttttttgttttattaatttatttgtatagaattaattaatattagttaaattattttatttaatattaaattatgttgcggtgaaaattattttaagttattgacgttaggttgttaataaaatatttagtttgtgattagaatttatttaatttattaattatagaattattattggagatatagaggggttttaatttttggtttttgtatttttgtttttttaatagtaataaaatgagaattatgagggaataggtagggaggtataggttagatgagaaaaaagagataagaagataaggaatttagataagtgatgttttttataaggttagtaaaagtattttatggtttattagttaaataggatttttttagtaaatatttattagtataattgttaataattttataatatttttatgaaagagttattttttaatattaataaaattgagataagtagttttttttttataatggttatttttattttttaaatattttatttttgtttttttatttaatttttttgttttaagttattaatagtagatgttaatagattttttttgagattttttttaataggtttatttatagttttttgtttttgaaataatttaatttattttgtagtagagaacgttttttatttaaagaaaaagtggtatgtgagtgtgtgaggatttttatattattgaataggatataattataggaaaatgaaatatgttttatggagtggtggatagcggaaagttatcggtttgtttttttttttttttttcgtatttgtttttttgtggtagtagtttcgatatggtgttaagttaaagttttttataatataaattttatttgtgaaattaatttatgagtagttttagtaattttgaaaattaaaatagaagagattaggaaatattatagtgtattgtttgtaataatggtaagttttttttgtgaaaattttgttttaatggtgtatatttaatatggaaaatgttttttttattatgggttaagattaaaaaagtttggaatttattggtttaagtggagggggatttttattttagaagtatttattgagtatttattgtgtgtttggtatgattttagtattttggggtataatagggaataaattaaagaaaaattcgtgtttttacggagattttattttagtaggaggagcgataattaataataaatataataaatgtaaattataaagaatgttttaaggtaataagtgttatgaagaaatagagtgaggtaaggaaggtttggggtgttacggagaggagatatattttatttatttttttttttggtggtatttataagagtttttattttttttttattaaatgtgttgtgatttttatttttttatttatatttttatagaataaaattcgtttgtgtttttattaggtaagaattttttttatcgttattagttttttataagttaaaaattatttttatagaatttaaaatgttttaatttatggtaagtagtaaattgaataaaggtgtattgttttttttatttttagagaatgaggataggagaatgggattaattaggtaggtttgtttgaggttttagtttagatggatattaataattttgttttatttttaagtttaggaaaattttttgtatagtttttttttgtgattataaataatttttaaagattatattttattatatagaaaaatttggtttttttgagttttagttagatttatttataaatgtttgataaggggtgttaattaatattttataagttttttggttttatagtgtatagtatattaaatttaaagaaatagtttttgtttggggattttataaggaattttagattgtttttttaaaagaaggtaatttgagggtgtgtgtttattttttttaaaaaaaaatgtttttatattagagggtttgtgtttgtttgtttttattttttttaaaaaaatgattttattggtttttttatttagaagttaaaaaaataagtttaataaatttattattatatagttttatttatagtatttgtaaatttggtgattttttgttttttcgaggtttttagaagtagttagtttttttcgttgttcgtaaagtgggttgttggaagtagagaagattagtttcgggggtttttaggagataggaagttattaaatgggggtggttagaggtgtgttttttttgagaaggagtttgtgattatagatttaaggaaagtgaagggttggttttgtggttatggcggtagggtaggttgggaagaattttttaggtagggagaagagtaaaaaaaaataatgttttaaggtataaatgtaagatttttagtgtggttggatggcgtggggtagcggggtaggagttagagttgagataaaatgtgttgaaatatttttgagagtgtttttagaatagggaattgtagcgttaattgttgtttgattttttgtgacgaaagggaaatttttaaaacggtaaggtttaaacgtgaaaggaaaagataaaaagttttttaattaaattgtaaatgatatggttttttatttttttatttttcgtattttttattgagtagtagtaaatataggaaatagttacgtataagttatattgtaattttttataaaggattttttggttttttttatttttcggaaatgagaattgtgaaggaagaaaaaagagagatttgaattgaaatgtatttttttaggattgttatttgagttattatgtaatgattattttattaagtaaatatttatttaatagataaattattatgttgggtatcgtgaggggttaaatataggtatatagaataattatagtataagtttgaaagtgaaaacgttagaagatggattttttttttaatgtaatggcgatttagaggaaggaaagatttttttttgttgagggaaattaaggaagtttttttgtaggaggtagtttttaaattttatattgaaagatgtagattttggagagacggaaaaaggtattttaggtagattattgtgagttggaaagttagtgatgttgtggtaaaatgtattttttatagaaaatagatgggtattttttatgttttatgattttttacgatataatttggttgttttttttattggcggatttgtggatttttttttttgaatttgtgggtatgtgattgttttgatagaaatgaagttatatgatattaagaataagtgaaaagaagaagaagaagaagaaaagaagtttatattatttttttttagtttttttgggatgtttgtcgggagggaagttagtttttatgtatagaggttattaatttgagattatttgtgtaagcgaggttaatagagatgttttggtttatagttaggtttaatcgcggattatatgtgtgagtcgttttgtatgttttatttcgtttaagttttagatgattgcggattagagaaaaattgcgtgggtgagtttttttttaattttgatttataagtttgtaaattaaataaaatggttatttaaagtaattaagtttgggggaattacgtagaaatagtaatgggaatagatgtatttgggttagtgtttttgtaatgatgtaatgatgatatttttagatgttaattaaggttaaagacgttagtggtaagttatgattaatatttttgtttattttagatgttgatgtggacgaggatggtttaggtatttgttagtatatttttagatgtaatttgtgtaatgcgggaggtagtttggagttatggaatgtatattgggaataggggtttagaaaatttgagttttgattttagttttgatttttggtatttataggaaagttagttaaattttttgggttttttaatgaatttatttgttttaaaatataaaaaaaaaggattttagaaattattaagtattatttagtggtatgggttttttaaattattttaaattaataaatgtatttatatagtttaaaattaaatagtattaaaggtttattatgaaaatagtaagtattttttttaatttcgtttttaatttttatttttgttttttattggtaattttttagtttttttttttcgtaataattattatatttttaaatattatgttattgtgaaatttaataatttattaggataatgaggagttagtttttttatatgttttattttttttttttatttttcgaaatgtttgtttttatttaaattattgttagtatttatatgaagatttttatataaatgtttattttagagttaaatagggtattataatattttttttttttaaatagtttttaatttttttttgaataaataatgattttattattaagcgtgtagaatattttatatgtgatttttttaatgtgttagtgattttttattatgttttttatgatcgtatttattttgttgagtttatttttttatttagagtttttttttttttgttagaagtttttagtttttaagtttagtttggattagatgttgttaagagttgttttcgttttgggagttttttttattttttatggattgaaattatattttttttatatattatttttttttatgtatttattataattttgttggtgtatattttttattagttttttaggaaatatgatattgaaggtgaatttttaatatttttatatgtttatatatttattgagttaggaatttagtcggttttttaaagttaaaagtttatgttttttagttttggggtattttattatattatttttttataaattttttgatttgtatttttttattttttttttttagaatttttattagtttgatgttggatttttatgaatattttttaaattttttttttttttaaaaatgtgttttatttttttattattttgtattatttttatagtattgttttgattttattttttaaatattttattaaatattttgttttaattattgtgttattgatgtttaagaattttttatatgttttgatggtttttgttttagtttgtgtatgtgtttaatttttgtataatttattttttttggtttgtttttttgtttattttattttgttttatgttgatagttttttttaaatgttttttattagtattgttattttttgtttttttgttgtatttgtttttttttaagtttgggtttttgattattgtaggagataagatttttgatgtcgggagtttgtatgttattttaaatttattatttttaagtgtggtttagtaaaataatttgtatttatgattatgtaatagttattagttattttgagagattatagaaaataaggcgtttgaagaatgaaaatttttttaattttaaaagggaagataatgtgaattttagaaataatagatttaagtaaaattaggtaatggttaataaaaatgtattagtattatggaagggaagataattaggagataatatggatttttagaataaatttattaaatttagtttagaaaatttttattgtattatatggtgttatgatttgaatgtttgtttttttaaaatttatgttgaaatttaattgttattgtaatagtattaagcgagatttttaagaggttttattttaggttaattaggtaatgaggtttttgtttttattaatgaattaatgttgttattatagaagtgggtttaatattttaggtatgggttttttgtaaaaggatgagtttagtttttttttgttttttttttgtttttttattttttattatgggagaaagtagtaagaagttttttattagatgttagagatttgtttttggattttttagttaatagaattgtgaggaaataaatttttttaaaaaaaaaaaaaatagggttaggcgcggtggtttacgtttgtaattttagtattttgggaggtcgaggtgagtggattataaggttaggagatcgagattatttcgattaatacggtgaaatttcgtttttattaaaaatataaaaaattagttaggtatggcggtaggtgtttgtagttttagttattcgggaggttgaggtaggagaatggcgtgaatttgggaggcggagtttggagtgagtcgagattgtgttattgtattttagtttgggtaatatagtaagatttcgttttaaaaaataaataaataaataaataaataatttagttttagttatttttatagttgtataaaatgaattaagatatatagtatatttgagaatataatagttatttttgtatgtaataattttgatagttgttaaatatttttgtgatatttttagggttaaaaagaaaagtagagtgtaaataagatagtattgttgttatttgaaaaaatatattttaagagtatttattggtttaataaaaatttattcgttgtttattaagtattaaatgttggttaatgtttgaaatattgatttatgggatagatcgatttgagagaaggtgattaataatattttataaggtttatttataattttatttttttgtaatttgttattattaaagggatgaaaatttataaaggtattaatttaaaattttgaaaattttttaaaatttgaatttaaaagagttttatagagtgtaatgttataaatatgtgttataattagtaaaattaatatttaaagtgatagaaaaaatatttatgtttttttaaaattaaaaatataagtaatatatgtttatggtttaaaatgttagaataatttataagaaaaattatagttttttgttttatattgttttataatttttttagttttttttagaggtaattatttttgatttttaagacgtttttttttggaatttatatttttatatatttatattttaggaagtatttattgattttttattatgttagataagggtttagtttttttatataggtaatttagttatataatagttttgggtttaatcgatatttggtattgatattattttgttaatatgaatattatttatagttggattttgtaatgtagtaagtaagattgtttttttttttatttttgttttttttgaagtttataattgtattgttttttgattggttttgttttttttgggattgtggttaattttttttttaatttttaatagttttttagtagaaatttttttagggaagttatatgagtttttaatattttggggggatatatttttggaattttttttattttgtattggttgattttagtttgttgtatatttgatattatgggtttatagtttattattttttttttgggttagatttgtttttttatagattttatgtttttttttttgttttttttatgttatgtggcggttattttttaataattttttgagaaagggtttatggaagatttattttttgggattttgatttttatgaatgattgatagtttagataagtattaaattttaggttggaaataatttttatttttttttttgaagggtattttttattagtttttgtgatggttaagaaatgtattgtttagtgtttttgttataaggagtatagttgattgaggttattagttgttatttttttgaatttgttattgtagttgattttaagattatgatttttatcggttatttttagatgattaaatatggtaggggaattaatgtaggtttattttagtaagatgtggatttcgttaatgggtaatattggtttaaggcgtttttattagtttatgtttgggttgttttgagatttatagtgttaattgaaattttttttagtttatttttttttttgtttatttttttttatagttgttggatatatattatgatttaaaggtttaatgttttttttagtttttttttttttattttttataattttttttttaataaattttttgtatatttaattttattttgatatttattttttttaggatttaaattaatataagaggggttggggaattagtttatttattttttggaaagtaaagagaatgttattttgagtgttgtgtaggggtagatagtttttttgtataaatggtgttttaattgttaaatattttaatagtagtaatttgggaaatattttggtggagaatgttattgtaggtgtaatgatttaggtattttttgtttataaggagatggaattgaatgttttttgatatattgtattgagattttatagagagttaatgagaaattgagggttaataataaatagttaaaggtttaatataagagttatagtttttttttttatagtggaagagtagagaaatttagtagtaggtttaggatttgatagatttgtagagatttagggatgtttaaatgtttagttaaggtagattagttatgttaaggttaaggtttcggttggggaaatttgggaatatttggagtttatagaggtggtttatttttttttagtaagagatagtatttttttatgttgaagaggtttcgtttttaaaaagtaataggtgtattttttaggagttgattcggtattaacgaggattaaattttagtataatttatttggagatagttgggtttgatagagaagaaaagatattatattttaatattgttttaagattgagtatgtattgtaaattttgaggagtagcgttggggtttttgattaaggaattggaatttaatataggataagaaataatttattatttagggaatatttttttcggaagtatgtttttacgatttagtaaggattttaggagacgcggtaaagttgttgttagggtggttttgagaagtttgtaaaaagggatgtttaatgttgagtaggcggaaatgtttgatattgttgttttaatagttgataaaagaattaagaagtagagagaagttggtatgtaagaattagtatattatgtgaggttaaataatttattagaggatagtgttttttagaagttttaagtagggagaaagagtatttattgtatttttaggaatatgtttatgggggtgttaattttattgagatatttagtgggggtatcgttttttaggttagggttgttggtagtagaggtgttatagagttgggtttgttgttatttacggggatggttagaagttgaaattatagaggttagatagtgagtggtgtttaattgttagaagttagggagttataaagatggtttatagagtatggttatataaaaagtgatgattttttgtatagtttttcgatttagttaattttttaagttataatttattgattgaagaggtgtttaggtttttaggagttaggattttgtaataatatagaggtatgatttttttattttattttttttatttaatatgaaaatgtatgttttttagttataggaaattttttggaattattttattgttttttttttttttacgttagttatttattgttgtgaaatagatcgtttttaatttggagaattgaattaataagaatttatttttttttttttgtttttgtgagttaatggggtttggttgggtaaatttagttttgagtatgtagttagggaagggatattgtaagggaaaaggtattggtagggagaatgaaggatagaggttagagagagtttagttttatttatgaattatatagtaatttttatatattttttatatatttatttatatagaagagatataatatgggttgttttttaataattatatattaatattttaataattaattagtattttattgtataagcgtattaatatttttttaacggattattttaatatatttagttgatgtttagttttaaagaataaattattattagcggtaaatttttttttatttttgtatattggagatgaaatttaataagattgaaagtttgaaaataaattattaaagagatgatagggatgtttggttttatagtaatttataagttggggggaaaaaatttgagaggttttagttgattgtaaattaatttgagttcgcggtaaggtgatagttaaaattgttaatgtaattttgggcggtatgaataaaatttagtgtttaataagaaatgtaatcgttgaagtttattttgaatatttggggtattgtttggttttgtatagtaaatgttaagagaggttttggaaatttttaggtttttttttttagttttttatttttttttatttgacgttttagttatttaaaagattttatgttgtggtgggaatggttatattgttttatttgtattgattttgtaagggatgttttttagaaaggtataatgttttttttattttgtgtgtttagtaagttaagtttagtagtagggtttattatttatttttgtaaataaagttttattgaaatatagttgtgtttatttattaatatattgtttatggttgtatttatgttgtaattatagaattgtgtaatagttgtaatagatattgtaggatttgtaaagtttaaaatttagttttttatagaaaaagattgttagtttttgattttataagtattgttttttttgattgttttcgtattatttttttaaaacgttaatttatttttttttttttgaaataggtttttaagtaagtatttattttttttaaggtatttatatattttattgtaattatttgataattattttttttttattaatttgtgatatgagggtaggaattttattttattttttttttttgatagtgtagaaatttggaaatggtagttttggttaggaaggagtaaaaaggttttttaggttaggagtttttttatagtttatgttagatagataggagaaaattgaatttttcgtgtagtttaagtagtatatttttggtgagtaatgtttacgttgagttgtgtttgattgtagataatttttgggagaatgtagttgagtcgggagtgagacgtttttattattgttttcgtatttgtgtagggttggtataaaggtttgatgggaataaggggatataggtttttatggaagaatttgggatatcgaagagaggaaaaggtagaggaaagaggattatatgatgagaaattaaagagaagagaggataggcggggaagagtagtatttttaagaggttttgatagggtaacgggtttgttttttatgtttttatttttttttgtagttttgtagtcgttttttggatttttacgaaaagagttttataaatatgttttttttgggagttagggttttggattttttatagggttcggtatagggagaattttaattattcgtttttagttttttgtatttattagtaggataatggtgatggatgatgagatagaggtaggttttatagataattttaaatttttttcgttggggagataggtcgatttttttttttttttttttttattttattttgaaacgttagaagatagagttatttgtttaaaggttatatttatatttttagaatttaatattgtatttgtttgttatagggtaagtttttaagaaatgtttttgattaaatgtttagttatttttatgtttttttggagtagatattagtatgaaggagaaaattttaggaagaataaaacgtattggtttttttaaatatgtgaaagatgtttttttaaatatgtgaaagatgttttgttaaaaagtgatttgttttattttttgagatttaggaaggtaaagagatagttacggaggagttttgtgtagtagtaggtttaatatgaaagagaaaattaagggggtaatttgagtggaattgagttttttttgttttaaagggttaagtaaaagttagttgattttaggagagttattgtaaggagttcgttttggagagaagtgtaatttgggattttttaaattttttttgattttaatattttaattattaaataaaatgtatttatagatatggaaataatatttgtttaattattatatttaaaattaatgtatattattgtttttagtttgagtattttattaagttataatgatatcggtttatggatgacgtgatatttgtattttaaataaaaaatgttaataaaaaaatttattgaaattggggttataaaagtttaattaatatttatttttggtttagttaatatataaagttatattagttataaattttagtatgtatttttttattattaagttggatttagaaagatatttgataatgtgttttatgtaaaaatacgttattttaaaaatgatttgatagtttttggttaaatgttattgaaataattttaaagaagaggtaaattaagtagttaagtgaggttattatgtttaatgtatttgtatgattttttttaaatagtttaagaggattattttttaagtattttgttattattattattattattaatgataaatttatagtttatttttgtagagttttttgtatttttttaaaatacgttgatatatataaggtgtttttaatttttataatatgtttgggagttaggtaatgtggtagagtttgttggttattttaaatgatttgtttttatttgattttaatttaatagaattatttattgagtattcggttttttaggggataattatttgtagattttttttgattatgtgattgagttttgtttaagggatagtgataggtgtagtttttaggttaggtatttgagaggttattttttttttttttttttttttttttgtttattggatgaaattgggatattatgtgttttggaaattaataaaggttatataacgtatttgtttaggaaaatttttattgtttttttttattttttaaaatttttttttagatattgtgtgagagtagattgtaagcgtaatattttatttataagaaagaatatggatacgttgaaattagaaatatgtattttatttttttatttatgtttttattaaaaattgtattttttttttttgtgttaagtattgagataagtattataaattttgaaataaatatgataggtagtttgtgtttttaagagagttataattgagtaaatgatttattttatttgtggttattgtagaatgaaaatatttgagttaagtttttgaagggtaagtaagagtttattttaagataaagaggggaaaaaggtattttttaggttatttttatatttagaatatattaaaatagagtatataaaagttatattttgtttatttgtttaaatatagattttaagtataattttgtatttttggagaaaatgtggatttgagataatttaataagttgtgtgtttttatttatttattattatttgtttttttagtaagtatgtattttattttttttttttatttaaaattttttttatgttttaaaaagataatatttattgaaagaaagataatttttgtataaattaattataataaaattttagtttagagtaatgatatttttgagaatataagataatttagaaggtttttatgtgtaaaagtcgtgattgttatatatttagttggtatagttaattgtttatttattttgtatttgagaaggtgtattgatattatttgaatgtatagtttatatttttttttttttttttaatttaaaataattggtattgttaaaatattgttatgattttgaaatgatttgattaattttttttttattttaaaatttttttttggatttgattgtaatttttaaaaaataatgtgtttaaaaaggagtgatttaagttgtttgggagatattttaattatttttgattaaatgtattattgaatttagtagtattttaaaatttatattaatttttaatttagttgattattttagttatgtataaaatatatttttttgagatggagtttcgtttttgttgtttaggatggagtgtaatggtgcgattttagtttattataatttttgttttttatgtttaaacgatttttttgttttagttttttaagtagttgggattataggtatttgttattacgtttggtgaattttttatatttttagtagagacggggttttattatgttggttaggttgtttttaaatttttgattttaggtgatttattcgttttagttttttaaagtgttgggattataggtgtgagttattgcgttcggttttaaatatattttaatgaaagaaaaatttgtaaagtattttttaaaagtgtatagtatatgtaatttgagtatatatatagtagataaatcgtttatattaattatttggggaataaaaatttaattagttaataaagttttttttaatatatatttttaaagttggttaggagattttattatttgtttttattttgaaaatttttttataatgttgtatggtgattatagatagtttttaattggatatttttataatggaattatatatttgatgatgaattttaaatttttattgtagatgttagagtttgttacgttatgtttatttatttttttttattagattaggatttggtagtttttgttttattggaaagtggttagaaagattgataaggagagaaaattttagtagtatgagtttataaaggtgaaattaggttattcggtaaattagaagttattttttgagtattaagggagggtaagatgttatttttagagatatagatgaagggaataggattattttagatagcgaaggggtaaaatggagataaatggttaaataaagggaagagcgcgggaggaggtatttgagtaaagcgaagttttgtgtaggatgttatagaaggaagagatggtatttaggtatggggtttaagggagcgtgttagttggttttagaagaataggtgggatttgaaaaagtaaggattttgttttgtttatatataatgttattttgtagagtatttattatggtatattgtagggggtaaggtagaaataagaattttagtagtgaggttgtttttattatttaggtaaggttggatggtgttttgtatttttatcgtagttatagataaggggagaagtggtttgattttggatatattttggaggtaggtagagttgtaggatttgttgatggattagaaataagatatgaaaaaggggagtagttaagattcggggtttaataattggaagagtaaaaagttattataatagagaaggggaagtaggggtttggtttgggatgtgttcgatgtgatatgtttattagatatttacgtggagaaggcggttgtttatgttagtttgatgttcggggaaatttgggtggagatttaaaatttttagttatcgggatgtagtagtatttaaagtaatggtttggagtgaatttagatagagttttgagttttttattatttataggtaaggtgaggaggaataagtaaaggagattaagagggaatcgttagggagttgagaggagaagtaagggagagttagggtttgaaatttaagttgaggaaggatttaagggataagaagtgatggttttaataaatattgtagatagatgggttgagatttgtatattgatgttaatgtttaataatgtttagattaatattttttagttttatttttttacgtgaaagaagttttttttataggttttttgtataaatgtttgtaagaattttaggcggtgaggggagttgaaggtgggaaatgggaatacgtgtatttttaatttgattttaatttttttagaatttatatatagaataaagatttagaggtattgttggggttgaattttttaattatagtttttagtgttgattttaggggatattaagaattttgttttaagagttgtgaaggttgagtagttggtttttaagttcgagagaaaaggtgtatttttttggattatatttaaatgagtaaagtagtttgagttttaagttttttgtaggagatttttttttttttgttttttttttttttttttttttttttttttttttttgtttttttttttttttttttttttttttttatatatatatatatatatatatattatttttgttaaggtttattttagtatgaggaatttataaagaatattaagatttttattttgagtagggtttttattatttgttttgttgtttgtttgttttgttttttgttttttaggttattaatgatttttgattttttaggaggggttaagttttttattattttaggggatttttttagtttatttgtaagttagtggaaatatagagggagtgagggaagggtgttagttagtttttattttttattaatattagatttcggaatataattggtttttatatttgtatagtagtaatatttaagttttagttaaaatgtttttttattaaaatttgtagaatgttttattttttttaggtaagtttaaatttttttattttcgttttttttaatttttatatatatatcgagaaaggttattgaaaatagaatgaaagtattttatataataaaattaatttaagatattttttttgataatgggaattcgtttttaaataagatataagaatgattaaatattaaattaaaagaaatgtgaaagtaaaattaatattttatattaattaatagtttgtttgtaatattagtaaatggagtatttatttgttattaatttttttaaatataaagtttattgtatttttaggaaggatggttagtgtttggtaaattttttgtgtaagtattgaaaaatataattgagaagttaattagagggttatgagtgggtaaaaagatttaaaatatgttgattatttaaaatattagagtattagagagtacgtaagtttttattttataataaaatgattttataagttattataataataattgattattttgtatatgtaagtttattttagggattttaaaaatagaatttgtaggatttaaatttaaagtaaagattttatgggtatgatttattagattttttagttgatttatttatttgtttttagtatgaattgataatttgtttatgttttttttaaaaagtgagattattttttttatagtttttttattattagttatatattggtggtttttagagttttttagatttataaaaggattgaaaaagtataagaattatcgttttaaaatatttttatgaaaagatatatataagtatgaaattataaaaattataatgtgtttttaaataaatttaatatttttttatggttagtagtagtaaataggttttgtggaattgatataaaatttaatttagttattattataatattattagtagtttagagtattaagttattttaataatttagtattgttttgtttatattatttatggttttaattaaaagtgtttagaaatggttttagtattgattttgtttagaatatgtggttgaattttaaatttaaaaataagttttttagtaggtttataagtgattagaattgggtattaaaagttgtatatttaaatatttttattaaaatgtttatatatgtatataaaatattttattgtgatataaaattttgtataaagtgtattaataattgatatgattataaatgaatttttaaaataatggtgtttaaatttgaatattaaggagaaaaaaggaggaagaaatatttgagataattttattatggtatagtaatattttttgttgttaaaattaataaaatattttgtataagggtgttataattaattttattaggttaataatgttataagtgaggaatttttttaattgtagagagtattgtggaaatatagatgtggtagaataatttatattattttgtagttgtttttgtgtttttatgattagttttgtttgagattgtataaagcggtttttatatttcggtgaataagattggtggatgtagttttttgttttgtcgtagaagggatttttaaatatagtttaaatttgatttttcgggagttgtgttttgatatttttataatagtgtgaatttgtgttataagtaagatagattttattggattaatattgaattcgtgatagttttagagagtaatgttatttgtgcggtttaagaataaacgtgttttttttatttattttgtttattttttttttgtagttatttttagtaaatttttttcgtttttatttttaggaatttttttatatttagagaaaggagtttttttttttattgcggaaatttattatcgttttttttttatagatggattttaaggggtatttattcgtgtgtttattaagggattttttttttaattttacgttttttaagggaagttagaattgtttagtttttttcggtgattatatatacgtgtttaagtgaagtttcgtttgggggagatttagtttttatatttttttttggtttttgtggaggttttttgttttttttgcgtggtttttcgtttggtttttcgtatttattaggaggaggttgtgcgttattaggtattcgagtcgcgggttgtttcggatgtcgggggttaggcgttcggtggcgtagtcgtgttaggttattacgtaggggttgtcgatggtgatttagtatttgatttgatcgtcgaagtggcggaagtagagtttcgcgtaatttttgaagtggtcggttagggcgcggttggtttagtcgtcgtaggcgttttgtaggcgttggggtaggttttagtggtatagggtgattacgggttgtacgtttagttttcgtagtcgttttagtaggcgtcggtagtagcgtagtttttcgcggttggggacgttcgcgttgttattggggagtattcgcgtttacgagatggagaagcggtagtgagtgatttcgagttcgcgtagcgttttcgtgtcgcggaagacgttgttgtagttgtcgttggttacgttttcggtggcgggttgtagcggcgacggggcgtttaacggtagattggcgtttcgggagtttttcgggggtgttagggggtggtgggtgaacgtattttagatggacgtatttttgtcgtgttgttgttagtcgttttcggtttggtaggcggcgttgtttacggtttagaggaagtcgtcggggaaggtgttttggaagaggttcgcggtttcgggggtaggaggtcgcgagaaacgggtttaggtttgcgcgtcgtcgttcggtttcgtacgtaggcggcggtcgtttaggtttagtagtattagtagtagcgatagcgacggcggcggcggtcgcgggcggcgcggcggggcgttggcgggtatgttgcgcgggagttaggtttcggggtttcgcgtcgcgtttttttatgttcgcgtttcgtcgcgttcgttcgtttatcgtcggcgcgtttattttcgtttttcggcgggtttcgttggtaataattatttgcgagtcgggattgttttcgttttggtattgggggcgggggtaggggcgtcgagggcgaggggtgttcgggaggggcgcggtagcgggtaaggtgcggtaggcgtcgttcgcggacgtcggagaaaggtatttgttttttttagttttcgggagtcgtgtaggacgtttcgtggacgtttaggtttattttttttgtttgtcgcgcgttttttgagagtagttttggagcggtttcgtcggggagaaaaggcgtcgattaatttttttcgatttgggggcgggattttgtcgggttttagcggagcgcgtcgttggggaagtatttgtttttattttttttttattcggaggtttaaagaagtttcggttggatattgttggagttaattagggattggtcgaaattttagagggattgttaggtgggatagtcgagggggaatttcgtcgtgcgttgaaagggatttttttttaggtgagatgttcgcggggagacgcgtttattcgcgtttttttttcgaggaagataaagtagatttatgggttgcgttgggattggggttttgtttttttttttattgttattttttaataattttaaattagtattttatttttgattagattttttagaatattttggtgaattttaaattatagtcgttgattgtttttttgaaaaattaaatattaagtttttaattttgagtaaattttatttatttttattattttttggtatttgtgttatttttcggttttgatttagtaggtaatttgtgtaaagttgtgcgtataggtttgttggagcgggaggtttttgggtcgtatatttgttatttgagttgtggagggaaaggggagggagaatttagtcggaatatttatttttattttttataatataatggagttatgacgttttttttgttgttaaagagtttttttgatagaagttgtagagttatagtgtttatttggatgtgggtagataggattgtggttaatcgaaatatagttggtggagattgagaaggtttaggttttatttttgtgatttggggtaggaaatttttgtaagtttaagtttttttttttataaaataaggatgttttgtttgttttgtcgttttagaggtttgtgaagtttagtgaaaaattgcgtaaaggtgatttaaagatagaaagtttagataagtgaaggattttgttaatatttttatttttttatttagtaagtcgtgttttagtttttttattcgtatacgtgtgttgaatgattaagatttttatagaggtgtatttatttttttttagtgatttattttttttgtattatttaatataaatttaaaggtaataatattttaaatgttgtagatgaaggtgtttttattaatttttttgaaatataagtataaatttattttagtattttatgaaatatttttaattttagttagtatatattattatgattagtaagattaagtttttagattgaaatagagttattgttattttgttaaatatagtatttatatttttttaataaatacgaaatagtaaattatgatattttagtaattttaaaaaattatagtatataattttattgttacgttgttttttagttaaatttaaaaagttacgtttatatggagtattatattttttttttagaagtgaagattggagtgtttgttgggttgtagtttgttaagttttaattagaaatgttttatgggttttatggaaaatcgtttaagttaagtatttatttattgatgtatggtttgtttgtttagggtagattttatttattgttatttttatttgattagtagtattttttaaattttaaagtagtgattaaaa

SEQ ID NO: 190 - DNA, 2914 bp, Artificial Sequence
  Chemically-Treated DNA
ggttgagggtcggagaaatagattaagagatattcgtcgcgagggtgcggcgatttaataagcggtttaggtattttcgattgttttaaagttttcgtttttttttttcgtttggagagggggtttcgaggcggtagttggggttttatttattgtttgttgattaggggagggggaaagtaatagtgtttataaagggtttagtggtaaggaatgaaatagggcgttgtgtggagtaagtttttgggtaggtttgggaaggagaaaatagggtcgtcggggcggtaggtgaagttttcggaggcggttgggttattggggttagagagcggggaggcggcggcggtatttgagttttaggatttcgcgtcgttggcggggtttgggggatcgggtaggtaggggacgtattgcggcggtaggaggcgttttcgggtatcgttttcgggtagtttttgattcgttaggcgtagtgtttcggttagagtttagatgtagttgtaggcgaagcgtagcgtttcgattttggtgagtttggtgtcgtcggggaacgagggtagtacgttgcgtagtgcgtttagggtcgcgtttaagttgtgtatgcggttgcgttcgcgatcgttggttttgacgcgtcggtttttgcgtagcgagtgtagtagcgtttcggagcggattcgcgttcggtcgcggcgtcgtcgttttttttgttcgtcgttttgtgtttttggaattttagacgttcgggagatattgggcgcgtttttgcgggtcggcgcgggcggtttcgaagcggaggttgtttgttggagtttggtatagtttttttcgtcggtgaggaagtcggataggttattgtcgttgttgttggcgtagtcgaggtcggagatgtaggttttaaggcgggttggtatcgttgcgttgtgtaggatcgacggatagatagaaaggcgtttagagcgttgtagttcggattgagggtagagtcgttagggcgtatttacgtttttaatagtttggggttgttattttgtgttagttgcgggtgcgagagtttggaagggtgtaggggcgtacggagaatttggtttggttttttcgtttcgtttgtaggggttacgcgttcggtcggttttttgagtgatgtcgtcggcgattagattagttcgtgtgagtatcgagtgtggtatacgattggttttaggattttttaagtattcggcgtaataatgggcgttttttttttttgttattttcgttttcgcggtagttcgggtgaatggagcgaggcggtaggttattttcgtgtagcgttcgggtatttgtataatttatgttcgcgggaggtcgttatcgttttttttttaattcggagtgtgttcgtaattatcgtcggttaatcggcggcgtcgcgcggtttcgggagtcggttcgggttaagttggttagggcgtttttaggtagtgaaatagaggcggggtcggcgggcgattagcggtcgaggtacgttttttttggggcgggttgggcgtttttcgttggggtgggacggggaggcggggcgcgagcgcgaaagtgtgagtcgtttagtgagttgcggaaatttggagggtatttggagtttgggttcgtattttttttttagttgtttagtggtcgcgtgattttggacgagtaatttaatttttttgagtattgttttttttatttgtaagatgagataaaagtttattttgtggaggatgattagatataatgtttgtggaatattaaatgtgtagtattcgttgaatagggtgaaaattatttttaaatagattggagagtggttatgttagaggtatagggcgtagggtaaggataagtgtcgttgtttcgtttaggttgatgaagaaacgggaaagaatttgatttttatttggggagtgcgaagaggagagtggaaaagaggatcgggtgattttttaggttgttttgagttttggttttattttttttttttttttttttttttttttattttttttcgtatttttgtttataagttattttaagatttttaataagaattaataatatgagaatttatataaataataatatgagaatataattattaatatgagaatttttttttttttggcgtttttgaaattttgtttgttttatgttcggagaaattcgttgtatatcgttttttggagttttgtttgtagtttttgtggttttttttagggtgagttagttaggggatttagtttttttggttcgagagagagttggtttttggagggtagtaggtgatagtggaattttttttttttaaattttttttcgttttcggtgttttaaattcgtttattttagtaggttttttttttgtatgttaggagttattttttttttgttatttatatttatttaggagttataggggtttagatattatttaattttgtatttggaggataaatagtaaggaatagtattcgattataggatgagggtattaaaaataaaatgagtagtttttagtaaagtgtttgttttttatttgatatttaagtggtagttttaggtcggatgtttggtttgttgttatgggagtttagttgattttttgggttggggggggattggtttttttgagaaagggggttgtgtagtggtagtttttatttcgatttattgattagcgtttgttttttggtttaggggattttgtttagttgttttttttttcgattgtattttgtaggtatttttgattttagtggaaggttaggatatagttatatataagggttcgagatttattagaagttatagaaagtggtttcgattagtttatttaggaaagggtagttgttggatggatacgggggttttttaagaatttaagggtttcgaggat

SEQ ID NO: 191 - DNA, 2914 bp, Artificial Sequence
  Chemically-Treated DNA
gttttcgaagtttttgagtttttgagaagttttcgtatttatttaataattgtttttttttgagtgagttggtcgaagttattttttgtgatttttaataaatttcgagtttttatatatgattgtgttttagttttttattgagattaggggtatttgtagggtgtagtcggggaaggggatagttgggtagagttttttgagttagaaggtaagcgttggttagtgagtcgaggtgggaattgttattatatagtttttttttttaaaggggttaatttttttttaatttaaagagttagttaggtttttatggtagtaggttaggtattcggtttgaggttattatttggatattaggtggggggtaggtattttgttgaaagttgtttattttgtttttaatatttttattttataatcgagtgttgttttttattatttattttttaagtataaagttgggtgatgtttgggtttttgtggtttttgggtgagtgtaggtgataagagaaaagtaatttttgatatgtagagggaagatttgttggaataggcgagtttaagatatcgaaggcgggagggggtttggaggaaaggggttttattgttatttgttgttttttaggggttagttttttttcgggttaggggagttggattttttggttggtttattttgaagagggttatagaggttgtaagtagggttttaagagacggtgtgtaacggattttttcgggtatggggtaggtaaggttttaggaacgttaaagaaaaggaaatttttatattaataattatatttttatattattatttatataaatttttatattattaatttttattaagaattttgaggtgatttgtgggtagaggtgcggaggagggtggagaagggaagggaaagaagggaagggtgagattaagatttaaggtaatttgggaaattattcgatttttttttttattttttttttcgtattttttagatgaaggttagattttttttcgtttttttattagtttgaacggagtagcgatatttatttttgttttgcgttttgtgtttttggtatggttattttttagtttatttgaaaatgatttttattttgtttagcggatgttgtatatttagtgttttataaatattatatttgattattttttatagggtaaatttttgttttattttataggtggggaaagtaatgtttagggaagttaaattattcgtttaaagttacgcgattattaagtagttggagaggggatgcgaatttaaattttaagtattttttaggttttcgtaatttattgggcggtttatattttcgcgttcgcgtttcgttttttcgttttattttagcgaggggcgtttagttcgttttaagaggagcgtgtttcggtcgttaatcgttcgtcgatttcgtttttgttttattgtttggagacgttttggttagtttagttcgagtcgattttcggggtcgcgcgacgtcgtcgattggtcggcggtaattacgggtatatttcgggttgggggaggggcgatggcggtttttcgcgagtataaattatgtaaatattcgggcgttgtacggggatgatttgtcgtttcgttttatttattcgggttgtcgcgggggcggaggtggtaagggaggggggcgtttattgttgcgtcgggtatttaaggggttttgaggttagtcgtgtgttatattcggtgtttatacgagttgatttgatcgtcggcgatattatttaggagatcggtcgggcgcgtggtttttgtaggcgaggcgaggaggttaggttaagtttttcgtgcgtttttgtatttttttaggttttcgtattcgtaattggtatagagtaataattttaggttgttgggaacgtaagtgcgttttggcggttttgtttttagttcgggttgtagcgttttgagcgtttttttatttgttcgtcggttttgtatagcgtaacgatgttagttcgttttgagatttgtattttcgatttcgattgcgttagtagtagcggtagtgatttattcggtttttttatcgacgaggaagattgtgttagattttaataggtagttttcgtttcggggtcgttcgcgtcggttcgtaggggcgcgtttaatatttttcgggcgtttgaggttttaggggtataggacgacgagtaggagaggcggcggcgtcgcggtcggacgcgggttcgtttcgaggcgttgttgtattcgttgcgtaggagtcggcgcgttaaggttaacgatcgcgagcgtaatcgtatgtataatttgaacgcggttttggacgtattgcgtagcgtgttgttttcgtttttcgacgatattaagtttattaaaatcgagacgttgcgtttcgtttataattatatttgggttttggtcgagatattgcgtttggcggattaagggttgttcggaggcggtgttcgggagcgttttttgtcgtcgtagtgcgttttttgtttgttcggttttttaagtttcgttagcgacgcggagttttggggtttaggtgtcgtcgtcgttttttcgttttttgattttagtagtttagtcgttttcgaagattttatttatcgtttcggcgattttgtttttttttttttaagtttgtttaaagatttgttttatataacgttttgttttattttttattattaggttttttgtagatattgttatttttttttttttttagttagtaggtaatagatggggttttagttgtcgtttcgggattttttttttaggcggagggaggaagcgggagttttaaagtagtcggggatatttgagtcgtttgttaggtcgtcgtattttcgcggcggatgttttttggtttgttttttcggtttttagtt

SEQ ID NO: 192 - DNA, 159782 bp, Artificial Sequence
  Chemically-Treated DNA
tttttaggtttttggtattagggttaagtttattttgaatttatgttatattagtaggcgaatattgttatattgatatttaaatgtttattatattattttaaggtttttgaagtaggggtaattttatttttagtaaataaaaattagattggataatcggaattgtataagttttataaaagtatgttggagttatataatgaaaaagtagatttttttattatgatgtttttttatatttggtattgttgtaaatggttaatatttattgttaattcggtataaatgtgtggtttggtaatattagaatagtaaatttaaatgaaaaaataaaagttaaatatttttatataaggttttatagtttgatattttattgcgtaggtaaaaagatattttttttttaattatagattattatttagtatgaataaaaaattataatttttatttttaaataggagttattggttttaatttttatatattttaaaattattgtgataaaaaataatgaaaaagttttttaataatgttatatatagtataatatagatttgtttttattatatagtatttaatatataaaatagaatattgatatatttgaatttatatgtagttaagtaagttatttgaggagggtatttttatatagttttttattagaaaataaaatttttttagatattttttagagagaagtaaatttttttttgaaaatttggttattaattttgggtggattaggttgtttgaaaatagtttgggaaattacgaaattttatttaaagggtttaaagtgttttttttatatttttattttttttttgatattaaaattagatatatatatataaaaatatatttatttatagttatagttagggagtgattagttaagatggaaattttattgaaggttattatggttttggaagtttgatagattaatgtattgtataataatattttttattttatggtgatgtagtttttagggtttttaaaagggaattaaaattatgagatttaggtgaaattggaattgttttttgtttttgaattttgaagggagcgtggtttttttttatggtatgtttagagtttattttatgttaattatttagtattttatagatataaattatgttagttttttttttggggtggttaaggtttttttttatagttttaggtatttggatatatatattttaaaagtgttatgttttaagtgttttagttttgtttgtatagtattttatagaatatttataaatattaaaaatattttttaggatttgttgtgagtaattaatttttattgaagttattataaattttaatagtttgggttgggatggttagataatatatatataggaaataaatttgtttttaaatagtattattatatagtatttaaatttataattaaatataattaagatgattttttttttttttacgtattttaaaagggtatagtttttttttttatttaatgaaaagttttttatagttgtcgatgagtattagttgatttattattgataacgaagtgtatataatttttttttttttattgagttttattttttgagcgttaagattgttgggatgaaaattagattaatgtgtgagatgtgttttttggttttaattatataatattttataaaggaatgataatttacgttttagaagttttttttgaaatttaatattgttattgataagaatatttaagtagtttttttaggtattaaaaatttatttagtcgggttatatattattttaaaatattatatttttttttagagagtatttaaaaagtaaatgattgtttttttattaaataatttttttaaaatattgaaaataataaataatatttaaaaagtatttaaagaaaataaaaatatgtttttattttatttggaaataaatttttgttgtaggatagaaaggaattagtgtattattggtaatttatgagattttgtattatttatatattgttggtatttttatgtaaattattgttaaatttttgaagtttttgttgttatttaattgttgggggagggttgtatgtgaaagtaattcgttattagatggtgtttttaaggatgtaagtattatttttttgttttttgtttatatattttatatattttagtgtaaggggagattgagtaaattaaatttgcgttgatagatttattgttggaatgagaagggtggttagaatgggaggtagaggataattttttttgtaattttattgggttagagttttagtaatttttattgtatataggattagtttttatttttttttttttttagagtaaattgtttggtttttgagattatcgttgtttgtatgaatgtatgtataaattataaattatataggttatttattagtatttttttgatttttataaaaaatatataatatgttatgataaaataattttatttaaaaattatttttattttatattatataagttattttataattattttaataaattgtatgtaaagttgtagtagtttttttttttttagattagtgaatattaatatgatatatatttgaaattataattaaatataaaaatatattagaagttttatatttttaatattagatttttagttttttattatataaataatttggttattttgaatagaaattaaattttttgtggtttagtaaatatgttaagttttgagtttatagaaagttggtaaggtgtatatagaaagggttattatagtttttattttgtttaaaataatttttaatagtgaagaaatttataggatttgtgttaaattttatggtatatattagggatgtgtagttttataaatatggatgtttgatatatagttttaaattataaaaattagtagttgagtttttttgtattattaggaaagattaattaattggtgatagatgggaatgtgaaaatgggtgtttagttatttttgttatattagagatttagtttttgggtaaagtttagtgagaggaattattttgtttgattaaaagttttttagttgtgttatagttggttatttggaattataatttttaagaagttatataaattattttaaaaggttttgaaagataaatagtttattagtttttttgttatatagttattgtaaaaatagggcgttaggtatagatagggttttttggtagttattttttaaattagttttttgtaattattatttatagtttatttagtaggttattggattaggtgttttatattagttaggattgttaatttgtataatttatataattttttattgaagtagatatatataaaatatgagtttttttttttttttttttgataagaatattggagatttgagttaatttttgtggttttttgatagttaagtgttattaggttagaagtattaatttatttttatatagatgattgattaatgtttagagtttatttgggaaagttacgaattagttgtttattttaaatagttgtataataatttgaataaaaaattatgtaagaaaaaatgagtaagcgtagtttattaaatataaaggaaattgttaaaattagatagtaatagttataaaaggtataattttttttttttgatatatatttgtaaatttttttttaggtttttatgtataaattaaaaatgttattttaattatataggggggggatatattaatagaaagtttagaaaattttatttagttaattgtgaaaaaaagtatgaagagaaagtttattatatagattttgggtattggtggtttaggtgttatttttttttgattgtggagattacgtttatatattaaggtttttaatttttgggatatattaattaataaattttattatttatttttttattattgaaaagtgatgacgatttaattgtttttgttgttaagttttggttttttataaattatatgtagtgcgtatttaaaataaaataatagatgaaaataataaaaaataaaataataaaatttttataggataaattgatagtttatataataaaagttattaattcgattttttttaaggtaattatttttattaaggtagttatttttgatgaaatagaagttttttgatatttttatttgaatattttggtatttgattggtgatgattttagttaatatttcggggaatttaatatttatggttttatttaaaaatgtttggaagtaatagttaaggagatttttaattatttgtaagagaagatatggtaatgattaggtttttaaattggttagtgggaatattttatgtttgttgttttttattttgaaaaaattatttggtttagaatatattaattttattggaattttttagatgaaaaataagtattttcgtataaaatatattttatatttttttgattgtatgtagaattatatagaattattttatgaattattgtagtattataatatatgaagggtgtattattttaatttaatggattaattatattttttaaaaatagtattattaaattttgtaataatatggtgattttatatatatatgattaggtgaaaggatattttataattggttttaggaaaaatgtttataaaattgaagtttataagttgaatttaagttattattaatatttataaattgggggcgggggtgggggcgttgttggtatataattatatttattaattaaaatatattttgttttagaaaatttttatatttggttttatgtttgatatttattttatgtatagaatttaagagttttgttagttgataaaatcgttgttagttttggttggagttttttttttttttgataatggttttttttagttttttgatgtaggttattttaattttattaaatagtttttggttttttagatcgtttttaggaattaaaaggttaagatgaagttagttaaaggatttttttttttttttttttttttttttttttttttttgagatagatagggttttattgtgttatttaggttggagtgtagtggtataattatagtttattggagttttgatttttttggtttaagtgatttttttattttagttttttgagtagttaggattgtaggtataagttattatgtttgagtggtataattatagtttattggagttttgatttttttggtttaagtgatttttttattttagttttttgagtagttaggatataagttattgtgtttggttaaatttttttgtagagataggatttttttatgttgtttaggttggttttaaatttttgggtttaagtaatttttttgtttcggttttttaaagtgttaggattataggtgtgagttattatttttagttagattttttgttataattttttatatatgtaagatgggtatttaatattgtttatgtatttttattgtattttaaaatataagtatttttttaggattattaattaaattatagttaagagaaaatgtaggataataaagaattggaggatttaattttgagtaaattatttgattttttatttataaaatggaagtggtgatgatatatttttttttttttagtttataaagttatttggaggattaaatgaaataatatagtgatttttagttaattttgtttgttattttgtatttgagtttaattttagtattgagatagatagaaggttttaataatagtgtttattttagtaattatattttggaatatttgtgatattattagttaattataattttaaaatcggtatgtaatattttttttaatgtagttaatagatatgttttagtagggagtaaatatttgtttttttttatgtatatggattttggttagtgaaattagtataaaagttttggggggatatattattttttagaaaatggtattaataaggataaggaatagagggttaattatggttttatttaattttgtggagattaggatttttgtagagtgttatattttttatagtgtgtttttgggaatattgattttgtgttaattatagttagagcgagataaaggatttggtggttaaagtttgagaaaagttaaatgtttaatatatattaggtagatttttgaattttagtattttttggagatataattgtgtattttttagagaggggaaatgtattattttttaaattgaaattttattgttgttgatatttttagaagatgttggtatagaggaaaagttatggatttaggagtttttagaagttttattattattatttttttttcgagatagagttttgttgtgttgtttaggttggagtgtattggtatgattttagtttattgttattttcgttttttaggtttaagtaatttcgtttattttggttttttaaagtgttgggattttaggtagtaagttattatgtttagtcgagtagttttattttttatttgttatgtggatttgaatataatttttttgagtattttttttgtttttttttattggattatgattagaattagattaatgaatatgtatgaaaatgtttgattttataaagtattataagatattagtattaatatgaaaatgaagatcgtttaattaggagtgataacggtattttatattaataatgggttaattttatatattattatattatagaaaatttaattattgtaaaattgtaaaatagcgatggtttatagtttttttttttgtcgtatagtttttttttttgtcggttagttttaattttaaaaataattatggtgaagtttaatttaatatgtatataaaagaattttatttattttaaatttttttttaatgttttaatattgaaattattaatattatttttttttttggttgtaggaagtaagtatagtttggaattttttttttattggaaaattggataataagtaatatatgattatgatttttaggaaaagagaaataaatacggtaagttatatttagtttaggagtaagaaattttaattttaaatttttgtgtttgaaagtaattattatattgtagtgaagggaaagggaatttagggtttagtaattttgttgggttgaggagaaagagattgaagtttggggaggttaaagtagttttaatttatgggttagattattggaaacgaaggaggtatataaagaaaggtttttagaaatttgtataatttatgggttagattattggaaacgaaggaggtatataaagaaaggtttttagaaatttgtataatttatgggttagattattggaaacgaaggaggtatataaagaaaggtttttagaaatttgtatagttttcggttgaataaaaatttgtgtatatttagggtgaaattttttgaggttatagaggaaagaaagatttaattaaatatgtcgggtatttagtagagatttaggggttatattttagaagtaaggttaaattagttttagaaaaaaggttatatagattagtggtttttaaaagggagggggagattttgtttttaaggggatatttggtaatgttagagatatagtagataaatttaatattataaatatttttgttttagaattaataagaataaataagatttaaatttgattgatatttttgaaatagtttatttaagaatttgtattttttttaagtatatatagaatattaatttagaatataaaataagtttgaatatatttaggaggattaagttatataatgaatgttgtttgataaaaatgagattaaaatagaagttagtaataaatatatttggagaaaaatttaaatgtttagaatttgatatttaataagttatagattaaataaggtattatgattaaataaggtattataaaattaaaaatttttagtattgaaaatatagtatattaaaatgtgtgggatgtaatgaagatagtgtttagaaaatttatagtattaaaagttttgattagaaaagaaaggttttaattaattatatatgtttttattttaaatataagaaaaatggaaaggataaagagtagaaacgaataattaagaatatgtataaataataataaaattaagattaagttggttttatgaaaatattggtaaaattgaaaaatttttagttagattgattaaaaaaaaaaaaaaaaagtaagaatatattaaatattaatgtcgggaatgaaagggaataatattagagatattggagttattagaaggatattatgggaatattatgaataatttaattttatattaataaatttaatatttgaaggaaatagttaaatttttttaaagatgtaaattaataaagtttatttaagaataaatatattattagtaaatatttgatgaatttgtatttgaaaatttttttataaaaaaggttttaaataaattaagatagttttattgttgagttttattaaacgtttaagaaagaaataatattatattattataatattaaagttatagaatatattttttatggatttagatgtaaaaatattaaaattttagtataatgaatttagttatatgtaaaaaggatattatattataattaaataggatttattttcggaatgaaaggttagttaattatttagaaattaaatagtatattatattattatattatattagtgattaaaaacgaaaaatatatgattttgaggtataaaagtatatgataaaagttttttttgttattatgaataatgttgttatgaatatgggtagttattaaatgtatggtaagttataagggttaattatatattttttaggatagcgataataaaaaaattatattaagttttggtaaggatgtagataaagttgtaggatttagaataattagatagaaaattagtaaagatatagaaaatttgaattagtttattaattaatttgatttaattgacgtttataaaattttatttaataagagtatagtaagtttttttttaagtatttatggaatatttaggatagattatatgtaagtgtttaaaaaagttttagaagatttattggagttatttaatattagagttttttaatgtattttttattttagtggaattaaattagaaatgaataggaagagatatggaaaatttttaaatatataaaaattaagtaatatatatgggttaatgaaaaaaattatgaaggatattagaaaatgaaatgaatgaaaatatataaaaaatgtatagttttaaatatttatataagaaaataaggtttttaattaataatggaagtttttattttaaattagaaaaagaggaataaattaaatgaaaagtaagtagaaaagaagaaataataattaatgatataggaaataaaaagagaaaattaatgaaattaaaaattttaatgaaattaaaaattggttttttgtaaagattaataaaattgataaatttttaattagattgattatgaaaaaaagatgattaggtataaattatgaaaatttataatggaggggatatttttatggattttataaaatttaaaggattataaataattttatgtttaagttagataatttagataaaatggtttattttatagaaatatataaattataaaattatgttaaggaaaaatataaattttgaatagatttatataataaataagtaaataattaaaaattttttttgaaagaaaatatagatttagatggttttattggtaatatgtattaaatatttaaagaataaataagattaatattttataaattttttaagaaaatagaaaatattttttaatttattttaagaggttagtattattttggtagtaaagttagaaaaagatattataagaaaagaaagttgtagattagtattttttataaagagagatataaaaatgattagtaaaatattagtaaattaaatttaaaatatatatggaaaagattatatattatgatttagttagaaaattagattttaaattattttaagttatttttttgattttgtaaataaatttgtattagaatataagtatttatatattgtatatagttgtttttttgttatagttgtagaattgagaaattgtaatagggattatatggtttataaagataaatatgtattgtgagtttttttatagaagattatttgtggaattatattttgtttagtagtattttagtagtatttttggaaagaggatttgatggtttttttatttttttaaagttggaatttttatttttttttaataattggaatttttttttttttttttggagacggagttttattttgttgtttaggttggagtatagtggtataatttcggtttattgtaatttttgttttttagatttaagcgatttttttgttttagttttttgagtagttgggattataggtatgtgttattacgtttggttaatttttttgtatttttagtagagatagggttttattatgttggttaggttggtttcgaatttttgatttgatgatttgtttatttcggttttttaacgtgttggaattataggcgtgagttatagcgttcggttagaaattggaaatttaagatgttaattatttttaaatggatttatagatttaaggttattttaataaaaattttattagattgtgtttttgagatagagttttattttgttgtttaggttagagtgtattggtatgattatggtttattgtagttttgatttttttttttagttttttgggtagttgggattataggtataagttattatgtttggttaattttttttattttgtgtagtgatagggtttcgatattttgtttaggttggttttaaatttttgggtttaagcgatttgtttgttttggttttttaaagtggtggaattataggtatgaattattatatttagttttaaaagattttttggtagagattgttaagttaattaaaaaatacgtggaagattaggtatagtggtttatgtttgtaattttagtattttgggaggtcgaggtgggtggattatttgaggttagggtttgagattagtttggttaatatggcgaaatttcgtttttattaaaaatataaaaattagttaagtatgatggtgggtgtttgtaattttattgttggggaggttgaggttgcgatgagttaagattatgttattgtattttagtttgggtaataatagtgagattttattttaaaaaaaaaaaaaaaaaaggaagtggaaatgtaaggaaattagaatatttaaaataatagtttggaaaagaataatagatttggagaatttatattattaaattttaagatttattgtaatgtaatagtaattaagatagggtgttattaatatgaatataggtatatagattattgggtaagaaatatagatcgttgggtaagaaaaagagtttgaaagtagatttatatatatataaataattgattttttataaaattgttaagtaatttaatagggaaaagagagttaagttttggagtaattagatatggattttggggaagaaaatgaattttgttttttattttgtattatatatttaagtatgtgagttgaaattatagaatttttataagaaaataaatagtagaaaatttttttaattttggattaagtaaaatttttttagtaaataaagatacgaagttttttttaaaattatatatttttgtttatttttatatttttttaagaaaattgtaaatgtaatttatttaaagaaaatatgtaaaatatatatttaataaagggttatattgagaatatttgaataatttttaaaatttagttaaaaaatgggtaaaagattaaaagaggtataatattaaataagaaatataggtggttaataagtttatgaaaagatgtttaatatttttaattattagtatatttacgatgaaagaggttgatagtattaagtattgaggaggatatagaatggattttaagaagttttatatatttttggtaaatgttaataattgcggaaaagtttggtaattttaaaaataaatttaaatatatatttaatttatgttttagtgattttatattttagtattgatttaagagagatgaaatgtatatttatatttttatttttttgtttgtttaatttgtaagaaaggtatagtaaaattttattatttttattagatttatttaagtatttttgttttatgaatttttgtattatgtaatttgaaattatatatttataattattttttttgaataaatgttttaaggagtattttgttttaatatttattttgtttggtaataatgtagttttttcggttttgttttggttaatataggggttagtaaattttggtttatgggttaaattttatttgtagtttgtatttgtaaataaagttttattggaatatagttatgtttgttttatttgagtatcgttaatgattatgtttttgttataagggtagagtttagtagttgtgatagagattgtgtaaagttaataatatttattatttggttttttatagaaaaagttggttatgttttgggttatattatgtaaagtagatttttttattttagttttttaatatttttatttagatatagttttttttaaatagtataaatttggattatttttaaaattttgttagattagtttggagtatttagtttatttttatatttattttatttttgagatagtgtttttttgttatttagtttggagaagagtggtacgattttggtttattgtaatttttattttttaggtttaaatgatttttgtgttttagtttttcgagtagttaggataataggtatgtattattatattcggttttttatagttttagtagagtcggggtttcgttatgttggttaggttggtttcgaatttttgattttaagtgatttgtttatagttttttaaagtgttgggattataggtgtgagttattatatttggttttatttttatatttaatgaaattaaattattgatgtgtttgaatttagttgtattaatgtattttatttgttattttttgttattatgtttttgtttatgtatttttttttttttttttttatgttttttatttttttggattgttttttttaggtattttttttttttaatggtttggtattttgtatattttgtatattttatttttagttgttatttttgaaatttattttagttttattttttagtttttaaggaaattgttattgttgttattttatatatatagtaaatgttagtttaaatgtatttatattatttattatttttgttattttttagttttttttaaagatgggattatttttattattttttttttaagatggagtttttttttgttattaggttggagtgtagtggtgttattttggttttttgtaatttttacgttttaggtttaagtgatttttttgttttagttttttgagtagttgggattataggcgcgtattattatttttagttaagttttgtatttttagtagagatggggttttattacgtaagttaggatggttttgattttttgattttgtgatttgtttgttttagttttttaaagtgttgggattatcggtgtgagttattacgtttggttgggatatattttttaataattttttagtgagtatttggtggtaaattttatttttattttttagttaaaaaaatagttgattggtgtatttagagtatttaaatttaaagtaattattgatatagttggattaatgtttattatgtttatattgtatttgagtttgggggaattttttttgatttatttatttttaagtttattgattttttgtttggttgtgtttagtttattgatgagtttattaatattattttgtatttttttatagtattttttagtatttatttttagagtttttatttttttgcgtatattattttttgtatgttgtttatttttttttattggagtttttaatttattaattataggtattgtaaattttttatttgataattgaaatatttgtgttatatttgaggattgtttttgatgtttgttttgtttttttagatcgtgggttttttttgttttttagtatgttttgtagtttttttgttgaaagttggatatgattgatatattaaaattgaagtaattagatttttagtgtgaggttttatgttaatttggttaggagttgggttgtatttaatgtttgttataattgtaggtattggaggttttagttttttttagtttttttgtttttatttatttttttttttgttgtttttgggttttttaagagttttttaaatagtttgtgttttgtagtttttttagttgtaatttattgttattttattttggagttttgtttatatggtggtaaggtgttggggagggggaggggaattgttttttaatttttatgattaaattttagttttttttagtgggtttgaatttttgggttgtgatttttagaaatgagataagaaggttaaggaagggttagaattttttatttgttttttttttaggttatataagggtttgttgaattagttttttttatagggtaggttttttgttgtgaatattttgttacgtatttttaaattttattttttttttatttttattagaaaaaggagggaattttttttgtatttttattataagaattttgtggagtttttggaagttagaaattttgtggggtaaatttaagaaattgtaggaaatttttattaagattgggtttttgggagtttttaattttgaagttagtttttatttagtttttagtaatttattaaaattgttatagtttttttggttttagtggtatttttttttaaattgttatagtttttttggttttagtggtatttttttttagtaagttgattttggttgtttttttgtatttgtttatttttttagattttgaagtggtggtttgttttatgatttttattttttgagggatttaagaaaagttattgtttttttagtttttatagttttgttgttatttttttgttgtgatttttagtatttatagattttttttgtggtttatatatataaatatatatataattattaaaaataattgtatttttttgtttttagatttatttattgtttttttaattgtatttatatttttattttttgtttttaaatttattaaatatatagaattagtttaaatgtttattaattaacgagtggataaagaaaatgtggtatatatatattatggaatattatttagttataaaaaggaataaaataatggtatttgtagtaatttggatggaattggaaattattattgtaagtgaagtaatttaggaatgggaaattaaatattgtatgtttttatttttaagtgggagttaaattatgaagatgtaaaggtatgagaatgatattatggattttgtggattagggttggggaggggatgagggatgaaagattatatattgggtatagtgtatattgttcgggtgatgggtgtattaaaattttagaaattattattaaagaatttatttatgtaatttattattatttgttttttaaaaatttattgaaattattttaaaaaagattataaatttaaaaaaattttaatttattaaatttattaatttattaggttttataaatgtcgttaaagagtaagttggtttgagttttatttatttttgtaggtttttgtttttatttagtttttaatttttttagtttagtatttttggtgggaggttatatatttattttagtagtttattatagtagaagtttatattttaaggtatatatttttatttttatgattttattattttttaataagaagaattcgtgatattatttataatgaaaaaaattatatagtttaattagtttgggatgtatataattgaaattatttttttttttttttttttaaataagtaaagttgttagtatttaggtattgaattatatttttatggtattaattaaagttatgattagaattttatgtaattgtttaattatttttttaataagtgtatcgttataggtaatattaaacgtttttagtaatgatttttatcgggtttttttgttttgattgaaatattattaatattttttatatttattaatataaaataattttttgttgagtaaaaatagtgtgaaaatattaagatgaatgtgcgttttggaaatgtttaaatagatatgaaatgattaaataaaattatagttttgtgtaatatttatagtttatagttatttggtaattatgaaattatagttattaatggaattaagattttttaaaaaattgtaaatgtatttatttgtatatgaaagaggtatttagttattaatttagtatttaataaatattgatatgtaatttttatttgaaatggtttaaggtttataatattaattagtttatagagttttttttaaaaaagattttttttagagtagttttaagtttatagtaaaattgggaggaaggtatagagattttttatatattttttgttttatatattattatttaaagtttatagttgagggtttatttttggtggtggatattttttgggtttggataaatgtataatgatatgtttttattattgtagtattatacgaagtatttttattgttttaaaaattttttgtgttttgtatatttattttttttttttttttaaattttggtaatcgttgatttttttttgttgtttttatagttttgttttttatggaatgttatatagttagaattatatagtatgtagtttttttagattagttttttttatttagtaatatgtatttaacgtttttttatgtgtttttatggtttgatagtttatttttttttagtttttaatagtattttattatttggatgtattatagtttattattttatttattgaaggatatttttgtttttgttagttaaaaagtaattttatagaagttcgttttataaatttttgttgttattttttagataatgaatttttgataatttagtttttatgttatgttaattaatttttaatagtaattaagtatattttttttaggatgcgttttttttttttataattttttatatatgttaatatttattaggaaattaaaatttttaattaaataatagtgtagtggataaaattattgtagttagttttttttttttatgtttttttatgattaaagattaaaggaaggaaggagaaaaaagtttatatagatttttattaatagagatttttatgtagtttatatatttttttgtttttgttatatttatttgttttattaattttggtgttatttattgtgtttttttaatattttatatttataaaaattatttgattagtaggaaataatagtagatttggtataattattagtattatgtatataaattaatttttgtttttaggtttttatattttatgtttttgatataaggtgaaaaggtgttttattaatttgaagagagaagtagtaaggtttttatatagagatattttttataagatatttgaagtttgtgtaatttagaggaaatatatagtatgtgtttatattggtcgtatatgtagggtagagttattttttgtttgtgaaagataaatagtagggtattagttagaaatattgttatttttttttaaaaagtatatttttgttttgttttgtaaaattatgaatttataaagaaaaataattattgtaataatattattgttaattttttataaaattagaattttggagaattttttttaaattttttgtattttggttgtttaaatagattaatgaataatttaatgtaatagtggagatattattttttattatgtatgttatgtattattttattatttaattaaagtgttagaatttttatagaatttattattagttgtttatttaaattaaggtttattatttgaatacggttaattagacgatagttttaggttttatatatttgatttttaaaggtaaatttttttatagtagtttattttaaagataaaaatgtgtgatattgtttatagttatgtagagggcgagatttagaatttgattttagatttttgatgtttaaaatttgtttttgataggtatatgttttaatattttttaaattaaaggtattaaattaatttttgtttatgattttgaagttattatatatttatgatttttaaataggtttttaaagttttttgatttgtgaaatgatattaagagtttgaaattgggtttagtttatagtttttaaaatgttttaagatttttttttttttttaagtttttgatagaaagtcgttttggatttaataatagaaaggttattatttttttttattgaatatgtggtttatttttttatataaaataaattagatatgatttatatgttgttaaagtgattagaggttttttaaatttaaaatttgtttttatcgaagaggtatttttttagtttttaatagtaggtaaagtattttttttttgggaggtattttttttttttttagttttttgtatatggttatatttatataattgaaaattttaataaagttatagtgtagtagaataagtaaaaatttatttttgttggttgtaaaaataataataattttttttttttttataacgttttgatttaagggtaattatgagagattgtttgatagttttatagagggttagaatttgaatgtatattttttgatatgtaatatttgtttgttatagatattagagtagtatggaaatatagtgggttaagaaaaaagggtggagggttgggtgcggtggtttatatttgtaattttagtattttgggaggttaaagtgggtggattatttgaggttaggagtttaagattagtttggttaatatggtaaaatttcgtttttattaaaaatataaaaaattagttaagtgtggtggagtgcgtttgtaattttagttattcgggaggttgaggtagagaattatttgaattttggaggtagaggttgttatgagttaagattatattattgtatttgagtttgggtgatagagtaagattcgttttaaaaaaaaaaaaaaaaaaaaagaaaagaaaaaggtggaggattgtttattttttaggtagtagtatgagaatataagaataggaagtatatattttttaatgaaaatgaaattaatgtaaatttgttgaggaaaaaaaattataaattttattttatgtaaggaatgtatgtggtatgattagattttgttgtgattgtttaaagttaaatttgaatgttttaataataaaaattttaaattaggttagttttataaattaggataagttggtgttttatataaatttgtttatgtttttaattttatttaaatgtttttaaattatatattagaaagtgattaaaaaataaatattgttaatatggtattttttaaatagtatggtaggattatgatgagtaataatgtttttagtttttttagaaattaaatatatttattagttaatttaaaattggatttaattatttaattttgttatattgtgatgtagtagtttgaatagttttttttttggtaataaaagttaaggtgatttttgttttttatataaatagaaattttttttattttttattttttttagattaggggtatgtgtgtgtgaattttttgtttatattgtattaatagtaataagttaggggtacgaaaagtagtaatataaggtagaaagtgagagtaattaggatgtgatttttttgttgtgtatttggtgatgtgaatattaagagtttaagagtatgttggaaaggatggatgggaatgaagagtgtgtgaaggaaaataatgggagaggaagtgaggttagattttggaaagtttgaaattatgtagaatatgtattggagggttagtgggaagatattgaagataatttgtgtattggggagatatgtgatgtagttagattgtgtttgaggaagtaaatattagttaatatgatgaacgttatattggagggagaaaacgagtgaggaaataattgtaatgaggtaaggggaaatggatatttgaagtatttcgtagatataggaataagtttagaggataagagaatagttgatttataaaattttaaaggtttggtttttttttagttaaataaaataaatttgtttttatatttttaaattatagatattgggtgagttttgttatgtaaagagatattttttgtgtttgggtttatatgttttattttattagtttagatatttttatttataattgtttttattgaatttatatgagttttattatgtttttttttttttttggaatagggttatgtaaatgatattatagtaagattttttgttgtttgcgatagattttattaattttagatatgttgttaaatatttttaaatatgttttgggatagtaataatgttatatgtatatttgttttatattatatttgttttgttttaagtatttataattttatttttagtttgtttagattttagatatttagtaggattgttttagttttgaattattataatagtagttaattaggaaaatattagttggttaaagatattttatgaatatagggaaaatgatatatatataatttatttattaataattagattaggagtaaaatatagtaggtttgtatttgattgtttatatgatttttattttagagtaaatgttataagaaatatttaggagtattgtagtagggttatttggttatttaggtgtaagtttttgaaatttgaattaagagaaataaaggtatgaggtaatattttttagaagattatttttgtgggaattgttaaggagtaatgagattaattagttttgttaaaataagggtatttttaatagaaaatggaaattaaatattaggtagatatagtttttttttgttatttgatattttaagatttataaatttttttgtgtttttttttttttttttttttttaattgagataaagttttgttttgttatttaggttggagtgtaatggtgttatttcggtttattgtaattttcgtttttcgggtttaagtgatttttagtgttagttttttaagtagttaggaatatagatttatattattatgttcggttaatttttgtaattttagtagagatggggttttgttatgttggttaggttggtttcgaatttttgattttaattgatttatttatttgggttttttaaagtgttgggattataggcgtgagttatcgtatttagttttttaggtgttttttaatagtttttaatgtaaaaaaaaaaaaaaaaagttagttttgttatttttgtttgtttaagtaaatatgaattaaatagtaaaatagttaaaatttttggtttggcggttattagtgatcgggaaagatagtggtgatggggatgaagcgggaatggttgacgggtgtaaaaatatagttagaagaaataagttttagtgtttagtagtataataggatgattatagttaataataatttattttatattttaaaatagttaaaagagaagatttggaatgttttttaaataaatgtttgaggtgatggatattttagttattttgatttgatttttatacgttgtatgtttttattaaattattatatgtattttttaaatataaatatgtatagtaaatatgtataattattatgtattgattttaaaaaatagaaaagaattttggtttgaggtattaattaatgagttaagtaaaatatttgttttgttatttatattttttttttttttaataaaataaggatgataggaggttaggttatttttttgttttttttttaattatttgcgtgaatataggtttgttaattttttgtttttaaagttagagttgatattaatattgatttttgttattttatattaaattttaatagggtaatttttatttaaaattatttttaaaattatatttaatgtgtagtattttatttagtgaagggttaaaattattttattttagtataaattttgataattaatatatttgatgtttattaattttataaataatttgatttttaaaagtggtataatgaaggaaaataaatggaattaattaaaaatattttttttttttaaattttagtgtaaaaggagttttgagtgagttttgtaatttgaattttgatattatattattttatgtgaaattattattttgtgtataatgatttgaaaagtagggagtaatgtaaatgttttattataaattttttattatttgtatttatttgatttttttttttatagtttttagaattaagagaaataagataagttatgggtttacgatgatataaaagttaaagtgtttttgttgaagaaaatataaaggtttatatagttgtttttttatgttttgtattttatttggtattgtttttgtttattttattgttgtaattatttgtcgtttttttaatatgttgagcgtagttatgattttttaagttgagtttggaatagagttattatattttgtatataatattttaggtttaataatttttaatagtgatattagggtaggggtgagttgtggtaacgttgtaggaattattgttttgttattaggatttttagaggttttttgtgagatttttgtagtggtttgttgaattttttttatttttttttttgtttttcgagttgtgggtatttaaataaatatatagaaatgaattgtaatgggaaggtttgcgttatatagtttatttaagaagtatttttattttttaaaattattaagatgggagaaatattttatttagtaattatgataaagtgatatggaaaaggagaaaaaatttttttttttttgaaagtaaaagatttagaggaatttatttttaattaattttgtttataaataggttagaaattttattagagttattttttatataaagtattataacggtatgttaaaataatttgagtaaataatttttgtaaatttttttataaattatttttttattttatttttattttaaatgtaataattttattggttatataaggtaaattatttttattataaattgaaaaaaaaatttaagtttggagtaacggattataaattgtggtttaagattaatttaaattatggtagtatatataatgaagagaattatattatttatatttgtttaaagttatttataaagataggaagatgatagtagattatatgttaaaaatagtattagttttattagtagaaaaaatttattttttatttttatataggtattaatataaatattgcgtgggattaaaaatatttgggaagatgaaatgaaaaattttatattatataaattataagtgggaaattttttttttataaggaagatttatattgattattttataaatttaaagtagttatttttatattatatataaattattttttattttgatttggtatggaattatttatttaaattataatatggattttgtagattttttagtagatttatttatatttttgaagttattttagtgattaaataaataagaattatattgtttttttagagggaaagtatttagaattttagggaaaggtaagaaatgtaatttatattacgaagaaatgtatttgtttaaattattagggatgtaaattattttgtaaagggaagagtaaatgtaaattatttttaaaaattatttttagattttttgtttttaaaatgatatattatatagtttatggaggatagatatggtggtgggaacgatattttaatgtataatgttagaatagaatggttttatttttattgtgttttatattaaatggggtaattgagaattgtaaaaatttttattaatagtttaaaatagaaatagaattatgatagaattatgttaattagtttattatgtttttttggaggtatagtatgatataggattaaagggtagaaatttgaaattagtatatttggatttaagttttggttttgttatgttgtagttggatatttgtgtaagttattttttgattttttatttttttttttgtaaaatgaggataatattagtttttattttatagggttgttgtgagaattaaatatgtaaaatgtttagaatagtttttggtatatattatagtaagtattatataataattattattattttaatttgtaggagaatatgtttttagaatattttaaatttggatattataatttaatagaggagtgataaaattttaaaaaggaaagatattaatatataaagaaattttttaaataattagaagtattttagtgaaattttgatttaaaattataaaatgtatttttgttgataatgtaaaagagaatatatatgtgttaaattaatatattgaaatagtattttgatagttttaattagttataattttaaatggtttggaatgtatatttttttattttatattagaataaggaagaaagagtaataagttggaggattaaaaaaaaatattttttatgatttagtttgtaattaattttttattatttatatatagttttaaatgagaaaattgatgttttttaatatagtttagaaagtataattgaatttaattgtgttgtattgattagagtaagaaataatattaattaattttttaaaatatttttaggaaggagttaattgaattgaattatttagttaagtaattattattttaaagtaatttagttaatataattttatataaatttttgatttattggagtatatagttgattagtagttaatataggagttttatagaagtgtttatgagtttgtggtaatattattttttttttaatgaaagtagagaaattttaattagtttaaaatttagtttataaaagttggttatttgaaaggataaataagattgatagattattagtaagattaataaagaaaaaaagagtgaagatttaaataagtataataaaaaatgtaaaagatgatattataagagattttatagaagtgaaaaagatttttatattattataagtatttttatgtatataaagtagataatttagaggaaatggataaattggaataaaggttttaaaaaatttagggtttatgtgtgtgtgtatgtgggtgggggggcgggtggagtttattatgaaagtattatttttgtttttagttgattttcgtatatataaagttattatttggagtaagtatgtatgtggaaatggaaatatataatttgtttagattgaattaggaagaaattgaaattttgaatagattaataacgagttttgaaattgaattaataataaaaaatttattaattaaaaaaagtttttgattagatggatttatagttaaattttattagatgtataaagaagagttggtattaattttattaaaattattttaaaaaagtaatttagaaagagggttttatttttaatttattttataagggaaatattattttaatattaaaatttggtagagaaataataataataataaaattataggttaatatttttgatgaatatagatataaaaatttttaataaaatattagtaaattgaatttagttgtatattaaaaagttaatttattataattaagtaggttttatttttgggatgtaaggttcgtttaatatatgtaaattaataaatgtgatttattatataataaaaaaaataatgattattttaatagatgtagaaaaagttgcgataaaatttagtatttttttatgataaaaatttttattaaattaggtattgaaggaatatattttaaagtaataaagagttttgtatgataaattaatagttaatattatattaaatgggtaaaagttggaagtattttttttaatgtaataagataaggatgtttaatgttattattttaatttaatatagtattggaaattttagttagaataattaggtaagagaaagagataaaaggtttttaaataggaaaataaataattaaacgatttttttttatttatgattttatatttagaaaattttgaagattttgttaaaaggtttttggagttgataaataattttggtaaaggtttaggatttaaaattaatgtataaaaattagtagtatttttatatattagtaatgtttaagttgagagttaaattaagaatgtaattttatttgtaatagttataaaaagagtaaaatatttaggaatgtatttaagttagtttaaaatttttataaggagaattataaaatattgttgaaagaaattaaagatgatataaataaatggaataatattttatgtttatggattggtagaattagtatagttaaaatggttatattatttaaagtaatttatagatttaatattatttttattaaattataatgttattttttatagaattagtaaaaagtattttaaaatttttatggaattaaaaaatgttttaaatagttaaagtaattttaagtaaaaagaataaagttggtaatattatattattttaaattaaattatattataggttatagtaatcgaaatagtatggtattggtaaaaaaaaattatatataatggtatagaatagagtttagaaataaagatatatatttatagttatgtaatttatataaagttgataaaaataagttatagggaaaagattttttattttattaatggtgttgggataattggttatttatgtgtagaagaatgaaattggatttttatttattgttatataaaaattagtaaggtggattaaagatgtaaatgtaagattttaaattatgaaaattttagaagaaaatttaggaaataattttttcgatattggttttgggaaagaatttatgattaatttttaaaagaaattgtaataaaaataaaaattgataatgggatttaattaaagagtttttgtaaattaagagaaattattataatttatagaatgggagaaaatatttgtaaattatgtatttgataaagttttaatatttagagtttatatggaatttaaattaataagtaaaaataattttattaaaaatgggtaaaggatatgaatagatattttttaaaaaaagatatacgtgtggttaataaatatatggaaaaatgttgattgttaattattagagaaatgtaagttaaaattataatgatattattgtggaaagaagtttggagattttttaaagaattaagagtttaattattatttaatttagtaattttattgttgggaatatatttaaagaaaaataaattattttattaaaaagatatatgtatttatatgtttattgtagtatggtttgtaatagtaaagatatggaattaatttaggtgtttattaatagtggattggataaagaaaatgtggtatttatatgttatggaatattatgtggttataaaaagaatgaaattacgttttttgtagtaatatggatgtagtaggcggttagtattttatatgaattaatgtagaaaaataaatattatgtttttatttataaatgggagttaaatattgagtatatatagatataaagatgggaatagatattgggaaatataagaggggggatagaggaagggaggtataggttaaaaagtatttgttaggtattgtgtttattttttagatgaaaggtttaattatattttaaatatcggtattatataatgtattttagtaataaatttgtatatgtatttttagaatttaaaataaaagttgaaaataagagagaaattattagattgggtttttgaatttaaaaaaattagttttagtaatatttggttataaatttgataatgttataagattaagttttatttgattgtttatattaaaaataaagttatattttggattgattataatatattttaaaatgaagtgaataaaaatatttagttttaagagaaaaataagtaagttttttaaaaaaaaatatttaggattattattaaaaattttatttgtttttaaatgttaggttttttaagtagtgaaggttatttttttaaaataaattttgagatttatttggtatggggtaagagtataaaaatatattatttggagttttaagttatatttatggagagatttgggtaaagttattttggggttattatcgaaattgtttggtttaggggaagtattttgatgaataagagaatatttttgaaggttgttaaaaaaaaagtgtgaaatatatggtttatttgtattgtaagtgttagggtttgttaaagatttttggtatacgtatatattaggttaaataaagattttatgtatattgaggttagtttaatataaaaatgatagttttatagtgaaattatatatataaattttaagaatttttttaagttttttttttaatttatttataagtagaattggattatttatatgatatgtgttatacggtatatattatagtaggaaataataaattagaatttttttttattatgtagtataaaaatggatataaagtaaattatggttttatttaaaggtgtttttaataattagggtttaaaaagtagaagaatgtatattaaagattaatatgtagtagtttttaataaatgttaatttttatattaattggatacgttatattgattataaaagtatataattggttatttttaatataatattttgagaaattgtagtttaaattgtatgtttaaattttttttttttttttttttttttttttttttttttttttgagacggagtttcgttttgtcgtttaggttggagtgtagtggcgcgattttggtttattgtaagttttaatttttgggttgatgttatttttttgttttagtttttcgagtagttgggattataggcgttcgttattacgtttggttaattttttgtatttttagtagagacggggttttatcgtgttagttaggatagtttcgattttttgatttcgtgatttatttgtttaggttttttaaagtgttgggattataggtatgagttatcgcgtttaatcgtatgtttaaattttatttatgtaagaaaaatttttgatgtttaataaaagatttaattggaaatggtagtgatggtataattaatagaaaaattagatgttagttattgtttggggtcgttttttagtatagtaagggtaaagggtattgtaattgttattaaattgtaagaaggaggaaaaaatggatagatttcgtagtttagtttattaaaattattattttgtagttgatatatttttttttttttgatgaaagaaggtttttatagtttggatagggagaaattgtttagaaaaatattatatatttaaaattttaaagattttaaattttatatgtatttagaaaagtatttaaaaatgttattgggtaagtaattataatatattagagatacgatagaattttatttgggtttgttttttgagttttatttaaaatttatttcgaaatataaaataggtaaaatgaaaaaatgaagattagagataattgggatcggagaaaataaattaaagggtattaaaaatttaagtgttttaatatatatttaaatggttaaagtatattatatatataggagattagagagtagtaagatgaaattgggtaaaatttgggtagagatttggtatttaagaaagtggggaatattgtttttataataaaaataaattatttttgtggaattgaaagtaaatttttgtgtgtattttttagttaatttttatagtttttataatatttataagaaagtgggtagttattattttatgtaaattaatgtttaatatgttgatattttgtagttaagtttaaatagtttggttaaacgtagatagagttgtgtgtgtggtttggggaattagattttttatagttatatttataaatttattttttatttaataagatgtttatatatagtgtgtgttagatagtattaataattagttttttttattaaaagaattatataggttagttgtagtggtttatatttgtaatattagtattttgggaggttacgttgggaggattatttaaggttaggagttagatattagtttgggaatatagtaagatttttttgtttttataaaaaattaaaataaaaattaaaaaaaaattagttgggtatggtagtgtatattcgtagttttattgggtgggaagatggtttgagtttaggagtttaaggttgtagtgagttatgtttatgttattgtattttagtttgggtgataagagttagattttgtttttaaaataataataattattataattataaaaggaattatatggtttttatttttttttagtattgttattttttatttggaggattgttatatttatttaattggtttttttatgtaagattagtttttgtaaaatataaatttgattatgtttttgtttttattttttatttatttaatttttatttagtttatagatttaaaatttaatgttattttttttttgatttttaagatagaattaggtgattttttttttgtttttgtggttttatgttttttatggtgtgttatgttattttgtgattgattttgtaatttaattagtagataaattatttgaatataggtattattttatttattttatatttagtgattgttttgttggtgtatatttgttgaataaaagtgttaattttataataaatattaagtatatgtgttatgagattattattatttttatagaatttgtaattttaattatagtagaattttaaattttttttagaggaaaattttttaatgttgagattagtgttaattatataatttgttatataaatagggatatgaaattttaatttataattagttttaggtttttttttttttttttttttttaagacggagttttgttttgtcgttaagttggagtatagtggtgtgatttcggtttattgtaatttttgtttttcgggtttaagtgatttttttgttttagttttttgagtagttgggattataggtgatattattacgtttcgttaatttttgtgtttttagtagagatagggttttattatgttagttaggatgattttgattttttgatttcgtgattcgtttgttttggttttttaaagtgcggggagattaagaaatttttttagaaattttttattgttgtgtgtatttaggttatggagttgaacgttttttttgattgagtagttttttaaatatttattttatagaatttgtaagtggatatttggagcgttttgaggtttacggtggaaaaggtaatatttttatataaaaattagatagaaggatttttataaatttcggggattataggcgtgagttattgtattcggtttaggttttttttttatttgaaaattaaaataaaatttatttagtttttttttgaggtttttttttttttattatttttcgtttgaagatttgtaataaaatatagatttttaagtaaaaggtatgtttttaaaaggtaaatagaaaaatggatatgtaaatatgtttgatatagaaatatttttaattttagggaatagttttgaggttgaaaaaaggagtaagaataataaagttgttgtatgttgtgtaagttttattattatataattttttttttttgtatatagtttggttgtattgaatttagtgtgtgtaagaagaattggtggataaataaataatatgatatatttatgaaaaaaattttttatttttattgggtagtaatattatgttagttaagtatatatatattgaattgattatattaattatatttgtttacgtgtatttttaaaagtaaaatgataaatttttataagttatagagataaataattgtttttagatatttatattattttttaggtttattttagtttgaagatattttcgatagcggtatgttgggtagtttttttttcgaattttatcgatgatgtaattattttttttagtatataggtaattgtgttgttttatatggaataaaaggtattattaaagttttataggtttttaaatatattttataaggatagtttttgtttttgttttcggtggaatataattaagatatttataggtattgttttgagggaatgtttttgtttatattgttattatgaggtcgagaggttaaaaataataaaaagagtttttttttttttgtttaataaattgaaaatagtgtaataaaaaattttattgtagtatttatatataaaaaaagtatataaattagtgaattatttaataaatttttataaattaagaatttttatgtaattagtttttagattaagaaatagaatagtattttaataggttttttttttgtttaattttagttagtatttattaagggtaattatttttttgataaattgtgttttatatagtttgatagattatgtttttttatttttatttttttgagatggagtttcgttttgtcgtttaggttgggagtgtagtagtgtagtggtatgattttattgtaatttttgttttttaggtttaagtaatttttttggtttagattttcgagtagttgggattataggtgtacgttattacgtttggttaatttttatatttttagtagagatagggttttattatgttggttaggattgtttcgattttaggatttcgtgatttattcgtttcggtttttcgatgtgttgggattataggtatgagttattacgtttagttaatagattgtgttttaaataaataatagtttggggtagatggttaattgtattaggtttaattttttgtaaagaataggttataaaattgattattagattataatttatttttgtttagagttgttttttaatgttaaatatttgtattagttgttttaatttttttttgtattttataaatattttagtttttttatttggatagaaaatggaagtattaatttaattttattttttataaattaaaagtacgattaatagatatatttattgatgaagtggttataatataaaaaagttatattttataaggaatttttaaattattgttttatagttattggaagaaaaaaagaaaaaaaattatttattgttaaaaatgaaaaattttaaagttttgtttatatttaattgaaatgttaggatgtgtatattacgttaattttgatttttttattttaggtatgttttgtgtatagttaagattttgagttataggattagaggtaatgtatttttataagttaaaaatagttttttgtggttattagtatgaagttggataagtttatttatttgttttttatttataaaatgaggagttttaattagtatttattattttataatatatggttacgtataattaatagttattttttgttaatttatttatttattttttgatttatttatttatttatttttagataagtttttgttacgttgtttaggttggagtatagtggtgtgttatagttttttgtagtttgaattttttgttttagttttttgagtagttgagattataggtgcgatgtttggataacgtttttttttttttttttttttttgtagagacggggtttcgttatgttgtttaggttggttttaaattttaggttttaagtaatttttttattttggttttttaaattgttgggataataggtgtgagttatagtgtatagtttattttttttgagttatagtgtttagtttatttttttgttaatttttttgataagataatgagatattttattttggagtttttgtgttttttattatttggtaaattttttttttaattaatagaaagatgagtttttaagttagttgaaattttgtgattttgttttgtttatatggtatttatttttgtggttaaagtttatttttggtaaataattttggttttttatttatggtgggtgtggtagttagttttttaagatggtttttagtgatttttgtttttttgaatgtatggttttgtgtagttttttttcgttttttattaagattggtttgtgtggttaataaaatatggtagaagtgatggtatgttatatgtgaaattagataataaaagataatagttttgttgtattgattatatatttttttggattatttgttatgggggatgtaaattataatgttatttacgttattttatagagattataaggatgttagttttggttagtgtagtagttttatttattgattagagttaaaagtaaagtttatttttgtttagtgtaaagttttgaataaagtgtaataatttgttgatatttatattatattatgttaattttgagggataatttataattttagtaggtattaagaatggagtgttaagtgtaagatatttttaatttataatgggtttatttggaggtaattttattgtaagtcgaggagttatattgaatgcgtattatttttttattattataaaagttgaaaaatcgttaagttagggattgttcgtattattattattattgtatttatatcgtggaaatatttaagtagttaagaaagtgaggagtaaagtgaggatacgaagacgtttttgttttttgcgtatgtgttaagtaatatttattttattaggagtaatgtataaagtagggttgggttttatttttgattttaattaataggtgggattattatattggttaaagttgttatttttgtaatttttgtggtgtaatatgagtaattttataatttgttaatgtattaaaaagtaaaataaaagaaaatgatttatttaatttttatggatatgtaaatataatatgagataaataataataatttttatatagtgaatgaataattgtttttttaaaaaattaatataattagagttttaggttaagttatttttaaattgttttagaaataattaaattatatgataattttttttttagaggagttattggtagtattaggatattttagatttttttttaataaatttgttatggaatgaattttttattttttagggagataatgttgttgttttgttagtagtttgaatttataataaagtaagatttgtgttaatataatatttatatagtgaaattagtttttttaaaatattttttttgatttttttaggtcgagttttttttttttttatttatattataatttttgtattttgttattgttaatttattttttattttagtggagtgtgattttttagagggtaaggattaggttttattggtatttatattatttagtatagtgttttggtttaatagaaaaaaaaaatgaataagaaatgaaatgaatatttttttttttttttgttatagtttttattgtgatttatttttgttaggttagtaaagttggtgattttgaaatttattagtttatggaagttaaagtttatgtttttaatataatgaatattatgttatgtttaaatttaatattattattttatatgatagtatttttttatagtgttattttatgttttttgattaaatttttagatattaatttgtatttttttattttattttagatttttttgtattgttgttttaaatatttttttgtttattagaggatttaggagttatttttttttttttttttaattgatatttagttttttatgggttttgtatataatggaaattttaaaatttattttgagaaatgaaaattaagtagaggaaaaataaattttttaaaatatatattattttttattgtttttttgaagaaaattttatagtttttataagttaagattttataatgatattttgaagttttattagagtatattaggtagagtttgggaggtggttttgttgttgttgttgaggagttggatggaggagagtttatatttggttttatgttggggttaaagaaggggaagaatagtgttatgatttaattgttaaaggaatattaaaatatagtttttttagttttttattttatagttagaatgtttatagtgaattttggttttaagtgttagtaggtattaaaatattttagttaaatatatttaaattatgttatatttttttttaaataaaattaagaatgaggttattttttttgaagtgtttttaaaatagaatggtgtggttttggtttatttttttttttttttttttttttttttagatgtttaggatttatttttataattacgtttattaaggtgttatatatagtaatatttattgttttttaagtttataatttatggtttttgttaaatgaatatttatgtaattattattataattaggagagaggatatttttattattttaaaaagatgttttttatgtttttaattgtttaggttataattttttttttaattttaagattttatataggtattttttaaaatttaattaagtgttattataattttatttatgttttttattagagttaaaatttttttataattttaaagtttttgttttatgtttttaatttttaatgttattttggttgaaattataattttatatgatttagagaagattgatttagaaatattttttataatttttttgtttggtttgtagtaagattggataaagtattaggtttttaaaagtgagttttattttgtttattttattttatgattgtttggtttgaagaagaagatagaaatgtgaatttgttttttttattaggtttttaatattttttatagttttattataaagagtgtaggtttagtgattattagttgtttaaaagataatttgttgttttaaaaatttttaattttaaaaaaaattggaaagaattgtataatggatatatattttttattaatatttattaagttttaatattttgttatatttaatgataaagatatatttttataaattaatgaaatagtgatttttttattattggaggaaaaattaattattgtattttatattatatgatataatggtttttaatgttgtatttttttaaggaattttttttttacgtgttgattttagaattaaaattgtattatgtagttaaaatgattttgtagttttttgtttgtaattagagattgtttattttatttttggttgtgtttttaagtaaatttttaaaaatatggatgttggtaatttgttgattttggaattttatatattaaagttcgttttgtttattatttatataagtttataaatatattagtatttttttttaaattttttttaatttgttttttttttaaaaaagatggaatttagaaataaatttaaattgggtgttcgttgtttttgttattttttattattttttgtttttatttattttagttaataatagtagtaagttttaattataaatatgtttaaattaatttatagagtaaagtaatttaaaatttttttttagttattaatttggttagaaattatatttattaagtaatgtagtttgttgttaatgtttcgtttaggaataaaagttaaaaggtaataataatggaatgataattttttttataaatgttattttaagtaattaagttagtaaatttaaacgatcgttttaaattttatttttaaatgaagttttttgaattttgttaattgtttgtttatttaataggtttagttaataggatagtatttttattattttaattttgggaaaaggttttagggttttatattgttttttgaatattgttaagaagaatttgtagatgttttcgtattataaggtatttattttttgttagatttgggcgagtggattgattatacgtcgaaagtttgtaatagaataatttgaaatgattttgttgtaggttcggtataggttatttttgattaatggaaatttgtgattaatgtagaggagttgttttgggttagagttttttagagaagtaggaaggttttggaatagtgaatggtgcgataatgtgttggggaagtaaaaatttttttggtttttattttgaagatatttttatttttgtttagttagtttttgttatttgatatttatttttagggattaaatagttgtttgtatattagtttatagaaaacgagtgtattgtttaaaggttaggatagtattttgtaatgtttattttattaattatatatatatatatatgtatatatagtatgtatttatattttaaataatagtttgtagtatttcgtagttttagtttttaataattttgtgaaaatgatattattatttttggatgcggttatacgggtcgtggtaggtggtttattagggagtttatttacggtgaagttgatatattttagattttagttgtattattttatagtttttgttattttgggtaggtatttattattttgatttttgagtttttttattagtaaattgggaaggatattatttgtgtgtgtgttgtgaaaataaggtaatatatagaaaatttattataagtttttgtttttagtaggtatttaatatatgttttttttttttttttaggaatattgaagattttatgagtaagtattatataaatggaaggtagtattaagtttaaattttaggatcgtatttttaaatttttagatattataatgtatgtaaaatatgtttaggttatttaattgtaagttatagatgataagggaaagtaaaaatgaataaatggattgatagtatagtagttgaaaatttggaattttaattaggtttttggtatttttttaggtagtcgttttgggttatattagataagaattgagtatatggaaagttgttagatgtattatagatatcggtgaaaaaagttaatttttgttatataaataggaggagtaagatagtttataatgaatattattggaaaaaatggatgaatgttaaatggtatttagttgtaagtttgatattgttaaaagggttagggtataataaaatggttagaatttaagagaaaattatatggaattgatattttttattaaggatatatggtagaaggaattaaaagtatattatagtaagagtgtatattttattttttttgaatgggaaagttaaaatattttggttttaagggtattattatttgtaatagttattgattgtttaatgtgtgtttatttatagttgtgttaaatattttgagaatgttaagaagttttattatgaattattgttagggtgtttgtttttaagtgaggaatttttggaataaaatgttttgttttaggtgaatatttgaatgttggtggtttttaattagaatggtaaatgtagtagaaatcgaataatttttgaggttgagtttatgttagagtttagagagagaaaattatgtataaagttagatatgtttatttagttttgttgtaagtaaagtaattgttataaggaggattatgggtgaaagttatggatggattatgagttaattatatatttagagaagtatgtaaaatgtgtaggtaaattatatttatttatttaggtagacgttttttggtatttgaatgaaaggtaagtattgtgaggatttagtattatgttataaatgataacgaattttgaaattttggtttaggatggagtattagaatattttgtagtcgttttttgtgttttagtattattacgaagagaattagttttatatatagataaatttgggtttaaattttagttttagtgttttaatagttgtgatagtggttagttgatttaatttttttgagtttatttttttattagtgttattttagggggtttgtgtggattatatatattagagttatataaagtattgttatatatttggtgattattatataataggtttttattttatttttaaggattattttttttttttttggaggattttagggaaagagaagtgttatagttttttttatgagtttgtagaaggttaatggttttttagaaatttaagtttaggtaattatagattgttttttttgattattatattaaaattggataatttcgttttttaaaggttttagtattgtaatgtggaatttaaaattgttattaatgaatttttgattgttatattgaaatatgttagtttattttgtattttgaatgtattttttatttatgtatgattttgtattattatgtattagttatttggaaaatattggtttattgagttatgtagattttttaaatgttgatatagtttattatgtaatataaaagagttatatttgttaagtttatagtggtagatataagtttttaaaaattttgatttttgtttgaaatttatattttattaattggtaataaatattttaagttgttttttttaaagtgttaagtttattttagttatttttgggaaaatatcgttaaatatttaaggttgaaaattagagtttattttttatggtattttatgaaaaaaagtaggttaatttatagtttaattttatatatttttttttgagataattattaaatgttatatgcgatataagtggattatgtatttttttattttgttatattgatatgagaaagattatatgtatttaagggttgaaatttaatgtaattaataatttttttgtttttttaaagattttaagtgtatgatagtgaatatagtaattattgtatattaagatgttaatagttttatttatttttgtttttgtattattattgtaaatgttgatataatgaaatggtaaataaagtacgtgttattgtgaaaatagtttgttttttaaggggagatttttagggttttatggattatattggaagaattgttgttatggagattagtaaggtaaagattttaaattagataggttataatttataatttaattttataatgtaatagtttggtgattttttaattttttttaattttaattgttttattgttaataggaatggtaatgtatttgataaaaggatatagtatcgtttattaaattagaggtttttttgatagagaaaggggtagagttggtaaattattatttaaatgatatgattggtttagtttttaatttaagtgaattaattagtaattttttagtgtaatgtaagaaatttatttgggagaaaaaaaataaagatattattattttagaaagtaagtgttaatatggaaaaaaattttagaaatatagttgttataattggattaattttttataattattaatagaatatttttattggtttgttagtttttgtttaaatatcgtaatatagtagtttttaatagagagtaattttgttttttaggagatatttggtagtgtttgaaaatatttttggttattacggttggggaaatgttattggtatttaagtgagaagaggcgagggatgttgttaattagtttataaggtataggatagtttttattataaagaagtatttagttttaaatgttaataatgttgaggatgagaaaatttggttataaagttttaagtaatataaagtggaaaagaaaaaaaaaaagggattagaaatattttaaaatttaaattatgtttaaaaatgtaataattgtattattgaagtagttttaaatagtttatttaagataagtttaaaaagagatttaaaatagaattgaagttaagttatggattatacggtttagttattaagtataggattggtttgagttagtaatttttttttttttttagcgttagtattaaaaggtagtttttatatattaaagttatttgtattttttttatttttgtttattaggaaaaatgtaaatatttagttgtatatattaggtgattatattttttgattgtttatttatttttgtattagttaaagaattattgatttgtttgataataagttatggaatagtttttaaattaaatagaaaaatgttttaggggaaattttttataatatttttgttaaatggttttagtagaatatattttattttatttaataagttaaagaaagattgattattttttttgttttgtatttattgagagaggtttgtattggttttaattttaggtttttattaagatagtttatttaaattttgtattatttatatttattttttttggggagagggttatagtaataaaatttatatattaatagattaagagaatgtttagtaaaggattttttagatttttaagatattagtggtttattatttagtgtttttgggtttggtttttttgtttgtaaaacgaaggttttgatttaattaattttaaataagttggttatattttgtaagatgggtttggggatggaaaagtggagaggaaaatatttggatttgtaaagggttttttaggttttgtgtatttatttgtagagagaatataattatgttatttatgttatttaaagtttaatttgttttatagaaataatgtattttttttttattggaagaattaatttagtttggttattgtgtttgggtaatttattttttaatagttgtatttttttttgttttttaaattaagtgttaaagatggagaaaaatagaataagttttgagattttaagtattttttttttaggttgtgtgttattagttttgtttgtttaggtttgtattaggggatgcgagttttaagtagaagtaataatagtatattgaatggtaaatagaatattaagaattagtatggtaagaagaaagattaaaaattttttgatcgtatagttatttttagaatgaagatcggattttgtttttattttatggttttttatatataagagtatataaggataatagatggtttataatttagaattaggaatatgatgtttttagagaaggtaagaatatgttggagataatagtgtagttattgattttttttaataaggtatttcgagtatttttgaaatgttatttgtgtttattttaaatataatagtaatttatttttaaatattttattcgatttttaaagagagatttgaattttttttattatatttagtaatttagatttatatgtagagattttgttaattttaatttattttttatattttatttattattttttgtaatattatgttaggatttatttttttttatttattttgatcgttgttattttaatgtatgtttttttttattttttgttttaattattgtaatggttgatattaagtagtttttttggtattggtttttttttttattttattttttatatattgttaaaattttttttttaatatgattaaaaatttgaagggtttttttattgtttatagtataagtttagtatggtttataatttggtttttttatttttttagttatatgttttattatttttttatataatttatgtagtttttttattattatagggattttggattttataaatatttattaagtatttatgataggagtagtttttgttaagatttgttttttttgtttgaagtgtttattatggtatttttgatttatgatagtttttagattttttaaaatattgttatatagtattttgtatagatgattttatgttattttttgatgtatatgtattttgtttttattaataattttttttaggtagggtttatgttttgggtttttttatatcgttagtattttgtataaagtttagtatatgtttatttattttttttatttatattttttatttttatttgttttgtaaaagaattttgagatagttaatatggtaaatatttatgagattataattagaatataggtataattttattattatttggtattattatgtaagttttttttttgtatagattattttatttaattttttttatagatttaagaggtgggtattatttttagtatttatagatgaagaaataagatttagaaaagttgagttgtttaaagtgatttaagtaattagtaaagttagggtttaaatttaggtttttttgatattaatattagtgtttttaagtaattttttttattttttattatgataaagtgttagaattgagaagttgaggtatatttaggtttttaatttgagaaataatattttttattttgtaggttgaagtttgatgttttgatgatataatgtaaaaaaggtggtaattttttttttgtgtttgtttttaattatgatttgtaaatgaagatttttgtttaaatagggattgttagattaggttaaataggtaaaaatatttgttttaaaattgtgtgacgatttgtgttatttgattaaatttttaaatgttttttaaattaatagatattttatattgtataattagtagtttttaaattttaaaaagatatttataaaaataaatggaaatgtagaatagttgtgtttatatttatattaatataaaggaaggaaaaggaatttttagaattaattttaatttgatttaaagttatattattttttttttttttttaaaggtaaaggtttaattttttaatttttagatttttatattaatttgagaattttttggtttttttgttatgttagtatattagataagttttttttgttatttggattttttttaggttttgatgttgttgtttttattttatatttaggtttttatatatttattgaaataatttaaaggaataattttaggtataggattttttatttatttgtggttttatttttgatagttttaggtatttgtagttaattatagtttgaaaatattaagtggaaaattttagaaataattaataagttttaaattttgtgtaattttgagtaatgaaattttatgttttggaacgtgaattatttttttgtttagtatatttatattggagacgttttttgtcggttagttttttattagttatttgtattagttgtttttatattgttgataaagatatatttaaaattgggaagaaaaagaggtttaattggatttatagttttatatggttggggaagttttagaattatggtaggaggtgaaaggtattttttatatggtggtggtaagagaaaaatgaggaagaggtaaaagttttggaaatttttgataaatttatgagatttcgttagttttatttattattatgagaatagtataggaaagattagtttttatgatttaattattgtatttttattttcgggttttttttataatatatgggaattttgggatatataatttaagttgagattagggtggggatatagttaaattatattattttatttttggtttttttaaattttatgtttttatattttaaaattaattatgtttttttaatagttttttaaagttttagtttattttagtattaatttagaagtttatagtttaaagttttatttgagataaggttagtaagttttttttgtttatgagtttataaaattaaaagtaagttagttatttttagatataagggtcggagggatggggggtagggggtaggggggtgttataggttaaatatagttgttttaaatgggagaaattggttaaaataaaggggttacggggtttatgtaagtttgaaatttagtgagttagttaaattttaaagttttaaaatgattttttttgattttaggttttatatttaggttatgttgatgtaaaagatggatttttatggttttgggtagtttcgtttttgtgattttgtagtttatttttcggttgtttttataggttggtattgagtgtttgtggtttttttaggtatatggtgtaagttgttggtggatttattattttggggtttggaggatgacggttttttttttatagttttattgggtagtgttttagtagggattttgtgtgagggttttaattttatattttttttttgtattgttttagtaaaggttttttatgatagttttgttttgtagtaatatttttgtttgggtatttaggtgtttttatacgttttttaaaatttaggtagaggtttttaaattttaatttttgatttttgtgtatttataggtttagtattatgtggaagttgttaaggtttggggtttttattttttgaagttatagtttgagttttatattggttttttttagttatagttggagtagttgggatatagggtataaagtttttagtttatatatagtatgaggatcgtgggtttggtttacgaaattattttttttttttgggtttttgggtttgtgatgggaagggttgttgtgaaggtttttgatatggttatggagatattttttttatggttttggggattaatattaggttttttgttatttatgtaaatatttgtagttagttttaatttttttttaaaaaatgggtttttttttttaattgtattgttaggttgtaaattttttgaagttttatgttgttttttttttaaaatagaatgtttttaatagtatcgaagttattttttgagtgttttgttgtttagaaattttttttattagatattttaaattattttttttaagtttaaagttttataaatttttagggtagaggtaaaatgttgttagtttttttgttaaaatataatatagtaatttttgttttagtttttaaaaagtttttaatatttatttgagattattttagtttggattttattgtttatattattattagtatgttggttaaagttatttaatatgtttttaggaggtttttaatttttttatattttttcgtttttttttgagttttttaaagttttaaagtcgtttttatatttttgggtatttttttagtaatatttattttattggtattaatttattgtattagtttatttttatgtttgtgataaagatatatttaaaattgggaataaaaagaggtttaattggatttagagttttatagggttggggaggttttagaattatggcgggaggtaaaaggtattttttatatggtggtggtaaaagaaaaatgaggaagaggtaaaaggggaaatttttgataaatttattagattatgtgagatttattaattattacgagaatagtaagggaaagattagattttgtgatttaattagttttttttgggttttttttataatatataggaattttgggagatataatttacgttgagattttggtgaggatatagttaaatcgtattattatttttgttattagttggattgttatagtattatagtgtttgtgtttaagtaatttttattttatttaatggtggttttaaagtataagaatagtgatgttggaatattgttataattgttttattttattattagttattattatttttttattttttttaattagtaggttaaatattaattataggtatgtatgtataggaaaaataatatatatataggatttgggattatttgtggtttgtggttttaagtatatattaggggttttggaatttattttttatgaataaggggtgggggttgttatatttagtaaataatgaaaatattggtaattttatttttagaagattaaggaggaaagaaatagtttttaaaattatataaaagttatatagtagatatttgtaatatagttagttagataaaaaatttaagattgaaaaaagtttttagtaggtgaaataaaatattttttttataataataattatattggaaattattgatttgtaattttgtgtgttaagttgtatgtttaggtatagtatataaataaattattttaaataatttttattgagtttattttatagataagaatataaaaattgggttttttatttgtttaaagtcgtattataaggtaatatttggatttgaatttagttttgtttaattttaaaatttatgtattttataattttgtgattgttgtttggtaggggtttgtagagtagtatttattaagtttgatagagttttttaagattatgtgggttatttaatagatagttttaaggtaaggttaaatattaaagttaatttttgttttttatttattttgttttttttattttttatattataatggagtataaattataattaagagatataaaagtatttagttatttttatttttttttttagatatttattatattaagttttaaatgaatatattggtattttaaattattaagataatgttatgttggttattgaaatgttaaattaatatgaagattatattttaaaaatataaaagtataaataggagtgttttgtatatttatattacgatttttgtttttagaggaattttgaagtatattgttatatgtttgattaatgtatttaattttggaatttttggggaagtatttgtttttttttgaaatatattgttttattaaagtattaaattgggtatatatgatgatatgaaaagtattttttaaattatagttaatttaagtaaaatgaatttaatattatatagttttaattagaaatgagatgttttgttatattattagttttgttaatagaagttgagtgaatagatttatatttattaattagaaaaaagtataggtataaattaatatgttatttgatgtgagtagattgagaaagttaataaatttttagttatttaatttaaaggatattgaagtattataatgtatatatttaatttgattatataataatagttgttatttatttagtatttttttatttatatattttgtaatttttattattattttgtattagtttattttgatattgttataaagatattatttgagattgggtaatttatacggaaaggaggtttaattgatttatagttttgtatggttggggaggttttaggaaatttatgattatggtggaaggggtaggggaagtaagatacgttttatttggtagtaggagagagaaagagtataagggaaattgttatatttaaattattaatttttttgagaattttttattataagaatagtatggaaaaaatttttttatgatttaattgttttttattaggttttttttttaaaatatgcgggttataatttaagattagatttgggtggggatatagagttaaattatattattttgtatttgtttttttttaaattttatgtttttttatattttaaaattaattatgtttttataatagttttttaaagttttattatagtattaatttaaaagtttaagattaaagttttatttgagatatggtaagttttttttacgtatgagtttataaaattaaaagtaagttagttatttttaagatataatgagggaataggtattgggtaaatgtttttgttttaaatgggagaaattggttaaattaagggttataggttttatgaaatttgaaatttagttgggtagtttttaaatttaaaagttttaaaattttttttgattttatgttttatatttagggtatattgaagtaaggggtgggtttttatatttttgggtagtttcgtttttgtggtttagtagggtatttttgtggtttttataggttggtattttgtggtttttttagacgtatattgtaaattgtcggtgaatttatttttttggggtttggaggatagaggttttttttttatagttttattaggtagtgttttagtggggattttgtatgagggatttaattttatatttttttttcgtattgttttagtagaggttttttatgaaggttttgtttttatggtagatttttgtttggatatttaggcgtttttatatatttttttaaatataggtataggtttttaaattttaatttttgttttttgcgtatttgtaggtttaatattacgtgaaagttgttaaagtttggggtttgtattttttgaagtaatggtgcgagttgtaatttggttttttatagttatagttggagttggagtattagggatgtagggtattatgtcgtgaggttgtatagagtagtaaggttttgagtaggaaattattttttttttttagtttttaggtttgtgatgggaggggttgtttcgaagatttttgttatgttttggagatattttttttattgttttggttattaatatttggttttttgttatttattatttattattttttatttattattatttattattttttgttatttatttagatttttgtagttggtttgaatttttttttagaaaatggggtttttttttttattatatggttaggttgtaaattttttaaatttttatgttttgttttatttttaaatttaagttttaattttagattatattttcgtgaatgtatatgattgaacgtttttagaattagttaagttattattaggatgttttgttgtttagaaatttttttttgttaaatattttaaattattttaaagtttattagttttttagggtaggggtaaaatgttgttagtttttttgttaaagtatagtaaaaataatttttgttttagtttttaataagttttttatttttgggattattttagtttggattttattgtttacgttattattagtattttggttaaaagtatttaaaataagtttttaggacgttttaaatttttttatattttttagtttttttttgagttttttaaattgttttaattattgtttgttatttagttttaaagttattttcgtatttttagattatttttatagtagtatttaattttgttagtattaattttttgtattagttagtttttatattattataaagaatatttgagattgggtaatttataagggaggtttaatttatttatagttttgtatagttggggaggttttaagaaatatataattatggtagaaggtaaagaggaagtaaggaaagttttatatggtggtaggagagagagaaagtataggggaaattgttatatttaaattattagatgttttgcgattttttatattattacgagaatagtatggaggaaattatttttatgatttaaatattttatattaggttttttttttaatatatggggattataatttaagataagatttgggtggggatatagagttaaattatattatattttgaaagtaggtatttttaattttatttgatagatgtagaaattaggatttagaaatgttagagaattggttttagaatattatattatatatttattaagaggtaaaatttaaatttgtatttaagattttaagtttattgttgttttatttttttgtatatgttaatagtaaaagtttggtttttaaattgtattatagattaagatagattaaattagaataatattataataattagaggatgttagaatttttttattttatagaaataaaggttaaatgatatttaaagtaataggtattataggtaagaaattaatatttttttttaaatattaatatttatgtattatttttttattttgtattttttagatatagataaaagggttgattatattttttttaaatatgtgaattgttttaaaatttaatatttttttatattttggtgagatttttttggtaaattatataattaaatattagttaaaatatattaaaaaatgtattgtggtgttgtatataatgtatatgtattttgatttttatatatttgtttatatatatatttgttaatttataataatagagtgatgtgttaagtaaattatcgtgtagttttatttttgaaaatttaataatagaatataagttttgttttttatagtttaagtaagtataggttattgtggtttattttagaatatttattagaaaagtaacgtgttttttttaaaatgttatttgttaatattttagaaattgtatgttaaataaagaagaaatatttaaagtaagtgatgatgtaatttttgttttaaaattttagggatattttgtataatgtaaaaattttaagggtatatttagtattttttttgagaaagaataaatggtagttattgttgtagtgggagatgtgtaatgtggaagttttaaaattgataaatatttataagtaaaataatagtaaataatattttttttttttttaaaataatcgttagatttataagtgaaattaatattgtatttttttaaatttgttttaaaagttttgttagagtttgtatttttataaaagtattgtaaaaattaattttaataaattaaattttttttgaaaagaattaaaaggaataagaatgtgaatgttagttataagaaagtatttttaaaattgtgtttttatataagtagttttgtatgtaggaaatagaaattgttgagtattattgtagattggatattgttgttaatagttttaaagtttaagagaagtggaatttttgaaaataaaagttattatttaaaattttaattattaatataatttttagagttgttatttttaataaaattatttttgaaaaaattttataagtaaaaatagttaaatataataataaagaattgtaggggatagaaagaatcgatattgttaaaatcgttatattgtttaaagtaattagcgggtttagtgttattgtttttaaaatattaatgatatttattatagaattagaaaaaaattattttaaaatttatatagaattaaaaaagggtataaatagttaaagtaattttaagttaaaagaataaagttggaggtatcgtattattcgattttaaattattataaggttaaagtaattaaaatagtatggtattggtataaaatagatatatagattaatgtaatagaatagagtttagaaataagattatatatttaaaattatttaatttttaataaagttaataaaaataagtaatggggaaaggattttttatttaataaatggtgttgggatattattttatattagttagaatagttattattaaaaagttagaaaataatagattttggtgaggttgtagagaaagggaaatgtttatatatttttggtggaagtgtaaattaatttagttattgtggaaagtagtttgatgattttttaaagaatttaaaatagaattattattcgatttagtaattttattattgggtatatatttagaggaatataaatgattttattataaagacgtatgtatgtgtatgtttattgtagtattatttataatagtaaagatatagaattaatttaaaagtttattaatagaagattgtataaagaaaatgtggtatatatatattatggaattttatatagcgataaaaagaatgaaattatgttttttgcggtaatatggatggagttggtagttattattttaagtaaattaatataggaatagaaaattaaatattatatgttttttttagttataattaggaattaaatattgagtatatagggatataaagaagggaaggatagatattggggtttatttgagggtgggaagagaatgaagattaaaaatttatttattaagtattgtgtttattttttgggtgatgaaataatttgtatagtaaatttttgtggtataaaatttgtttatataataaatttgtatatgtatttttgaatttaaaataaaagtttaataaaaaagaattgtagggttttttggggagtgggtaggggagaaaaggaattaataaaataatgattatgataaaatttttatttatagtttaaaattagaatataaaatatttaattatttgttaaaatatgaattataaaattgatattttaaggataagttattaatttgtagtataaatagttgataattttagattaaatgtgttattgttgataaatgatttatatttttaatattgaaagttgataagtatttagaatattaaaataatatattataatatagattgttaaatattaggtggatagttagtgtatgagtttagttgtattaggattattttaagaaagttcgggtattttgagtgtttttttttttttttaatttataattttttgtaagaattatattgtggattataatatttgagttataaggattaagagtgtaattggggttcgttgggtgggggggcgggatagtattaggaaaaatagttaacgtatgtcgggtttaatatttgatgagttgataggtatagtaaattattatggttatatgtttatttatgtaatttgtatattttgtatatgtattttggaatttaaaataaaaattataattaaaaaaagaattgagtagttgtattattagaaagatggtagtagtaagatagaagaaaggaaaagggtttaggtttaagcgattggaattatttttatatgatttttggcggtagaaacgtgataaggtgcgttttagacgattagaagtgaaattttatgttttggaattgttagataaatattttttggtttttgttgtacgtatcgaaaggattgatggcgtgagtttacgggtgtagagaattattgtaagatttcgtttaaagaaaatttttagtggtatttttgtaaaagttattttttagaatttaaaaatgttgtatatagtggaattttatgtgatttggggatttttaaatttgaagtttgttcgagaatttattttgaaacgtggataagttaaggttaagaataagattatttttttgatagataatatagtgattgaggagtatttggggaagtttggttttatttgtttggaagattttatttatgaaattgtttttttagggaagtatttttaggagattttatggtttttgcgttttttttattttttagtggtttattatgttattaaaaatagagtgggtttttttaaggagatgggtatatttggttatcggggtgaacgtattaattagtttattcgttagttgaattagatttaggtgaggtagggttgaaaattgtttttgggttgatttttgataggttatgttttgttattttataagttttttttgtatttattagtatttaagagtaattttgagattgggaggaaagaggaggttggtataaatagatggagatttgttgggattagtgaatgtttgattaggatatggggttatgtatagtttaagagttataggtttaaagatgtcgagtaattaaaaattgtattgttggtcgggcgcggtggtttacgtttgtaattttagtattttgggaggttaaggcgggtagattatgaggttaggagattgagattattttggttaatatggtgaaattttgtttttattaaaaatataaaaatgagttgggtgtggtggtacgtgtttgtagttttagttattcgagaggttaaggtaggaaaatcgtttgaatttaggaggtagagattgtagtgagttaagattgcgttagtgtattttagttgggcgatagagcgagattttattttaaaaaataaataaataaataaataaataaataaaaaattattgttgtagttatttagatggaaatggggaaagaataatattaataattgattttaaaaaggatttgaagatgtgaattatttattttgttgaagaaattttaattttttgaaattattttttattgttgttgttatatttttaggtgataaattgcggtaaattttttattagtgaagtggaagtatgcgttttgttgttttgggaatttttattaagtatttttagagaagattattttttgttttatttttaaaaattggaaaggaagggttaaagaaaagatagtagttggtcggtcgtggtggtttatgtttgtaattttaatattttgggaggttgaggtaggtagattatttgaggttgggagttcgagattagtttgattaatatggagaaatgttatttttattaaaaatataaaaattagtcgggtatggtggtacgtgtttgtaattttagttatttaggaggttgaggtaggagaatcgtttgaatttgggaggtggaagttgtagtgagttgagattacgttattgtattttagtttgggtaataagcgaaattttgttttaaaaaaaaagaaaagatagtagtttatgtttatgttaagtattttttattatagtttagttttaaggaaaaattttagcgttttttatattgggtgttgtgttatttgaaatcggtatattttatggaggaaggagttttgttttgttgtatgtattttagggtttaatgttggtaaatgagttattttagtatttgtagaaggttttttgagatttttatagtagtcgattaagtttaaggatataattgaatttggagagttttggggttttgttttgataaagatttgaaatatatataggaagaaaggtataaaaataaatgtttatttgtttttgttgtgaaaaaaaaaaaaaagaattaagagtatagagagtaatagaaagagggagattttttaaattatattggaagtagtaagtttttttagttagtttgaggaggaattttgtttttgtttttgttttttaaaagggagtaaaagggtataaatagtttataagaagtatttatttgaaagtttaattttttttatagtgcgaaaaagaataaaataatattagaaaaggttattatgatttttgaaatgtagtataaagttaaaatttgaaaagaagaagaaatattgaattagataagggtatgtaatagagaatatgaggggtttatatttttttgatattgtagggagtagttgaaatgattggttgacgttatttgtgggttttggtttgaataggaggtaatttgattttttttttattagtattaagaaattatattatatatagtatagtggtatatgtcgaggtttttttagttgtaggttggttttattttttatttatgtgggaaaggaaaattgaataaatttaatatagttatgatttttatattgaggaaaattttttgtaattataaagtttaatttatgtttttatatttaattcgtagtttattttaagattattgttgtaaatttatttgttttaagattattgttgtaaatttatttagaattatatagttagatagaatgaaaaggtaatttgttaaatgaagttaaattggaagatatttttatattataaaaattataattatttagataatttagaaaatagtaaaaagtttaaattagaaaataaagtcgttatttttttgatagaaaattagtaaatatttttatatatagtttgtattttttaaaaaaattgtatttatttattttggggataataatataaatggttaatttgtattttgttttttatgtgtggtattatttatttgtatattttatattttgataaaatttttatgttaatagatattttatatgattttttagtagttgtaaagtatttggttgtaatttttattttttcgttattggttattttttggttttttattattataaatattattgtatatatttttgtaaatgtttgattatttttttaagttaaatttttagaagggattggaaagtcgatggataattttagggtttattatatggatttttaaattgtttttttttatttgttttaggaaaagtaggtaaaatatggatatatgtatttttttatattcgtttttaatagaaaataaatttggtgaattggttattgataaaatttgtttatttttttgttggggtgtttgtttttttttgattagtaagaatgttttggatgttaagtatttaaatatttagtttattgaggatatagttataaagtttttattttgaattaaaattttaaatattttaagtatgatgatataatttgtgatgtttagagttttggttgttgtttatatgataatttttttagttatatttttgtttgaagtgtatgtgagtttgaaaataaaatgattagttaaatgtagttttggttaaagatggtatatttaatatatgtttttattttagtttttttttaaatttagtatatgtttttaaaagtatatatttttaagaataaagagaagagataatattagtaatagtttataagatagaaagtagatggataaggattgttggttttttaagatttgttaagttattagtggggaaagttaagaagtaatttaattattatgaaaaaaaattttgaaaggtttaaaaattgggggtaaaggtaggggtttaaaattaggaagattggtttaaagtttgtttaagaatatttataggtttttttttatagaaatggtaggttagattatgagtgttaatttgtttgttaaaaattaaagtgttagataaaaaatatttttaaaaaatatttaggttaggcgcggtagtttatgtttgtaattttagtattttgggaggttaaagtaggtagattatttgacgtgaggagtttaagtgaggagtttaagtttagtttgttaatatggcgaaattttgtttttattaaatataaaaattagcgggtatggtggtatatttgtaattttagttattcgggttgttgagatagggaaaagtttgaatttaggaggtggaggttgtagtgagttaagattgtgtcgttgtattttagtttgggtgatagagtgagattttgttttaaaaaatatatatatatatatatatatatatatatatatatacgtatatgtgtgcgtatatatatatatatatttttttaaaagtattattaagttgataaaatgataaagaattaggttaaatttaaaggaaagtattttaagttatttgtgtttagagaataatagatttaggtaaatttggattttaattaaaaggatagaaaattagaaaaatggataaaaaaatttatattttataatataggaattttaaatggttaataaatatatgaaaagttatttagtttaattagtaattagggaaatgtaaattaaaacgataataaaataatttatatatttattagattgataaaaattaaatatttgataataagatgtgttttgagtttaaggatgtaattattttggaagatagtttggtattatttagtaaagttaaagataagaatgttttatgatgtagtaattttattaatagatatgtatttaaaaagaaatttatatttgtaaataaattaatgtgtatatatagtaaaatgtgtaagaatgttggtagtagtatttttttggttaaataaaaattataaattagttaaatgtttataatagtggaatgatttataaatatttatatattttatttttgaggatataattttatatagtaatgaataaacgatagttgtatattataatatgaatgaattttataatgttgaatgaaaaaagtaagatgtaaaatgatatatataatattttatttatataaaatttatatatatatgatattttattaatatggaatttaaaatatataaattgagttatattgtttaaggatgtttatataggtagtaagaaaaataagaaaataacgattatatttgttagggtagtggttatttttggggaggaggaataaaataggatttgtaaatttatatggttatattggaggtttttaaggtattggtaatattttattttttgttttggttggtaattatatattgttagttttattattattattttttattaaattgtatgtatggttatgtacgatataaattttagttaatgatggatagtatttatagtgatggttttataaaattataatggagttgaaaaagttttattatttagttgtagttgtgtattgtaatataatattatgtttatgtttgtggtgatgttggtataaataaatttatcgtgttattagttatagaaaagtatagtaaatataattgtgtatagtatataatattcgataatgataataaatgattatgttggtggtttatgtatttattgtattatattttttttattattttagagtgtattttttgtttttttttttttttgttaattgttaaatatttttagttaggttttttagtaggtatattagaaaaaggtattgttattatagaaaacgatagttttgtgtttgttattgtttttgaaggttttttagtgggataatatgtgaaggttgaatattgatgatattgattttgtataggtttaggttaatgtgtgtgtttgtgtattagtttttagtaatagttttaaaaataaaaatattttaaaaatggaaaaaagtttatagaagaaggatataaaattttttttatagttgtataatgtgtgtgttttaagttaagtgttattaaaaaggagttaaaatgttaaaaaaattaaaagtttataaagtaaaaaagttatagtaggttaaggttaatttattattgaagaaaatttttttataaatttagtgtagtttaagtttatagagtttatattatagtagattttatataataaatgttttaggtttttatatttatttattatttaatgatttatagtaatttttaattttggaagttttatttatagtaagtatttatataggtgtattatttttttttttttttatattgtatttttattgtattttttttatgtttagatatataaatatttatcgatgtattagaggtgtttgtagtgtttagtatagtaatatgttgtaagtttgtggtttggaagtaatagttatattatatggtttaggtgtattgtaggatatattatttagatttgtgtaagtttattttatgatgtttgtataatgatgatatcgtttaatgatgtattttttagaatttatttttgttgttaagtaatatatgattgtatatttgttttgtttatttttatgtatatatgtttgttttatagtaaaaaaaaatgtaatttaaaataaaaaatagaaaaagaaatagatagtatgattttttttattttagtttttgatgattttttattttttgttgtttatattttttttttttagaatttttaagttggttttttaatttttttatttttttttttattttatattgttgtttttttgtttttatttttgggatatttttttatttttattttttaattttttaattgagttttttatttatgttattatttttttaatttttaagagtttagttttattttttgaatgtttttttttttaaaattttttaatttgataaatgtattattttttttatttttgaggatataagtaataggtttgagggaagtttttttatttaagatgattgttttgttgtttgttttgatttttgttttgaagttagaagttttttttttttttttattttattttttttttttttttttttaggttgagggttggtggggtttcggattaaaggattttagatatagttgagagtagaaatattttaaaaataaaaggaagtttaagtgagttattatatattaaattattaatggtatttatttagttgaagaatatagagaaaaagaagaatgaagaaaaattaatagaattttatggatttgagagatagtattaaatggttttatatatgaatggagttttagaaggggaagataatgaaaatttaagagaaagataatgaagatataatgattagaattagttaatttagtatggttataggatataatatttttaaaatattttatatatgcgataaataattggaaaataaaatttatattaatataatttaataattagtaaaatatatatatataatagatatgggataaaagatgtgtaagagttttataggaaaaatgagaaaatattgttgaaaggaattaaagatttgaaaatattgttgaaataaattaaatatttgattaaatggagagatatatagtgtttttggattggaagatttaatatagatttaatttttaaattgaagttttttatatttaaattgatttaattttaatgtaatattaattataattttagtaggttttttttgtgtgtgtatagaaattgataggttgattttaaaatttatagggaatataaaggatttggaagaattttagattttggttttgttttttggggaagggttagttatttttttaaagatgattttttttttttttttttttttttgagatagagtttcgttttgtcgtttaggttggagtttaatggtataattttggtttattgtaattttcgttttttgggttgaagagatttttttgttttagtttttcgagtagttgggattataggtgcgcgttattacgtttagttattttttgtatttttagtagagatagggttttattatgttggttaggttggttttgaatttttgatttcgtgattcgttcggtttggttttttaaagtgttggggttatagatatgggttattatattcggttaaaaggcgatattttttaaaatatattaattgatttattaaatatatatttttaaatttttaggtttggggatatatgtgagggttcgttaaataggtaaatatatgttacgggggtttgttgtatatattattttattatttagatattaggtttagtatttaatagttgtattttttttgtttttttttttttttttatttttagtattaggaattaaatatgaataatgaaggtagtttagttaataaaattgaattagttttttagtttgtgggtaaatataaaattttttttttagaggtttgataagttgttgtagtttcgaaatgatttaaataataatttatatgatttgatttattaagaagtttgaaatatattaaataaattatagttttaaagaatgaataataggataatggaatgttaaaggaaaataaattaatttaaaggaaatttttatttgtaaaaggtttagtaggatttgttaatttagaattaggagtgttttttaatttatgaggtttttattttagtattttaaaaaattaacggtaaatggttttatggtttatagtaaaaggagatattttatttaagtaaagttattagaataatggtgattgtgagaagagttgaaaataaaagttagttatttagtaattagaatgttagaaagaaaaaagaaaagataaaaatagaaatatatttattattggtttttttaggatatttggatatatggtttataattattttaagtaatattttttttaaatataagaagagaagttttttaattgttaaaattgttttaatagaatatgtgtattatattttaattagtattagtatattttttgattattagaaagttgaaagtgaaatgatgttatttaatataaatttgtttttaaataatattttttttaagaatattttttagttattaaaatagaattttggggaaagaaaagatttattttaaatattttgtggttaaatataaaattataatttataatagataatatatttaaatgtttttaaattttattatgaattgaattgaaatattagtattatgggtttaatattaataattttatagtaaagaaaatatagagagggaggaggggtaaaatgaatgtttttttattatatgttttgatttatttttattggtgtttgtttaggatgatgtaattattgaattataagttgttttattgatgttatgtttaaaatgataagttttagttttttagatttttaataagaatttacgatagttatagttaaaatagtatgaataataaaaaggtgttatgtaggtgttttatagaaaaaaaaaaattaagaaattattatattttaagaattaaaatttttttttttttggttatttcgtttagtttgtttattttttatgattatattataatgacggaggttaatttttgtttagtacgtggtaggtattatgttaaattatttataggaattattttggttattttaattttggtaatatttttgagaatgggttttattaatatttttatttaagggataaggaaattgaggtttagaaggtttattgtttaaggttattaaggtggtggttttgtgagaattggaatttagatttttagatttttaggggaggagtttatttaatgtattttgttgttgttttttatattgatgatatattaatgatatttattatggaaaaatatttgttgaattaatttaagagaagttggaaatgttagtaaaaatttttatagtagtatgagaatatgtttttaaaaattaggagaaggagatgttttaaaatgttttaagaaggaattagaaagttttgagtaaggaagtatcgaaaaatgatcgagtttttagttaggagttaggaaatgtgttttgtaattggaattataattgttttgagtaaaatagattgtgtttttatgaagttttaatagtttattgtaggagatatataaggaaaaggttagttaaaatatattgtgatttatgtcgttatgtgagaatattaaaggatttttagatatagagaggtgttagagaagttttttgatttgttacgagttggaaaggtaagtagagagggaagtcgaggaagagaagatagttatgtgtgaagttttttggtatttagagtatagtttttttaggggaatttaaagataatagaagatgataaaaaaatatattaaataatattagaaaatattgtttaattaaggttttaagtgatttgaaagttataggttaaattttataaggataaatataagatagtatttagggaatggaaagtgataagtataatggttatattgtttttttatatttagaatggtatagtattttagtgtaatgtagagtttagaattaggaaatgggtaattattgggattttagatatttttttattattaatttatagggtgataattaatagtttttttagtttttttgggtttcggttttttttttggtaatttatggataaagttaattgtttagtaggaggtaggttgtttgatttgatagttttttcgggattttttaaaattaatgattttttaatttagatatatgatggttaataattagggatgaataataatattattttaatgagaattattaatagaaattaatattatgtgtgaggtaggtattattattatttttattatatagataaagaaaaatgtaaatttagagaagttaaattatttgtataattttatataattagttattagtggagttagagtttttttttaggtattttagttatagagtttatatttttaattattagaatatgttatatgtttttttttttttataagttgtaatatttttagtattgttattttgtgtgtatttatgatacgtaattttttaatttttataatatttttggaaggtgttatttttatttagagatgaaattaaaattttgagagtttttatagggatttagttgtggtattgggtttagattttattatgatttttattattatgtttttttaaatatagtaaattatagagattaaataaattagtattatagataaatgaattgtaaattttatttatttaattttttgttattaattaatttataaaaagaatattagtattaataaaagatattttatttttataaattagttattgttagttatttttttttttaaattgtagaattttattaattatgttttttttggattgtataagatgtagtatttttaagttatttaattatgatatagtgtttagaatttaaatatttttaaatattatattttgttatggtttatttggaaaatttaagttttaaaaagattaagataaattaggtaagagagaaaaagtagatttttaataattttttatatttatatcgtataaaagtttgtttttttaatattataaagttaatttttaaattttattttagtatgttttgatagtatataggtgaaattaaataattattatattaaaataatagtaaagataataattaatattaattagttattatggtttaagtattttattaattttaatttttataaaaattttatgtattattattagttttattttatgaatgaggatatttaagtttagaaagggttgttaatttttttaaagaaagttatataattagaaaatagttatacggtaggtttttgaataatgttttgtttaatattgttttaacgttgatgagaaaaaaaaaatgatgttgattgggcgcggtagtttacgtttgtaattttattattttgggaggttaaggcgggtggattatttgaggttaggagttttagattagtttggttaatatggtgaaattttgtttttattaaaaatataaaaattagttaggtgtggtggcgggcgtttgtaattttagttatttgggaggttgaggtaggagaaatttttgaattcgggaggtggaggttgtagtgagttgagattatattattgtattgtaatttagtttgggtgatagagtgagattttatgttttatttttattttttataaaaaaaagaaaaaaaattgatgtttgtttagttttgtttagggttattgtttgtgtagagttggttcgttttttttatgtttgtgtagtttttttttagatatttcgttttttttttatatttcgaagttgtgtgtgatacggtaattggtatgtttgaagggttttagtttgagtgtgagtgtgtatttgagtgtattttataatggggtggcgttttgtttatagggttagttgttttgagttatgagtataagttgtaggttttttggattttgaattggaatgaatatattggaaaatgaatgaatataaattattattattgttttttgagatagagtttagttttgttattaggtcggagtgtaggggtataatttcggtttattgtaatttttattttttaggtttaagtaatttttttgttttagttttttaaatagttgggattataggtgtgtattattatatttggttaatttttgtatttttagtagagatggggattttttatgttggttaggttggtgttgaatttttgatttttagtgattcgtttgttttggttttttaaagtgtcgggattatagacgtgagttattgtgtttggtttataaattaatataaaatgaaaatttataaagtttgcgataattatttaaatgtatgataataaatagtgtagtttaaaaatgtttagtaagtttgttttaattattatttttgagttatgtggtgatagggggtgttttttataatttttattttgtaaatatttattttttgattttatttattattattatgattattattatttattggtttattaaaaattgggtaaataattattttttgtttttattatttttaaatgtatatatatagtttatatttattttagtggttaatattataagtgttttgggtttttatttagaagtttagtgatgtttttgtgattagaaatatgttataggaatttaatttttgtttatattaattagtttgtggtaaaattggttttattagaggttgttttgtttaaggttatagtttttaagaatttattgatgatgttaagtgagagtttattgtatgtggattttaaataagtagattattttagatggtaggttttttattattatgttaaatatataatgttatgatttttataaatagtagattattatgaggtatatattgtatgttgttagatttttaaatttaggttattaaagtaagttattgataagttagagataattagtaagtaattgagatgatatttatttgtttaagtgagatatttgttgtggttaatttaggggttgtgttagggttattgtgttttttttttttttttttcgtaataggtttagaattttatggtatttgttatttaatatatagtataattttttaatttgttttagtttaggttttaggattttaaatttttagtttatatagagtggtttttagaagaggagatgtaatagaagaggaaaatagatttttatttagttttttaataaagttagtattagtttggtttgaatatagtttatgatttttttattttttattgatattttattttgataaaggtataggggttttgaaaatatataggaaattagatttttgtgttattgtaaaatttataaatttaataaattaaaattttttaaatttggttgacgtcgtgattataaggagatcgttattaaaataatgtttatattttagttgtgattaaaatgaaatatttttaaaatatgttaataaagtatagtagtaaaattgaaataattgtaaattttaaaaatttaatataattatattttaaatgtttttttatatattagttgttttaaaaattaaaaacgtagtatgttattgtttaatttaggatattttttttatgagtagaaaataagagaattataaaattaaataagatttttttataatttaagattgtttggtagaaatagtgaatggtataaggttaatgaaaatcgatttttgatgttattaaagtagtaatatgtgtgtttagtgttttttgatttataatataggttttagtatatagtattgtaaaggaaatttttttttagagagggtgaagttttttttaatgagtatttttttttttgtttgttttttttttttagaatgtttatatagtataagaaatgtatatttgatatagaaaatgttaaatgtttaaatatttagaatttttttgtaattattgtagtttatttaaattgttttattaaattaaaaagtagagattaaattttaaaatttttttatttgttataaaagggaagaatatagtttgtaatatttttataagttgtagttattaatatttgtaagaattgaaattggtattttttttttttatgtgaaatatatatagatatatatatatacgaataaaaagaaaaatttgtatttgaaaatagattttaatttagtgttgttatttttaggttttaattttaatgttagttatttttttatagggtattatattagtaaagaattaaaggttttttttttttgtaaattttatttaaagtatatgttatttttaatgtttatttaaagggatagagagtgattttttgggaaatttattttattattatagaattggagattgttaagggttaatttaagtgttaatttttgttatataagaatttcggtttgaaaaatttatttttttttttagtaaagattataaaattatatttttattgtagaaatttagattaaatattaagggataagtattatttgtgtgaaatgatattgatgtttttaggtaggtaatagttttattaaaatatatgttgttaaaatgtagtttttatgtaatttttaaaaattaatagttttgttttgtagaggataaagtttaaatttttttagttagtaaatatagttttttatattttgtgtttagtttgtttttttaaaacgggtttttatttttttaagtatatattttagtgttagtttttaatttttgttttttagtgaggttatttgagtttgtttatttggtgtttttttggtttgaggattatatttttaaaatataggtagtttgatagagtaaatttgtttatgattttttagtatttattttagttttttgggtttttaaggttttttgagtattttagtttatagttgtgatggtggattatttgttgattttgttttatagtattagttcgtgttttcggtagtatattttggagttttaattataaaatttgaaatgtgattttagataaaattattgaaaatgtttaatgaaattataaattataatatttagtgaatggggtaggttataaggtgttataatagtattttaaaaaattgatttaatgattagattaatatagttgattttaattatttgtagattttatatttgtaagtttatatatttgttatattttatttgtaatttttaaatttatatttgtttttttatcgattcgtggataagtatagaatagtaaaaaatttgagtcgattgatatgtatgtttttagttgaagttaaacgaagtgatacgttatttttttgttttagtttttaaattgtaaataagtgttttttttatggtaaatttagtggtatattttttgagttttgtgttttttgttgggaattttgttgtttaaaatggtttttatgtatagttttgaagtattatttagagtttttatgtacgagaagattatgatgtattttacgaagaaagtatatgtattataagttttgattagatatgatttatagtgttgttagttatgagtttaatgttaatgaattaataatatatattaagtatggtatttttaaatagaaatatatatgaaataagggtataatttaaaatttttttataaatatagaaagagaataggttttattgtatttgtaaatatttttttttataaatgttttttgtattattgataaaggaaaatatttgaataatttttttttttatgtatgttaatttggtgaaattttatataaatttttaattattgttgtattatatgtggtaaaattgaagtggagggaggattagagagagaagttttttttatagatttttttttttttagttttttaagtttttgagaaaggatgaggggggttaaagatgattttattgtttttttgtggcgattgttaaatagtggtagtatatttttttttagttgttttgttttattaaaatgtaggtttttttaaggatattattttttttataatattatttgatgatggttgttttttttttaattgtttttatttgagagatttaaggttaagaagggttagtatttttttttttattggataattgtttattttttttatgatgatttattattttatgtttgagatttatgagtggaataggtttatatttttattttttaattttttttattataatttatttttttagaagattttattttttttgttttggaatttggttttttttttttttaattttgttatgtattagtatttattgttattagatagtggattttatttatatttaggttttgggtttttgttttagttatagtggtttaaaatatagtattttttaaaataaattttttttttaggttttaatttgttgtttttttgtagtttttatagttttgttttttagttttgaaatttattttttttttgtttttttttttatttttttatatatttaataaatattttgagagtttattatatattaggtattggggtatattatagtgaaaaatataaatatgaatttttgtttttttaaaatttttagattagtaggagttgtagagacgagtatatagtagttgtaatataatgaggtaaatgttaggataggggatatatttggtgcggtgatggtattgaagagggatatttaatttaaacgtgggagattaagaatgggtttgtatgataatgtgatatttagttggattttggaggaagaggagaagtgaaaaggagatgaaggttagacgtgaggtgaagtatagggaatagtattatgtaaagatatagagttaagaaagagggaagtaaaggtagtttagaaaggttatataataaaaagtttattaaattataaaagattttgtaagttatggtaaatttttagattgtatttaggatagtgagaattttagggtgttttaaagaggggattaatttgattatatgtttatgtttgaaagttttagttgtagtatagaatatagattgaagatgataagggagttagttaagatgatgatgtagttatttagttataaaattatggtagtttggtttaaggtaggagtagttaagaatataagtagaagggtttgcgaggtatttatttagtttaatttatgaggtttaatgattgaaattatgtgtatagagaggggaaaagggtagttagggattatgtttagatttttgttttggggttgatagtattatatattttttgagatagggattataggagaaagaggaagtaggttttagaataagttaatgaattattttggatatgttgtgtttgagagatttataatttatttaagaaaagatatttagttagatagttggaaatatgggttaggaggtaaagagatatatttgagttggagatatagtagatatggttgttttttgtataaggataaatggtaattgaagtaatagaaaaggatgggattatttagagaaggagaaaatgagaagagggtttagtataaagttttgagaaattttgaaagaagaatttgttaagaggttagagaagtagaaggaggaaaattagaaatagaattgtgttatagaaattattggtagatgtttttataaataggattttggtgtttagtatagggttggtgttaatagtaggttattggaaagtgtttattgaatttaaggataagtaggttattgataattttggaaaggttaatgtgaatggagtggaagtagaaaattagtgattttgtaaggttaatgaattgttttatattttttaaatgatttttatatttatttttttatttttttttttattgttattattttagttaatgtttttattattttttgttagatttttagtaatgatttatataattgttttcgtatgtagttttttttcgagaattgtttttttaaataaaataaagtaatatatagtttattttatgtataattgttagagtaatatttttaaggtatagtttagaataagttaattttggtttaaaaatataatggttttttattgtttttagagtaaaatttaaattttttagtatgatgtttaaagttttttattatttggttttaatttaattgtttagttatatcgtttatattttaaatatttatttttataaaaaaatgttgattttaaaaaaattaaagttatttaaagagttaggattatagatatatagataagaataattttttttttttgttgaggaaaaaaagatgtgtttagggttttttttatttatttattaaaatgaataaatagtatttgatagaatagaattgttataaaatatagataattgttttttttgtgttgtggtatgaaatatatggtttatagagaaaaaaaatggtgttttagtatttaataatatatttgattaatattaatttgttatagaaaatatttttattttattattagttaatttattttatatttttagttaagtaaaatgataaaaaatttataaagatataattttttttataaaggttttttttagtaattttgtagaagttattcgatggtttttaattgaaagatggtagtttttatatattttattaatttagtaagtgtgatagttttgtatttatattataagttagttgggaaataattatataggtaaaaagttattttaggtttttagattaattttaatttaaatagatgagagagatttataataaatttaagagaagatgttttaaagatgatttaataatagatgaagagagttttgttatataattttaggggtagtttaatttttttataatatttttagttatttaatttttttggggtggttttttaatattttatataattatatatatgtataaatatatatatgtatgtatatataatgcggtatgttgatgataaaatatgtttagtaaaaattttgtttttttataatttggtttgtttgttttggtattatattgtaatatggggtaagtggttgtaaagtgattttaggattgattataagaagattattgtgtattttataaattttatattttaaagaaataatagttattaaaagtatttttattgagattggtataatgagtttttatattatgaattgtaagaattggttattttagatatatttttttggtttatatttttttttaattataatttattatgttttttagttagagaaaaatatttttatttatattattgaatttttaatatattttacgttttttttatatgttgggttttttatttgtaaaataatattaatataggtatatttttgagatattttaggttcggttttagattataataaagtgaatattgtaataaagtaagttagacgaattttttggttttttattatatataaaagttatatttatattatattgtagtttattaagtgtgtaatagtattgtgtttttaaaaatgtatttattttaattttaaaatattgtttaaaaatgttaataattatttgaatttttagtgagttgtaatttttttttttgtggagggttttgttttagtgttgatgtttgttgattgattagagaggtggttgttgaaggtggggtggttgtggtaattttttaaagtagataataatgaagttttatttttttttttataaaagatttttttgtagtacgagatgttgtttgatagtattttatttatagtagaaatttttttaaaattggaatgaatttatttaaattatgttgttgttttattaattaagtttatgtaatattttaaattttttgttgttattttaataaggtttatagaatttttattaggagtagattttattttaagaaaaaaatttatttgtttatttgtttataagaagtaattttttatttatttacgtttttttatgagattgtagtaatttcgttatattttcgggttttatttttaattttagtttttttgttgtttttattatatttgtagtgattttttaaattgaagtgttgaattttttaaatttatttataattgttggaattaattttttttaaattgttattaatgttgattttttgatttttttttgcgaattataaatttttaatagtatttagaatggttaattttttttagaaggtttttgatttattttgtttaggtttattagagtaattattgtttatagtagttatagttttataaaatgtattgatttgaaatttgaaattattttttgatttatgggttataaatggatgatgtgttggtaggtatgagaataatatttattttgttgtataattttattagagtttttgggtgagtttaggtgtattgttaatgaatagtaatattttgaaagtaattatttttttttgagtagttgaataggtttttatagtggttttaaaatatttagtgaagtatattataaatagatgtgttgttatttaggttttgttgttttatttttagagtataagtagagtagattaagtataagttttaagggttttcggatttttggagtggtaaatgagatttggttttaatttaaagttattaattatattagtttttaataagaatgttagtttgttttttgaagttagatattgatttttttttagttatgaaagttttagatggtatttttttttaataaaaggtttttttatttatatggaaaatttattatttagtaattttagttagattttttatataatttgttgtagtttttgtattagtatttgttgttttattttatatttttatgttatagcgttggtttttttttttaaattttattaatcgatttttgttagtttttaattttttttttgtagtttttttattttttatagtttttatagaattgaagagagttaagttttggtttaaaggaatgttgtgaatggtttgattttttgtttagattattaaaatttttttcgtattagtaagaaggttgttttattttttgattatttatatgtttgttggagtagtattagttattttttttaagagttttttttttgtatttataatttagttgtttagtataagagtttttgtttttggtttgttttggtttttgatgtgttttttttattaagtttagttatttttagttttttatttaaagtgagagatatgtaatttttttattttaatatttagaggttattgtagggttattaattagtttaattttaatattattgttttttagggatttgagagttttaggaagagggagatagatagggaatggttagttggaagagtagttagattatgcgtaatatttattaattaagtacggtgttttatataggtgaggtttatggtgtttgaaaataattaaaatagtaatattaggttggtacggtaattttagtattttgggaggttaaggtgagcggattatttgaggttaggagttcgagattagtttggttaatatggggaatttttatttttattaaaaatataaaaattagttaggcgtggtggtatacgtttgtaggttcggttattggggaggttgaggtaggaggattgtttgaatttgggaggtagaggttgttgtgagttaagattgaattattgtattttagtttgggtgatagagtaaaagttcgttttaaaaaaaaaaaaaaaaagaaaaaattaaagattattgattattggtcgtaatagatataaaaatgatgaaaaagtttgatatattgagagaattattaaaatgtgatatagagatataaaatgagtataagttgttggaaaaatggtattgatagattcgtttaatatagggttgttataaatttttaatttgtaagtgaaataaaataaaataaatacgtaatatttgggaagtataataaaataaggtatgtttatatttaaatatgatagaatatttttataatggttatagttattatgttattaattgtttttagaagtaatattagaaatatttggagggttttattaaaatttagatatttaattttaaaattttaatttaggaaatttggtatatagttttggaatttgttaggtgatttttatttgatatttagttatttgggttgaggtgggaggatagtttgagtttaggagtttaagaatatagtgagttaggattatgttattgtgttttagtttgggtgatagagtaagattttgtttttaaaaaataataaataaataaataaatatatttaatgggggaaaaattttaaaatttttggtttttaaatattatataatattttttttttaaatagtgatggttagtaaattaaatatattgaaagtagggtagagaaatttttaaatgtgattttaaataaattaatataaggagtaagttaatttgagaaatttcgtttaattataaaattattttttaaaaattttttattattatgttaaaggtatttagatttaatgaaatagtattaataatttttaggttatttttaaaagattttataagttttaaaagattttatgaaatatttaataattagtatagttgtgtttttaatgtttaaaagaggtagagataaataagttaaaaggtatttttttaattttgattgtgagttataagtttgatgttgtttgaagttaattggtatggtgtttatttatagtaagttgtttattttttgtttattaattatattatagagaaggaatgtttagagatatagagtgtttttttaagatagattaatagagaaagaggaatttataagtttattaaattgttatagatattgtttttaatattgttttaaaatattttaatttattttttataattttagtatttttaaattaaataattagtttttaatagataaatttatagtaatagtttattagtggaatgggtagtatttttttattagtttaaatattttttaaataaaatttttaaaggatataatatcgattttaaaatggatttgaatttaagttaattagattgaagttgatttaaattgttttaaataattaatttttagtataaagattgagagtttaatattaatattaatattaagaaatggagtatttagagaaatagaaaatagaaaaaatgaattttgattattaagagaaaaatgggtgggaagtatttgtttagtatattaataattttatttaatttttaagtttaaatagtagagtaaattattttagtaataatatttaatattttttttggatttttagagttagtttggattgttttttttttttattgttttgtttttagtatattatgtttaataattttggagttttggtttttgtaattttttgattttatagtgatatttttgttgttgttttttttatttttttgttttttataatttgtattttttaaaaaaaaaaatatacgtaaatgttgttatattattaaattattaaattattttatatttttttataaatatatattttttgttgaaaaagtttagtgttaatgattattagatgtacgttatttttttttttaagagtttaaatgagaaagaatatatatatagaatattaggattagtttataggttagagtatatacgttatttttaagattttattaggtgtaagatttaagttagattttagttaataggtaaataaataaaattaaattttatttttgttttaatagttagtatttggaaaggtgttggatttatgattttggaaattgtatagtttataaatagaatttcgaaataatgttgaggtagtagtggtatttttttatttttttagtgtttgtattttaaatttaaagggttaaaaaagtattaattgtaaataggttgaaagttatatatttataacgtattgttagtgtatttgttataggaaagtaagtttgttaatatggtaaatagtttgaaaaaagattatgtataaagaaaatttaaatttagattgatattttaataattatagggaaagttatattttttagataaatttttagtttttattttttttttaaattttaattaatgggaaaaagaagaataaaaaatattattttgttaatttaataaaattatatatggtatataaaattgagtatagtaatatgagaaagttgaaattggagaaaattaaaaaatatacgttttatttaataagtgaaaaataattttataaatatttaaaaagaattttgtaatttttagtgtgtagttgtattggtaaaaggtaatttaaatttattttatgaattataaataggggaatgttatgtttttttttttttgtttttttttagtttttatatttaaaaaattttttagagttacgtagatttttagattttatatttattttttttttttatgttgtgtaaggtagtatttttaaaatagaatttttaatatttaataaaaaagaaaattttgtgtaaatattttagttgtttttattgaaaaatatatatttttataattgtattgtaatttgtttattttaaggtggtatagttattagaagtttataggttatttcgaaagtttttttttatttttttttattattttttatttttttttatatattttagatttttagaattaaaattagtttttttggttaataattaacgtaaaattttgagataataaaaaaacgtaagtatttgagtgaacgaataaatattaaatatttgattaagttaaacgatagtttttttatttgaaaatagaaaagttaagatgttttgatcgttaagttattgtgtattattgaataggaagtttatgttttgtaaagcgggtaaggatttgggtagatttttttttttatttttttttgttagtagtatttttcgtttattattttaataaattaaatatttattatatatagaattttttatttaagatgtttttttttaattatttagtgagatttatgttagtttagtagtggatataagaggatatgagaaaggaagaaaggttttgggataatttttatattaaaagtaagttttttataggagtaacgtatttaattttgaagagggatagttttataatgtttattttgattatgaattatgaatatgatagtattttttgaatatttttgttattataattatttaatatttggtattattaaatatttgtggagagaattatattgtgtaaatattagtaaagaattttaaatataagagttttttttttgtttttagttttaattagttttaatttatttttgttaaaataagagtttttaaatttttagtaaaatatttttttttaaaaaattaaattttggtcgggcgcggtggtttacgtttgtaattttagtattttgggaggttgaggtaggcggattatttgaggttaggagttcgagattagtttgattaatatggagaaatttcgtttttattaaaatttaaaattagtcgggtatggtggtatatgtttgtaattttagttatttgggaggttgagttaggagaattatttaaattcgggaggtagaggttgtggtgagtcgagattatattattgtattttagtttcgtgaataagagtaaaattttattttaaaaaaaaaaaaaattaaattttatgtagaatttttaatacgtaagatagataaaagttgttattttattgttaaagttttttttgtatatttaaatttataatattaatttgtataggaagtaattagtaagattaatgaagatgttttgataaaattaatataattgaaatggaagttataaataatagttatgttagggttattattaaagtttggatttaaatagtttgaaagttattattttaaaattttattgtgtttttattaatagttttaagttttatttttaaatttttgtgaaatttttttttcgtataaaaataaagtttaaattttaataaggtttattaaaatttagattgtaatatatgttttattagttttttgtaggaattattttttagttagtatggtttttttagtgttttttaatatattaagtttagttatttattttaataaatatatatttgagtgtttataatgagtttttagatttttgtttattttgtttattattgttttggatttttttttaattatttttaataaaagtttttttttattttttaaagtatttagtttttttgttatttatgaattttgaagtgtttgtttttataagttgtttaaatgataaatagttatatggtatagcgttaaggttgttaataaatgtattaaaatatataattttgttttcgatttggatttttaaaaattaagtttttagttggatgcggtggtttatatttgtaatttttagtattttggaaggttgagatagatagattatttgaggttaggagttcgagattagtttgtttaatatggagaaattttatttttattaaaaatataaaaattagttgggtatggtggtaggtatttgtaattttagttattcggtaggttgaggtaggagaattatttgaatttaggaggtagaggttgtagtgagttgagattatttttttgtattatagtttgggttatagaacgagatttcgttttaaaaataaaataaataaataaataaaataaattaagtttttatttttattggaaggagaaaaaatttatttttgaattttaaaagtgaagatttgaaatttatgtattatttataggaaatgtatgtgtaaatgtgtatagtttaagtggtatttgtggtttgtttattttgttgagtattttaaaattttaaagttatagtttggtatatagaaaagttatttggttgttaaaaaaagttatattttatatatatatgattaaagaataattatttaaaatgttttttatagtatagtatttgattaaaagttttaaatatattaaatgtatgagttttattttattaatatttgtaaatttaataaaagtatttttagtggtttgtatataatttagttttaaattatgtttatatttttttgtgattttttgtgttattaagtttttttaaatttataaatgattgtttttttttagagaggatttgagatagttttaaaaaataggtaaaatttaagatggtaatttaaaagagagtgaaaagtttattaattatatttttataggagtagttaattggattattgttaaattatttagaaatataaaatatttaggatagtattagatttttatttttgtttgttgattaatttaagtttaatttaaaattttttattgttatattaagggaataattttaatatgataatagaagaatataggtttttaaatatttaattttgatgttataaatagtattaggttttgttttatttataatatttaataaagtattaaggatattgttttatttaatgatgttttcggggtttttggtattttattagggatttatttaatatgattgatatattaatagtaagtagagtgatttttaagttagatatatgtaaatatatagttaagttttaatgtaaattttttttgttataaattgatagttatattgtagggtattaggttttattttgagtttatttagtgaaaaatagaaataagtatataaaaattataatatattaaatataattttaaataaataagttattttatagaagaataggaatgagataaaatgatttattgtaggataattttgaattaagtatttttttgttaataattagagagtttattgggtatttagtttgaaaatagtttaaattgttttttttaatttaggtaatagtttttttttttgattgttagattaagttagtttatttagtataagtaggaagtatggttgaatgattaaagataaaataggtagtagtaatattggtattaattttattagattgaaattttggtttggattatagtataaattgaaaattgttaaattttaataaaattaaaaaaggaaataaaaaattaattgttagaagttttaattaatatttttaatattagtattagtgttttaatttttttattttttattgatttttttaaaataaaattaaaatgtaatataagtggtatttaaggtaattttttaaattttagaattttttttttaaaggaaagtttttttagaaataagatgtgtaatgtaagtcgggtggatttttttatttgtatttaattttttgagttatttttataatttttgatagtttttttgagtagttaggaaaatattaataaataattgtttaaatattgttttatagataaagatcgttttattattgaagttgttgtttggtggatagtattattaggtattgatttgaaatatttgttagttgttgtaagaaatttttagatgttttacgaataatagtttgatggagggggtattaatgtaatttttaaataattggaaatttgtatataaaaagtttatttgttttaaagttgaatttatgataattgaggattattagtatgttagataatgtataggaattattagattttaaagtttagataaatggtaaaatagtttgaaagatttttagtattgaattttggttaatacgaatttatttttaaaattaaaggggagtaatagtatttttaattattggttagttttgagagagataatatttgggttttataaaaagtgtttttaaaataatgttagtaaaattggtggaaaaaagaatttaagttttatatatttataaaagtaaataaaaagggtaaaaattgttaaattgaattttttcggaatttgaaaattaattaacggtttgaagtagtttagggaatttttattgaaaaataaaaataatttttttttttagtttatttttggtaagaatagtaaattttgtggtgttttatttagtttttatttattttttgatttttagtttagtagtagttatgaaaataatagtttatattttatatttttggtatgaaagatagtagaatggattttttttatgaagatttgtttttttttttttttgttgagacggagttttgttttgttatttaggttggagtgtagtagtgtgatttcggtttacggtaagttttattttttgggtttattttatttttttgttttagtttttcgagtagttgggattataggcgttcgttattatagttatttattttttcgtattttttagtagagatagggttttatcgtgttagttaggatggttttaattttttgattttgtgatttatttgttttagttttttaaagtgtcgggattataggtgtgagttattgtatttagttaaagatttgtaattaattatttggtttatttgtttggtgattttatggaagattattttaaaaggattgtttttattttgtttaatttagaattggtttagtgtttttttggggtatatgacgggtggaggagttgaaaatatttatgttaattttttaatttgttgttgtttgatagataattgttgaagaaaataatatattagtttaaagattgagaggaaaagttggggagtttgtaagggttttgaaagggtttaatatatttttggaaatttagagggttatatgtatgagtagggttgtgtatatgtttaggaaagatggagtaggttttaaatttttattatttgttgattttaatgttttgtagaagttggtagtaaaggttaaggtagggttgtaaattttttgggtaagagtttaaggtttgttttaatgtatatatagaggttatgggtaaagattggaagatattttgtttttaggtatttaatgaaatttttgttaattattaggtgattattaaattaataaatagagattttagggtgtttataatttttaaagaatataaaatttatagaattagttatgaaaagttattaaataaatatttataatatttattaataataaatattggggaggggagatagtttgattgttagagttgttatattataatatttaaaatgtttagttaataataataattataaggtatataaagaaacgaagtatataggaaaagaaagaaagaaaatagaaattatgtttgaggaagtttagatattagattttatagataaagatttaaaattattgcgtgaatttaggaggtggagtttgtagtgagttgagatcgtgttattgtattttagtttgggtgatagagcgagattttatttttaaaaaaataaaaaaaaaaagatttaaaattagttattttaaatatatttagtgatataaattatgtttaaagaattaaaggaaagtataaaatagtattttattaaattgagaataatataaagatagtaatgataaaattgaattaaagagaaattttgaagtagaataattgaaatgaaaaattttttagaaaaaaatttattttatagatgttatttggagaagagaaaatttatgaattcgaagataggttaaattgagattatttagtttgaggaagtgaaagaaaaaagaatggggaggaaaaaattggatagagttttagagatttttgggatattattaaataaagtaatatataaataattagagtgatagaaggagcggaaaggggtaaaaagattatttaaaaaaaaaatagtggtaaaagaatttgatatatttgatgaaatatatttataaagtttaataaattttaagtagaatagattaataaagtatatatttaaatgtattataattaaattattaaaagttaaaggtaaagaatgaattttgaaagtagtacgataagtaagttattataaataagtgatttttaataagattaatagttgattttttattagaaattatggaggttagaagatagtacgatgatatatttataatgttgaaagaattatatgttaattaagaattttgtattttgttaatattattttttaaaaatgaaggataaattaatatatttttagataataaaaattgtgagagtttattattagtatatttttaatatatgttaaaaggagttttttaggttgaaataaaaggatatttataataattttattttgtttttagaaatataatattaggaaagggaattatataagtaaatatataagatagtaaaaatgtattttttgtttatattttttttttttcgtatcggattttaaagataattattaagtaatatttttaaatttatattgataaatatatagtgtagaaagatgaaaatttatgataataatagtatagagtggaagtagaagaggtatatagaggtaaagtttttatatattgttgaagttgagttgatattaatttaaattagatttttttttttttttatttttttgggttagttttgttttggtatttaggttggagtgtagtggtgtgattaaagtttattgtagttttaattttttgggtttaagttatttttttaatttagttttttaagtatttgggattataggtatatattattatgtttggttaatttttgtatttttttgtagagatagtattttagtaagttgtttaggttggttttgaatttttggatttaagttatttttttgttttagttttttaaagtgttgggattataggtatgagttattgtgtttaatttaggttgttaaaatgataataaaattttcgtggtaattattaagaaaataattaaaaatatataataaaagaaatgataaagaaattaaaatcgttatattagaaaatatgtaatataaaagaaagaaggtagtaatggaagaatttaagaataagagatataaaataaaggaaataaatggtaaaatattagaagtaattttttttattaataattatattaaatgttaatggtttaaattttttaaataaaaagtaaagattggtagatttaattgttatttatagagatttattttagatttaagaatataaatagaaagtaaaagaagaaaatattttatgtaaatagtaaataaaagaaagttgaagtggttatattaatatagataaatagatttaagataaaaattgtttttatagggtattgtataatgataaaagaattaatttattaagaagatataataattataaatttatttgtatttaataatagaattttaaaatatataaagtaaaaagtgatagaattgaagaaaataataaataatttagtaatattagttggagattttaatattttatttttaatagatagaataattagatagaaatttgtaaggaaatagatttgaatagaattatgtattaatatatttgttaaatattttatttaataaaagtagaatatatattttttttaagtgtatatgaaatattttttaggatagataatgtattaggttataagataagttaaataaattttaaaagatagaaattatataaagtatgttttcggattagaatggaatgatattgagaattaataaagaaggaaatttggaaagtttataggtatgtggaaattaataagtttttaaataataaacgggttagagggggaagaaattataatggaaattagaagattatattttgagataaatgaaaataaaaatataatatattaaattttaagggatgtagtgaaagtatatatatttttgagaaggaaatttatagtagtatatgattattttataaagaagtaagaatttaaattaggaatttaattatttattttaagagattagaaaaagaagaattaagtttaaagtaagtataaggaagaaaataataaagattagtgtagaaataagtgaaatagagaagagaaaaataatagagtaggttaataaaaataattaaagttgggttgggtacggtagtttatatttgtaattttagtattttgggaggttaaggtaggtagattatttgaggttaggagttcgagattagtttgtttaatatggtgaaatttcgtttttattaaaaatataaaaaattagttaggcgtggtggtgggcgtttgtaattttagttatttggtaagttgaggtaggagaattttttgaattcgggaagcggaggttgtaatgagtcgagattgtattattgtattttagattgggtgataagatggaaattttgttttaaaaaaaaaaaaaaagttgtttttttgaaaacggataaaattttattttagttagattgattaagaaaaaaaaggagagaagatttttaaattattagaattcgaaatgaaagagtgaatattatgattgattttatagtaaaaaaataagattataaaggaatattatgaataattatatattaattaattagataattatatgaaatgaataaattttttaattaattgttaaaaatgatttaaggagaaaaaaatttgaatggatttataataaataagtaaagatattaagttagtaattaaaaaatttttaaagaagattttagatggttttattagtgaattttattaaatgtttaaagaataattattaataatttttttttttaaagttttttttaaaatagagggaatatttagtaaattatatagtttattatatttattggttagttataatagattaatattttttataaatataaatgtaagtatttttaataaaatattggtaaattgaatttataagtatataaaaaggattataaattataattaagtgagatgaaatttaagaatatagggtttgtttgatatatgaaaattaattaatgtgataaattataaaagattagaaaaatatataaaaattttaatagttgtagaaaaagtatttgataaaatttaatgtttttttttgattaaaataattaaaaagaaaatatttaataaattaggaatagaaaggaatatttttaatttgataaaggataattatgaaaattttataataatatatttaaattgaaaggtttttttataagatgaagattaatataaagatgtttatttttattattgttatttaatattgtattggaggttttagttagggtaattaggtaagaaaaagaagtaaaaaatgtttagattgaaagggaagaagtaaaattatttttaattgtagatgatatgattttatatatagaaattttaaatttattaaatattttattatgttaattaatgattttagttaggttgtaggatataaaaattaatatataaaaattagttgtattattaattagtagtaatgaataattttaaagtgaaattaagaaaataaatttataaaagtattaaaatttaaaatatttaagaataaatttaatcgaagtataagatttttatattgaaaattataaaatattaatgaaagaaattaaatatttatagaaatggaaagaagttttgtatttatgggttggaagatttattaattgttatgatggtaatattttttaaattgatttataggtttaatgtaatttttatttgaattttaattgttttttttttttttttagaaatggagagttgatttaaaatttatatgagtttgtaacgaatacggaatataggtaaagtaattttaaaaaagaataaagttggaagatttatattttttaattttaaaattttgtataaagatgtaataattaaaatagtgtggtattggtataagattagatatatagatttatagaattgtgagtttaggaataagtttatatatttatggttagttgattttaataaggtattaagattatttaatggggaaagaataatttttttaataaatggtgttgggataattaggtattattatataaaagaataagttagagttttattttatattatatatataaattaatttaaaatggattaaaggtttaaatgtaagagttaaaattataatttttagatgaaaatataggtgaaaattagtttgattttagattaggtaattttttaaagatatagtgttaaaaataaagaattaaaaaataaattggattttataaaaattaaaaatttgtgagttaaatgatattattaagaagtgaaaagatggttttttaaatgggagaaattgtttttaaattatatattttataagggtttagtgtttagaatatatttgtatatatatatatatatatattttagatatatatatatatatatatatatatatatatatatcgataatttaataataaaaagataatttaattttaaaatgggtaaagaatgttaaagatatttttttaaagaaaatatataaatgtttaaaaagtagatgaaaagatgtttaatatcgttagttatttgggagatataaataaaaaatataatgagatatttatatttaataggatggtgttttagtttgtgttttgttggtataattgaatacgtgagattgtgtaatttattaaaaaaaagaaatggattttttatatttttggaggttgggaagtttaaggttaaggggttatagttgatgaagaattttttgttgttggaggattttttgtagagttttaaggtgatatagggtagtaattatatagtgagaaggttgagtttattagattagttttttttttttttttataaagttattagttttaatttagtgataatttattagtatattaatttatgaatggattagtttatttatgagggtagatttttgatgatttaagtattttttaaaggttttatattttaatattgttatattggggattatgttttaatatgagttttggaggggataaatattcgaattatagtagttggttaataagaaaagatagttaataaatataggtaaggatagagaaattggaatttttatatattgttgatgggagtgtaaaatgatatagttattgtagaaaaatgtttggtagttttttaaaaggtaatatatagagttattatatgatttagtaattttatttttaggtatttatataagagaaataaagatatatgtttatatagaaatttgtatatgaatgtttttaatagtattatttataatagttaaagaatggatataatttaaaagattattagttaaggagtggatagataaaatatggtagtatatttatataatagaatattatttagttataaaaagaaaatgaagtgttgttatatgttataatatggatgaattttgaaaatatgttaagtgaaataagttaggtataagaagttatatatatatgattttatttatacgaaatgtttagaataggtaaatttatagagatagaaagtaatatttgtgattgttagggatgttgttaattattttgtaatatatagaatagttttgatagtaaagaattatttaattaaaaatgttaatagtttagaggttgagaaattgttttacggtgaagtttaatttattaaaaagtaaaaaagaattaattatgagaaaataaattaatattattttgttttaaatttattagagtattaagtttttatttattttgataatattagattaaaaggtgaaggagtatttagttattagttttaagtttaaagtgtattttggagtttatttattttaagatgtttttaaaattttgtaatttttaagttttttttttttaaatgaatttagttaagaatttatagaagagtagattaaattggaatttggttttttttagttttttagtttaagatattatgatattgaagtagtttagtggatttttataataatagtttttttaatttttttgtttatgttgttttgtaaagatggttttttgttatttatttaaaaataagatttttaagtagtttagaaatatattgagggatgttattaatgtattatgattgttttttttagttgattttatagtattttggaatagtagttaggaattaaggataagatggtattttttgtatatattttagatagaagtaatttattttttgtttatttaggatttgaaaaatgttaattttaaagaataatgtatatcgttagtattttttttaaatttattaattataaatatgtttttattgtttagttaattttatttagaggggatatattaattttgtaaatgtattttttatagtagaataatttgtattttttaaattgtatatttatagaagagagttatgagatatgaagttaatatattaagggtatcggttatagatttgtatattgtagaatattatatcggtttttttagattttagtaaggtcggtatttagttgaagttgtattggtttggttttagtttattattgtttttatttttatttaaatatttatttatttgagtagttttatgatagatgaagaaatataaaaatttttatttggaaatttttaatgatttaatattttaattaaatagtaattgaggaaaagaaagtttaaaggaagagaaattaggtttgtataaaagtaagatattaggaatttataagtggttggaagtttcgtatttgagagtgatggtaatttgattttagagatttattaatttagtataaagttgttaaaatttgttttttaaatttttatggattatttagattatagttaagttaagtatttgtgtaaggtatggaggatattaataaaagtatagaaatatattaaatgttttttatgtgtttttttttgatatttaaataagtttttaattaattaaagattagaaaagggggaaattttgttttagattagattgtggtttttaaaaataaaatgtttgtttttgttattatatgtatattttttataatattaggtggttttttgaaggttattaaattagtaatattataattattaaaataaaatatgtttattttgaaaaaaatttataattttgaaaatttttttaattttaatatttttattttattttgaaaagattgtttttgtttttgatttatagttaaagtagatttttattatatagtttagtattttattataaattattttggtttttttatattttatattatttttttttgttgttttagtagattgtaaatttttggttttttttttttagtttttgttaagacgtaagagtgttgaaggtaggggattaatgtttgttgatagatattgtttatagtagaaattgtagttatggtgattaggaggtaaaaaagtataaagtaaaaaaatcgtgggtttggcgagaagagttttggggttttattttatttttgttttttattagatgggtattattggttaatatgttttattttttttattttttatatttttattaataaagtagtggtagatgatattttttttttagagttattgttaaatgggattataaatgtgaacgttttgtaaatattaagagttttgtgtgattataatttattattatttatgttattattgttaaggtaaaatattaattatatttttttttttttttaaataattgtttatttatatttaaattgttgaattaattttttttaattttttttttatttttgttttttagtgtttatttaatattaaaagagtagtttttttttatatttaggagatttttaatggatgtttgaaattataggtagtattaaatattatatatatttattttaaatgtttttttttttttaattaagtatttattatatatattggttgtaaatttttgtagtttgagatatgatagtaaaattagtacgtattttttttttattttttataattttatgtataaaagatttatttttattatagattttagtagttttagtatatgattttttttttttatatataagtttagaatttttattttttatttaagggaagtaatttatagtttttttttgatatatttgaattgttaggattattatttttgtattttggggttattatgaagtaaaataaggattatttgaagttaagtgttgtaatattagaagagttaatttgataatttggatggttattaagtgattaaggggtaggtagtatttatagtatggagatgttgaataaaggaatgatttatattttaggtgggatgggtgggaagtataaaatttaaaatttttcgattttttatttttgtaattttttatttaatatttttagaatatagttgattgcgggtaattgaaattttggaaagtaaaattgtagataaggcggattattgtataaattttgaaattttttgtaagggttttttgtgttttattatagttggttattatttggtttattaaatataagtttttaaattttgttgtaatttttaatataaaagttggggaggttaaaattgatttataataagtgttttttgtatagtataatcgtttagaaattttttattgttattttgtttaataattataattattgttttgatttttaaattatatatgtataatttaatatatttattttatttagtattagaaaagttttagaatattaaaaaaagttttttttttaggaattttgtaattaatgtttattttaagtcgtaattttaatgtttgtattaaaataaaataagtaaaaaataaaaataaaaataaaaaattgttttgatttttaaatattttttataaaaattattaaatggtattaagaaaaattaaatataaatattttatatttattatattgttataaatgtaaaagattagtattagtaaaagttgatgagaatatttttaacgttttttggaaataatttggtattatttagtagaagttgtagatgtgtatgttttgtgatttagttatttaatttttaggtataatttttttggggaaaaaaaaatttttataaatgtgttttaggagatatttttatagtagcgttgtttaaaatagtaaaattttggaaataatttaagtgtttattaataggggaatagagaaatgtatgtattgtatttattaaaaggtttaataaagatttttataaaaaagttttagtttatatggatgaattttataaataatgttgagttaaaaaaataagttataaagattatatttatcggggggtggggggttaggggagggatagtattaggagaaatatttagtgtaaatgacgagttgatgggtgtagtaaattaatatggcgtatgtatatttacgtaataaatttgtacgttgtgtatatgtattttagaatttaaagtataatataaaaaaaaaagattatatttaatgtgattttataatataaagttaaaatatatgaaattaaataatgtattatttagggatatgtagataggtagtaaaattataaaataaagtaaaataatgtaaaaaatataaaatttattagtatagttttgtagatgggaagggagggggatgtgattgggaaagggtatttagcgagtattaaagggaatagtaatgagttgttttttaagttgggtggtaggtataaagaggtgtttattattttttatatatatatatttttttatgtgtatgaaataaaaaaaatttaaaaaatatgatgtttatggtatgatataaaaaatgtgttaagataagtttttaattttagttattttttttgttttttaataattgttttattttgttattttattgatatataaagtattatgttattatttttattgtttttttaggatgattattatttaatatttatattttttagattttaaattgttaaaaatttgttttagttttagattggtttggggaatgttttatagtggagtaaatgaaaataagggtttaaaaatatagtgagtaaagggtcgggtgtggtggtttacgtttgtaattttagtattttgggaggtcgaggcgggtggattacgaggttaggagatcgggattattttggttaatatagtgaaatttcgattttattaaaaatataaaaaattagtcgggcgcggtggtaggttttgtagttttagttatatgggaggttgaggtaggagaatggcgtgaattagggaggcggagtttgtagtgagttaagattatgttattgtattttagtttgggcgatagagcgagattttgttttaaaaaaaaaaaaaatatagtgagtaaaaaagatatgattaggtgggtgattatttaaattttttagagagtttttagtaattttgatttttgggttttgttattatatttttaaatgggggcgagggtagggaggagagatagtatatagaaatttattttatgagtttaaatgataagggttttaaagtatagtgagttaaaaaaaatagtgagttaaaaagatattagatttaatattttattttgttaggttttaggttgatatacgtttagtagttgtatttgaatatagtttttataaaatttttcggaggtttttattttttaaatgtttaggatacgtttttaagagaagtaatttgtatgtatatatatatgtatttatatgtattttatttgggtttttatattttattgattttttagagattttattttataatttgggatgattattatgaagtgatgaaaattataaattttattagtaaagggatgttggtatgtaggtagatattagatttaatatattattttgttagattttaggtagatattaggttagtagttatatttgaatatagtttttttaaaattttttttgggattttattttttcggttgagaaagtttagttatgttatttatttttaaatggaagttttcgggaattttatgtagaataaattattgaaagttatttatagagatgatataaaatttttaaaagaaaaatgtaaaaaaattatgatttaatgtttttgaaaatatttaagataattttaaaattttttttaagatttaaatttaaaaaaaaatttgaaatagttaaggggaaaatatatgtatattcgtataaagatatatatataaagatatatatatagatatatattgtaatattatagtagttataaaagagttaaaatttttttaataggggtttagttaaatatattatggtatatttatatggttattagaaagaatgaggtagatttgtttggatacggaaagatgtttgtgatatatttttaagagatataattcgtatgtacgtatattatatatatttatgttgtttatatttattttataaattagattgttattaaaaatttttaatataaattatgtatttttatttataagtaagttgtttatttttagaaagtataaaaaatatgaaaagtaattaaaagattagtaattatgttaatagtagagagttatttgataatttttgtaagaaatttatttttttgaagattgtttatattattggaaaaattgattaaagaggaatataagggttaatgtataaagtaatttttttaaaaattaggggaaaatttttattttaaaataattatgttatattttgaatagtatttggatgagtatttgggagaatataaaatataggatagggtttggtattttaaaaatttttatgaattatttttatttaaattaatatgttaataggtataatgttttatattatatttttatgaatttttaatgttatttagtttttaagggaggttttttgaaattagatttatgttaatgagaatttttttaaagtaaaataaggaaaatttttatttattagaaagttgaaagatgtggagaaaaaaaaaaagttggtatatattttgtataattataataagttaaaaaagtttgtattttatataagggtagtgggagaaatatattgatgagatgatataatggaaggagattggattatagttttttgttgttttataaatgtagttggaattaaagattgttatagcgggaaagaattgtggataaatttttatgtgaggatatagatatttaagtagggttaggatatttagagtatttttttattttttgtatatgattttttttatgatatttagtgtttttttttatttagagttatttttatatgtttacgttttttttttttaagtttatgatagattttaggagaaagttaggtaggtttgttgtttttggttttattataatgtaattagtatatggattatttggttattgtgggattttttttatgttattagggttttagtttgtataattatttttttggtaatagaatttattggtatatttgttgttttttttagtgtagtggttttaaatgtaggtgattatttaaaatttttagggatttttaaaaatttagatttttgggttttgattttgtaatttttaaatgggggtaagagtagggagggaagatgatgtatagaaattcgtattttttttattgtattttaggtgtagttgtgtattattagtttttaatattatttttgattgatttattatttgtgatttaagggtattagggtttggataaggtgcggtggaggattggagatttagaatgaatgatggaggagggaggaaaaataaggtagttattgttttatgggagagatagataggattggttttttgtgtatgtgaagtaggtgttgtgatttcggttatattgggaaggtttttttgttttaaagtattttttattagttttttattaatgtttgaaattttatttttatgattttatttttttaagttatgttatttgttaaatagaaatattttttattttttagtattttattgtaatttttttttaatgaagtataaatttatttatttttttttaataatttattaaaataaagtaggtttaggagggtattgtattttttgatttggtagataggaaggggatgttatttttttttttttatataaaaaaaggttatgatttaatatgatggtttttgtaatttgttttaggttagttttagggtattatttatggagttgttgtatgttaggatgatatttgatttagaggagatgtgaatttgtataaggaagaattatttgatgatgttttgggttatattttcgtttatattagttttattattttttgattttttggtatattttttagtatttgttatagttaattgttttttaattattttatgtgtttgtattatgtttttttagttagatataggtttttttgaggttagaaaaaatatatgatttattttttttttttatgagtacgtagtgtagcgttgaaaaggtataaggtttttagtaagatttttattgatatattttattagtaggtaatatagggagaaatatttttatggttatttttttatgatttttttatttttgaatattgaattcgatttgttttttaagttttttttttttttaagtaattgttttttttaaattaagagtttttttttattagtttatttttgtaggttttgtaaaaatgtattgatatgaaattagtattaattatttgggaaaatatttttggattttaaatatgtttgagggagttgaagttttcgttgatttatggttgaaagtagtttttgtaaaggatgaaattgggggttaggtgtagtggtttatatttgtaattttagtattttggaaggttgagattagagtattaattgaggttaggaatgtgagattagtttgggtaatagagtattattttgtttttataaaagatttaaaaaattagttaaggatggtggtgtatatttatagtttaagttatttgggaggttgaggtgggaggattgtttgagtttaggagtttaaggttgtagtgatttaagtttgttttattgtattttagtttgggtaatagagtgagattttgttttttaaaaaaataaataatataaaatgaattgggaaatgttaattaaaatagcgaagattgtaatttataaaggttggtagtttaatttaaaaataaaaaaaattaagggtttttatgttaaatgtttttattttttatattaaattttatttttaataaaaaattatatttaaatgttattttttttttttttaagaaaagaagtttatatgaaaggtagttatggtgcggaaaaatttagatttgtttgtgtttataaatagataatgttagaggtggtggttttagtttttagttttttgagaatatttatttggtattttttttaaaagaggtattaattttagttaatatttttgattgtttgaattttgagatatttggttttttgtataaattaaattaatttagttttattgtgtgtgtgttttattttttttattattattagttggatgaatttaggtgtttagtttttatttaatatgataattatgtttaatataagaaatttatgtgattttatttttatatggtttttttaattttttaaaagtagttattttttaattgttaatgtggaatgatattgtttttttttttattttatgtaaaatttgatttataggagtgataattgttatatatagtattaaggtatttagtgtgtataggatggattataattttttaaaaaaaaaatttagattgggattgtgtttaatgttatattttttaatttatgaattatagggaattttattttaaggagatttttggatttgtattttttaattttgagttttaattattttttttttataggaaaatatttttagtgagtggttattttattggggttataattagttaaatatttttttttttttttttaatatattttttttttttttttaatttaaggaagatattgagttttatattttgaatggagtgtgggagttaggtttgtaataataaaagtagttatataagtgttttgtatttatttagttttttttttaaaatatataaagaatttgaggtttaggtgaattaattattattgaatgtttattaggaagattaatttttgtaggattgtagaaataagtgatggagttggaatttgaatttttgttagtttttaaattttaagattttatttttttgttataatgattttgtttttttattagaggtaaggtttatgaataattcggatattatagaaggattagaattttaaatatatttgatttttataattattgtgataaatcgtaaaaaaataaaaataaaaaaatatttttttttatagttatatttttttgtagtgtaattgtagtttttttatttatttgaatttagattagtttcgtgatttgttttgattaatagaatgtggtagaaatatagttgttttaagtttaggttttaaagagttttgtatggttttgttggtttttttgtaattttaatgttattgtgtgaaaaagttaagggtagtttatttttattatttattgttatagttaattagttaattgatagtagatacgttgaatgtgtttagttgagataagtttagtttggttagattagtagaattgtttattttatttgtagatttatgaagaataataaatggttgttattttaaagttattaaattttaaaagtagttagttttaaattgttaatatggaaggatattattttttttggaaagatattgtttttttttttattttatgtaatattttatttataggagtgataattgttaaatttaagtgggaaggtatttagtatgtttgttatagagtaaatattaatagatataataaatatagttattttgagtaagtagagaaaataaaagattgtttataaagtttataaaagagggtttcgatatgtaaaagtttgatattaagataaatatttaataaatttttaattatttgatttaaatttgtaaagtaagattgaaaaataagatttgatttatttaagaatttgttaggtgttttggtgtaataaatttatttataaatattagtaattgtgtatttgaaaatttatattaagaaagtaaagttttttatattgtgggatttaatttatattgaattatataaaaattatttttttttaaagtttttatttgaagaggtagaattttagtattatgacgtttaaagtgttagtattttttttaagaagaagttaaagtaattggagaaaaaaagtaatgaagttatttttaaaattttaagaattttttaagatatgaaaggtttgtttttttttagatagttttattttaatttattttaattttaagttttttagaggtttaagtagttgatgagtgattgagagaggaatttgtgtggattatagggtaggggggtgggagaagagagttaaataggaagtatatgtattatatatgtattttttagtttttttttaagtttatggtcgaaatataaatttgataatggtattataagttaaagtatttattttttaattataattaattagtttgaaagttatgttatttgtaataaattgatagttagtattatattgaatggggaaaaattgaaagttttttttttaagatttataataagataagagtgtttattgttatttaattggaagtattggaagatttatttagagtaattagataagagaaagatataaagggaatttaaaatggaatggaagaagttaaattatttttgtttgtagattgtatgattttattggaaaagtttaaagattttattaaaaaaatattagaatagataaatttagtatagttataggatataaaattaatatataaaaatttgtggtatttttagatgttaatagaggataatttaaaaaagaaattagaaagtaattttatttataatagttatagataaaataaaatatttaggaataaatttaacgaaagaagtgaaagagttttataatgaaaataataaaatattgaggaaaaatattgaagaggatatataaaaaaagaaagatagtttatgtttatggattggaagaattaatattgttaaaatgtttatattatttaaagtaatttatagatttaatgtaatttttattaataaatattaatgatattttttatagaaatagaaaaaaaaaattataggatttatatggaattataaaagtttcggaatagttaaagttattttgaataaaaaaaataaaattggaggaattatattatttgattttaaattatgttataaaattataataatttaaataatatagttttagtataaaaatagatatatagatttagagaatttagaaataaatttatatatttatagtgaatttatttttagtaaaggtgttaagaatatatattagggaaaggatagtttttttaataaatggtgttgggaaaattggatatttataggtagaatgaaattagatttttattttttattatatataaaaattaaataaaaatggattaaagttttaaatttaagatttgaaattaggatattaaaagaaaatatttgggaagttttttaggatattggtatgggtaaagatttttttagtaatattttaaatgtataggtaattaatgtaaaaatggataaatgggattatattaagttaaaaaatttttgtatagtaacggaaataataaagaagtaatttataaaatggaagaaaatatttgtaagttatttatttgagaagggattaataattagaatatataaagagtttagataataggaaaaaattaaataatttaatttaaaaaatggataaaagatttgaatagatattttttaaaagatatataaatggttaataggtgtatgaagaaatgtttaatatttttaattattagagaaatgtaaattaaaattataatgagatattttattttagttaattatatattatttttataattgtatgtttgtattaaaatatgatttgtattttataaatatatatgtttattatatatttataaaaattaaaaataaattttaaaaataaaattgaaataaagttaagattataatgaagttagtttgagattaattaatgaaaaaggtttattttatgaatagcgtgtagtatggtataatagatagagtttttaagtaaaaatttttggtattaaggagttgtttaattttaaaatatattattaaaaataattttaggagtgttttttaagtgttagatattgtgttatgtagtttatatgtattattttgttgtgtttattttaaaagtgaggaaatagagtttatagggttatgaatttggttaagtttatatagttgttagttagatttatatttagggaatttgaagagttttaatttttatttataatattggatttagtttttttatatgaagtgagatttggatattaaaattagttttatttggaattttatgattttttgataatgacgggagtatattttttcgtggtttgtgtattgggtatagggatgaagattggtattttttattaaaaataaatgtttttggggtgtatgttgatatgaatttttatatttaatttttttttcgtatatgtaaatatagaaatggtgaggttagtttgggaaataagtttattgtttatagttattttggttagtttattattttttaggtaaggtttgtttgtttttgggttttttttttaatttttggtagagtaggtattaagtaaatgttgaatgaacggaaaaatattttatagtttttgttggaaagagtttgaaattggatggtattttagaatgtgttttataaatgttttgaatgtaatatttataaattataagttttagaaaggtagaaataattaaagttttgtttattgttgtattttttgtagtttgaattgtgttttatatatagtaattgtttaataaaagtgttgtttttattattgttattagatttttatagttttagttttttttaagagaaagtaaaatatatgtattaaaggtaaggttatgttatttgttttttttgtggttttttgtttaaatagttttatttaaattgagtattttaagtgttaggtgttatagtgaaaacgttttttgtttttaaggagattggatttatttggagataaattagaaatatataaatagtattaatttaataaatatttattgggtatttattatgtgttaatgattaatttaggtagaaagaattgtgtggtttgtggttgttagaggatattattagatgaggtggggggttatggtttggattatataaaggaaagtatataaaataagtggtattaaattggttttgaatattatatatattgttaaaagtagagagaaggagtttgaattttagattgtaatagtttttagttatgttatatggtatattggtatgttgttattaatttaggatttatggtaaggaatttgttagtaataatgatttatgtatttttattataaagaaaagtataaatattgttagggggaattgtgatttgttataattttcgaaaaaagtaatttggaaatatttgttaaaattttaaatatatatatttttgatttaggaatttaattttggggaaatttattgtattatttcgtttttatattgtaataaagaattatttgtgtttggataatttatgaagaatagagatttaattgatttatagttttataggttttaaaggaagtatgattgagaggttttaggaaatttagaattttggtggaagttgaaggagaagtaagtatatgtttatatggtagaggaggagatagagagagaagggggaagtgttatatatttttaaataattaggttttatgagaatttacgattatgagaataataagagggaagtttatttttgtgatttagttattttttattaggttttttttttgatatgtggggattataagtgattgagatttgggtggggatatatagttaagttatattattttgttttcggttttttttaaattttatgtttttatattttaaaatataattttgtatttttaatagttttcggaagttttaattttttttagtattaatttaaaagtttaagtataaagtttttttgggttaaggtaagtttattttgtttatgagattgtaaaattaaaaattagttatttttaagaaaaaattgggatataggtattgggtaaatttttttattttaaattagagaaattggttaagataaagaggttataggttttatgtatgtttaaaaatttgtaggatagttattaaattttaaaaatttaaaatgattttttttgattttacgttttatgtttaagttacgttgatataaggggtgagtttttaaggttttggatagttttgttttggtggttttgttgggtatagattttgtagttgtttttataggttagtattgagtgtttatagtttttttaggtatatggtgaaagttgttagtggatttattattttggagtttggaggatggtatttttttttttacggttttattaggtagtgttttagtggggtttttgtgtgggggttttaattttatgtattttttttgtattgttttagtagaggatttttatgagggttttgtttttgtagaatgtatggatatttaggtatttttatatattttgaaattaaggtagaggtttttaagttttaatttttgttttttgtatatttataggtttaatattatatgaaggttgttaaggtttgaggtttattttttttgaagtaatagtttaagattattttttggttttttttagttatagttggagttagagtagttgggatgtagggtattatgttttgaggttgtagagagtagcgtaattttgggtttggtttacgaaattattttttttttttagatttttaggtttgtgataggaagggttgttatgaaggtttttgatatgttttggaaatattttttttattttattggttattaatattaggttattttttatttatgtatatttttgtagtttatttgaattgttttttagaaaataggttttttttttttattataaggttaggttgtaaattttttaaatttttatgttttgttttttttttaaatttaagttttaattttagattatttttttgtgaatatatatgattgtatgttgttaggagtagttaggttatatattgaatgttttgttatttagaaattttttttgttacgaattttaaattattttttttaagtttaaagatttatagatttttagggtaggggtaaaatgttgttagtttatttgttaaagtaaagtaaaagtgaattttgttttagtttttaataagtgttttatttttatttgagattattttagtttggattttattgtttatataattattagtattttggttaaaattatttaatatgtttttaggaagttttaaatatttttttatttttttgtttttttttgagttttttaaattgttgtaatttttgtttattatttagttataaagttgttttcgtatttttatgtatttttatagtaatgttttattgttttggtattaagtttttgtattagtttatttttatagtgttataaagaattaattgagattgggtaatttataaagaaaagaggtttaattgatttatagttttataggtttaataggaagtattattgggaggttttaggaaatttatatttatagtggaaggtaaagaaattatgtttttatatggtagagtaggagagatagtgagtgaagagggaagtgttatatatttttaagtaattagattttatgagaatttattattatgagaatagtagaggagaagtttgtttttaggatttaattattttttattaggttttttttttgatatgtgaggattataatttaagatgagatttgggtggggatatagagttaaattatagtatttatatttagaaaaaaagttgttatttgtaaagggtatatagaaaagggtgtttattagaaatttgtttgtagtggtaaaaattacgaaattatatgaatagaatattgtttatttaaaagaatgggattcgtatttgttaatttggaaggatgtttagggtgtatttgttaggtgagaaaagtaagttgtagataaaggggtataagataattttatttttttatttaaaggtaagtaatttagaaaattttatatgtgtttgtttatgtttatgtaattatagagaaatgtggaggataaggggagatgtgtaggaagaaagaggaaagaaagaaataggaaaggagacgtgatggaaataagtttattaatattttggggtataattttattgatggaatgaatatattatttttgtaaattttgaaggggtatttgtaaaaagaagaataaattttaaaaggagttaattataagattatttttataatgtttatttatatttagatatgtttttttggataatagattgtgtataatttaaattttttaaaggttatggagagtttatgtggttatttattatttattatcgtgtatatgggttgtggtataaagaaggagaattattatgttatgagtaataaaattatagatattttttgattaggggaataatattgaaagtggtgttttaggaagattaatttggtagtagattgtagaatgaattaagaagggagaggagaaaattagagaaataattaggagattattgataagagtaataagagtttgaattagggtgtggttagtttttttttgttgtgttggttttttagggaatagaaatttaatttttttttggtttttagtttttttattttatttttaattgaattttagggtttttgtggttttagaagtatgttttttattatttgttttaattatatttaaattttaaatttaagttttttttttaaaaaaattataaacgaaattattagttatattgtgttatttaagatttttttaatttatttggttttgatttttgggaatgtttttatgttttaaagattggttttaagaataataattatttatatatttatgttattttattttgttttttttatgttagttaatgtgataattattttttttttgttatattttaagattgttgttttttaattttttagttatttatttattttgtggttgttttttttggttgttttttagagttttgtttttgttttttttttttttttttttgaatattagagtagtttatttttaaatgattttatttgatttttttgttatggttaatatttatttaatttgtatttttttttttttgcgattgttattgttatattaggttgaatttttttataatttttagtagaagagatgaatttattttattaattttttgattgttatatattatagatagaataagttaaatttaaaatataaataagttgaagaaagatattttgaaaatttaggtaaaaataaaatatttttttttttttaaggtatttagtgattatatatatatttatttgaaaaatgaggaaatcgattttttgtttgattttttaggtaagttagtataaatatatatattagatttatttgtttaaataattttaatttttataaaagtgaaaagtataaagtttttgttataaaagtttttatattgataatttattatgttattgttttgagtaagtttttaataaattattaaaggaaaaaattttttaattttttatttataaatattggttattttaattttttaatggtaaatagattagagttattttaagaaattatgaaaagtaatttatttcgaagttttaaagtaaatttagagattgttaattgaaaatatattttttttatgtatattttttgtatttatatatatttgttagttttaaggtttatttttatttggggaagataatttgggttattattttttttttagtgatatttattatttgttgatattttttttattcgagaaagattagaaatataatttatttttatatatttttttggtttatatgttaaattttgtttatttaggtatttaatatgtatttgtagaggttttattatgtgttagatattattttagacgttggtatataggagtaagtaaggtagatagtattattgtttttatggagtttatattgtagtaggtgagtagataagatataaatagatgatgttaagaagaaggaaagattgtgaaagattttattattttagatagagtagttagagattttttttatagagttgatatttaaatgagagagtaaattatgtgggtatttggggaaagaatattttaggtaaattttttttagatttgggtttatatattggggagtttagaaagaggattattttttttagataataaggatatttttaagtgattagaagaaaaaaatattttgtaattagggtatataaattgaggttatggtgaaagttatgttttttttttgttttgtattatgtgatatttgatgataatatgtatgtatataatatttttatttattagttgttgaagttttttgttggtttatttttatgtatttagtttttatttagttaattaattttttttatttttttttttatttgttttagattttttgttgtttttttttttattttaaatagttgaattaaattttgttttttatttatttatgtatttttttttatgaagttttagttatgtttttttaggaaggagtttgagattttttaagtttatattttaaaaagtaaattgagggagggggaggtagggatgattattattagagtgttttttatgttgttggggatatttattttttttatttttatatgtttagtgtttagtttgataaatgtttgttgttgttaagtgtaattagaaggattttggagattatttagttaattttttattttatttattattagaatttttggtttagaatatgtttttgtagttttttagtttttttatttacgaatataataacgtagttaggttgtttattgattttttagtgtttatagagaaatattgaggtatataaaaattaaatttagttaggtattagaattgaagtttagaatttttatttttttttttaatagttttataatttttttttttggtttttttatttattgtttttttgtttaaatatgtttgtgggatttttaaagtattgtatagttttgttaaatattattattaattaaaaggttatttatttttaaaatattgaattagaaattattttattaatttgttttttttttaaaaatattttttgattaaaaatgtagtgtttatttatagattgtattaatattagtttatgatatgtgtttagtgatgagaagtatttgttatttaatagaaaatttattagttttttagttgatagaataaagtaagaggtttaaggtaaataaagtagtgtagagaaaatttgttagtagtaaaatattatttgttatgttaggatggttttttttttttattttttagttttgaaaatttataaattattttttggggagaaagaataaatatttaagaaaatagtttgtttttagtataattttaaaaaatttaaagtttttaagtaggttgttgttataaagaaattttaagaatttcggtattaatagaatagttataaaatgaatattttatttttgatattattatatatgtttttattattttaaagattaggatttattttaatttagtattttttgaatagtaaatatgattaaatttagtaaatagtagtaataaaatttatttagtttttaaaagtattattagtaatcgtagaggttttttttaggttgtgaggaataaaagttaaaaatatattaattttatattgtagttataatttaaattattttatgagtataaataattttagtatatttgagttgtttttgttatattgataattagatatttaattttttgatatattaagggaaatgtgtatgaatgagaaattaaattgtttgggagattgttgtaggaatttatattatgtttattttatatttgttattgttaaatttaagtttaagttaaaagtagatttattttatttaaatataaaataaatatttatttaaaaaattaggtttagaggtgaatagtttttattattttattattatgttaagaagagggaatatataaattgttattataaagttttttaataattttaagaaaatataaattagaatttaattattaagtattatttattttagaatagttattttgggaagttatttatttattttaggtatatttaaaatagaattaaatattttttgtagaaatatttatgtgggtttttttaaaaatttttaaagaaaataaatgttattattcgagagaggattaaatttttaaatatttggtaatatttatatgatttggagttatataaataaagttaagggataaatatattttttttgagtaagaatagttaggtgttattatagtgtaatgagttcgatttttttttatggtttataaggtggttttgaaggtagttttaaagaggagtaatatatatagttttttaaggtggaaatttagaatatttattttgggttttttgttttaaaaaaaaaatttaatttattttatagttatatattttgtttttaataaatttagttgaattttagatgataaattttatataatgttttgattaaaatttttttaagtttttatttaagaaagttgtttataaatttaggttttatatcggtatgtttattaatttaaattgtcgtttaataattttatgtttttttttgtttttataattttggtttaatagattaaatttgtttaattgaagttttttttaattatttgattaataaagaaaataagttagtgtagttaagttttataatttttttaattttatgtagttaggataaattttggtatttaatatatttaagagtttttttagatagttttaataaatgtaataaatgtaaaaaaattttaaatttgaaaattttatttttatttttaggtaaattaaggtttttaatgataaagaatttttgtatatttgattatataaaaatattagaataggaaatattagaaagagaatattttagtatttattaataaaaatataataatgtggttggagttattattatggttattatgtagatggtatatttaatattttttaataaaatttattgaaaattttgtcgaaggcgtttttaaaaaataataaaattgaaaaaaaaaattattgtgaagatattacgttggtatttgaaggttttaaaatatagtagtttttatgaaattgcgatttatgattttttagggattgtatatagtagattttaaaagatttttgattataggtaatatttatattatagttatagatgttataacgtatttagttaatgagagttatgttggtttaagttaagtggatttggtagagttttaaaaattttattttgtatttttataatgttttttaatttttttttttttttttttttttttttttgagacggagattcgttttgtcgtttaggttggagtgtagtggtgtaatttcggtttattgtaagtttcgttttttaggtttatattatttttttgttttaggttttcgagtagttgggattataggtattagttattatgttcggttaattttttgtatttttagtagagatagggttttatcgtgttagttaggatggttttaattttttgattttatgatttgttcgtttcggttttttaaagtgttgggattataggcgtgagttatcgcgtttggtttaatgttttttaatttttaaagtaaacgtatatgtataaattttgttaggtaaaaatttttttattattttatagaaattgaaattgtgataaaaagtagtaagtgattttataaatatatgtaggagagtagaggtttgattttttatattttatttaaagattcgttgttgataaaaattattaaagatatatgaggaattaatatatttaatattaaatatttttttttagataagtgttaaggttttttggttttttttttttttttttttttaaatgtttttagtttttatatttgtaaaattaaggtaaataatagttgttttttgtgttttatggatattgatagaattgagatttaatatagtaattagaataaaaatttttatagagttgagatttaaatgagatgaatgtatgtaaagtgtttagtatagtgttgttatataattggtgtttaattattattaggtaaaaaaaaattaataaaatgaatagagaagaatatagatattgtatattttaaaaatttaaatgagttaaaagtaatttttataaaatatgtggttagtttgtattatgttaattaattatttgttttagatgtttagaagagatttagataattaaagaagtttattagggaatttagataattaagaattgagatatttaaattggtaatatcgtttattaagtgttttgtgatttttattttaatattttttatggattttaattttttattcgaaaaaattagggggtagaattagggaaatttttaagtttttttaagttttaatttaaaataattgtaacgaatatagaaaataagttttgagaatttaagagttttatttttcgggtgttaatagtagtaatagtttatttttatatattattaattatattattttaaatttttattttataaaaatattaaatttgtatttatatttatttgttttatattcgataatttataaagaaaatgttaaagaattaattttgttatattattttttattttaattattttttttattaaattgacgggttaaaaggattgtggaattttagaaatatatatataggtgttttgaaaataatttaaatatagttgtaaagaaagtatttttgattttaaagtatttagttggaggttatggattgttttttttagtattagaaattaggtttttggatttttagttgagtattttttttttgtttttattattgaatatttaaattaaattttttggaagggatggttaaaaaaataaaaaagtaaaatttgtaatttaaatagttttaaaattaaggaagtttttatttttaataattataaaagaaaatattaaaacgataatataaagtaaaatagtgtttataataaattggtagagttttagtgtttagtatgtgataattataaggttataagttatagtattgttttaattagtatgaaataataaattatgtagtgaattgtattattttataatagtttttaaaatttggttattaaatatatttttataatagttatagttaaatattatggatagttatgaaattaattagaataaaggttaattttattgtaaaaagaaatagtaagttaatattttttgtaataaattatgttttaaatattgtatatttattgaatttttaaattattagttataaaaataaaaatttaaggtaagataatgcgtaaatatttataattaattatattattaaaatttttttttttttatatatatttttggtgttttatagtgagaatgaaaaaaaaattataaaataataggtatttttattgaatttgttgtattatagataggattaatgttgttgaaatttgttaaaaagaaaaaatatttaaaagtattcgaaattaatatttgggttattttgaaaaagtatgtttaagtatgtagttttattgggatgtaattaatatttaaattggataagtgataaaattcggggataatatatttttatttaaaatattgaatttaaggaatgtattgtaatataaatggtttaagtgattgtttagtatttgtagaattttataatttattttgtatattatgaaaaattaatttttttaatattttagtagaaaaatatataatttatagaaatatattattaaagaaaagggttgttttttagttagttgataatggttgtaaaagggtattatgatatatgaaatgattatattaatattaagatattaggtcgattatatttaagttattagatttttatttattaaatagtagtttaaataaaaatgagaaaaatatgaatttaattttagttaaaataatttttaagtaaaatgtgtattttatttttttttgataataaagtatagtaagaaataatataatttaaaaattagtattatatagttatggttagttttagatttttatttgaaataaaagaaattaaattgtaattttgattgatgtatttttttgtatttatagttttaaatttttttttttttaaatttttaatttatgatagttgatttaaattgttagtttttagaattgatttggatatttttaaatttatttatagtattttatatttttgttgtttttttttttttattttttatttttaattaatttatgaattttattggaaattttgtatttagagatatttataatagtattgagtattaaggaaagtaatttgttataattaggtgtttgggggttaaaattattgtttataaataattttgaattgtaataaaattttattttttttttaatatgtaaaatgaataaaaattattattataagttatattttaatttagtttagtatagaaatgattatatataatttaatagggaaaggaatatttagtagatttttttttttttaaaattgaaatttttaataggaatattttatttatttgaaaaatataaaatttaagtattaatagaatatgttagaagaaaataagagtagtcggttttttgaagttgtagaaataaggatagtatgggtttttaaaaattttttttaaaggttaatatgtaatggatttttttttgtagttatagtttaatttaataaaatttttttgaaaattttttatgtaataggaattattaatgtatattttttatgatttagaaatatgaaaataagtgtttattaatttggtaaatatttgtaaatattgtattatataattatttttgatgaaaatattattaggatgtttttagaagggtaaatgttatttagtataaatttattttgtttatttaatttgtttatttaagtattagtatataatgagaatttattgtttattaaaattaggaataattattaaagtaaaaaagaatgtgttttaagaattaagtttaagttttagattttgtttaagtttaatgtaaattaagattttttgggttgttttagttatttgtaggttagagtagattaagatttatgtaattaattaattaatgtagatgtttcgatttttatattaggtagttatattaaagtaaatttttttgatttaattttttttttattaaattttaaaaggtttttaaagtgatttttatttatatatttattttattattaatataatttgtatttaatttatatttatgtaaggtatattttagaataagttttttataaaatgtataaatattaaataagtagtaaaagtggttagattaaaatatatgtaatataaatagataagattaaaataatatatgaattatgttattaattataaaaatataaggggattagttatagaaatatcgtaagtaattttaataaaatttgattatatgttagttatatatttttgtattagttattttatattaaaatgatatatttgaatatatagtgtgttttaaaaattttttttattaattatgtagttataataagttatagatttaaaaaataagatttttattataaagttaaaaataagtgaaaatatatttaaaaagaaattttttttaatatttagaaattattttatataaatgagtattagaaatattaagtttaaaaaatattgaaatatttattgttagaatttttagaaggaaaagaaaaagaaaaaaggtaggaagtaaagaaagtatttatgggggtgagggtaaattatagttaaaataaatttttttttttcgtattttttttttttttgagaaaatatttaatatgatgttagtagaatttgttttatttattttgtatttgtataggtttttaattttattatttttataaaattagatatagatgcgattattaatgagatattaaaatttatataaattttagtagttttattaagtgttaattattatttaattttagattttgtcgaaaattgaatttataagtttattttatattatttattttttttaataatttttttttttaggatacgaataattttttaatattaaaattttaatataattttaataaaagttttaatattatttaaaattatttttgttttttatttttgttattaatgtttaaatgaaataaggttgaaaattaaataatgtagaaatgtgttttcgttaataagtttatgttaaatgtattgaattttagtatttttaaaagtatattaagttagaatgattagtttgttttatttaaagaatagattttgagaataaggttttttttgttttattataaatgaatttagaaaatgttttattaagtttaattataatatttataattttataattttatgtgataatttaatgttgtggtggaaggaaggaattgtttttttttatttttagagaataaagtgaggatttttttttaagtattttgataaaaataattttaggtggtattttaaaaagttaaattgtaatttataattttttttaatttaaaaggaatttaagttattagtggtatttaatattttttttcgtaaagttagaaggttagtatttaagttgtggttttaatgtgttgattatttgttgattatttagggttattggttatagtaaatgtttggttatagttatgtaatatatagagaagagaaagtaattaattttagttatattagggttgttgtttggaaataatagattaatttaatgatggtttaaaagaaatattgttttaatttatttggatgaagttttgttttgggtaattatagtttttagtgttaagttaatgttataaggtataaaatttttaaatattaataaaatattttgtataaagtattatatttttttgttaggatatagattattgattatattttttaattatagattggtataaaaataataattttatttgatattaaagaatttttaaagagtcgtattattattgttttgtttattatttttataaggttatgggatttaaattaaaaatacgtaaagatattttatgttatgaagtattataaaagttaaagtattaaaattatttttagtgatttaagagtaattatgtttatttatttatattttatattttagattttatagggtttaaaagtttatagtaaatggaaaataagttttgttttttgttttttttttatagtaaggaaaatgaaaattatgttatgatgattattagggtaaaatttattaataatttttaagagttttttaagatgttttatttttttttgtataattatatgttttataaattaatttaagagttttttatagatagtttagttaaattaatcgtatttaatttttttaagaaaattaagtatgcgaattttattgttaaaaatttgtaattgaaaattttaaaatatagtatgttttttagtatttaaaatataatagtttatgtaataataaagattttaaatttttttattgaaaagattttaaatttttaatttaggttgaagtagtgtttttttaaataaaggataattatttaaataatagattaggaggtagtttatattaagatatgtaagaattaaggttttttggtttttttttttttttttttgataattaagttttttagaagaatagaatatagtttaaatttaattttaaattatttttttaataagaaaagttttttaagtatagaggaaagaaaagagatattttttaggttaggatagtttttatagaaaaaggatttttaaaaatttgaataattagttaatgggaacgatgaatattattaatatttaagaaaaaattttaatagttatatataaataaattattgtttattatgtttttttttaaaaaaattcgttgattaattaattttgtgttattataatttatatttttatatttttttttataattaaaatggatataaaatttagtatttatttgaattggggatgaggttacggggtagagaaatttatttttattaatacgtatatttatatttagaatttttttttgataattttattttttgatttttttgggttagataaaaatattagtatgtttataaacgattgagtaaaaaaaagagaaaaattaaacgaaagttgaaaattgaagtttaataattttggttattagttatttatttgagaatttgtaggaatatttgaacgtaaaattttgttttgtattatgttgatattaattttttttttaaagagattgattagtagatataatttgtttattttatggtaagaattttgtgagtaagatttgtgtttaatattatggtttggtatattgtttattgtattgttttagtaattttaaaatttaaattttttaatagaagatttagtttgaagaatagggttttttgttagtatttttgtttttaattttttaattttaagttaatatttaacgaatttataaataaggtagtataatttttgattatgtaagtaagggtattatttattgtaatataagaatatattttaaaatagttgaatgattatgtataatataatatgatattatgagatattatatttttttgaatttatataatttttcgttaagatatttgttaatgagtaatattattttaaaaatgttaaataaaatttttatcgttggttaatgggatattgaaaattattatttaaggaaaaaatttgaaatggttacgtatagatgttatttaggttgtttattttttttatttttaaaaggttatttaaatttatttatataaaaaagtatatgaatttttagagaatatatataaattaatgaagatttatatttattaatttattttaaatgtattatttttaagaaatagaaaaatattgattttattttgaatagttattagaaaaaattgttcgattagggaagtttagagtttttagagaagttaagttgttatttttagatttttggtatttattttaattttcggaattaacgggaattggtggaatgatattaaaaataggtttttgattttgttgttgagaaagggatgttgtatttatgttatagtggtatatttgttttttagaggtatttatattatgaatagaaatggtagatattttattattaattatatttgttttaggaaagtttgtttgatagtaaattgtgtttagttttttttgtttaattattttaggggtgtagagttcgatgaaattttttttttttgtttttatttggggtagtgttatattattggggtttgataaaattagatttttattatttttaattttgggtttagtgttcggtaaaatgagaggtttgtagtttttattcgagtttttttttaaaaggaatgaatcgttttttttcgttagaggagaaagtaaatagtttttatttattaataggtttgatttttaaggatttttattcgtttttttatttggggatttagaagaaaattttaaattttgtaaaatgttaaaggtgttttggtttgtggtatataattttatattgttatcgttggtgttagtttggttttttaaatgttgttgttttgaagatatattagagtgagtttttggaaattttttttttgtgggggtagtagatatagtagtggatgttgaatttttggggttttttggaatattggtcgatttattgaggtttgtaatgtttttttttaaaagttttaagtttgtttttttcgaggaaaggttgatttggttttgttgtgggaattttaggttattttttattatttttgtttttgttttttttatatatagttttattgagagtgaaattgttttggatagatttggttgttgcgtattgtttattgagttttttggaaaattaattaaaagttttcgttgtttggagtttgattgagaagcgatagttagtgagggtgaagacgtagaaatttttatagtagtttttttttttagggttttatagaagtttattatatttttttttttttgagtaagtatattgttggggtttttttttttattaggagttaatgattttttggagtttattagtgaatattaattataaaataaaaaataaaaacggggggaaaatattataagttttaaagttatattatttttttgattcgattagtaagaggtagtttgttaaatgaattttttagttaatttcgaattaaattttttgttattagaagagtagtttttattttttagaataaaaagttatgttttttgtttttatttagtatgttatatttaaaagtataatgtaatttatttgtatagttgagggtaaaagtgtatcgaattaagtttggttatttattttgtcgtttattgaacgtgtagttttgttaattatagatattataatttattatatttgattattttgaaggtttaagttgatgttaaagtatttaattttaaaaaaaggaagtgtgattattaaaatttttatttttttttaattacggttgtttgtttttttgagaattaatatatataatatttgataaatattatgttagaatttttaatttttaattatttttaaattttttttttattagttagttatatatttaaatttttgagtataattaattggtgaattatgtacgttttttttgaaaaataaataatgttgatttgtttatttttcgataggttgggaaaaggttttttaatttatatttttgattggatgtgtttatttttaaattttggatatatgaaatgagatatattttatataggttaattaaaatttagattttaaagagtagaagagaaggtgtagtagttttttattacgttgttagtttatataatttaaatatagttgatttttattataatttataaaaatatttagattaagttatatttgtttatattgtttgagatttttaatatgaaatgttattatatttttaagtttttttttttttaaataaatatcgaagtattgaaaaatggaaaaatatagaatcgtaaaattatatttatataaatttaggtataattgtatttagtaaaatgtttaaaataattttttttgtttttatttatttaaatttttatttattttaatttttagtttatttttaagagagtaagattgttagtatatcgttaattagggtgttttaagagatgggttaagacggagaagcgtatttgggatattatagttaaatttcgtttaataaaaggtaattttttttatgcgatgacgttaggtagtataaatgttattggtttttattgaaaagtgaatatgaaggtagagagaggggtgtggatttgttattataaattttgagggtaaattgtttatttttttatttttttgtttcgtttatttgaggcgataacgatttttaaatacgaggtatcgaatggagtttaatgaatttttatgtcgtttttttgatagttgtttttaaattcgaaattaaaataatattttttaaaacgaaaacgtttttttaagcgatattattttttagtttaagttgtaaataatttagttatattaattggttttaatgaattatgttagagggttttaagtggtattataaggttgtaattattaagtttgtaattttaaacgttaaattagtatttgtaaaaatcgtagtataaaattattacggttatagggggtttttttttaaaaggggttatttagaaattttaggcgcgaattaataataaacgttaaagagtaagtttttgcggggcgggggtggagaagagaaaaaagtgcgaggttaaaagagaagtacgtttagatttgttgagtttttttttcgatacgtttatttttaatagataacgtcggtttcggtcgtagtttttaagttgcgggttgttagtttttcgcgtgtgtatttttacgcgtttcgtacgttttttttaagttaggcgtcgtcggggttttttcggagttcgggttcgcgttcgggcgcgtcggggtggcgtgtaaatattcgggcgagtaaaatttagacgcggtttagcgtttattacgaaaacgggtgtcgggcgatttttttggagggaaaggggatattagggggagaaaagaggttaggattttcgcgaggaatgagaggttcgaagttttcggtagttcgatagggtttcgttcgtcgttcgaggttaggtttttttttttcggttcggttaggggacgtttgcggagggagaggaagaggttagcgttgttattcgcgcgttgttttttcgttatcgtcgttcggtttttgttagttttttatttttatttttcgaggttaataaaagtttgtaggttttcgcggcggttttcgagttgttttcggttttagcggtatttcgggggagcgagcgcgtttcggttttttttcgtttcgttttttatttttggtagaggagtcgttcgttcgttatcgttcgtagttttcgtcgtagtcgagataaataatttagtttgtgaacgtagaaggagtaggagggaaatatattttttttttttaaaaaaaggaagtaaatagtcgtttttttttttatgggtggggggagagtttttatttaagaaagttttttattgtttagttgataagttagtttttcgtttcgcgtcgggtttcgcgggtcgaggtttcgggcgcgcgtgtttcgtttcggttttagttgtttcggtcgtttcggttgcggcgtttttttttatttatagaattcgttttcgacgggtaggcggtgattcgggttttcgttatagatacgagttcgtaaaatggaggaggcggcggcggagggaagagagcgcggatacgcgaaagggtagttcggtttgggcgagcgagcgggatcgagcggggagcgggtggaggcggcgttacggcgcgtatatattcgtatatacgcgtttttattttattttcggtcgtttttcgttcgaggggtcgcgcggcggtcgcggggaacgatgtaatttgttggtgacgtttggtaattgtaggggcgttcgcggtttttgtttttacgtttttcgcgcgggtttcgttatttcggtttcgacggcgtttgtacgttcgcgttttttggcgtggtcgtttcgttcggtgcgtcgcgtttcgtttttcgtttttaattttttaggaaaaagggtggcggcggtagcggcgggggtcgatttggtttttttggggcggcgttaagagggttatcgagtttttttagttttttttttcgttatttttttttcgttttcgtttagtttcgcggttttagatttattcgggagttcgttttgttttttggcggtaagcgtcgttagtgtttttgcgggtgatagcgggcgggttataagagtcggggcgtttttcgcggttgagttgcgtgagtggttcgcgtcgtcgtcgtcgggtcgagttgcgtgaagtgtgttatttcgaaaggggttacggggttgtacggaaacggtgtcgtagcgtttcggtcgcgttcggggtcgggcggtttgatacgttttttggggaggttttagggaagggacgggatagcgggggtcggcgtatacgtattttgggttcggggggagtcgcgtgtcggtaggttttttattatcgtattatttgggcggtcgggtttttagttgtcgtcgtcgcgttttcgtattgggagagaagttgtaaagtagaatttattttttttcgcgtttcgatcgttttttattttttttttcgagtttgcgaggcggcggcggcggtagaaggaggcgtcgtttgttaagtttaatttttatttttttcgtttaatgtgtttatattcgaaggaagttgtacgttaaatgtaaaatttttagcgagttggatttttttgtattttttttttattattatgattaaggaaagtagggggcggtaggtttaaaagtaagttgtaggcgaaatagtaagttgttggcgaaatatagtttttttttcgaaatttttgatttttttttttatttcggttagggttcgcgtttaagttttcggtgtaggttttattttcgaattttgatatttgttgttttcgattttgtgcgttgtttattttattacgtttataggatttttgtttttataaataaaataaaatataggtagttttaaaatgttagcgtttaattttttatagatgtttttgttaggagttttttttttagtttaaggggaagggaattcgtggttcgttttgagaaaggagagggtcgtggggcgaggggtgttcgtgcgggaagttttcgttttagtttttttttttagttcgtcgcgtcgggaaggtttggacgatgtcgggatcgagttttttattttgtgcggtatagattatgatttttgtgattttgggaaaggttgtgttgtgtgggtttagggtttggggaggtaatttttgcgtttttataggtgatatcgtttgttagtttttgatacgggcgggggttgtcgtagttttatttaattttgttcgggcgttcggttatagttatttttttatttttcgtcgcgtttagattgacggcggttttttttgttttgatattttgaagacgattggggaagcgcgtttcggaagtcgttcgtcgttattttggtagggtatagtgtcgttagttcgttttcgcggttattattttggtaaaggttcgcgatcgcgggtagtttaagtcgtttttttttggtttttaagggtaaacggttttttgtgtattgtttgatgtgaaaggaaagaagtaggtttttagtaagttttttgttcggagacgatttacgggggtcgtttttagaggattttggagtcgttattttggtaaaggaagagatattcgttatttcggaaaagaagagggaattaatcgtatgttaacgtagaatttttagttagaagaatttttatgaagggcgttgagtaattttatgttaataaaatttttttttggatttagaaggtagatttcgttttttttgttttttggtataagttaattagaaggaggtttttgttttggatgtttatttgtgaggttatgagaatattgtttgatttagttgttcgtttttttaatttttgagttttaagtattagaatgagatgtttttcgttaatttggtttttaaattattaatagttttatgggaaataaattaagatttaattttataataatgttttatacgttttaaaagtgagttaaatagtttatgttaataattatttttgtatattgtttaaaatgattaagaattttatttatatatatatgtatgtatatatatgtatatatatatatattatatatatatatatgtatataattaaggggataatatagttgtttaatagaatatatttttttatgttattagtttgttttattgttgaatttttgttttaagaatttattttatcgtttatatatgtttaaatttttagtggtaggtattttgtttaaataatttatgattttataagagtttttaattattttttttttatttttttttttttgtagattttaatggggaagaatacgtagttttaaatatgttattgaaaacgtttttaattgagtaaaaaaaaaaaaaaatttattttaatttttttttttagtaatttaaatgtgtttgttaattttttaatttgatagtaaaaaaatttttattttttagttttttatatttatttggaagtatgtatgaattataagttaattttttttttttagagtaatataaatagttatgatttgtggttaatatttattgatttttatttttttgttgtttatttttgttgataataattaaatgagataggtattgttattcgattttttaatatgaggataataggtttatagaggttgatgtttgtttaagtttatatggtttttatgtattaagagaggaattagataatattaaagtggttttttttattgattttaattattaatatgaagtagtatattaattttgatagattatttataatatgtgtttacggaatttaattgaagagatgaattttagtgtgttagaaaggacgtgagatttagtattataataataatataattttaacgaaagttaatatttattgcgtatttgttgtttgatagatattattgaaagtgttttatgtatagtattttaagtttttaggtatggtatttattaatttgtaattttgggaatttataattattataagaaataggatgaatttttatttgagtgggaaggtatttgattgttttagaagtagaggtggaaatgaaggtgatgtatttagatttagttaaggtaaggatttgatttattttgttatagttttatgttttatttttggaatatagtttattatatagtaggtatttaataaatatattatagggttataataatattgagttaattagttaattagatgtaaaattatttttattgggttattgttgtggttaaatgggttaataaaaagtgtatagataatttttaagatttttatttttattgttttgtgtttaaatatttgagtgttttttttatttttttttaaaataaattagattagatttttgattgtatgtttttatagtattttgtatattttgttagtatattataatgatagtttattatttgtgtttttatttgttatttttttgtattatttattagaatataagttttgtaaaggtagggattgtgtttgtttgtttatttttgtattattagtgtatagttggtgtttagtgggtgttggttaaatgaatgaatgaagataatatatggttttagagattatgttttaaggttaataaaattttaagtttgattaataattaaattatttgatatattgattttagaaattgatatattatttaagtgagtttttttattttttttatgttttgttatttttatttttattaaaataatttaagttgtattgttagattatttttttaaaatattaattaaattaggttgtgtttttttttaagtatatataataatttttgattttagtgttatatagattttaatttttagtatggtatttaagattattatttttatttatttttttgtagaaagtgaagttttttagtggatgtgattgaattggagtttaatttaaaaattagttaaaagaaggaaataattttaagaaagataatttgtaaattttaaatttttgaaatttttgaaatttaaaatttgtgattgaatatttattttttaattttttgatgaaggtttaaagtttttatgagtttattgattggagttttatgttttttttagtgtgtgtataaattatatttgtaatgtattgatatagtgtagtagttaaaagttagattataaaggttaaatatagtttttattattaaaaggaatgtaattttgggtaggttaattttttgtgtttttttttattatttgtaaaatggggataataatagtattgatttataaagattaaattagtttgatatatgtgaagtgtttagacgaatttttgggttataggaagtatttgtttattattagtaattattatttatttgtagaattattatttttttttttttttttaaataaagtagaataagaaattaaagatatatatttagtatttatgatttgaaatgtttaatattgaaagtgttttagattttggatttttttttttttgattttggaatatttgtattataatgagatatttcggttatgggatttaagtttaaataggaaatttattttttgttttatatatattttatagtttgaagataattttatataatatttaaaataatttggggtatgaagtaaagtttgtggtaagtatttttatgtaggattttttatttgtggtattataataatgtttaaaaagttttggattttggagtattttaaaatttagatttttaagttagggatgtttaatgtgtatttttagaataattttcgtgtagatttttaaatttttatgattttttatttttgtttttatattagttttttaaaattgttttatatttattttatttgacgtaattgtaagttaaggaaggttatagggtatttttttatttagattttatagaataattttttatatttattttattattttatttaatatttaattaaattaagtaagtatagtaataagtaataaatggtataaatatgtttgggaagtaaaagtattaggaattgttggtagtttaattggtgggagtagaatcgtgtgaagtgtagaagtgattatggttttagtgtttagcgtattttgggtattaatttattgttttttagggagattggagaattggattagttgagatcgatattgagtagtgtttgttatacgattttgttaaagaaaggatataagatattatatttatttttatgttttttgttgtttattatatatatttttttttatataagtatatttttttgtgatttatttttttatagttcgtgattttttgttatggttttagtttttatttattttttttttttgtatttttttattttaaatgtgtgatgttaaatataaatgggaattatgtatacgtgtattgtgtatatgtgtattgtgtattttgaatatgttaagtttatataaatagtttttattggtggttagaatttattttaaaaaattatttttgtagttattatagttattatttgtttttttaaaataatattttgattttggaaaatatttttatttttatttaattttataaggtaagaggtttaagggaatttagttgagttttgaatgagttatttttgtttgttttaatatttgtattttatgttagatatgtttattataaataatttatattagtatagtaagtttttaattataatgaattttattttggtatttttcgttgtaattagaattaatattttcgtttggattgggaaatgttaaattattattagtttttttgttgttttgttgttttttatgatgtttttaatgattttattataagtaatttaaaatattataatttgtgtttatatgcgtgaaatgtttaatgggtgttttggttgattttattttttatgttggtagaatttagtttaagtaatatttgatttaaggatgaggtagttattagtagataaatgagataaatgttgttataagtaggaatttaatgtttttaatgtttggaggtattagagtaagtatattgaataattgtaataagtattacgtattttgtttttttatttgtggtatttgtggttttttatatgttattagtttttttttttttttgatttaattttttttttttttttatgtttttttggtaaagagtgttttaatttgtttcgttgttatgtggaattttttagtttatttgagaatttgtatttttattttggtttttatatttttttattagagtatatagggttttgttttgtttttaagttaatttagaaatagtggggttgagatgaaaatatttttggtatagggattttttaataagataagaagatattttatattaaattttaaagtgttataaaggatatttgttattattgaaaaaaaaattgttttgagattagtatttgttaattaaattttttttatttttttgttgaatttttaatataagatttggtttttagattttattttgttatttatttatttgaatgagtttggggtaggtatttgattttttttagttttgttttttaatttgtaaaggaaggataatgatatttattttatttattatataggaagtaatgtaggttttatatgggattatgtgtttaaacgtttttaaatattaagttttatttggaaaatttagaggagtttatggaatttttgtattattattttattataataaaaatgaaaattattattgtttttttttatttattttttagggaattagtgtaatgggtagtttggaattttaggtaggggagtgataatttagtagtgtatcggaaataattgtattagtttgtaagtattgattgttaaatttttagagattttgtaagttggttgttaattatagttattattaaaaattaaattatttataaatttataattaaatattttaataataaaaataaatgttgaagattttattgtttaattattttattttattttattattatttatgtttttaaagttatttttgtttgttttgtataagaatatattatacgatggtatgatgtagcgtatttttttttaacgttgtatttagaaatgttattttggtagtttgaaattaattatggtggagtatttatattatagaaattgggaaatatgataaattagagtttgatttgttttgttgattgtttagattgatagagtagaagaaattttaataatgaagattgaatttaaaagtgttttagtttgtgaatataaaaatttgaggaaatatttttttagtatttgaaagttattattagtaaaagaagttatttttgttattaatgaacgagtttagttttaatatttatttttgttgttttatttttatttcgtttattaatgtaaaaatattaattaatatttatgttgggattttagtattatgaatgatttttttgttgattggatattaattagatatttatttgtggtttgattttgttaaacgtgtttgaattttagttgtaggttggttatggatataaatattttgtaaaaattattgaaatggttttgtgaaaattatatggttatatagaatttattattaagagtgttatatttttttttgttttttgtaaattatgtgatatatatatgtaaaaattataaaatatatagatattttgttttttttaggagttgttaaatatttattaatatattaatggatataatttaatttattatttgaaaagttcgttttgtttgcgatgtggagtatgagttgtaggggttaagggagaaagtagggagagtagtgaggagataggtatattggtttaaggaaagatgacgaagtttgtattggttgtaatggtaggggagttggggagttatggttggataggagaggtattttgaaggttaaaggtaagtaaagtagttatttagtagttttatgaaagagatggatttttaggaattttttatgttaagagaagattttttggtgaagagtaagtaggtttagttgaatggggtgagtgtatagaaagttgtgttagagaaaaggagttagggagggttgtagtaggaagtaggagatgttggtagttttaggattttaaggtaaatatttttatattagatggagaaagttaggttggattgttagttaaatgtcgaattgttttaaagtgtagggggggaggggggaggggaagttttaaatattagtaatatgttgtaattggaatttatatattaagttatttatttagtaattttattgatttttgtttatatggaggggttatttgtttatttttatgttttgagtttattttaatttatagtagattttttttttttatatttggtaattttaattataaaatttttatattgaattattttgtgttatatatatattgttgtttttttttatgttttttatttttttatttttatttttttttgttatgttataaagaaggattttattaaaagttattttattgttttgtttattagttattagaaaatttttggtaattatagttttttttattttttttgttttttttattataatttataatttatattttatattataggtttttttgtttgggttttaatattttttaagagaagttattatattttatggagtttaaaaaatagtaaatgttttgtaaaagaaagaattatgtttttatatttatttatttttttaattttaatgattagaagaaggaaagatttttagttatatagttattaatgattaatattttgaggatttagtttggatatgttgtttattttggttttttgatgattagttattttaggtatggttttaattaattagggaatgtttattaatagaagagatttttttaattaatattttttttatttatttttttaataaaagagaatttttttaataaaatataatttttttaataaaatagtaattattatatgttaggttttagtataaggttgtagggatattaaaatgataataattttttttttggaggaaatggagatagatacggttataagttattatagaataatgtagatttatagaaatgtgttagatgtatagggtattttataagttttaagaagttatttggtgtttaaggttaggaaaatgggtgtggatatggagatggtggttacggagggttttttagaggttagtaggattgatttgaattatgaagggttttttttaagttatttgtttttttttttttttgaagataatatttttaatggaagtttgtagataatatttattaggttattttttggtgtatttataagaaattttattgttaaaaatagagttttttgatttattgaaaagtttaggggaagtttaattttaggaggtatgattggatttaggggtttaaatgaagtttaaagggtttaaattttattttttagttttatttttttgttttgttttgttttgttttttggaaagattatttttatttttttatttggtggtttgtggtatttggatttaatatattttgttaggttagtaattttagtggaaagagttttttttttataattttagtagttgtttttgggaggggttttattggtttagttggtttaaatgtttatttttggattaataattatgattaagggatgttaggaatgtgtattatgatgggtaaagtttagtttaagtgtttattattgatatttaagaatggggtataaatgaaagagagagaagaggaggtgtttttttaaataattggagattttaaatttaaataggagaaaagggatttttgggtatgtagaaaaaaatttagatgtttatgataatagttttttattaaaatattaatagtgatataaatattatattttatattttaagagaatagatatgatttaaaatgtttgttagtaatggaaagaattttgaaaattaagtatagttgttataagttttattggttttattttttgtttttaatagaatgtgggtttgtattttgaaattttaaatgttatataaatgaattgatgattgttttgtagaaatagtatttttatttaattgggttttttttgggtgatgaagtgatgtttataatttttaagttagttttatcgttttttattgaaggagtttgttttatttgaatatgattttaataatatgatgggtataggcggttgtagtgagtttttgtttgtttattttgttttttttgttttgataagttgaatgttacgtaaatgttttaagtttttgtattgggtaggtaggaagttagaattagtaatagaagtagtaggtattttgtgaatatttgttgattaattttagttttataggtttgatgggttttttatttttataattattattagtaaatagttattgaatgatgtttagtatatttttatttttttttttttgattttgatttttattttttattttatttttttgtgattttattacgtgtgtttttgtttattagattaatagagttttttgtgattagtttataattatttagttttatttttatttatgagatatttttatttgtttgtttaaatttgtttttgttatgatttagtttaagttttttttggaattagggaaaggatgaagtgtgaaaaaaaaggaattaaatagttcggttattgaatggttattttgtgtttgatgttatattagtatatttttatatttgttttataagttagttttttttattagaagtaatgtttaataagtttataagtattgattgggtttattttatagagaaaatggagagtagtgaagggtgaggaggttatgagttatggatatgataaatggggaaagattttatagaagagagattggggttatttaagaaaaatcgttatttttgtgtagacggtattagaaggatgaaaaataattttagatattatttatgtttttaagaaaaaaattttaaaagatgttagaaaataatatatatttattgtaaaaatttaaatatatagaaggtagaaatgtataaaggtaaaaatttttttatataattttattttgtagatgtaattatttttttttttttatattttgatggtaataaatttgtaattatttttgagtttttatgtatattttagattttttattttattatttttttttttaaaaatttttattatgtgaaatagaaagtagaattgtgattattagaggttgggaagggtagggggaaggggaggatggggagagattagttaacgattataaaattatagttagataagaggaatgagttttgatgttttgtagtattataaggtaaatgtgattaattataatttattgtatatttttaaattttttttgtttatatatggatgtatgtatgtatatatgttttttaaaaataaaaatgagattttattatatgtattttttaatttttatttattaaatgttattggatatttttttatttttttaatatttttaggtaatagtagtatagtatattattgttttaatttttttttattgaagtatatgtaaattgtttttaattttttattattgtaagttatgttgtaatgaatatttttgtatttagatttttttgttattgtataattattatagaattgaaattttttaggtaaatgtgatttgtaataattattaagtatttaaaagtgttatattattgggtttattttaaaaatgtttgtttattatagtttattttttatttttatttttttttagatattttagaaaaaattaattagagtagtagttatggatggttatgtaggataggttattagttggagattttttatgttttgttattgatatagttttgttgaatttatttttatgttaaatgtattaataatttaagaggattggtttatatatgaattgggaagggattatttagggatattataatgtttgatggttgtttttattttattagggattttgatttgttttgttgtggttatatggtagataggtattgttttatttgttaagtattttttttttatatatgatattaggatttaatattttttttggaaaattattttttttttaattttggtttatgcgtttatggtggtattaatttatttgtaattttgtatgggttaggtttggtaatattagagataggtatatgatagggatagatatattttaatttttggttttttgggattatttggaaatttgttttgttttttaataggaatagttaagttgatacgatgtaagtttggagtagttgtggtttattatttagagattttattggattgaggtttgtaaaaaaaaaaagtaaagagatttggaaatagatttttaattatataatatgaatgtttagattttaaggtgagggttgtttttagatttgattattatatattttaatatattattttttttttttttttttttttttttttttttttagttagttggagttagttaatatttgtattagaaagggttttgatattagaagtaaaggtttaaaatatgggggtgttgttttttttggaagagatagggaggttaaggttattagatatggaggatgattttaaaagaaaaggggagtttaaaagagaagttagttgaatgtttaaaaataaattttatttgttttataagtttggttcgagtttttttttaatgattaattagatgagatggttaaattttttttttatttaaaatatataaatataaataagaatattagtttttagttaatttatttattttggttatatttgttttaggtttttattttttttattaatatataaattgtttttttattttaggttgtgtttaaaaagagagagagagagaaatttggtaattttttaagaaatgttttacgtagtttttttttagggtttaaattattattttattttttatattgatttagttttttgttttattgttttgtttatagtagatttggtaatatattaatagtatttataaatatgatttagtggaattatgtattaaaatattttaatatttttttagtatttgcgattttgaaattgaaatttgatagttgaagaaaaagttttattaagatgaaaaattaattttttagtggaattaaatttataatgtttatataaaatattgtttttgttttatttatataaattttatattttttttttttattagtggtaggggaatatggagtgggatgttattagttggatttaatagatatttatttatttattaggagtttgaaatagatttgagattttattttttagtagatatatgtttttagtaagttatttaatttttttgaatgttagtttttttatttgaaaagtaaggttaataatattatttgttttaggaggtttttatatagattaaaaaagatattttttgtaaagtatttagtatggtttttgatatttaattaatgtatggtaaagtaatttattattacgtttttagaaagtgagatagttttgtaggtatattttaagtagaaagtatacgtttatatataatatattaattttttttaaacgaagttttttttttttttatattatggattgtgaagggagtatttgtttaataaaagaaagattttgtaaaagaaatttaggtattggttggaaatttttattatatgatttattaggttttttttagttttgaggttttataattttataaattatataagtttatatattattgtgggatttgatttttatgaaatttaagagaattataggttttttatatttagttgagtatgtttaaataaagatagatatttaaaagtatagatattgattacgtgttttttaattagtaaaatattatagttaaaagaaatagaagtatagagaaataaaatgatttgtttgaagttttattgatttgttaagaaattagattgaatgtgtaagtttttttaatttttagttgggttttttatatattaaatatagtgatatataatttttagttgttaatatttattttttatgagtttattgtttgttatgtgttaatttataaagttatttatttatttatattagtgttattaaaaattttttaattttataattatagtttgtgtaacgtagtagataaagtattgggttgggataagggattgggttttggttttggttttgtttttttttttttttgtttttaattgtatgatttgggtaagttatttttttttttttggattgtttgtttttttttgtttaagtatttggatttttttttttttttttttttaatttatatagaagtaattatgttttttttattatttttaattgtaaagtttttattagatagtttatatttattggttatttgttgaatgtttttgtgtagtgagttggagatagaggtaaataaggtatggtttttgtttttagggtttttttagttaagagggtatagggtgtgaaggggtataggttagaaggtgaaggtaggggttagggaaggtttttggaggaggtagaatgagatttaaagggtaaatagttggtgttgggtggtaggtaggtagatataagttttagtgatgatatagattatgttgaaaggaagaatagtgttaatagaattggtttggacgagggtagaattagaaagaatttagattttgatattttaagttgtgtgattttgatttagttatttttgtttttttatttattaagtaggtataatgatcgggtttttttttaaggttgttgttataatttaatgagattatatttgttaattttagtgtagtatttggtattattataggttaaatatttttaattttaaattttgaaatcggaaatgttttaaaatttaaagttttttgagtgttattatgatgtttaaaggaaatgtttattggaatattttagattttggatttttggattagggatgttttatttgtatgtattttgtaaatattttaaaatttgaaaatatttgaaatttaaaattttttttgtcggaagtattttggataagggatatttaatttatattattattaatttatttttattaataatatgttgttatatttgtttttttgtttttttttttttttttaaggatacgggtatatttatattttgttattaaatatattttgtttataaatatttttagtaatatattgaaatatttatttgaagtattatgataaaagaaatgtggtattttatgtaatattttggggagtatcggggaatttgtttcgatagttatataggtttttttttattttttttaagcgttagttagtttgagaaataaagggatagagtttaaaagagagaaattttaaagttgggcgtttgggggagatattatatgttggtaggtttcgtgatgttttataagtcgtaaaattagtaagtttttattagggatttttaaaaggggagggaatgtacgaataggtgtgggttatagagattacgcgttttataaggtaatagaatattataaggtaaatggaggtagggcgaaattataggattataggacgggggcgaaattaaaattgttaataaagttttgggtattattgtttttgataatattttattaggagatagggtttgagagtaattggtttgattaaaatatattaggtaggaattttttttttttaataagtttgggagcgttatgggagattggggtttattttatttttatagttttaattatagaagatagttatatttaagggggttattttagagatttatttttaggggtatatttttttttttagggatgttttttgttgagaaaaagaatttagtaatattttttttatttgtttttgaaagaagagaaatatggttttgttttttttggtttatcggcggttagagtttaaggttattttttttattatttgaataattgttgttattttgttttttttttaaggtgtttagattttatattgtttaaatatatatgttttataatttgtgtagttaatataattattatagggttttgaggtaatatatattttttttagtttaggagatgataggattaagagattaaagtaaagataggtataggaaattataagggtattgattggggaagtgataagtgtttatgaaatttttataatttgtgtttagagattgtagtgaagataggtataggaaattatagaagtattaatttggggaattaataaatgtttatgaaatttttataatttacgtttttttgttatggttttagttggttttttcgtttggggtttttgatttttcgtaataggggagattatagatatgttattaattataatggttttttttagaatattagtttttaattgggtgattttggttttaggggatatttggaaatttttggagatatttttggttgttatagatggaaagggagaattttattggtatttagtgggtagaagttagggattttgttaaatattttgtaatgtatagtatagttttttataataaagaattattcggtttaaaatgttaatagtgtcgaggttgagaaattttgttttagatgtaatttagttattgtttttttttaataattattgggaaatacggtaaaattatgttttttaagattttaaatttagttgtaaaagtgtattttttggatattttatatattttaatattttttttgaaaataaagttttttagagaatttggtggaattattttaattttttttgttataaagataatggaaattattttattttattattttttttttatatgtataatttaggataaatttttttttttttatgtggtaattttaatgaaatttattaaaaaagatatttgattaattttagtttgggagttttttttagagtagagaaaattttggaaatttgtaatagtgtgggtttttttttattattacgggggatataaatggttagttattaatgatggtttttgtagtttttggaggagagtgttaagtgttatttttgagtttttatagtttttttaatatttttgttaaagtggggttaataatagggggtttagaagggtttgtatgtttttattattttttattttttatttttttttttttagaagtaatatagtgattaagagtgtgggtttcgggtttgaatttggttttgttgtttgttagttatagtgattttgataaattttttaatttttgtgtgttttagagtttttttttgtaaaatggggggaaataatagtatttattttataggattgttatgaggattaagtgagtttttatgggtagagtatttaaaatatagtttggtatatgggtgtggaggtttatatttgtaattttagtattttgtgaggttgaggtgggtatattatttgaggtttggaattgaagattagtttggttaatatagtaaaattttatttttattaaacgtgtttgtaattttagttatttgggaggttgaggtaggagaattatttgattttaggaggtagaagttgtagtgagttaagtttatattattgtattttagtttgggtgatagagtgagattttattttaaaaaaaaaaggatatagtttggtatataataagtagtaaataaatgtgagttgttttttttattttttatttttatttgtttttgtggatatattgaagtaggttttaggtatgatatggacgtggtggaagttatatgttattgtagagtatggaatatagttatagttagggttagttggggttaaggtagggagtggttgaagtggtgtttattgttttattaggtttgttttttttttagtttagtaatattttgtgtttttttttttttatgatttttattaatatttagtttttttttattttttttggtttttttttttaagtatgatattttattaagttttttttatttttattttttatagagttttatttggttattttttgaagtattgatttttatttgagttgtttattagattatttgggaatttgtttaaagtatagatatttgggttttgttttttaacgattattttaagtattttgattttagtgtttatttgagagatagtatggtatagtatttaagaatatgattaaagagttaggttgtttaggttacgggttcgttgtatgattttgagaaaattatttaattttttgttttttattgtttttatttgtaaaatgggggtgttatgttttgaatgtttgtgttttttttaaatttttgttgaaattttaattttatggtgatggtattaggaggtggaatttttgggaggtgatttggttatgagggtagagtttttatgaatgggattagtgtttatataaaagaggttttagggagtttttttatttttttttattatgtgaggataaagtaagaagagaagatggttgtttatttgtaaattaggaagtaggtttttattagataatagttttgttagtgttttgattatggattttttagttattagaattaagagaaataaatttttattgtttataatttacgtagtttatgggattttgttatagtattttgaataaattgaaagtaagagtgtttattttataaggttgtaagaataaatgagatgttttttaaaatagtgtttggaatgatttttgttttttttgtttattttttttttttttttatttttttatttggtttttttttttttattatttttttttttttttttaatatatatatattgttttattttagtggttttatatttgtaggttttcgatttaggtttttaatttaatttgatttgatttttgtatatggtaagagatgatattggtttggttaaatattttttgaataagatattaaaagtatagttaattagtgtaaaagtggataaatgagattattttaagttaaaaggtttttgtatagtaaaggaaattattaataaagtgaagagataatttatagaatggaataaaatatttggaagttatttatttgataagggattaataaatagaatatataagttgtgtaaataatttaataggaaaaaataatttgatttaaaaatggttaaaagatttgaatagatgatatacgaatggttaaaaatatttaatatttttaattattagagaaatataagtttaaattataatgagatattattttattttagtgaaaattgtttttattaaaaagatagggaattacggatgtttttaaaagtgtggagaaaggggaatttttatatattgttggtgggaacgtaaattagtatagttattatggagaatagtatgaaggtttttaaaaataataataataataaaatagagttattatattatttagtaattttattgttggatatatatttaaaagaaagaaaattagtatatcgaagagatatttgtatttttatgtttatcgtagtattatttataatagttaaggtatggaattaatttaagtgtttattaatagatgaataaagaaaatgttgtatatatatataatgaaatgttatttagttataaaaaagaatgaaattatgttttttttattaatatggatggaattggaggatattatgtaagagaaataagttaggtatagaaagataaatattatattttttgtttatatgtgggaatttagagagagaaagaatagaatgatggttattagggtttgggaagggtagtggggaggggggataaagagggggtgtttaatcgtatatttttattcgtaggtgggaattgaataatgagaatatatggatataggaaggggaatattatattttggggattgttgtggggtgtggggaggggggagggatagtattgggagatatatttaatgttagatgacgagttaatgggtgtagcgtattattatggtatatgtatatatatgtaattaatttgtatattgtgtatatgtattttaaaatttatagtataataataataaataaaataaaaaataaaaaagaggggtgtttaatggatacgaaaatgtagttagatatgaggaataagatttagtgtttagtagataatagggtgattatagttaataaaaatttattgtatattttaaaataattaagagtggaattgtaatgtttttaatataaatatattataaatgtttgaggtgacggatattttagttattttgatttgattattatatggtgtatgtttgtattaaaatgttatatgtattttttatatatttgtaatttttatgtatttataataattaaaaataaaaattttttaaaagaaaaaaaatttttatatatttatggttttaagtatggttttgggatttagtaatgaattagatgtaattttagttttatatggtattatagtttaattagtggaaaatagatatataaataaataaagatatgtatgtgtataatgtatgaatgagagagttattgatttttttagaaaagagaagggagagatgaaaggttttaaaggggaaatgaatatggtattgagtgttagaatagagatgaaattaatttattttatgtaataaatatttttaaaagtatttattatatattaagtataggttttagtgtttttttgaaattgtttttttttagagagtggtagttttatttttaatttgatgttttaaaaaaatatttaatttaaaatagtaaaataatttataaaaaaaggtaaagttcgaggatttataaaacgtattattatttatatattataaagttgtagtaattaagatagtgtagtattggtatgaggataggtatttagattagtcgggtagaattgagagtttagaaatttatatgtttatagttaattgattttttataagaatattaagattatttaatgaggaaagaattatttatttaataaatagtattgggataattggatagttatatgtaaaagaatatttaaaaaattaatttaaaatggattaaaaatttaaatgtaaaagttaaaattataaaatttagaagaaagtatgtatgtatattagaatttcggattagttaatggtttgttagttataatattaaaagtataagaaaaaaatagttaaattggattttattataatgaaaaattattttgttttaaaagacgttgtgaagaaaataaaaagataatttatagaatggttgaaattgtagataacgtatagaaatggtagaatttgtaagttatatatttagtaaaggtttagatttagaatatataaagaatttttatattttaataataaaaagataattaatattttaaaaaaaggtaaatgatttgatagttttttaaagaagatgtgtaattagttaataagtatataaaagatgtataatattattatttattatagaaatgtaaattgaaaatataggagatattattttatatttattaggatagtaataattgttttttaaaaaaaggaaaataaatgttggtgaagatgtggagaaagtggaatttttatatattgttagcgaaattataaaatggtttagatattgtggaaaatatattggtagtttttttaaaaaggtaaatatagagttattatatgatttagtaatttaatttttaggaatttatttaggagaaataatatgtttgtttaaaaatttgtatatgaacgtttataataatattatttataatagttaataagtggtaatagtttaagtgattagtttatgagtggataaataaatatggtagatttagaggataaaatgttatttagttataataggaaatgaagtgtggatcgatgtatgttataatatggagaaatttttaatatagtatgttgagtggaaggtgttagatataaaagattatatattgtgtgattttatttatatgtaatgtttatggtaggtaaatttatagagatagagaaataattaattagtggtcgttagggggttagggaaaagggaattgggagtgattattaatagaattagagtttattgttggtgtgatggatatgttttgaaatttgatagcggggatggttgtataaaattaagaatatatttaaatttattgaattgtattttttaaaatggtaaagtttatgttatgtgaattatatgttaatagttataataaaaattattaattaatatatgttttttattttttttggaatgttgatatattgatataaattagttaaaataataaagtacgagttatgttattaatattcgttttataaaaatacgtgttttgtattttagtcgaaaagttaaagtttatttagattatgattaggagtaggtagaggttaagggaaggttaagtttaaaggatttagttgttaagatttttttgattaatttttaaatttttatatgataatttatttgtttagtaaagtttcgttttgaaaaaataatttttattaaaacgttacggtataaaaattagtgggttaaattttgttttataggtataaattagttattttgaaatatgtacgaatttttgtgatgtatagaatagttgtttggttgatgttgatttgtgaggttttgatgtgttattgtagttttttagtgtgttttttggtgaagagggtattaatagtatttgtttttttttttttaaatgtgtttttacgaagtttattttttgggaggattatttatgtgagtggatgttagatttgtttataagtttataaattatatagatttaattttgtttattaaagtaggtttttttttttatttttgttttttttgaagagtttaaaagttaaaatattagttttaatgaattttttattatattttagtaagtttaatatttttaattttagaggaagaattttagtttgtattataagtaagaaatagtatttttattattttgtgtgataaattgtgtttttattgattattttattttagatatagtttagtattttttttttatagagattttaggaaacgatagtatagttttttaatagtgaaaatataaatatagattttgaagtagtttgtggttttagtatgtgggaatgattagttatattggggattgttttgatagtagggtgggttgggggaattattttgagaggttaattatgaaatttatataaaatggatgaaaagttattttaatggatagaatgataaataaggtaagaagaagaggggaaagatagttggtaaaataaattttagtagtgttttttttagtattatttaggaaattataggatttgggaatttttattttagtgggaaggtcgtagttagtgttgtaaataaatatggaggatttgttagtaatatcgtttttttgtaagatggttgtattaggttttattaatttgataatattaaaattagatttttttgttttttttttttttatggatttaatgtttattagtaattttttgaatatgttttttatgagatattatgttgtagtggttaggtatttatattttggtttatattgtgtgggtttaaattttatttttattatttattagtattgtgattttataagtttagaatttttgattttatttataagagggttttaattataatttttatcgatagatttgtgaggttattatggaaaatgtttgatattgtgtttggtataatgttattgttaataaatgttaattattatggttattgttattttaatataagtatgtttatgaaaatagaatgggttttttatatgtggtaattatgttttttattaaaaattattaaaatgggttttttgatttaatatgttaattatttgaatttagtgtaagttttataggatttataagaaaagaggatttataggcgaatagatttaggtttttgattttgttaagttaaggttatggtaaatttattaaggttataaaaatgttattttgtgaagttttttggggtttgttttttggtttttttttgaaaatgttattttatttaggagtttgtttttaatttttttaagaggagattttatagaggaagtaataaaatgggattaatggtttatatggtgagtgaatgttgaaatattgatttgttgaggattgagtttttgtaatttaggttatatttttttttaaaattttttaaaggttttttttttgtttttaggataaaatttaaattttgtgttagagttttataaggttttttttttttgattttttttgtttttttaattacgttttataatttttttttgttttattatgttttagtttaggggttggtaaattataggaaagtttggtaatattttattggaatatagtatatttttttgtttaagtattgtttatggttgtttttatattgtaatggtaggtttgggtggttgagatagatatatatggttttattgtaattgtatggtaatatttaattgtataggatttgggaagttaggtttagttgtgagtttaagaaaaggaaatgattttgtttattagttaataatttttgttataaaagtaaagtaatgtgagtgggggttttaaaaatttttattgttttcgttattttgattattatttattttttattaaaggtttttggggtatattttgtagattttattattttagggtatatattttgaaaagggttgattttgttaatttgatttggtattttgattaaagttatttttatattttgattaaagttataattgtatgatataggtatatttttattattagtgttttaagaatatgaaacgggaagttgatgatttttaaattattttatattgagtttaaatttattgtttaataataaataataatgataataatagtaatagatgtgtattatttatatatattattattttattttatttttatttatggtaagtgtttttgttatttattttatagatgaggaaattaaggagaagagaagttaagtaatttgtttaggttatataataggaagtaatgaataatggatttaggatttaaagttagtagtttgattattgagtataattaattaattttaattataaaattttattatatggttaaatgaatattttatttttgtgtagtagtttatagttataaattggtgagtatttttattttttatattagaaataaaggtatgaaaatgttaagagatttggtaaggttatgtagttattttttaggtaaaagaatattaggaatttggtttttggattttttcgtttataaataaaatttaaatttgaattgtatgtaattatttttgttatggtagttatgtatttagaatttggtgggtattaaattagaataaattatttggatggtattttagttataatatatttaaaataaaaagagttaaatatttataaagaaaatgagaggtaatgtaataataataaaagttggaaatgattttaatattaattagtagaagaatggttaaattaattatattgtatttataagatgatgttattaaaaattatggtttttggtttggtgcggtggtttatgtttgtaattttagtattttgggaggtcgaggtgggtagattatttgaggttaggagtttaagattagtttggttaatatggtgaaattttatttttattaaaaatataaaaaaattagatgggtatggtggtaggggtttgtaatttttgttattcgggaggttgaggtaggagaattgtttgagtttgggaggtggaggttgtagtaagttaagattgtattattgtattttagtttgggtgagagagtgagattttatttttaaaaaaaaaaaagaaaagaaaagaaaaagaaaaagaataaaaaattatggttttttaataatatgggggaatgtttataataaaaataataagtatatatgtttgtgtatatataaaaatatatatatatatatatatattaattttattttaaaatatttttatgaattttatgtttttatattagattatgtttttaaattttattaatgtgtattgaataattttataggaattgtattaaaatatttattatggatatttttggatgtgagatgatggtagatttttttttatatatttttttgtatttttttattttttttagtgaagatatattatttttatgagtaggaaagttttacggtacgtgttgttatatagattgaatgtttgtgtttttttaaaatttatacgttgaaattttaatttttaatatgatggtattaggaggtagggtttttgtaagtaattaggttatgaaggtggagttttatgaatgggattagtgtttttatgaaagagtttcggaagagtttttttatttttttagttttttgaggatagtgagaagatagcgggttatgaattaggatgtaggtttttattagatattggatttgttagtgttttgattttggattttatagtttttagattgtgagaaataaatgtttgttgtttaagttattaaatttatggtatttttattgtagtattttgagtatattaagatatatgttattttaaggaaagatgttaatattttgttttttatagtttgtttttttagtaagtttttatcgtgtttaggggtgttgagtttttattgtaattattaaaaatatagttttatattataagtaattttgtttaggaatttttagttgattattagtattaaataaacgtattttgaatttagttatttatataaatgttgtttatgtagagatgtgggaggagagaggagaaggttatgatttttttgtggttttatgggatgtattgtttggtttttttttggggttataggggtataggtttagatatggtttaggatattagggtttcgggattgggtaagaaatgtggtttaggagtttttggggagagagatgggttatatttttttttagtgtatttattttttaatagggtttaggaatttttagagaaaggattgaaattttgtttattaatgtattgtaaatttatgtttgagaaagtagggtgtttttagatggagaatagattatagagaagaataagtgtttttattgaagaattaaattggtattataattttaataagaaaaattggtgttatgtatgtttttatttataagtgggagttgaataatgagaatatgtggatatagggaggggaatattatatattcgggtttgttagggggtggggggtaaggggagggagagtattaggataaatatttaatgtatgcgaggtttaaaatttaggtggtgggttgataggtgtagtaagttattatggtatatgtatatttgtgtaataaatcggtacgttttgtatatgtattttagaatttaaagtaaaataaaataaaataaaatagaaaaagaaaagttggtgttagtagagagtgggggttataggtagttttttagttgatattaaaatttgtttgtatatagttattttaggggtatttttgtagttttggagaaaggtgtagtgggttgatttggaagaataataattttgtaaaaggtagtaatattatggtttaattagttttgtagtggggtttttggatgagtggattataataattattatagtaattatattttttggttttgaatgatatttatatgggtttgggaatagagatgattttttttgagggggtggtggtagttgtaaagttgataggagcggagttttaattttggtgggggtggaggagtagaatatgtgtacgattattagggttggtggtaaaaattgttttgtttggtttagtatgtttttagtgaggaagttttgttatgagttattagaatatttgggattgggtgtatttatagtgttagtttagttgaatgtagtattaagtgtgtttattttattttgttgagtgggaggtgatattggattagtgatttggatcgttgaattatatatttaaaatatgtaatgcgttaggttaaaagtgttataaagaaataaggttataataaggtagtaaggtatttagtatatattttaaatttataaatattggttttgtaggatttttaggtgatggtgattgtggtggtaacggggatggggatagatttttagttttgaggggtatttttgtggaaatattagagttttggtttatggatttttgttatagtggggatagaagtgaattatttttggttgtacgttagtatttttaggtatttttagaaatatttaggggaaagatattttttaaaaggttgaggtaaagtagggatatttaaaattggtgaagtgtgagatgttcgggatgagtttgtttaaataaagtaagttaaaggggttattaaagcgtacggttttttatgaatttaatgtttttttttaagtaatttaatttttgtggttatttgttatagttattttaaggagttgtttttggaagtttttatttttatgaggtgtaagaaaaattatgatttaggtaaatttgttaatatttttttatagaaagtttatttttagaggttttttttatcgggattttttttatttgtttatagtttattgagtaatttatcgattattgcgttttttgttttacgtttattcgttttttttttttatttaaattttaattagttttaatggtagaaaagtgatttgatatataacgttatttaaaaggataaatgattgatagtagttcgatttagtttttattttaaaggaggatgtttggagtttataatgttttaatggaaaggaattgggttaattgtgtaatttttttaataaggtaggttattggtgggaggtttttgggtaggggagttttttggaatttgttaatgatatattttaaaggtaatttaattgatttatgaagttaattttgatggtgttgatgatgttattaagaagttttaagtttgtgttgtttaaagtttatagagttttatttaatatatttttttgagttaggtagagaagaaatgattattttttattaatagtaaggatattgaggattggagattatttttatttgtttaagtgttttagttagtagttgatggaaatagtattaaatatatatatatataatttatttatttaaattatatatatatataatttatttatttaaattatatatatatatatatatttaattttattttgtgtgggtaaataaaggtagaatgtttaagataaggttgtttattttggttgttattggtattttggaataatattaagttgtaaggggtttaagattagttaaattatttgatttgtaagttttttttttttttttattttttatgtttaattttttagtaatttttgtaggtttaatatttaaaataaatattttttattattttattgtttttttttatttgaggttttattttttttatgtagatggttatggtagttttttgattgttttttttttttttatatttgtttatttatagttaattttttatatattagttagagggattttgtttaaatttaaggtaggttagggcggttttttgtttggaatttttagtagtttttttttgtaggtagagttaaagtttagtttgtatttggtttttggttgttttgatggttttagttttagttttttttgttttagttagattgtttttttttttttttaaatttgttatatatttttttattttagggtttttttattggttattttcgttttgttttttgagttttttagatatttatataattggtttttttattttatttagatttttgattaaatgttatttttttagagaagttttttcgttattattatttttttagttttttattgtgttttagttttttttatagtattttttatttaatatattatatatattttaaaacgcgttgtttcgtttttttttttagttggaagttttatgttagttttgttttgttttttgttgtatttttattgtttataatagtatttggtatatatttgttgaataaatgaaattgagaaatttagagtaaattatttttttttagataaagtttataaaaatgttttttttttgtttagtttaaattatttagtatataatattagttttgtgattgtttttttttttgatgttttgatttttgagtgatttttaataagtaattttgttagaatttattttatttagttatagaatgggaataaaaatataatttatttttttttttagatattttaatgaagtaaagttttttttgttttttgaggaaaggagttaggtagatgaaaatttttgttattaaggtataattaaagttcgaggagggtaggagttgtattttgtttttttttattttcgtatagagaaggtatttattaagtgtttattaaagttaatatttgtggtatataaattgtatttgtttttgtagtagtcgttatagaagttggttttttttttgggttaattgttttgagagtattagaatgaaatttgatttagatatgacgtagatttttttttttagaagaagttagttatataatttttgatgaataaatagttattaacgatgagtataaattagagaattttagaagtgaagaaaattttagattagaagattttgtttttcgggtataatttttttttttttggagagaaatatagtgatttttttaattatggtgaattttttagtttagtttagagttattgatttagtagatatttttttaggtagattttaatggaaattaatatgtgaggtttgatgttgggaattttattatgtttaataaggatttgaaaattaaatgaatgcgtgtatatttatattaagtaatttttttttttgtttttattatttttttttttttttttttttattttttttttgtttttattttttttttatttatgttttagtgttttcgttggatatatgcgtattttacggttttgtagggtttgaaagatttttgattttttaaggtttagtgatttggtattagaagatttaagttttttttttttttttgttatttaaagaagcgtgttgtaatttttttagtagaagtgaaagtgattcgtttttatttaaatgtttgtataggtataagaatgagggcgagagggagtaagagaagaggaagaggtattttttgaatggggtgaaagtaaatttttatataatttgattatataataggaggaaatgaaaatttgggtttaagggtaattttgttattggttattagtttgtgttattaagtaggtgttagaaaaataaattttattttgattttaggtatttattttaataattggatttttttaattttttatttttaaggaggatttatgtaagaatgtataatttatagttaatttggagatgaataaaatattaatatattttttgttttttttaaaatataatatttaaattagtgtgatgttttggttattattttatatatgtatttggattgtaaatgagtttagttttaagtatatttgtaatagtggaataagtgaggtttgtattatatggttaaattgatattaatgatggtggtttcgagaacggattttattttaagatatttgatttgtagatagttgagtatttatagtagttttgattttattgattttattggttttagttagaaggtttttatttagtgtatttagttattttgatttttaattataatagaattttttaaatagatttgtttttagagagtttgtttgagatagattaaatggtagaagttgtaaaggatgttattgttttatataaaagatttgtggaaattacgtttagaaatttgttgtttttttattttaaaagttgttatatataaaataatagttagggttaaatagttattattgtgataataattatttatggtacgtttgtaattgttttaaaaagttaatatggaaaagttattagaattaagtggtgatgttttatttaagaagtagaaaagatttataatttattatggatgtaaaaagaaatggattttaagaaatttgttattgtagttgttgaaagaatattgttaaagtgtttatttatattaagtggttttatagaacgtagtttttttagattttagtgttagtttttataaaattgttggtttgttttaattttttggaaattataggtgtttttttttaatattagtgattatatttttttttgtgtttttgttggtaggaagtttagagtttaatttataatttttaatgatttttattgaattttatatttgtattttttttagttttttttttttagggtgggaatagggttttattaatttttttttggatttatttgttttataatatttttttttattttgatttaattgttttttttttttttttttatgatatatgtttttaaaagttggtatgaagtgaaatggagtatatttggttttaaagtgataaatttaatatatttaaaattattattttagtgtgattatttattttattttattatcgttttagaataatgtatttagaatgttgtttttttttttgaagttttaaaaattatttaatttttttttgaattagtgtatattaacgtttatattttaattttttatattttgtttgtttttattttttgttttaaaagaaattaatgtgtattgtgattttagtttttattagttattaatttggggattaatatgattgttttattgttagtgagtatttttttttgatagttttaggaggggtgattaattttatttgatttattatgtttttttattttgtttgtttagtgattatggttttgtatttttttgtatttatttttttattatttaatttaatttaattatttattgtttgattattttgtattttttttttttttgttttttgtatagaattcgttattttttttttgtttttatttagttttttttgttggttttttattttttttatattataatgttggagtgttttagggttaagtttttgggtttttttttttatttgtaaatatttttattttggttggtttgtttaatttaatggttttaaattaaatttttatattgaagatcgaaatttatgttagtaatttggatgtttttttcgaattttagatttatatacgtaatagtttatttattatgttt

SEQ ID NO: 193 - DNA, 159782 bp, Artificial Sequence
  Chemically-Treated DNA
ggatatgatgagtaggttgttgcgtatgtgagtttggagttcggaagagatatttaagttgttgatataaatttcggtttttagtgtagaaatttgatttaaagttattgggttaaataaattaattaaggtaagagtatttgtaggtaagagaagagatttaaggatttagttttaaggtattttagtattatgatgtaggggagatgaggaattagtaaaggaggttgaatggaaatagagaaggaatggcgagttttgtgtaagagataggaagaaagagaatgtaaaatggttaaataataaataattaagttgaattagatggtaaagaaataaatgtaaggaaatgtaaggttatagttattgggtagatagagtaaaagaatatgatgaattaggtgagattaattattttttttggaattattagaaaaagatatttattgatagtgaggtagttatgttagtttttaagttgatgattaatggaaattaaggttatagtgtatattaattttttttgaagtaaaggataaaaataaataaaatataaaagattaagatgtaaacgttagtgtatattaatttagagaagaattaaatgatttttaaaattttaagaaggaggatagtattttaaatgtattgttttaaaacgatagtaagatgggataaatagttatattagggtgatgattttggatgtgttaaatttgttattttgagattagatatgttttattttattttatgttagtttttaagaatatatattatagaaaaagagaaaagaaatagttgaattaaagtgaagagaaatattgtgaagtaaataaatttagggaaaaattaataaaattttatttttattttaaaaaaaagaaattaaaagaagtgtaaatataaagtttaataggagttattagagattgtaaattgggttttgagttttttattaataaaagtataaaggaaaatatgattattggtattaaaaaaaaatatttatggtttttaaaagattaaaataaattagtagttttatagaagttaatattaaaatttaaaggaattacgttttatggagttatttaatatggataaatattttgataatatttttttaataattatagtaataagttttttagagtttatttttttttatatttataatgaattgtaaattttttttattttttaagtaaaatattattatttaattttggtaatttttttatattaattttttagaataattgtaaacgtattataaatgattgttgttatagtggtaattatttgattttgattgttattttgtatatagtagtttttaaaataaaaaggtaataagtttttaggcgtaatttttatagattttttatgtaaaataatgatattttttgtaatttttgttatttaatttattttaagtaagttttttggaaataaatttatttgaaagattttattgtaattagaaattagggtaattgaatgtattagatgaaaattttttgattggggttaatgaagttaataaagttaaaattgttgtgaatgtttaattgtttgtagattagatgttttgggatggaattcgttttcgaggttattattattaatattaatttggttatgtaatataagttttatttgttttattgttataaatgtgtttaaaattgagtttatttataatttaaatatatatgtaggatggtaattaaggtattatattaatttaggtattatgttttagggggaataaaaggtatgttaatattttatttatttttaaattaattataaattgtgtatttttgtatagattttttttgggaatgagaaattaggaaaatttagttgttaaaatgaatgtttaaaattaaaataaaatttgtttttttggtatttgtttgatgatatagattaataattaatgataaaattgtttttgaatttaagtttttatttttttttattgtgtggttaggttatgtaagggtttgtttttattttatttaaaaggtatttttttttttttttttgttttttttcgtttttatttttgtgtttatgtagatatttgagtagaggcgaattatttttatttttgttggggaaattgtaatacgtttttttaaatggtagagagaaggagaaaatttagattttttgatattaaattattggattttagaaggttagaaattttttaagttttgtaggatcgtaaaatgcgtatgtgtttaacggaagtattggggtatgagtggggaaggaatagaaatagaaagagggtaagagaagaaaaaagggaaagtggtgaaggtagggaggaaaattgtttagtgtgaatatgtacgtatttatttagtttttaaatttttgttgagtatgataaaatttttagtattagattttatatgttggtttttattaggatttgtttgggggaatatttgttgaattagtggttttgagttgaattaggaaatttattataattaggagagttattgtatttttttttaaaaaaaaaaaagttatattcgagagataggattttttgatttgaaattttttttatttttgaaattttttggtttgtgtttatcgttggtagttatttgtttattaagagttgtgtagttggttttttttgaaaaaaggaatttgcgttatatttaagttagattttattttggtgtttttagagtagttagtttaggaaaggggttagtttttgtgacgattgttgtagaggtaggtgtagtttgtgtgttatagatattaattttgataagtatttaatgagtgttttttttgtgcgagaatggggaggaataaaatgtagtttttatttttttcgggttttagttgtattttaataataggaatttttatttgtttggtttttttttttaaagaataaagaagattttgttttattaaagtgtttgagaaggaaggtaggttatatttttatttttattttatagttgggtaaagtgagttttaataaagttatttgttaaaggttatttagaggttagagtattagaaaaaaagataattataaggttgatgttgtgtgttggatagtttaaattgaataggaagaaaatatttttgtgggttttatttaaaaagaaatagtttgttttgagttttttagttttatttatttagtaagtatgtgttaagtgttattgtaggtaatgaagatatagtagggaataaaataaaattgatatggagtttttaattagaaaggagaacgagataacgcgttttaaaatatatataatgtgttaggtaaaaagtgttataaggagagttaaaatataatgagaggttagaagagtgatagtggcggaggggtttttttgaggagatgatatttgattaggggtttgaataaagtaaagaggttagttatgtgaatatttggaagatttaaggggtagggcggaaatagttagtagaaaggttttgaggtaggaaggtgtgtggtaagtttgaggaaaaggaaagatagtttgattggagtaaagagaattggagttgaggttattaaggtagttaggagttaggtgtagattgggttttgattttgtttgtagggaggaattgttgaaggttttaagtaaaggatcgttttgatttgttttaggtttgaataggatttttttggttggtgtgtgaagaattaattgtagatgggtaagtgtggaaggaaggagagtagttaggaagttgttataattatttatatgagagaggtaaggttttagatggaggggagtagtggaatggtggaaagtgtttattttgaatgttaagtttgtaggagttgttggaggattggatatgggggatgagaaaaagagagaggtttatagattaggtaatttagttgattttaagttttttatagtttaatattattttaaggtgttaataatagttaaggtaaataattttgttttggatattttgtttttatttgtttatataagatgaaattaaatatatatatatatatataatttaaataaataaattatatatatatataatttaaataaataaattatatatatatatatttagtgttgtttttattagttattagttgagatatttgggtaaatgagggtgatttttagtttttagtatttttgttgttaatgagagatggttattttttttttgtttagtttaaaagaatatgttaaataaaattttgtgaattttaggtagtataggtttagggttttttagtaatattattagtattattagagttaattttatgagttagttgagttgtttttggggtatattattaatagattttaggaagtttttttgtttaaaagttttttattaatggtttgttttgttgaaagaattatataattagtttaatttttttttattaaggtattgtggattttaaatatttttttttaaaatggaaattaaatcgagttattgttagttatttgtttttttaggtgacgttatatattagattatttttttgttattagagttagttgaagtttgaatagggaaaaggaacgaatgaacgtggggtagagaacgtaatagtcggtgggttatttagtaggttgtggatagatggagaggatttcggtgggaggagtttttaaagataaattttttatgggaaaatgttgatagatttatttgagttatggttttttttatattttataaaaatgaaggtttttaagggtagttttttgaaatagttgtaataagtagttatagaagttgagttgtttaaagaaaaatattgaatttatggggaatcgtacgttttaatagtttttttggtttattttgtttaaataaatttatttcgagtattttatattttattaattttgagtgtttttgttttattttagttttttaaagagtgttttttttttaaatatttttggaaatgtttaagggtgttgacgtgtagttagaaatagtttatttttgtttttattatggtaggaatttatggattaaggttttgatgtttttataaagatgttttttaggattagaaatttgtttttattttcgttgttattatagttattattatttggaaattttgtaggattaatgtttgtgaatttggaatatatgttagatgttttattattttgttatgattttatttttttatagtatttttaatttagcgtattatatattttaaatgtataatttagcgatttagattattggtttagtgttattttttatttagtaaagtgagatgaatatatttggtgttatatttagttaggttggtattgtagatgtatttagttttaggtattttagtggtttatgatagggtttttttattggagatatgttgagttaagtaaggtagtttttattattaattttgatagtcgtatatatattttgtttttttatttttattaaggttgaaatttcgtttttgttagttttgtagttattattatttttttagggagagttatttttgtttttaaatttatataaatgttatttaaagttagaggatgtaattgttgtagtaattgttatagtttatttatttaggggttttattgtaaagttgattaaattatagtgttattattttttatagagttattatttttttaaattaatttattgtatttttttttaaggttataaaagtgtttttagggtggttgtgtataggtaagttttgatgttagttgggaaattatttataatttttattttttgttaatattaatttttttttttttattttattttattttattttattttaagttttgggatatatgtgtagaacgtgtcggtttgttatataggtatgtatgtgttatggtggtttgttgtatttattaatttattatttaggttttaagtttcgtatgtattaggtatttgttttgatgttttttttttttttattttttattttttgataggttcgggtatgtgatgtttttttttttgtgtttatatgtttttattgtttaatttttatttatgagtgagaatatgtataatattaattttttttattggaattgtagtgttagtttagttttttagtggaagtatttgtttttttttataatttgttttttatttgggaatattttatttttttagatataggtttgtagtgtattggtgggtaggattttagttttttttttgaaagtttttaagttttattgaaaaatgaatgtattggggaagggtgtggtttatttttttttttagaagtttttgagttatattttttatttagtttcggaattttggtattttaaattatgtttgaatttgtatttttgtggttttagaaagggattaaatagtatattttatgaaattataaagagattataatttttttttttttttttttatatttttatataaataatatttatatagatgattgaatttaagatacgtttatttggtattgatggttaattggaagtttttaagtagaattatttataatgtgggattgtgtttttagtggttgtagtgaaggtttaatatttttaaatacggtgggaatttgttgaggaggtaggttgtgaagggtagggtattagtatttttttttaaaataatatgtgttttagtgtgtttaggatgttatagtaaaaatattatagatttggtggtttaaataataaatatttattttttatagtttggaggttgtgaagtttaagattaaggtattgatagatttagtgtttggtaaaggtttgtattttagtttatagttcgttgtttttttattgtttttaagaggttgaaagggtgagagagttttttcgagatttttttataagggtattaattttatttatagggttttatttttatgatttaattatttataaaggttttattttttaatattattatattgggggttaggattttaacgtatgaattttggggagatataaatatttagtttatataataatacgtatcgtgaaatttttttatttataaaagtaatatatttttattggagaaagtaaaaaagtatagaaaaatatgtagaagaaaatttattattattttatatttagagatatttatggtaaatattttaatataatttttgtgaagttatttagtatatattaatagagtttgaaaatataatttaatataaaagtatgaaatttataaagatattttaaaataaagttaatatgtatgtgtgtatatgtatttttatatatatataaatatatatgtttattatttttattgtgagtatttttttatattattagaaaattatgattttttgtttttttttttttttttttttttttttttttttttttggagatggagttttatttttttatttaggttggagtgtagtggtgtaattttggtttattgtaatttttattttttaggtttaagtaatttttttgttttagtttttcgagtaatagggattataggtttttgttattatgtttatttaatttttttgtatttttagtagagatggggttttattatgttggttaggttggttttgaatttttgattttaggtgatttgtttatttcggttttttaaagtgttggaattataggtataagttatcgtattagattaaaaattatgatttttgatggtattattttatggatgtaatataattaatttaattatttttttattagttaatattaaggttatttttaatttttattgttgttatattgttttttattttttttataaatatttggttttttttattttggatatgttgtagttaaaatgttatttagatagtttattttgatttagtgtttattaggttttaggtgtatgattgttatagtagagatagttgtatatagtttaagtttagattttgtttgtgagcgggagaatttaaagattaagtttttaatatttttttgtttgaaaaatggttatataattttgttaaattttttaatatttttatgtttttgtttttaatatggaaaatgaagatatttattaatttgtaattgtaaattattatataagaatgaggtatttatttaattatatggtgagattttgtagttaaaattaattaattgtgtttagtggttagattattggttttaaattttggatttattatttattattttttattgtgtaatttgggtaagttatttaattttttttttttttagtttttttatttataaaatgaataatagaagtatttattataagtgaggatgagataagatggtggtatatgtgagtggtatatatttgttattattattattattgttatttattattaagtagtgaatttagatttaatgtgaaatggtttagaagttattagtttttcgttttatgtttttaaagtattggtgataagagtatgtttgtattatgtagttataattttaattaaaatatgaaagtaattttaattaaaatgttaagttaaattagtaaagttagttttttttaaaatgtgtgttttaaagtaataaggtttgtagggtgtgttttagggatttttggtggggagtgggtggtagttagaatggcgaaaatagtggggatttttagggtttttatttatattgttttgtttttatagtaaaaattgttggttgatgaataaaattattttttttttttggatttatagttagatttaattttttaagttttgtatagttaaatgttattatataattatagtggagttatatgtgtttgttttaattatttaagtttgttattgtagtgtgaaagtagttataggtaatatttaaataaagggatgtgttgtgttttaataaaatgttattaaatttttttatagtttgttagtttttgaattagagtatggtaaggtaagagagaattgtagaacgtggttggaaaggtagaaggagttagggaggaaagattttgtggaattttagtataaagtttggattttattttaaaagtagaagggaagtttttgaagggttttagaaaagggtatgatttgaattatagaagtttagtttttagtagattagtattttaatatttatttattatgtgaattattgattttattttgttattttttttgtagaatttttttttaaggaaattgaaagtaagtttttgaatgagatggtatttttagggaaagattaggaggtagattttaaggggttttataagatggtatttttgtggttttggtggatttgttatgattttggtttggtaggattagaaatttgaatttattcgtttgtaagttttttttttttgtaagttttataagatttatattaagtttaggtgattaatatattaagttaaaaagtttattttagtaatttttaatgaaaaatataattgttatatgtgagaagtttattttatttttatagatatatttatattagaataataatgattataatggttagtatttattaataataatattgtgttaggtatagtgttaagtattttttatgatgattttataagtttatcggtaggaattgtggttaaaatttttttatagataaagttagaggttttaaatttataagattataatgttagtgagtggtagagatgagatttgaatttatatagtgtaaattagagtgtggatatttagttattataatatagtgttttataggagatatgtttagaaggttgttagtggatattgaatttatgggggaaaagaaggtagaaaaatttgattttaatgttattaggttaatggggtttgatgtagttattttgtagaagaacggtattgttagtaggttttttatgtttgtttataatattggttacggtttttttattaggatgggaatttttaaattttataattttttagatggtgttggaagaggtattgttgaggtttgttttgttaattatttttttttttttttttttgttttatttgttattttatttattaaggtgattttttatttattttatatgaattttataattaattttttagggtaatttttttagtttattttattattagggtagtttttaatatgattaattatttttatatattaagattatagattgttttagaatttgtatttatatttttattattaaaaaattatgttatcgttttttgaaatttttatgaaaaaaaaatattaagttatatttggagtgaaatggttagtaagaatatagtttgttatataaaataatgaaaatgttattttttatttatagtgtagattggggttttttttttagaattagaaatattaggtttgttaagatgtgatggggagtttattggggttagtgttttagtttttgaattttttaaaaggaatagaaatgaagaaaaagatttgttttaataaataaggttaagtttgtatgatttatggatttatgagtaaatttgatatttatttatatgggtggtttttttaagggataaatttcgtaaaagtatatttaagaaaaagggagtagatattgttggtgttttttttattaggagatatattgaaaggttgtagtagtatattagagttttataggttagtattagttaaatagttgttttgtgtattataagaattcgtatatattttaaaatgattaatttgtatttatgagataggatttgatttattaatttttgtatcgtaacgttttaataaaaattgtttttttaaagcgaagttttgttgagtagatgaattattatgtgggagtttaaaaattagttaaaggagttttgataattaagttttttaagtttggtttttttttggtttttgtttatttttgattataatttgaataaattttaatttttcgattagaatgtaaaatacgtgtttttgtaaaacgaatattaatggtataattcgtgttttattattttagttgatttgtattaatgtattaatattttaaagaaaatagggagtatatgttggttaataatttttgttatgattattgatatgtaatttatatgatataaattttattattttaaaaagtataatttagtgagtttgagtatgtttttaattttgtataattattttcgttattaaattttaaagtatatttattatattaataataaattttggttttattagtagttatttttaatttttttttttttagttttttggcgattattaattaattatttttttgtttttatggatttgtttattatgaatattgtatataaatggaattatataatatgtagttttttgtgtttggtattttttatttaatatattgtattaaaggtttttttatgttatagtatgtatcgatttatattttattttttgttatggttgaataatattttgttttttgaatttattatatttgtttatttatttatgagttgattatttaggttgttgttatttattagttattatgaataatgttgttatgaacgtttatgtataagtttttgggtagatatgttattttttttgggtaaatttttaggagttgaattgttgggttatatagtaattttatgtttatttttttgagaaaattgttaatatgttttttatagtgtttgaattattttataatttcgttggtaatgtatgagagttttattttttttatatttttattaatatttatttttttttttttaaaaaataattattgttgttttagtgggtatgaagtgatattttttgtatttttaatttgtatttttgtaatgaataatgatattgtgtattttttatgtgtttattggttagttgtatattttttttagagaattattaggttatttgtttttttttgaaatgttggttgtttttttattgttgaaatataaaagttttttatatattttagatttagatttttattggatatatgatttgtaaattttattatttttgtacgttgtttataattttaattattttgtgggttgtttttttattttttttataacgttttttgaagtagaatagttttttattgtgatgaagtttagtttgattattttttttttgtgtttttggtattgtaattaataaattattgattaattcgagattttgatgtatatatatgtttttttttaagttttataattttagtttttatatttaagtttttaatttattttgagttaattttttaaatatttttttgtatgtagttatttagttgttttaatgttatttgttgaataggtgattttttttttattgaatggttttggtatttttgtaaaaaattagttgattgtaggtatatgggtttttggatttttaattttattcgattgatttgaatgtttatttttatgttagtattatattgttttgattattgtagttttgtagtatgtaagtagtagtacgttttgtgagttttcgaattttgtttttttttatagattgttttgttattttgagttaagtatttttttaaaatattaagttaaaaatgaagttgttattttttaaaggaggataattttagaaaggtattgagatttgtgtttggtatgtagtaggtgtttttgaaaatgtttgttgtatggaatggattgattttatttttattttaatatttaatgttatgtttattttttttttggagttttttatttttttttttttttttttaagaaaattagtaatttttttatttatatattgtatatatatatatttttatttgtttatgtgtttattttttattaattagattataatgttatataaggttagaattatatttaatttattgttgggttttaaagttatgtttaagattataagtatataggggtttttttttttttaaaaagtttttatttttaattattatggatatataagagttatagatatgtaaagggtatatgtgatattttgatataagtatatattatataatgattaaattagggtaattgggatattcgttattttaagtatttgtaatgtatttgtgttagaagtattgtaattttatttttagttattttgaaatatataataaatttttgttaattgtagttattttgttgtttattgaatattagattttattttttatatttgattgtattttcgtatttattaaatattttttttttttattttttattttatttattattattatattataagttttagggtatatgtgtataatgtgtaggttagttatatatgtatatatgtgttatggtggtgcgttgtatttattaattcgttatttagtattaggtatattttttaatgttattttttttttttttttatattttataatagtttttagagtgtgatgtttttttttttgtgtttatgtgtttttattgtttaatttttatttacgagtgagaatatgcggttaaatattttttttttattttttttttttattattttttttagattttagtaattattattttattttttttttttttgagtttttatatatgagtaagaaatgtgatatttgtttttttgtgtttggtttattttttttgtataatgttttttagttttatttatgttgatgaaagagatataattttatttttttttatggttgaataatattttattgtgtatatgtataatattttttttatttatttgttggtggatatttaggttgattttatattttggttattgtgaatagtgttgcggtaaatatgggagtgtagatattttttcgatatattgatttttttttttttgggtatatgtttagtagtgggattgttgggtaatatggtagttttattttgttgttgttgttgtttttaggaatttttatattgttttttatagtggttgtattaatttacgtttttattaatagtgtatgagggtttttttttttttatatttttgagagtattcgtaattttttgtttttttgatagaagtaatttttattgggatgagatgatattttattgtagtttagatttatatttttttgatgattaaggatgttgagtatttttggttattcgtatgttatttatttagattttttgattatttttaaattaaattatttttttttattgagttgtttatataatttatatattttgtttattaattttttattagataggtagtttttagatattttattttattttgtgagttgtttttttattttgttgatggttttttttgttgtgtagaagttttttagtttgaggtgattttatttgtttatttttgtattggttgattgtgtttttgatgttttatttaaaaaatatttggttagattaatgttattttttgttatatataaaaattaaattaaattggattaaaaatttaaatcgaaggtttgtaagtatgaaattattagaataaaataatatatatgtgttggagggagagaagaaagtaatgaagaaagaaaggttaggtgagaaagtaagagagaagggaaaatgaataagaaagataaaagttattttaggtattgttttaaggggtattttatttatttttataattttatgagataagtatttttatttttagtttgtttaggatgttataatagaattttatagattgcgtgggttataaataatagaaatttattttttttagttttagtgattgggaagtttatgattaaggtattgatagaattgttatttggtgaggatttgttttttggtttataaatggatagttattttttttttttgttttgtttttatatggtgggaaggggtaaagaagttttttgaggttttttttatatgggtattaattttatttatgagggttttgtttttatgattaaattattttttaaaggttttattttttaatgttattattatggggttaggattttaataggaatttggaaaggatatagatatttagaatatagtatttttattttatagataagaatagtgagaaatagagagttaaataatttttttaaggttatataacgaattcgtagtttaggtagtttggttttttggttatgtttttaaatattatgttatattgttttttaaataaatattaaaattaagatatttgggatgatcgttgggaggtagagtttagatatttatattttaaataaatttttaaatgatttgatgggtaatttagatgaaaattaatgttttaagaaatagttaaataaaattttatggaaggtaaagatggggagagtttggtgagatgttatatttgggaggaaaagttagggaaagtaagagaaaattgggtattagtaaagattatggagaagggaaaatataagatattgttaggttaaaaaagaggtagatttgatgaagtagtgaatattattttagttattttttattttggttttagttggttttggttgtgattgtgttttatattttgtaatgatatgtaatttttattacgtttatattatatttaaagtttattttagtgtgtttataaaagtaagtaagaataaaaagtaagagaaataatttatatttatttgttgtttattatgtgttaggttatgtttttttttttttgagatagagttttattttgttatttaggttggagtgtagtggtgtgagtttggtttattgtaatttttgttttttggggttaagtgatttttttgttttagttttttaagtggttgaaattataggtacgtttagtagagatggggttttgttatgttggttaggttgatttttaattttagattttaagtgatgtgtttattttagttttataaagtgttgggattataggtgtgagtttttatatttatgtgttaggttatgttttaagtgttttatttatgagaatttatttagtttttataataattttgtgaggtaggtattattgtttttttttattttatagggaaggattttgaagtatatagaggttaaggagtttattaaggttattgtagttaataagtagtagaattagatttaaattcggagtttatatttttaattattatgttgtttttagaagaaagaaaataagggatgaaggatagtaaaaatatgtaagtttttttgagttttttgttgttggttttattttggtaggagtgttaggaagattatgggaatttaaaggtgatatttagtatttttttttagaggttataggagttattattggtagttagttatttgtatttttcgtgatggtggagaaaagtttatattgttgtaagtttttagaattttttttgttttggaaaagatttttaaattagggttaattaagtattttttttggtgaattttattaaaattattatataaaaaaagaagaatttgttttgaattatatatataggagaaaaatgataaaataaaataatttttattatttttgtagtaaaaaaagttggaatgattttattaggttttttgaaggattttgtttttaaaggagatgttaaaatgtgtaaaatatttaaaggatatatttttgtagttgaatttaggattttaagaaatatggttttatcgtgttttttaatgattgttgaaaagaagtagtgattgggttatatttagggtagggttttttagtttcggtattattgatattttgggtcgggtaattttttgttgtggggggttgtgttatgtattgtaggatgtttagtaggatttttggtttttatttattagatgttaataagattttttttttttatttgtgataattaaaaatgtttttaggaatttttaaatattttttagggttaaaattatttagttgaaaattagtgttttagggaaaattattataattaatagtatgtttatgattttttttgttgcgggaagttagggattttaaacggagggattagttgaagttatggtagaagaacgtggattgtgaagattttatggatatttattagttttttaaattaatatttttataattttttatgtttgtttttattgtaatttttaaatataaattgtgaagattttatggatatttattatttttttaattaatatttttgtgattttttatatttgtttttattttaattttttaattttgttattttttaaattgaggaggatgtatgttgttttaggattttgtgataattgtgttaattgtataaattgtagagtatgtgtgtttgaataatatgaaatttgggtattttgaaaaaagaataggataatagtaattgtttaggtaataagagagataattttaaattttgatcgtcggtgagttagggggaatagagttatatttttttttttttaaaagtaaatgggagaaatattgttgaatttttttttttagtaaggaatatttttgagaaagagaatatgtttttgagggtgggtttttgaaatggtttttttgggtgtggttgttttttatggttgaaattgtagggatgaaataaattttagttttttatagcgtttttaggtttattaggaagaggaaatttttgtttaatatattttggttagattagttgtttttaaattttgttttttgataagatgttattaaagataatggtgtttaaaattttgttagtaattttaatttcgttttcgttttgtggttttgtgatttcgttttgtttttatttgttttgtgatattttattattttgtgaagcgcgtgatttttgtgatttatatttattcgtatattttttttttttttgaaagtttttaataaaaatttgttggttttgcggtttgtggggtattacggaatttattaatatgtgatgttttttttagacgtttagttttaaaattttttttttttgaattttgtttttttattttttaaattggttgacgtttagggaaaatagaaaagaatttatgtgattatcggggtaggtttttcgatattttttaaagtattgtatggaatgttatattttttttattatagtgttttaaataagtattttagtgtgttattgaaaatatttataaataaaatatatttgatagtagggtatgaatatgttcgtgtttttggaagagaaagaggggataagagaataggtataatagtatgttgttggtgaaaataaattggtagtaatatagattgaatattttttatttaaaatgttttcgataggaagggttttggattttagatatttttagattttgaaatatttgtagaatatatataggtagagtatttttaatttaaaaatttaaaatttgaaatgttttaatgagtattttttttgagtattatgatagtatttaaaaagttttggattttggagtattttcgattttagaatttgggattagggatatttgatttatagtaatgttaaatattgtattaaaattagtaaatgtaattttattgaattgtgataatagttttaagaggaaattcgattattatgtttatttagtagatgaggaaatagaggtaattaggttaaggttatataatttggagtgttagagtttggattttttttagttttgttttcgtttaagttagttttgttaatattatttttttttttagtataatttgtgttattattggagtttatgtttatttgtttgttatttagtattaattgtttattttttaagttttattttgttttttttaggagttttttttgatttttgtttttattttttgatttgtgtttttttatattttgtgtttttttaattgggaaagttttgagggtaggggttatattttatttatttttatttttagtttattgtatagaggtatttagtagatgattagtaaatatgggttgtttagtaaaaattttgtagttagagataatgaaagaaatataattatttttgtgtgggttgagaaagaagggaagggaaagtttagatatttaagtagaaaaaggtaaatagtttaaaaggggaaaagtaatttgtttaaattatgtagttgagggtaggaagaaagggggataaagttaaaattaaaatttagttttttgttttagtttagtgttttgtttgttacgttatataaattgtgattgtgaaattaaagggtttttgatggtattgatataagtaaataaatggttttatgagttaatatatgataagtaataaatttataaaaggtaaatattgataattgaagattatatattattatgtttagtgtgtggagaatttaattaggaattaggaaagtttgtatatttagtttggttttttggtaaattaatgagattttaaataaattattttatttttttgtgtttttgttttttttggttgtagtattttgttggttaaagagtacgtgattaatgtttatgtttttaaatgtttgtttttatttgagtatgtttagttggatgtggaaaatttatggtttttttgggttttataaggattaaattttatagtgatatgtaaatttgtgtggtttatagaattataggattttaaagttgggagaggtttgataaattatatagtgaaaatttttagttagtgtttggattttttttatagaattttttttttattggataggtgttttttttataatttatgatgtaaggagaaaaggggtttcgtttgaaggaagttagtgtattgtgtatgggcgtgtattttttgtttggggtgtgtttatagggttattttattttttgaaagcgtaataataagttattttattatgtattaattaaatgttagagattatgttaaatgttttatagagaatattttttttaatttgtataagaattttttgaggtagataatattattaattttattttttagataaggaaattaatatttagaaaagttaagtaatttgttaaagatatgtgtttattaggaggtagagttttaagtttattttaagtttttaataagtaaataaatgtttattgaatttaattaatgatattttattttatatttttttgttattgatgagagagagaagtataaagtttatgtaaataagatagaagtaatgttttatataagtattgtggatttaattttattaagggattgattttttattttaatggaattttttttttagttattaagttttagttttaagatcgtaaatgttaagaagatattaaaatattttaatatataattttattagattatatttataggtattgttaatatattattaaatttattataaataaaataataaaataaaaggttggattaatatggaaagtagagtaataatttaggttttaaagaaaaattacgtaagatattttttagaggattattaggtttttttttttttttttttttaaatatagtttaaaatagaaaagtaatttatgtattaataaaaaaaatagaaatttgaggtagatgtaattagaataggtgaattaattgaagattgatatttttatttatgtttgtgtattttaaataaagaaggagtttgattattttatttagttaattattaaaaggaaattcgagttaaatttgtgaagtaggtaaagtttatttttagatatttaattggttttttttttgggtttttttttttttttggggttattttttatgtttggtaattttaatttttttgttttttttagaaggagtaatatttttatgttttagatttttatttttgatgttaggattttttttgatgtaagtgttagttaattttagttggttgaagaggaaggaggaggaagagaaggagggggaataatgtattgaagtgtgtaatagttaagtttaggagtagtttttattttaggatttagatatttatattatataattgggaatttatttttagatttttttgttttttttttttgtaaattttaatttaatggagtttttaagtggtagattatagttgttttaagtttgtatcgtattagtttagttatttttgttgagaaataagataagtttttaagtagttttagaaagttaagaattaaggtgtatttgtttttgttatgtgtttatttttgatattattagatttggtttatgtagagttatagatgggttaatattattataagcgtatggattaaagttagggaaaggatagttttttaaaggaaatgttaggttttagtattatatgtggagaggggatatttggtaagtaaaatagtatttatttattatgtggttataatagggtagattagggtttttggtaggatggaggtagttattaagtattatggtatttttgaataatttttttttagtttatatgtaaattaatttttttaaattgttaatgtatttaatataaggatggatttagtaaaattgtattaatagtaaaatatgaggggtttttagttagtagtttgttttgtatagttatttatgattattgttttaattgattttttttagaatgtttaaaggaagatgaaagtagaaaatgagttgtagtggataagtatttttaaaatgagtttaataatgtagtatttttgggtgtttgataattgttgtaaattatatttgtttgagaaattttaattttataataattgtataatagtagaaagatttagatataaaaatatttattgtagtatggtttgtaatagtgaaaaattgaaaataatttatatatattttaataaggaaaggttaaaataatggtatattatgttattattatttgaaaatattgaaaagatgaaaagatgtttaataatatttgatgaataaaggttgaaaaatatatgtagtaaaattttatttttgtttttaaaaaatatatatgtatgtatgtatttatgtatagataaaaaggatttgaaaatatataataaattatagttaattatatttattttatggtattgtagaatattagaatttattttttttatttagttgtaattttgtaatcgttaattaatttttttttattttttttttttttttgttttttttagtttttgatagttataattttattttttattttatataataaaagtttttaaagaggggaataatggggtgggggatttggaatatatataaaaatttaaaaataattataaatttgttgttattaaaatataaaaagaaaaaaatagttatatttgtaaaatgggattgtgtgaggaagtttttatttttatatatttttattttttgtatgtttggatttttataataagtatgtgttattttttagtattttttgaagttttttttttaaaggtataagtaatatttaaagttattttttatttttttaatgtcgtttatataaagataacgattttttttggatggttttaattttttttttgtaagatttttttttatttgttatatttataatttataatttttttattttttattgttttttattttttttataaagtgagtttagttagtatttgtaggtttgttaagtattatttttaataagaaagattaatttgtaaagtaaatgtggaaatgtattaatatagtattaagtataaaatagttatttaataatcgaattatttaatttttttttttttatattttattttttttttaattttagaaagaatttgaattgggttataataaagataaatttagatagatagataaagatattttataggtagaaataaaattgagtgattataaattaattataggaggttttgttagtttgatgaatagaaatatacgtgataaaattatagagaggtaaaatagaaaatgaaaattaggattaagaaaagggaaataaaaatatgttggatattatttaataattatttgttgatggtaattatagggatggaaaatttattaggtttatggagttaaaattaattagtaagtatttatagagtgtttattgtttttattattggttttggttttttgtttgtttagtgtagaggtttgagatatttgcgtgatatttagtttgttaagatagaaggagtaaaataagtagatagaggtttattgtagtcgtttatatttattatattgttggaattatatttaagtgagataaatttttttagtggaagacgataaaattagtttaaaagttgtaaatattattttattatttaaaaaaggtttaattaagtggagatattatttttgtaaagtaattattaatttatttgtgtaatatttgaaattttaaagtataaatttatattttattaaaggtaggaagtgaaattaataaaatttgtaataattatatttaatttttagggttttttttattgttgataaatattttaagttatgtttatttttttaaaatgtaaaatatgatgtttatgttattgttaatattttgataaaaagttattgttatggatatttgggtttttttttgtatgtttagaaatttttttttttttatttaaatttaaaatttttaattatttggagaagtattttttttttttttttttttatttgtattttatttttaggtgttagtggtgggtatttgagttaggttttgtttattatagtatatatttttgatattttttggttatagttattggtttagggataagtatttgaattaattagattagtgaaattttttttaggaataattattaaaattatgggaaaagaattttttttattgaagttattaatttggtaggatgtgttaaatttaggtgttataggttattaggtggagaggtggagataatttttttagaaaataaaataaaataaaataggaaaatgaagttaagggataaaatttaagttttttggattttatttgagtttttgaatttagttatgttttttgaaattaaattttttttggattttttagtgaattaaaaaattttgtttttaatagtggggttttttataaatgtattaaaaaatgatttaatgaatgttgtttataagtttttattagaagtattatttttaagagaaaaaaaaaataaataatttgaagaaaattttttataatttaagttagttttgttaatttttaggaaatttttcgtgattattatttttatatttatatttatttttttaattttaaatattagatgattttttgaagtttatgaagtgttttatgtatttaatatatttttgtaagtttgtattgttttataatgatttgtaatcgtatttgtttttattttttttagagaagagattgttattattttgatatttttgtagttttatattggggtttaatatataatagttgttattttgttgaaggaattgtattttgttgaaggaatttttttttgttgaaggaatgaatggagagaatattaattaagaaagttttttttattaataaatattttttgattgattgaaattatgtttaaaatagttaattattagaagattaaagtaaataatatatttaaattgaatttttaaagtgttagttattggtagttgtatagttgagaattttttttttttttggttattagggttgaaagggtgggtgaatgtggagatatgatttttttttttgtaaaatatttattattttttaaattttataaaatgtaataattttttttgaaaaatgttaaaatttaaataaaaaaatttgtaatgtggaatatagattgtaggttataatggaggaagtagggaaagtggggaaaattgtggttgttagaagttttttgataattaataggtaagataatagggtggtttttggtagggtttttttttatggtatagtaaagaaaaataggaatgaagaagtgagaagtatgaaaggggatagtaatatatgtgtaatatagggtgatttagtgtgagagttttataattaaaattgttaaatgtgagaaaaaaaaatttattataaattgggataggtttaaggtatggagatgaataaataatttttttatgtgggtaaaaattaatgaaattattagatgagtagtttagtatgtgagttttagttgtaatatgttattggtatttggggtttttttttttttttttttttttgtattttgaggtaattcgatatttgattaataatttagtttaattttttttatttgatataaagatatttattttgaaattttagaattgttaatattttttattttttattataattttttttgattttttttttttggtatagttttttatgtatttattttatttaattaagtttgtttattttttattagaaggtttttttttagtataaaaagtttttggaagtttattttttttatagagttgttggatgattgttttgtttatttttggtttttaaaatattttttttgtttaattatagttttttagtttttttgttattgtaattaatataaatttcgttatttttttttgggttaatgtgtttgtttttttattgttttttttgtttttttttttagtttttataatttatattttatatcgtaagtagaacgagttttttaaatagtaaattagattatgtttattagtgtgttagtaaatgtttaatagtttttgaggggaatagagtatttatgtgttttataatttttatatatatgtattatataatttataaaaagtaagaaaaaatataatatttttaatagtaaattttatatggttatgtgatttttatagaattattttagtgatttttgtagaatatttgtgtttatagttaatttatagttaaaatttaaatacgtttggtaaaattagattataaataaatatttgattaatatttaattagtaaagaagttatttatggtattgaagttttaatatgaatgttggttgatatttttatattaatgagcgagataaaagtgaagtaataaaaatggatgttggaattaaattcgtttattaatgatagaagtgattttttttgttgataatagtttttaagtattagaaaaatatttttttaagtttttgtgtttataaattaaggtatttttaagtttaatttttattattaaaattttttttattttgttagtttagataattaataaaataaattaagttttggtttgttatgttttttaatttttatagtataggtattttattatggttgattttaaattattaaaataatatttttgaatgtagcgttaggaagggatacgttgtattatattatcgtatggtatgtttttatatagaatagatagaaataattttaagaatatagataatagtaaaatggagtaaaataattaggtagtaaagtttttagtatttatttttgttgttaaaatatttgattgtgagtttataaataatttggtttttaataatgattgtgattaataattaatttataaaatttttgaaaatttaatagttagtgtttgtaagttggtataattgttttcggtgtattattgaattattatttttttgtttaaaattttagattgtttattgtattgattttttgggaaataagtgaaaagagataatgataatttttatttttgttgtggtgaagtgatagtgtaaaaattttataagtttttttaagttttttaaataaagtttagtgtttaaaaacgtttgaatatatgattttatgtaaggtttatattattttttgtgtgataggtggggtagatattattattttttttttatagattgaaaaataaggttgagaaaaattaaatgtttattttaggtttatttaagtaagtaaatggtagaatagggtttaaaaattaggttttgtattgaaaatttaataagaggatagagaaaatttaattgataaatattgattttaaaataattttttttttaatggtgataaatgttttttgtagtattttggagtttgatatgaagtatttttttattttgttaagggatttttatattaagaatgtttttattttaattttattatttttaagttagtttaaaaataaaataaaattttgtgtgttttaataagaagatataagaattaaaatggaaatgtaggtttttaaatgagttgaaagattttatatagtagcggggtagattgaaatattttttattaaaggaatatgggagagaaaaggagattaaattaagaaaggaagaaagttaatgatatatgaggagttataaatgttataaatgaaaaaataaagtacgtaatatttgttgtaattatttagtgtgtttgttttaatgtttttaaatattaaaaatattgagtttttgtttatggtaatatttattttatttatttgttgatagttgttttatttttgaattaggtattgtttaaattaagttttgttagtataaagaataaagttaattaggatatttattgggtattttacgtatatgagtataaattgtgatattttaggttgtttatgatgaaattattgaaagtattatgaaagatagtaaaatagtaggaaagttagtaataatttagtattttttagtttaggcgggaatgttaattttaattataacgaggaatattaaagtggagtttattatgattaagaatttgttgtattagtgtgaattgtttataataggtatgtttggtataaaatataaatattgaagtagatagagatggtttatttaaagtttagttgggtttttttgaattttttattttataaagttaaataggaatagaagtattttttaaagttaagatattattttaaagagataaataatagttatgatagttgtaggaataattttttaaagtaagttttaattattaataaaagttgtttgtgtgggtttaatatgtttaaaatatataatatatatgtatataatatacgtatatatggtttttatttatatttaatattatatatttaaagtgagagagtatagaaaaaaagaataaatggaaattgaagttatgataaagaattacggattataggaaaataagttataaagaagtatgtttatgtaagaggaaatatatgtgataaataataggagatatgggaatgaatgtggtgttttatgttttttttttaatagaatcgtgtaatagatattatttaatatcgattttaattgatttagttttttagtttttttggaaaataatggattgatgtttagggtgcgttgaatattggaattatggttatttttgtattttatacgattttgtttttattagttgagttattaatagtttttggtgtttttgttttttaaatatgtttatgttatttgttgtttattattgtatttatttaatttgattaaatattaagtaaaatgatgaaatgagtgtaaaaaattgttttataaaatttaaatggaaagatgttttatagttttttttgatttatagttgcgttaagtaaggtggatgtaagataattttaaaagattggtgtgggggtaggagtgaggaattataaaaatttagaaatttgtacgaaaattattttaaaagtatatattgaatatttttaatttgaaaatttgaattttgaagtgttttaaaatttaaaattttttgagtattgttatgatattataaatgaaaaattttatatggaagtatttattataaattttgttttatgttttaaattattttaaatattgtataaaattatttttaggttataaggtgtatatgaaataaaaaatgaattttttatttagatttgggttttatggtcgagatattttattataatgtaaatattttaaaattagaaaaaaaaaaatttaaaatttaaaatatttttagtattaagtattttaggttatggatattgaatgtgtatttttaattttttgttttattttgtttaaaaaaaagggggaaaatagtaattttatagatgaataataattgttaatgatgagtaaatattttttatgatttaggaattcgtttaagtattttatatatattaaattggtttaatttttataaattagtattattattatttttattttatagatgatggaaaaaggtatagagagttagtttgtttaaggttatattttttttagtggtggagattgtatttggtttttatagtttggtttttaattgttatattatattaatgtattataggtatagtttatatatatattaaagaagatatggaattttagttagtgggtttataaaagttttagatttttattaaaagattagaaaataaatgtttaattataggttttaggttttaaaagttttaaaagtttaaagtttgtaagttattttttttaaaattattttttttttttaattaatttttaaattaaattttagtttaattatatttattagaaggttttattttttataaaggggtaggtaaaggtgatgattttaaatattatattgggagttgggatttgtgtagtattagaattaagagttattgtatatatttgagaaggagtatagtttgatttagttgatgttttggaggggtaatttggtagtatagtttggattattttagtgggaatggagatgataaaatatgaagagaatgggagaatttatttgggtaatatattagtttttgaaattaatgtattaagtggtttggttattagttaggtttaaggttttattggttttaggatatagtttttaagattatatattatttttatttatttatttaattaatatttattgagtattaattatgtattagtgatataggggtgaataaatagatatagtttttgtttttgtagaatttatgttttggtgggtgatatagagaaataataaatgagggtataaataatgaattattattgtaatgtgttaataaagtatgtagaatattataagaatatataattaagaatttaatttagtttattttaaaaaaaagtggggggagtatttagatgtttaaatataaaataataaaaatgaggattttgagggttatttgtatattttttattaatttatttggttataataataatttagtaaaagtgattttatatttagttaattagttgatttaatgttattataattttgtaatgtatttgttgggtgtttgttatgtagtgggttgtgttttaggagtgggatataaagttatgataagatagattaggtttttgttttgattgagtttgaatatattatttttatttttatttttgtttttaagataattaaatatttttttatttagatagggatttattttattttttgtagtaattataagtttttagggttatagattagtaaatgttatatttaaagatttaggatattgtgtataaaatatttttaatagtgtttgttagatagtagatgcgtaataaatgttgattttcgttagaattgtgttattattataatgttaaattttacgttttttttggtatattggagtttatttttttaattaaatttcgtaagtatatattgtaagtagtttattagaattgatatattattttatgttaatgattgagattagtgaggaaaattattttaatattgtttaattttttttttaatgtataggagttatgtgaatttagataagtattaatttttgtaagtttgttgtttttatattgaaaaatcgaataataatatttattttatttaattgttgttagtaaaagtgggtagtagaagagtggggattaataaatgttagttataaattataattatttgtattattttgaaaaagaggggttaatttatagtttatgtatgtttttaaatgaatgtgaaagattaaagaatgagaatttttttgttattaaattaaaaaattaataggtatatttagattgttgaagagagaaattaggataagtttttttttttttttgtttaattaaaaacgtttttaatggtatatttaaaattacgtatttttttttattaagatttgtagagaaaaaaaaatgaagggagaataattgggaatttttgtgaaattataaattatttaagtagagtatttattattaaggatttgagtatgtatgagcgatgaggtggatttttagagtagagatttagtagtgagataggttaatggtatggggagatgtgttttattagataattgtattgtttttttaattatatatatatatatgtatataatatatatgtgtatatatatgtatatatatatgtatatataaatagaatttttaattattttaagtagtgtataaggataattattagtatgggttatttaatttatttttaaaacgtgtaaaatattattgtagggttgggttttgatttgttttttatgaaattgttggtagtttaggggttaaattaacgaaagatattttattttagtgtttgaggtttagaaattggaaaaacgggtaattaggttaagtagtgtttttatagttttatagatgagtatttaaagtaagggtttttttttagttgatttgtgttaagggataggagaagcggagtttgttttttgggtttagaagggggttttgttaatatggagttgtttagcgttttttataaaaatttttttggttgagggttttacgttggtatacggttggtttttttttttttttcgaggtggcgagtatttttttttttgttaagatggcggttttagaattttttggaggcggttttcgtagatcgttttcggataagaggtttgttgaaagtttatttttttttttttatattagataatgtatagggaatcgtttatttttgagaattaaggaaggacggtttaggttattcgcgatcgcgaatttttgttaagatggtggtcgcggggacgggttggcgatattgtattttattaagatggcggcgggcggttttcgggacgcgtttttttaatcgtttttaagatgttagagtagggggagtcgtcgttagtttgagcgcggcgggaggtgagagagtggttgtggtcgagcgttcgagtaggattaggtggagttgcggtagttttcgttcgtgttaggagttggtaagcgatgttatttgtgggggcgtaaaagttatttttttaaattttaaatttatatagtataattttttttagagttataaaaattataatttgtgtcgtataaggtaggaggttcggtttcggtatcgtttaagttttttcgacgcggcgagttggggaagggagttggggcgggggtttttcgtacgggtatttttcgttttacggttttttttttttttaggacggattacgagtttttttttttttggattgagggggaagtttttaataggaatatttgtagggagttgaacgttggtattttaaagttgtttgtattttgttttatttgtaggggtaggggttttatgaacgtgatagggtgagtaacgtatagagtcgagggtagtaaatgttaagattcgggggtggggtttgtatcgggaatttggacgcgggttttggtcggggtggaagaagaggttaggagtttcggaaggggggttatatttcgttagtaatttattatttcgtttgtaatttgtttttaagtttgtcgttttttgttttttttaattataataataaaaaaaaagtgtaaagaaatttagttcgttggaggttttgtatttggcgtgtaatttttttcgagtgtgagtatattgggcgggaggggtgggggttgaatttggtaggcggcgtttttttttgtcgtcgtcgtcgtttcgtagattcggggaagagggtgggggacggtcggggcgcgggggagggtgggttttgttttgtaattttttttttagtgcgagagcgcggcggcggtagttgaagattcggtcgtttagatgatgcggtggtgggggatttgtcggtacgcgatttttttcgggtttaaagtacgtatgcgtcgattttcgttatttcgttttttttttgaagtttttttagagggcgtgttaggtcgttcggtttcgagcgcggtcgagacgttgcggtatcgttttcgtgtaatttcgtagtttttttcgaagtgatatattttacgtaattcggttcggcggcggcggcgcgggttatttacgtagtttagtcgcgggaggcgtttcggtttttgtggttcgttcgttgttattcgtaggggtattggcggcgtttgtcgttaaggggtagagcgagttttcgagtgggtttggagtcgcggagttgggcgggggcgggaaggaggtagcgagaaaagaaattggagaaattcggtggtttttttaacgtcgttttagagagattaggtcggttttcgtcgttgtcgtcgttatttttttttttggggagttgggggcggggggcgaagcgcggcgtatcgggcggggcggttacgttaggggacgcgggcgtgtaggcgtcgtcggggtcggggtggcggggttcgcgcggagggcgtgggggtagggatcgcgggcgtttttgtagttgttaagcgttattaataggttgtatcgtttttcgcggtcgtcgcgcggtttttcgggcggggagcggtcgggggtggagtgggagcgcgtgtgtgcgagtgtgtgcgcgtcgtggcgtcgtttttattcgtttttcgttcggtttcgttcgttcgtttaggtcgggttgttttttcgcgtgttcgcgttttttttttttcgtcgtcgttttttttattttgcgagttcgtgtttgtgacgggagttcgagttatcgtttgttcgtcggggacggattttgtgggtggaaggagacgtcgtagtcggagcggtcgaagtagttgggatcgggacggggtacgcgcgttcggaatttcgattcgcggagttcggcgcggggcggagggttggtttgttagttgggtaatgggagatttttttaaataggggttttttttttatttatggagaaaggggcggttgtttattttttttttttagaaaaaaaaaatatattttttttttgttttttttgcgtttataagttaagttgtttatttcggttgcggcgggaattgcggacggtggcgggcgagcggtttttttgttagaggtaagaagcgaggcgggagggggtcggggcgcgttcgttttttcgaggtgtcgttgggatcggagataattcgggggtcgtcgcgggagtttataaatttttattagtttcggggagtgggggtggggggttggtaagggtcgggcgacggtgacgaaagggtagcgcgcgggtgatagcgttggttttttttttttttttcgtaggcgttttttggtcgggtcgagggggaggaatttgatttcggacggcgagcggagttttgtcgaattgtcgggggtttcgagttttttatttttcgcgggaattttggttttttttttttttttagtgttttttttttttttaagggggtcgttcgatattcgttttcgtggtgaacgttaagtcgcgtttgaattttattcgttcgaatatttgtacgttatttcggcgcgttcgagcgcgagttcgggtttcggggaggtttcggcggcgtttggtttgaggagggcgtgcggggcgcgtgagggtgtatacgcggggggttgatagttcgtaatttggagattgcggtcggggtcggcgttatttgttagaagtgggcgtgtcggagagagaatttaataggtttggacgtattttttttttaatttcgtattttttttttttttttattttcgtttcgtaagggtttgttttttagcgtttgttgttaattcgcgtttgaggtttttaagtggttttttttagaaaaagattttttgtaatcgtaatggttttgtgttgcgatttttataagtgttagtttgacgtttggggttgtagatttgataattgtaattttgtaatattatttaagattttttggtatggtttattagggttaattaatgtggttgggttatttgtaatttaaattgggggataatgtcgtttgagggagcgttttcgttttaggaaatattgttttggtttcgggtttgaaggtagttgttaaaaaagcggtatggaaatttattgggttttattcgatatttcgtgtttagagatcgttatcgttttagataaacggggtagagaggtggggagataagtagtttatttttaagatttgtagtggtaagtttatatttttttttttatttttatatttattttttagtgagggttagtgatatttatgttgtttaacgttatcgtataggaaaagttattttttattggacgggatttgattatagtgttttaaatgcgttttttcgttttagtttattttttaaaatattttgattaacgatatattaatagttttatttttttgagaataggttgagaattgggataggtgaaggtttggataggtgaaggtagagaaaattattttgaatattttattggatatagttgtatttgaatttatatgaatgtgattttacggttttgtgtttttttattttttagtatttcgatatttgtttggaaaggaaagaatttagagatgtaatagtattttatattgaggattttaagtaatgtaaataaatgtagtttaatttagatgtttttgtgagttatgataagggttagttatatttaagttatgtaagttaataacgtagtgagaaattattatatttttttttttgttttttaaaatttaaattttagttggtttatataaagtgtattttattttatatatttaaaatttggaggtaggtatatttagttagaagtatgggttaaaaagtttttttttagtttgtcggaagataagtagattagtattgtttattttttaaagaaaacgtgtatggtttattagttggttgtatttaaaggtttggatgtgtgattagttggtaggagggaaatttggaagtaattagggattgagaattttagtatagtatttattaaatgttatatgtattggtttttagaaaagtaaatagtcgtgattgaaaagaggtaggaattttaatgattatattttttttttttgaaattaaatattttgatattaatttgaatttttagaataattagatgtaatgaattataatgtttgtgattaataaagttatacgtttagtgagcggtaggatgaatagttaagtttagttcgatatatttttgtttttagttgtgtaaatggattgtattgtatttttaaatgtggtatgttgaatgggagtaggggatatggttttttattttggaagatagaaattatttttttggtaataaagaatttgattcggagttaattaaaaggtttatttaataagttgttttttattaatcggattaggaagataatgtgattttagagtttatgatgtttttttttcgtttttgttttttgttttgtagttgatatttattgatggattttaaagaattattaatttttggtagagaagaaaattttagtagtgtgtttgtttaggagaggggagatgtgatggatttttataaaattttaagaggaggagttattgtgaaggtttttgcgtttttatttttattggttgtcgttttttaattagattttaagtagcgaagatttttggttgattttttaaaaggtttagtaagtaatgcgtagtagttagatttgtttaaagtagttttatttttaatgggattgtatatgggagagatagaaataaaagtgatgggaaatgatttgggatttttatagtagggttaaattagttttttttcgggggaaatagatttaaagtttttggaagaaagtattgtaaattttaataggtcgattagtgttttagagaattttaagagtttagtatttattgttgtgtttgttgtttttatagagaaggagtttttaaaaatttattttgatgtatttttagaatagtaatatttgaagggttagattggtattaacggtggtaatgtgaaattgtatattatagattaaagtatttttgatattttgtaggatttggagtttttttttgggtttttaggtaaagagacgaatgagagtttttggagattagatttgttgatagatgaaaattgtttgtttttttttttggcgggagaagacgatttattttttttggaaggaaattcgaatgaggattgtaagttttttattttatcggatattaaatttaaaattaaggataatggagatttggttttgttaagttttagtaatgtaatattgttttaagtgaaaatagaaaaagaagattttatcgaattttgtatttttggggtaattaagtaagagaaattgggtatagtttattgttaggtaagtttttttggagtaaatataattggtaataaaatgtttgttatttttgtttatggtgtgagtatttttggaggatagatgtattattatgatatgaatatagtattttttttttaatagtaggattagaagtttatttttaatgttattttattaattttcgttggtttcgaaaattggaataggtgttaaggatttggagatgataatttgatttttttggggattttgaatttttttggtcgaatagttttttttaatggttatttaaggtaagattagtgtttttttgttttttaagaatggtatatttaaggtagattaatagatgtaaatttttattgatttatatgtgttttttaaagatttatgtgtttttttatatgaataagtttaagtggttttttgaaagtaggaaaggtagataatttaagtgatatttgtacgtaattattttaggttttttttttaaatagtggtttttagtattttattggttaacggtgaggattttatttaatatttttaaaataatgttgtttattaatagatattttaacgaaaaattatataaatttaggagagtataatgttttataatattatattgtgttgtgtatggttatttagttgttttagaatatgtttttatattataataaatgatatttttatttatatagttaaaagttgtgttgttttatttgtaaattcgttaagtgttagtttgagattaaagagttaaaagtagaagtattaataaagagttttattttttaaattgaattttttgttaaagaatttgagttttgaagttgttaaagtaatgtagtgaatagtgtattagattatagtattagatataggttttgtttatagggtttttgttataaagtagataagttatgtttgttgattaatttttttaagagaggaattggtgttaatatggtgtaaaataaaattttacgtttaaatgtttttgtaagtttttaagtagataattgatggttaaaattgttaagttttaatttttagttttcgtttgattttttttttttttttatttagtcgtttataagtatattgatatttttgtttgatttaaaaaggttagaaaatggaattattagaaaaaagttttaaatgtagatatacgtgttggtaggggtgaatttttttatttcgtaattttatttttaatttagataaatgttaggttttatatttattttagttgtgaaggaaaatataaaaatgtggattgtagtgatataagattgattaattagcgggtttttttaaaagaagatatggtagatagtgatttatttgtatgtaattattgaagtttttttttaaatgttagtgatatttatcgtttttattaattagttatttagatttttgaaaattttttttttgtgaaagttattttaatttggaggatgtttttttttttttttttgtatttaagaagttttttttgttagggaaataatttagaattagatttaggttatgttttgtttttttaaaaggtttagttgttaaaaaaaaaaaaaaaaaaattaaaaaattttggtttttatatgttttaatgtgaattattttttaatttattgtttaaataattattttttatttagaagaatattattttaatttgagttgaaggtttaaaatttttttagtaaggagatttgagatttttattattgtataagttgttgtgttttaaatgttaaaagatatgttgtgttttaaaatttttaattgtaaatttttggtaatagaattcgtatatttggtttttttaaaagagttaagtacggttgatttgattaagttatttgtaggaaatttttaaattgatttataaaatatgtaattatataaagaaaaataaaatattttaggaaatttttggggattattaatggattttgttttgataattattatggtatggtttttattttttttattataaagaaaaggtaagggataaaatttattttttatttgttatgaatttttaaattttataaaatttgggatatagagtataagtagatgaatatagttatttttaaattattaaaggtgattttaatgttttaatttttatagtattttatgatataaagtatttttacgtatttttaatttgggttttataattttatggaggtagtaggtaaggtaatgatgatgcggttttttagaagttttttaatattaaatgaaattattatttttatgttaatttgtgattgggaaatataattagtagtttgtgttttaataagaaggtataatattttatatagggtattttgttaatatttgaagattttatattttatggtattaatttagtattgggaattatgattatttaaaataaagttttatttaaataaattgaaatagtgttttttttaaattattattgaattagtttattgtttttaaataatagttttgatatagttaaaattagttgtttttttttttttatatgttatatgattgtagttaaatatttgttatgattagtgattttgagtgattagtaaataattaatatattgagattataatttgaatattgattttttgattttacgaagaaaaatattaaatgttattaataatttgaattttttttaaattaaaaaaagttataaattgtaatttgattttttaaaatgttatttaaaattgtttttattagaatatttaaaaaaaaatttttattttattttttgggggtgggaagaggtaattttttttttttattataatattgaattattatataaaattgtaaaattatgaatattatgattgagtttagtaaagtattttttaagtttatttatagtaaaataagagaaattttatttttaaaatttattttttaagtaaaataaattagttattttaatttaatatgtttttaaaaatattgaagtttagtatatttagtataaatttattgacgaaggtatatttttgtattatttgatttttagttttgttttatttaagtattaatgatagaggtagagaatagaaatggttttaggtggtattagagtttttattgggattatgttgaaattttagtgttaaaaaattgttcgtattttgaagggagggattattggagagaatgaatgatgtaggatgaatttgtaaatttagttttcggtagagtttaaaattaagtgatgattggtatttaatgaagttattaaaatttatgtagattttaatgttttattagtaatcgtatttgtatttggttttataaaagtaatgaaattgaagatttgtataaatatagaatgaatgaagtaaattttgttaatattatgttgaatgtttttttagaaaaagaggaaatacgaagagaagagatttgttttgattgtgatttatttttatttttatggatattttttttattttttatttttttttttttttttttttttttaaagattttggtaatgggtgttttagtgttttttaagtttaatatttttggtatttatttatgtaaagtgatttttgaatgttaaaggagatttttttttaaatatatttttatttatttttagttttatgatgagaattttattttttaaatttgtaatttgttatggttatatgattagtaaaaaaagtttttaaaatatattgtgtatttaggtgtgttattttagtgtgaaatgattaatgtagaaatatgtgattagtatgtggttagattttattgaaattatttacgatgtttttatggttagtttttttgtatttttataattggtaatataatttatatgttattttggttttgtttatttgtgttatatgtattttagtttgattatttttgttatttatttaatgtttatatattttatgaaagatttattttgaaatatattttgtataaatgtaggttaaatgtaaattgtattaatagtgaaatggatatgtgggtagagattattttaggggttttttgagatttagtgaaggaaagattggattaaaagggtttattttaatgtgattgtttaatgtgaaagtcggaatatttgtattaattggttagttatataaattttagtttattttggtttgtaggtgattgaaatagtttaggaaattttaatttatattaagtttagataaggtttgaggtttaggtttagtttttaaagtatatttttttttattttaatgattatttttaattttaatgagtagtgggtttttattgtgtattagtatttaggtgggtaaattaaataagtaaaataggtttgtgttgaatagtatttatttttttgaggatattttggtaatatttttattaagagtaattgtgtaatgtaatatttataggtatttgttagattaatgggtatttgtttttatatttttgagttatggaaaatatatattgatgatttttgttgtataaagagtttttaagaaaattttgttgaattaagttataattataaaaaaaaatttattatatattgatttttagaaaggatttttaaaagtttatgttgtttttatttttgtagttttagagagtcgattgtttttatttttttttggtatattttattaatatttgggttttgtattttttaagtaaataaaatatttttattgagaattttaattttaaaaaagaaaaggtttattaagtgtttttttttttgttgaattatgtgtgattatttttatgttaaattagattagggtgtgatttgtgatggtgatttttgtttattttatatattaagaaagaaatagaattttattgtagtttaaaattatttgtagatagtggttttaatttttagatatttaattgtgataggttgttttttttagtgtttaatattgttgtaaatgtttttaaatatagaatttttagtggagtttatgaattaattgggggtggagggtgaagagggaggagtaatagagatgtgggatgttatagataagtttaggaatatttagattagttttgaaaattaatagtttggattaattgttatgaattagaggtttaagaaaagaaaaatttaggattataggtataagggaatgtattaattagaattataatttaattttttttattttaggtagaaatttaaaattgattatggttatataatattaatttttgagttatgttgttttttattatgttttattattaaaaaaggataaaatgtatattttatttgaagattattttagttaagattaagtttatattttttttatttttatttaagttgttgtttaataaatgaaaatttaatgatttgaatgtagtcgatttaatgttttaatgttgatataattattttatatattatagtgtttttttatagttattgttaattgattggagagtaatttttttttttggtaatatatttttatgggttatgtatttttttgttggaatattgagaaaattaattttttataatatgtagaataaattatggggttttgtaagtgttagatagttatttaaattatttatattgtaatatattttttaaatttagtattttgaatgaaagtgtgttattttcgaattttattatttgtttaatttaaatattaattatattttaatagagttgtatgtttaaatatgtttttttagagtaatttaagtattaatttcgagtgtttttaaatattttttttttttagtaagttttaataatattaattttgtttataatgtagtaagtttagtgaaagtatttgttgttttataattttttttttatttttattgtagggtattaaaaatatatataaggggaaaaaagttttaatgatatgattagttgtaaatgtttacgtattattttattttgaatttttatttttgtaattaataatttgagagtttaataagtatgtagtgtttaagatatagtttgttgtaaaaagtgttaatttattatttttttttataataaaattagtttttattttagttgattttataattgtttataatatttagttgtggttattatgaaagtatatttgatagttaaattttgaaagttattatgaaatgatataatttattatatgatttattattttatgttggttggggtagtgttgtgatttatgattttatgattgttatatgttgaatattaaagttttattagtttgttatggatattgttttattttatgttatcgttttaatgtttttttttataattattgaggataagagtttttttaattttaagattatttaaattgtagattttgtttttttatttttttaattattttttttaaagaatttgatttagatatttagtagtagaaatagaagaaaaatatttaattaaaagtttaaagatttagtttttaatgttaagggagatagtttatggtttttaattaggtattttggagttaaaaatattttttttataattgtgtttgaattgtttttaaaatatttgtgtgtgtgtttttaaaattttataatttttttaattcgttaatttgatgagggaagtaattagggtagggaatggtataataaagttggttttttgatattttttttatagattatcgaatgtaagataaatagatgtgaatgtagatttggtgtttttataagataaggatttaaaataatgtagttggtgatatataaaaataaattattgttgttgttagtattcgagaggtggggtttttgggtttttagagtttgttttttatgttcgttatagttattttagattagaatttaaaagaatttgagagtttttttaattttattttttaattttttcgaatgagaaattgagatttatagaaagtgttgaggtaaagattataaaatatttaatgagcggtgttgttagtttgaatattttaatttttagttatttaagttttttggtaggtttttttaattatttgggttttttttagatatttggaataaatagttgattgatataatatagattagttatatattttataagagttatttttgatttatttagatttttaaaatatatagtgtttgtatttttttttatttattttgttaatttttttttatttaataatgattaagtattaattatgtgatagtattatgttaagtattttgtatgtatttattttatttaaattttaattttgtgaaagtttttattttagttattgtattaagttttaattttgttaatatttatgaagtatagaaggtagttgttatttattttaattttatagatgtgaaaattaaaggtatttaaagagaaaaagaaaaaaaaaattaggaaattttaatatttatttgaagggaaatatttaatattgggtatgttagttttttatgtatttttaataatttttgttaatagcgaatttttaaataaaatataaaggattaggtttttgtttttttgtatatatttgtaaagttatttattgttttttgttatagttttaatttttgtaaaatagtgagagggtttttatttgataggatttgtgtatgtacgtttattttgaaaattaaaaagtattaggttaggcgcggtggtttacgtttgtaattttagtattttgggaggtcgaggcgggtagattatgaggttaggagattgagattattttggttaatacggtgaaattttgtttttattaaaaatatagaaaattagtcgggtatggtggttggtgtttgtagttttagttattcgggagtttgaggtaggagaatggtgtgaatttgggaggcggagtttgtagtgagtcgaggttgtattattgtattttagtttgggcgatagagcgagttttcgttttaaaaaaaagaaaaaaaaaagaaaagaaaattaaaaagtattataaaaatgtaaggtggaatttttaaagttttgttaagtttatttagtttaaattagtatgatttttattggttaagtacgttatgatatttgtgattgtggtgtaggtattgtttataattaagaattttttagggtttgttatgtgtaatttttgaagggttatggatcgtagttttataaagattgttgtattttaaagtttttaaatgttaacgtagtatttttataatgatttttttttttagttttattattttttgaaagcgttttcgataaagtttttagtggattttgttgagggatattaagtatgttatttatataatagttatagtgataattttaattatattgttatatttttattaataaatgttagagtattttttttttggtattttttattttgatatttttatataattaagtatgtaaagattttttgttattggaaattttaatttgtttgaaaatgggaatgaaatttttaggtttaaaatttttttatatttattatatttattgaagttgtttgaaaaagtttttgagtatattgaatattaaaatttattttaattgtataaagttgggaggattgtgaaatttgattgtattgatttgttttttttattgattaaatggttgaaaaaaattttagttaaataaatttgatttattaaattaaagttataaaagtagaggaaagtatagaattattaaacggtagtttaaattggtaaatatatcgatgtagaatttaagtttgtaggtagtttttttagatggaaatttaaaaaaattttaattagaatattatgtgaaatttgttatttggaatttagttgggtttattaaggataaagtgtatggttataaaatagattgagttttttttttaaaatagaaaatttaaaataaatgttttaagtttttattttaggaggttatgtatattgtttttttttgaaattgtttttagaattattttgtaagttataaaagaaaatcggatttattgtattatagtaatatttaattgtttttgtttaaagaaaatgtatttattttttagttttatttgtgtgattttaaattatatgagtattgttagatatttagaaatttaattttttttcgaatgataatatttattttttttgagggtttttaaaagagtttatatagatatttttatagaaaatgtttaattttgttttgaatatgtttggaataagtgaatagttttttagggtgattattttgaaatgggtgatgtttagtggttaagttttgatttgtgtttttttgaagttattaaggaattttatgataatagtttatatattttttttttttggtatagtaatgaagtaatagagattatttatttttaagtttgattttttaaataagtgtttattttatgtttaagtaaggtaggtttgtttttggtttggatttgaatttggtaatagtagatataaagtaaatataatgtgaatttttataatagttttttaaatagtttaattttttatttatatatattttttttagtgtattagggaattaagtatttgattattagtatagtaagaataatttaagtatattgaagttatttatatttataaaatagtttgagttatagttataatataaaattaatatatttttgatttttattttttataatttgaaaaaaatttttgcgattattgatagtatttttaaaaattaaatgaattttgttattattatttgttaaatttagttatgtttattgtttaaaaaatgttaggttaaaatggattttaatttttgaaatgatgaagatatgtgtagtggtgttaaaaataggatatttattttgtaattattttgttagtgtcgaagtttttagaatttttttgtgataatagtttgtttaagaattttagattttttagaattgtattaaaagtaaattgtttttttggatatttgttttttttttttaaaagatgatttataagtttttagagttaagaaatgggaaggaagagttattttagtatggtaggtaatgttttattgttaataggttttttttgtattgttttatttgttttgaattttttattttgttttgttagttgggaggttggtagattttttattaggtagtaaatgttttttattattaaatatatattatgggttggtgttagtgtagtttgtggatgggtattatatttttaattaagaaatgtttttaaaggaaagataaattggtgaagtaatttttaatttagtattttagggatgagtgattttttaattgataatgatatttaatagagttgtatagtgttttgggggttttatagatatgtttaaataagaaaatagtaaataaggaagttagaaggaaaagttataaaattattaagaaagaaaatgaaaattttaaattttaattttggtgtttggttaaatttgatttttgtatgttttagtgtttttttatggatattgggaaattaataagtaatttagttacgttattatgttcgtaagtggaagaattaaagaattataaagatatgttttaggttaagaattttggtggtaggtagagtgggaggttaattagatgatttttaaggtttttttaattgtatttggtagtagtaagtatttattaagttagatattgggtatatggagatgaagaagatgaatatttttagtagtatggagagtattttgatgatagttatttttgttttttttttttttagtttgttttttgaaatgtgagtttgaaagattttaaatttttttttgggaagatataattgaaattttatggaggaaagtgtatgaatgaatgggaaataagatttgatttaattatttggaataagaaaaggggtaataaggagtttgaaataaatgaaagaaaagatggaaagaattagttgattagatgaggattgagtatataggaatgagttaataggagattttagtaattaatggatgaaagtattatgtgtatgtatgttgttattaaatattatatgatataagataaggagaaaatatgatttttattataattttagtttgtgtattttagttgtaagatattttttttttttagttatttaagaatatttttattgtttaggagaaataattttttttttgggttttttagtgtataagtttaaatttgaggaaaatttatttgaaatgttttttttttagatatttatatggtttatttttttatttaaatgttagttttgtaaaagagatttttgattgttttatttgaaatagtagaattttttatagtttttttttttttttgatattatttatttgtgttttatttgtttatttgttataatgtaagttttatgagagtagtgatattgtttgttttgtttatttttgtatgttagcgtttagaatagtgtttagtatatagtaagatttttataaatatatgttgaatatttaaataaataaaatttaatatataaattaaaaagatatataggaatggattatatttttaatttttttcgagtgaggaaaatgttagtagatagtgaatattattgagagagagatgatagtttaggttattttttttagatagaaataagttttaagattgataggtgtatatgaatatagagagtatatataaagaagatgtatttttaattgatagtttttaaatttgttttaagatttcgaaatggattgttttttataattttttagaataattttggtttgtttattattgaaaaattagagtagttaatgtttgtaaatgaagggttagagggtttttttttttggtggtttgttaaaagtttgtttaaggtagtaatatagtaaattgttaatataggaatttttgtagtagaagttttatgttttttatttttataagaattgagattatttaagtagatgagtttaatgtatatgtttgtattgatttatttagaaggttaggtaagaaatcggtttttttattttttagataagtgtgtgtgtaattattgagtattttaagagaggaggggtgttttatttttgtttgaatttttaaaatatttttttttagtttatttatattttagatttgatttattttgtttatagtatataatagttaggaggttggtaggataagtttattttttttattaagagttataggagagtttaatttaatatggtaatgatagtcgtagaaaagagaaaatgtaagttaagtaggtgttagttatagtaagaaaattagatgaggttatttaagaatgaattgttttaatgtttaggaaaaaagaggggagggataaggatagggttttagaaggtaattaaagagagtagttataaaataaatgaatagttgaagaattaggagataataattttaaaatgtggtagggagagggtagttgttatattaattagtatagaagagatagaatagaataatataaatatatgagtgattattgtttttgaaattagtttttaaaatatgggaatatttttaaaaattaaagttagataaattagggaaattttaaatggtataatataattagtgatttcgtttataatttttttaaaaaggagatttaaatttgaaatttagatgtaattaaagtagataataagaaatatatttttgagattataaagattttgagatttagttaagagtaaggtagaaaggttggaagttagaagggaattaagtttttgttttttgagaagttaatataataggaaaaaattggttatattttagtttaaatttttattatttttattaatagttttttaattgtttttttagtttttttttttttttttttaatttattttgtagtttattgttagattaatttttttagaatattatttttagtattatttttttgattaaaaaatgtttgtggttttgttgtttatagtatagtggttttttttttttgtattatagtttatatgtacgatgatagatggtgggtagttatatgaattttttataatttttggaggatttgggttatatatagtttgttatttaagaaagtatatttgagtgtaagtgagtattatagggatagttttataattgattttttttaaaatttgtttttttttttgtaaatgtttttttagaatttatagaaatagtgtgtttattttattagtaaaattatattttaaaatgttaataagtttatttttattacgtttttttttttattttttttttttttttttttttttgtatatttttttttattttttatatttttttgtaattatataagtataaatagatatatatgagattttttgggttgtttgtttttaaataaaagaatgggattattttatatttttttgtttgtagtttgttttttttatttaataagtatattttgaatatttttttaggttaatagatgcggattttatttttttaaatagataatattttatttatgtggtttcgtgatttttgttattataagtaagtttttaataaatatttttttttatgtattttttataaatagtaattttttttttaaatataaatgttatggtttggttttgtatttttatttaaattttattttgaattataatttttatatattaggggaggggtttggtgaaaggtgattgaattttggaggtagattttttttttgttgtttttatgatagtgagtttttatgagatttggttgtttgaaaatgtatggtatttttttttttatttattgttttttttgttttgttatgtgaaaatatggtttttttgttttttattgtgagtgtaagttttttgaggttttttagtaatgttttttgttaagtttgtggaattatgagttagttgaattttttttttttgtaagttatttagttttagttagttttttatagtattgtgaaaatggattagtatagaaatttggtattaggatagtggggtattgttataaagatatatgaaaatgcggaagtaattttgtaattggataatgggtagaggttgtaatagtttggaggatttagaagaagataggaagatgagggaatgtttggaattttttagagatatgttgaatggttttgattaaaatgttgatagttatatggataataaagtttaggttgaggtggttttaggtggagatgaggtatttattgggaattggagtaaagtttatttttgttttgttttagtaaatagattgatagtattttgtttttgttttagagatttgtggatttttgaatttgagagagatgatttagagttcgtggtagaagaaatttttaagtagtaaagtatttaatatgtggtttggttgtttttaataatatatagttatatgtgtttataaagagatggtttgaagttggaatttaggtttaaaagagaagtagagtataaaagtttggaaaatttgtagtttgattttgtggtagaaaagaaaaatttattttttggggagtaatttaagtgagttgtagaaatatgtatagatgaagagtagtttaatgttaatagttagtagaatagggaaaatgtttttagggtatgttagagatttttatggtagttttttttattataggtttggaggtttaggaggaaaaaatggtttcgtgggttaggtttagggttgcgttgttttttgtagttttaggatatggtgttttgtattttagttgttttagttttagttgtggttaaaaggggttaggagataattttgggttgttgttttagagggggtaagttttaaattttggtagtttttatgtggtgttgggtttatgggtgtgtagaaggtaagagttgaggtttgaaagtttttgttttgattttaggatgtatggaaatgtttggatgtttatgtattttgtaggggtagagtttttatggagattttttgttagggtagtgtagaggagatatatggggttagagtttttatatagagattttattggggtattgtttagtggagtcgtgagaagagggatattattttttagattttagagtggtagatttattgatagtttttattatgtgtttggaaaagttgtaggtatttaatgttagtttgtgaaagtagttgtagggtttgtatttagtagagttattagggtagagttgtttaaggttttgggagtttattttttgtgttagcgtggtttggatatgagacgtggagttaaaggagattattttggatttttaagatttaatgattgttttgtaggtttttggatatgtatggggtttgtagtttttttgttttaattaatttttttagtttggaatgggggaatttatttaatgtttgtattttaatttttttttggaagtaattagtttttgattttatagttttataagtagagtggatttgttttgatttaagaagattttgtatttggatttttgagttaatgttggaaggagttaagattttcggggattattgagaatgtaagattgtgttttgaaatgtaagaatatgagatttaggaggggtcgggggtagaataatatggtttggttgtgtgtttttatttaaattttaattatttgtaatttttatatgttaggggaggggtttagtgggaggtgattgaattataagggtggattttttttttgttgtttttatgatcgtgagtttttatgagatttggttgtttgaaagtgtgtggtattttttttttttttttttgtttttttttttgttatgtgaatatgtgtttgttttttttttaatttttattaggattttaagttttttgaggttttttagttatgttttttttgaagtttgtggaattgtaagttaattaagtttttgttttttataaattatttagatataggtagttttttattgtagtgtgaaaacggaataatataatagatttttttaaagttgggtttttgagttaggggtatgtgtatttaaaattttaatagatatttttaaattatttttttcgaggattatggtaagttatagttttttttggtagtgtttatatttttttttataataaaaatatataaattattattattaataaattttttgttatgagttttaaattgataataatatattagtgtgttatataatatagttgaggattgttgtagtttagaatttaggttttttttttttgtttttaataatatgtgtaatgtttaagattaatttagtgttatttattttgtatgtttttttttatgtagtttaggttatagttttttattttatttgatggtattttttggtagttatagattatatagttttttttatttaaattagttattagtatatagtaggtatttagtaaatgtttgttgaattaatattgtttatatatttttaatttatttttaagtaaatttagtttttttaaggataaggaacgtttttattataatatttagtatttaaggtatttaatttaggtagggttgtttgaataaagaattatagaggaagtaaatagtatggttttgtttttaatatatatattttatttttttttagggaaaattggaattgtaagaatttagtaataataataagaatagtatttttattgagtagttattatatgtgaggtatagtttaaattgtagaggatataatagtggataaagttttagttgtttttgtttttttgaagtttatggtttatgggtgttatatttaagatatttgtaggatatattttaaaatgttatttaattttaggttttttttagtagaaattgtggaatattttttcgtttatttagtatttatttagtgtttgttttgttaggaattgaagagaaagtttaaagataggtagattttatttgagaggtagtgaattgattaggatgattgtgggtagtagatttgttttttaaattagttttattatttttgtatttgtatatacgaggaaaggattagatatagggatttatgttagtatatattttagggatatttgtttttagtgaaaggtgttagtttttatttttgtatttagtatataaattacgaagaagtatgttttcgttattgttaaagaattatagaattttaaatggagttagttttgatatttagattttattttatatgaggaaattaggtttagtattgtgagtaagaattaggattttttagattttttgggtatgaatttgattaataattgtgtgaatttgattaaatttataattttgtaaattttgtttttttatttttaaaatgggtataataaagtgatgtatgtaaattgtatagtatagtgtttggtatttaaaaagtatttttgaagttatttttagtgatgtgttttaagattagataattttttaatgttaaaggtttttatttgagaattttgtttgttgtgttatattatacgttgtttataagataagttttttttattaattgattttaaattggttttattatgattttaattttattttagttttatttttaaaatttatttttaatttttatgggtatatagtaggtatatatatttatggggtataggttatgttttaatgtaagtatgtaattgtgggggtgatatataattgattggggtgagatattttattgtagttttgatttgtatttttttgatgattaaggatgttgaatatttttttatatatttgttggttatttgtatgttttttgagaaatgtttatttagattttttgtttattttttaagttggattgtttgatttttttttgttgtttgaattttttatatattttagttattaatttttttttagatgggtagtttgtaaatatttttttttattttgtgggttgtttttttgttgttttcgttgttgtgtagaagttttttagtttgatgtgattttatttgtttatttttgtattggttgtttgtgtatttgaggtattattaaagaaatttttgtttatattagtgttttggagagttttttaaatgtttttttttagtattttagttttaggttttagatttagggttttagtttatttttatttgatttttatatgtggtgagagataggggtttagttttattttgtttatggatatttagtttttttagtattatttattgaagagattgttttttttttagtgtatgtttttggtatttttgttgaaaatgagtttattgtaggtgtatgaatttgtttttgggttttttaggtttgtgtatttgtttttatgttagaattatgttgtttgggttattatagttttgtagtataatttgaagttagataatgtaatttttttagttttattttttttgtttaggatggttttggttatttcggggtttttgtggttttatataaattttatgattttttttttttatttttgtgaagaatgttattgatatttattaataaagattgtattgaatttgtagattgttttgggtagtatggatattttaataatattgatttttttaatttatgagtatggattatttttttttttttgtgtgttttttttaatatttttttttagtgttttattgtttttattgtagagtttttttatttttttcgttgagtttatttttaggtgttttattttatttgtagttattgtaaatgagattattttttgattttttttttagattgttttttgttggtatttagaaatgttatagatttttgtatgttgattttgtattttgtaattgtattgaatttatttgttttaatatttttttggtggagtttttaggtttttttaataagattatatagtttgtaaataagaataatttgattttttttattttattttggattttttttatattttttttttgtttgattattttaggtaggttttttagtatttttagttgaataatagtgggtatttttgttttgttgtagattttagaagaaaggtttttagtttttttttatttagtatgatattagttgttagtttgttgtagatggtataatttttaaattaattgattatagttaggaagtggatattttaatttgtggtattattattagatttatatttcggttataagtttgaagaggagttgaaaaatgtatatgtgatgtatatgttttttatttggttttttttttttatttttttgttttataatttatataagttttttttttagttatttattaattatttgaatttttgaggaatttggggttaaggtaaattagaataaaattgtttgaagaagagtaagttttttatgttttgagaaatttttggggttttagaaataattttattgttttttttttttagttattttggtttttttttaaagagaatattaatattttgaacgttataatattaaggttttgtttttttaaataaagattttaaaaaaaaatggtttttgtatgatttagtgtgaattaaattttatagtgtaaaggattttatttttttaatgtagatttttaaatatataattattgatgtttataagtagatttattatattaaagtatttagtaaatttttgaatggattaggttttattttttagttttattttgtaaatttaagttaaataattaaggatttgttaaatatttgttttaatattaagtttttgtatatcggggtttttttttataagttttataagtaattttttgttttttttgtttgtttaaagtagttatgtttgttgtatttgttagtatttgttttataataaatatattgggtgtttttttatttagatttggtaattattatttttgtaaatgagatattatataagataggaaaaagaatagtatttttttaagaagaatagtatttttttatattaatagtttagagttgattgtttttaaaatttagtggttttaaaataataattatttattattttttatgagtttataaatgaggtgggtagttttgttgatttggttaagttgaatttattttagttgggtatatttagcgtatttgttgttagttggttggttggttgtagtaatgaatggtgaaagtaggttgtttttaatttttttatatagtagtattagagttataaaagaattagtagaattatgtaaaattttttaagatttaggtttggaataattatatttttattatattttattggttaaagtaaattacggggttagtttagatttaagtgggtggaggagttgtaattatattgtaaaggagtgtgattgtagggagaggtgtttttttatttttatttttttgcgatttgttatagtagttgtaggaattaggtgtatttaaaattttgatttttttgtgatattcgaattgtttatgaattttgtttttggtggaaaggtagaattattgtgatagaaggataaaattttggaatttagagattaataaaggtttagattttagttttattatttatttttgtaattttgtagaagttaatttttttgataggtatttagtaatgattgatttatttgaattttagattttttatgtattttaaagaaagggttaggtaaatgtaaagtatttatgtaattgtttttattattgtaaatttggtttttatattttatttaaggtgtaagatttagtgttttttttgaattaaaaaggaagagaaagtgtgttagggaaaggaagagaaatatttgattaattgtggttttaataaagtgattatttattgggggtatttttttgtaagaaaagaatggttgaggtttagagttaagagatataaatttaaaagtttttttggggtaggattttttgtgatttatgggttgagaggtgtaatattagatatagttttagtttagattttttttttaaagaattgtagtttattttatatatattgggtgttttaatattatatgtggtaattattatttttataaattaggttttatataagataggaaaaagaatagtattattttatattaataattgaaagatgattgtttttaaaaaattaaaagggttatatagaaataaaattatataaattttttgtgttaaatatagttgttatattggatgaggattaaatatttaaatttatttaattagtagtaatagaaaagatgaaatatatatatagtaaaattagattaatttaatttatataaagggttagatattttagaatttagatagttagagatgttgattagagttaatgttttttttaggagaggtattaggtaagtgtttttaaagaattggaaattgagattattatttttggtattatttatttgtgaatataagtaagtttgaattttttcgtattatagttattttttatgtaagtttttttttttagaagaaaagaaggtaatatttgggtgtaattttttattaagggtgaaatttagtgtagagagtaaaggtatttggtatagaagtttttagttttttttgtttttaagttgaattgttagtttttatggattgtagttttcgttgttttgattgatattttttaatttattttgtattatttatttttttaagagatagggttttattttgttatttaggttggagtgtaatggggtaaatttggattattgtagttttgaatttttgggtttaagtaatttttttattttagttttttaagtagtttggattataggtgtgtattattatttttggttaattttttaaattttttgtagagatagggtagtgttttgttgtttaggttggttttatatttttggttttagttgatgttttggttttagttttttaaaatgttgggattataagtgtgagttattgtatttggtttttaattttattttttataaagattatttttaattataaattaacggaaattttagtttttttagatatatttgggatttaaggatatttttttaaatgattaatgttaattttatattaatatatttttgtaaaatttataaaaatggattagtaaagaaagatttttaatttgggaaagatagttatttggagagaagagaaatttaagaggtaggtcgagtttagtgtttagaaatgagaggattataaagagatagttataaaaatgtttttttttatattgtttgttgatagggtgtattagtgaaggttttattaaggattttgtatttttttagcgttgtattgcgtgtttatagggaggaaagataaattatgtgttttttttgattttaaaggagtttgtatttggttagagagatatgatgtagatatatgaaataattaagaaataattaattgtagtaggtgttgaagaatatattaggaggttagagaatggtagagttagtgtgggcgaaggtatagtttagagtattattagatgatttttttttatgtaaatttatattttttttgggttaagtattattttggtatgtagtagttttataggtaatgttttaaggttagtttgaggtaagttgtaaaagttattatattgagttatggtttttttttgtgtggggggaggggaatggtattttttttttgtttgttaaattaaggaatatagtgtttttttaaatttgttttgttttagtggattgttaaaaagaagtgaatgaatttatgttttattagggaaaggttatagtggaatattgaggagtaaggggtatttttatttaataaatgatataatttgaaggaatgaaattataaggatggaattttaggtattaataaaaagttgatgagagatattttgagataaaagagtttttttagtgtaatcgagattatagtatttattttatatatataggaaattagttttatttgttttttttatagagtagtagttgttttgtttttttttttttttttattatttattttaaatttttagttttttatcgtattttatttaaattttgatatttttaagttatagatggtgaattagttaaaagtagtattaaaaattagtggtatatagttatatttggaatgtagtaagaaaaatacggatttttgtatattattttttttttttgtttttatttttatttaagagttatagggttagaatttaagagtttgagtttttgaaagtttttaaaaattttggatgattatttatatttagaattattgtattaagaaggataataaatatgttaataaattttgttgttaaggaggtgattatgtaagttggaattttgataatatgaggagaattttataatagttaaatagtttatgtattagttatattataataaagttaaaagtagtaggtttatttgatttttttttgaggtttattatgagtttagagagaaggaacgtggatatatagaggtagttttagatggagaagggtattaggtgttatggaaagaattatgtgtaagaagtaaagaggtgttttgaatgttttagttttgtttaggtgtttgtgtttttatatgagaatttatttatagttttttttcgttgtaataatttttggttttaattgtatttgtgagatagtaaaaagttatggtttagtttttttttattgtattattttattaatgtattttttttattatttttgtgtgaaatataaatttttttggtttattgtgattatgtaaggtgtatgttaattttttttttttttttatattttttagttttttgatgggtaaaaattttttttattttgttttagaaaaatttttattggtatagatttaattttagggagttttttttgaaagttaaataatattgagaatttatgaaaatataatgtagagtattatgtttgttagtatattagtttaaatagaagtggtttatgaaaatttttgaaatgttagattttgttttgtgttttgtatttttttaaatatttatttagatattgtttagaatgtaatatgattattttgaaataaagatttttttttagtttttaaaaaagttattttatatattaatttttatgtttttttttgattaatttttttagtagtgtaaatagtttttagggaagtagattttttatagaaattgttaagtggttttttgttgttagtatggttattaattttttggttattttttatattttttatattttttggaagtggataatttatttgtaaataaaagtgtataatttgtattaaaaatttttagtaataatttaatttgtaaaatagatgtgagtagtatgaatgtgtgtgatatgcgtatatacgaattatgttttttaaaaatgtattatagatattttttcgtgtttaaataaatttattttattttttttaatagttatatgggtatattataatatatttaattaggtttttattaaaagaattttgatttttttgtagttattatagtgttgtagtgtgtatttgtgtatgtatttttgtgtgtgtatttttgtacgagtgtatatatattttttttttggttattttagatttttttttaggtttaaattttaggaaaggttttgaaattgttttaagtatttttagaagtattaaattatggtttttttatattttttttttagaagttttatgttatttttatgagtagtttttagtaatttgttttgtataaaattttcgaaaatttttatttaaaaataggtggtatgattagatttttttagtcgaaagagtgaggttttaggaaggattttggagaagttgtgtttaaatatagttgttgatttgatgtttgtttagagtttggtaaggtgatgtgttgaatttagtgtttgtttgtatgttagtatttttttattgatgagatttgtggtttttattattttatggtaattattttaagttataagatggagtttttagaaaattagtagagtatgaaggtttaagtaaaatatatgtgagtgtatgtatgtgtgtatataaattattttttttaaaaacgtattttgggtatttaaagaatgaggattttcgaaggattttgtggaagttgtgtttaagtatagttgttgagcgtatgttagtttggagtttggtaaggtgaagtgttgaatttagtgtttttttgatttattgttttttttgatttattgtgttttgaagtttttgttatttgggtttataaaatagatttttgtatattgttttttttttttgttttcgtttttatttaaaagtatagtggtagaatttaagaattagagttattaaaaattttttagaaaatttggatgattatttatttgattatgttttttttatttattatgttttttttttttttgagatagagtttcgttttgtcgtttaggttggagtgtagtggtatgattttggtttattgtaagtttcgtttttttggtttacgttatttttttgttttagttttttatgtagttgggattatagggtttgttatcgcgttcggttaattttttgtatttttagtagagtcggggttttattgtgttagttaggatggtttcgattttttgatttcgtgatttattcgtttcggttttttaaagtgttgggattataggcgtgagttattatattcggttttttatttattatgtttttaagtttttgtttttatttgttttattgtaaaatattttttaagttaatttggagttgaggtaaatttttaataatttaaaatttggggaatataaatattggataatgattattttgaaaaaataatgaaggtagtagtataatattttatatattaataaaatggtaaaataagatagttgttgaaggatagaaagagtaattgaagttaggagtttattttaatatattttttgtgttatattataggtattatattttttaaattttttttattttatatatataggaaaatatatgtgtgtaagaaataataaatatttttttgtatttattatttaatttaaggaatagtttattgttattttttttggtgttcgttggatgtttttttttagttatatttttttttttttttatttgtaggattatattagtaaattttgtattttttgtattattttgttttgttttatgattttattatttatttatatatttttaaataatatattatttagttttatatgttttaattttatgttgtggaattatattaaatgtagttttttttttttatattatattttaagttttagggtatatgtgtataacgtgtaggtttgttacgtaggtatatatgcgttatgttggtttgttgtatttattaattcgttatttatattgggtattttttttaatgttattttttttttagttttttatttttcgataaatgtagtttttataatttgtttttttaatttaatattgtttgtaagatttatttatgtaagttgaagtttttttatagagatttttgttaagttttttaatgaatatagtatatatatttttttgtttttttgttagtggatatttggattgtttttagagttttgttgttttgaataacgttgttgtgaaaatgttttttgaaatatatttataagagtttttttttttttaagggaattatatttagaaattgaataattagattataaggtatatatatttataatttttgttaggtaatgttaaattgtttttaaggagcgttagaagtgtttttattaatttttattagtgttagttttttatatttgtggtagtatggtgggtgtgaaatatttatgtttagttttttttggtgttatttaataatttttataaaaaatatttagaagttaaggtagttttttgtttttgtttttattttttgtttgttttgttttaatgtagatattgagattacgatttggaataaatattggttgtaaagtttttaaaaggaaaattttttttggtattttggagtttttttggtattgaataaaataagtatgttaaattatgtatgtgtagtttagaagttagagtaataattgtgattgttgaatagaatggtagtaaaaagtttttaaacgattgtattgtataagggatatttgttgtgggttagttttagtttttttaatttttatgttaaaagttgtaataaggtttaagggtttatgtttgataggttagatggtgattagttgtgataaaatatagggaatttttgtaaaggattttaaaatttatgtagtagttcgttttatttgtagttttgttttttaaggttttagttattcgtagttaattgtgttttgaaaatattaagtgaaaaattatagaaataaagaatcgaagagttttaaattttatgttttttatttattttatttgggatgtgaattatttttttgtttagtatttttatgttgtaggtgttgtttgttttttagttatttggtagttatttaggttattagattgatttttttagtattataatatttggttttaagtaatttttattttattttatagtggttttaaagtgtaggagtggtgattttggtaatttagatatgttaaagagaagttgtaaattgttttttttaagtgaaagatgaaaattttagatttatatataaagaaaagaaattatatgttgagattgttaagatttatgataagaatgaattttttatatatgaaattgtgaagaatgaaaaagaaatgcgtgttggttttgttgttatattttagattgtaaaagtttgtagttaatgtgtatgataagtgtttagttaaaaggaaaaaggtatttaaggtaagtatatatagtgtttggtattatttgtgattttaggtatttattgggggttttttgagtataaggggagattatttttttagtgttaaatgaatattaaggaatagagatggggaagaggttggagaagattagtttagtagtttgagtataggtaaatagttgtttgagaaagaagaaaaatgtgattagtattttattttagtaatagtggtatagataatgataaattatagttatatagaatttttagtatttatagaacgtttatatttgtgattttatttaataataattttgaaagaaaggtattatttattattgttttattgataaagatataaaaggtaagagagatgaaatatattggttaatgatatttatttggtaagagatagggatggggtgggattttaaggtttttttcgttaagtttacggtttttttgttttatatttttttgttttttgattattatggttgtagtttttattgtggataatgtttgttagtaagtattgattttttgtttttagtatttttacgttttagtaaggattggaaagaaaaagttaggagtttatagtttgttggagtaatagaaaagaatgatatgaaatatgaagagattaaaatgatttataataaggtgttagattatgtagtaaaaatttgttttagttgtaagttaaaagtaagagtagtttttttagaatggaatagaaatgttggaattaaaggaatttttaaagttgtgaattttttttaagataaatatgttttattttggtaattatggtattattaatttgataatttttagggagttatttaatattatagaagatgtatatataatgataaaagtaaatattttatttttaaggattataatttaatttaaaataaaattttttttttttttggtttttggttaattaaggatttatttaaatattaaagaaagatatatagaaaatatttagtatatttttatatttttattaatgttttttatattttatatagatatttgatttggttatggtttagataatttatgaaaatttaaaggatagattttaataattttatgttaaattgatagatttttaggattagattgttattatttttagatgcgaagtttttaattatttataggtttttgatattttgtttttatatagatttaatttttttttttttaaatttttttttttttagttgttatttgattgaaatattgagttattaaaaatttttaagtgggaatttttgtgtttttttatttattatgaagttgtttaaataagtaggtgtttgaataggagtagaaatagtaataggttgaagttagattaatatagttttagttaaatgtcgattttgttaaagtttgggaggatcggtgtggtattttataatgtataagtttgtagtcggtgtttttaatatgttggttttatgttttatgatttttttttgtaaatatgtagtttaaaaaatataagttattttgttgtagaagatatatttgtaaaattgatgtattttttttaagtaaagttggttaaataataaggatatatttataattaatgaatttgagaagaatgttgacgatatgtattattttttgaagttaatattttttaggttttaaataaataaaaagtaggttatttttgtttggagtgtatgtaaggggtattattttgtttttggtttttggttgttattttaaggtgttataaagttagttaaagagagtaattataatatattgatagtattttttaatgtgtttttgagttatttgagaattttatttttgaataggtagtaggaaattatttttgtagggtagtatgggtaaagggattggagggattattattataaagatttattgaattgttttagtattataatattttaaattaaaggattggaaagagttagattttaatttaatttgtttttttatgaatttttagttgggtttatttaaaaagaaaaaatttgaagattgtaagattttgaagatattttaaaataggtgaattttaaggtgtattttaaatttgagattgataattgaatatttttttattttttgatttgatattgttaaaatgaatgaggatttagtgttttagtaagtttggaatagaatgatattaatttatttttttatgattgatttttttttgttttttaatagattaaattttatcgtagaatagttttttaatttttggattattgatatttttgattggataattttttgttgttagggttgttttgtgtgttgtaggatagttagtaatatttttgataattataaatgttattttttgtttttatggatttgtttattttggatatttcgtataaatagaattatatatatgtggttttttgtatttggtttattttatttaatatgtttttaaggtttatttatattgtagtatgtaatagtattttattttttttttatggttgagtaatattttgttatgtggatatattattatattttgtttatttattttttagttgatggttttttaggttgtgtttattttttggttattataaataatgttgttaagaatatttatatataagtttttgtgtagatatatatttttattttttttgtgtggatatttaggagtagaattattggattatatgataattttatgtgttattttttgaggaattgttaaatatttttttatagtggttgtattattttatatttttattagtaatgtataagaattttaatttttttgtttttgtttatatttattaattgtttttttttattagttaattgttgtggttcgaatgtttgttttttttaaaatttatgttggaatataatttttaatgtggtagtattgagatgtgaggtttttaagaagtgtttgggttattagaggtttgtttttatgaataggttaatttatttatgagttaatgtattaatgggttattattggattgggattagtggttttataagaagaggaagagaattaatttagtaagtttagtttttttattatgtgattgttgttttgtgttattttgggattttgtagagagttttttagtagtaagaagttttttattagttgtggttttttgattttggattttttagtttttagaaatgtaagaaatttattttttttttttaataaattatatagttttacgtatttagttatattaatagaatatagattaagatattattttattgggtatgggtattttattgtgttttttatttgtgttttttaaatgattaacgatgttgaatatttttttatttgttttttggatatttgtgtattttttttgaagaaatgtttttaatattttttgtttattttaaaattaggttgtttttttattgttgagttgtcggtgtgtgtgtgtgtgtgtgtgtgtgtgtgtgtgtatttagaatatatgtgtatgtatatatgtagatatattttaaatattagatttttatgaaatatataatttgaggataattttttttatttaaaaggttatttttttattttttgatagtgttatttgatttataagtttttaatttttatgaagtttaatttattttttaattttttgtttttggtattgtatttttaaaaagttgtttgatttaaggttaaattgatttttatttatgtttttatttaagaattatagttttagtttttatatttaggtttttgatttattttgaattaatttgtgtatatggtgtgaagtagggttttaatttatttttttgtgtaatgatatttagttgttttagtattatttgttgaaaagattattttttttttattgaatggttttgatattttgttgaaattaattgattataaatatataggtttatttttggatttataattttatgagtttgtatgtttaattttatgttagtattatattgttttgattattatatttttgtataaagttttgaaattgggaaatgtgagttttttaattttgtttttttttaagattattttgtttatatttcgtgttcgttgtaaatttatatgaattttaaattaattttttatttttggaagaaaaaaagaggtaattgaagtttagatagggattgtattgaatttgtagattagtttggggaatattgttattataataattagtaggttttttaatttatgaatataagatttttttttatttttgtagatatttagttttttttattaatattttgtagtttttaatataaaagttttgtatttcgattaaatttatttttgaatattttgggttttgatgtttttatgaatttgtttttttaattttattttaagattgtttattgttattgattagtaatgtaattgatttttgtgtgttgatttttgtattttgtaatttagttgaaattattgattagtataatagagtatttaatagatttaggatttttatatataagattatgttatttgtaattagagataattttatttttttttttttaatttggatattttttattttttttttttgtttagttgttttagttagaatttttagtgtagtgttgaatagtagtggtgagaatgagtatttttgtgttggtttttattttgtggggaaattttttagtttaagtgtgttgttgtggggtttttatagttgttttttattagattgagaatgtttttttttgtttttagtttgttgagtgttttttttttgattgttttaattaggaaagggtattagattttgttaaatgttttttttgtagttattgagatttttgtgtgtttttttggttttttatggtttattatattaattgatttttatatgttaaataaattttgtgtttttgggttttattttatttggttatggtttataattttttttatatatttgtagatttagtttgttagtattttgttgaggatgtttgtatttatatttataagggatattggtttgttgtagttgattagtaagtatagtaagttgtatagtttattaagtgttttttttgttttgggggagattttgagaagaaggattgttggtaattgttttttaaatatttggtaaaatttattagtgaagttatttggggttttttttggaagttttttgattattaatttaatgtttttatttgtttgttataagtttatttagatttttttttttttgagttatttttgatagttggttgaggaatttgtttattttatgtagttatttaattggttagtgtataattatttatagtatttttttataattttatttttttgttgtaaggttagttataatgtttatttttttatttcggattttggtaatttaagagtttttttttttttttttttttggttagtttagttaaagtaaagttttgttcgtttttaggggaatagttttttttttttttttgaggtagaatttttattttgttatttagtttagagtgtagtggtgtaatttcggtttattgtagttttcgtttttcgggtttaagagatttttttgttttagtttgttaagtagttgggattataagcgtttattattacgtttggttaattttttatatttttagtagagacggggttttattatgttgggtaggttggtttcgaatttttgattttaggtgatttgtttgttttggttttttaaagtgttgggattataggtgtgagttatcgtgtttaatttagttttggttatttttgttgatttattttattgttttttttttttttattttatttatttttatattggtttttattatttttttttttatgtttgttttggatttagtttttttttttttagttttttaaggtggataattaagtttttgatttgaatttttatttttttgtaaggtggttatgtattgttatgaattttttttttagaaatgtatatgtttttattgtattttttaagatttggtatgttgtatttttgtttttatttgttttaaggtatagttttttgatttttattgtgattttttttttttttaattcgtttattatttaggaatttgttgatttttatatatttgtgaattttttagatttttttttttgttaatttttagtgttattttattttggttcgagaatatattttgtatgatttttattttttaaaatttatttggtttgttttatgatttaatatattgtttattttggaggatgttttatgtatatttgagaagaatgtgtattttgtttttgttgggtagagtgtttgataggtgtgttggtatatagttttgtttaaatttgtttttttgtagatttttatttagttgttttgtttattggaagtaggatattgaaatttttaattaatattgttgaattgtttattgttttttttagttttgttattttttgttttatatattttgaaattttattgttaggtataagtaagtttatgattattatatttttttgatagattgatttttttattattatatagtgttttataagaataatttttattttaagtttatttgtttatattagtatagttattttagtttttttttgtttattgtttgtatggaatattttttttttttattttttatttgtgtttttgagtttaaggtgaatttttgtagatagtaattggatttgttaatttttgttttttatttggggagtttaaattattgatatttaatgtaattattgatgaggaagattatttttgatattttgttatttgttttttttattttgtgttttttgtttttaaatttttttattattatttttttttttttgtattatatattttttagtgtaacgattttaatttttttgttattttttttgttgtatgtttttagttatttttttagtggttgttacggagattttattgttattttaatagtttaggttgggtatagtggtttatgtttgtaattttagtattttgggagattgaggtaggaggatagtttgagtttaggagtttaagattagtttgggtaatttattgagatattgtttttataaaaaaatataaaaattagttaggtatggtggtgtgtgtttgtagttttagatgtttgagaggttgagttgggaggatagtttgagtttaggaggttgaggttgtagtgaattttgattatattattgtattttagtttgggtattagggtaaaattagtttaaagaaatgaaggaaaaaaaaaatttaatttagattaatattaatttaattttaatagtgtataaaaattttgtttttgtatattttttttgtttttattttgtgttgttattgttatagatttttatttttttatattgtgtgtttattaatgtagatttaaaaatattgtttagtagttgtttttagaattcgatacggagaaaaggagatataaataaaagatgtatttttattgttttgtatgtttatttatgtaatttttttttttgatgttgtatttttaaaggtaaagtagggttattgtgagtgtttttttgttttaatttgaaagattttttttagtatgtgttggagatatgttaatgatggatttttatagtttttgttatttgggaatgtgttaatttattttttatttttgaaggatagtgttggtaggatatagaatttttggttgatatgtaatttttttagtattatgaatatgttatcgtattgttttttgatttttatggtttttgataaggaattaattgttaattttattgaggattatttgtttgtaatgatttgtttgtcgtgttgtttttaagatttattttttgtttttagtttttggtagtttgattgtgatgtatttaggtgtgtattttattagtttgttttatttggagtttgttgagttttgtagatgtattttattagatgtgttaagtttttttgttattattttttttttaaataatttttttgttttttttcgttttttttgttattttgattatttgtgtgttgttttgtttggtggtgttttagaagtttttgagattttgtttagtttttttttttttattttttttttttttatttttttagattggatgattttaatttgatttattttcgagtttatggatttttttttttttaagtgatatttgtgagatgaatttttttttagagaattttttattttagttattttattttaaaatttttttttggtttagttttattattgttatttttatattatttttagtttaatgagatattgttttatatttttttttagttttttagatatagtttatgttattgaatatatttaaaatagttgattttaagtttttttttttttatttttttggagatggagtttcgttttgttatttaggttggagtgtagtggtacgattttagtttattgtaagttttattttttgggtttacgtaatgattttaagtttttgtttatgaagtttagtatttgggtttttttaggtatagtttttgttttttttttttttttttttgtgtatttcgtttttttgtatattttgtaattgttgttgttaattggatattttgaatattatagtgtaataattttggtagttagattgttttttttttttagtatttgttgttggtgagtattgtagatgtttgtttagtgattttttatggttaattttgtaaattttatattttttgaagattgtgggtattttgaagtttttgtttgttagtttagtggttatttaataattaatagagattttattaaatgtttagaagtaaaatattttttagtttttgtttatggtttttgtgtatgtattagggtaggttttgaatttttatttagggagtttataattttgttttagtttttattattagtttttgtagagtattaaggttaataggtggtgagagtttggagtttattttattttttttgagtatatatatagttttatttatgtatgtggttttttagatttttaggagtatgttggatttttttaaagtttttatagattttttagtttttttttttaatttttagattagtgtgttgttttttttaatagttatttgttaggtagtagtaaattaagagattagtataaatgtttttaatttttttattcgttatgtgttttagggaagtattaagttagttttaagttaggtaaaataaagataatttttttgaggtggttttttatggagttattagataggtaaattaaataattaattataagtttttggttggatatagtggtttatatttgtaatttcggtattttgggaggttgaggtaggtggattataaggttaggagattgagattattttggttaatacggtgaaattttgtttttattaaaaaatacgaaaaaataggtggttgtggtggcgggcgtttgtagttttagttattcgggaggttgaggtaggagaatggaatgaatttaggaggtggagtttgtcgtgagtcgagattatattattgtattttagtttgggtgatagagtaagatttcgttttaataaaaaaaaaaaaaaataagtttttatgaaagaggtttattttgttgttttttatattaggaatgtggaatgtggattgttatttttatggttattgttaagttaggaattaagggatagatggggattgggtaaaatattatagagtttgttgtttttattaagaataagttggggaagagggttgtttttgttttttagtaaaaattttttgggttgttttaagtcgttgattaatttttaggtttcgaaaaagtttagtttgatagtttttgttttttttatttgtttttatggatatgtagaatttgagtttttttttttattagttttgttgatattgttttaaaagtattttttgtaaaatttaaatgttgttttttttaaggttagttaataattaaaaatattgttatttttttttgattttggaaatgaattcgtattgattaaaatttaatattagaggttttttaagttgttttattatttatttaaattttagaatttaatgatttttgtatattgtttagtatattggtggtttttaattgttataagtttaattttggaataaatgaattttttgtgtgtaagtttttaattgtttggaaattatattgatgttttttttattaaattgttattcgtgggatatttaggaattttttatagtagttgataaatattttaagttagtgtttggtagtattgtttattaggtaatagttttagtagtagagcgatttttatttataaggtagtgtttgagtaattgtttattagtgtttttttaattatttagaagaattattaggggttatagaggtagtttagagagttgggtgtaagtagagaaatttattcggtttgtattatatattttatttttagagaagtttttttttgaagaaggagttttaaggtttaaaaaattattttgaatgttatttatattgtattttaattttattttagagaaattaatggaaagtagaaaaattaaggtattgatattagtgttaagaatgttggttaaagtttttggtaattaattttttatttttttttttaattttattaaaatttaataatttttagtttatgttgtaatttagattaaggttttaatttaatgaagttaatgttagtgttgttgttatttattttgtttttagttatttagttatgttttttatttatattgaataagttagtttaatttaataattaaaaaagaaagttgttgtttaagttaagaaaaatagtttgaattgtttttaaattaaatatttagtagattttttagttgttgataggagaatgtttaatttagaattgttttgtagtagattattttattttatttttgtttttttataggatagtttatttgtttgaaattgtatttaatatgttgtgatttttgtgtgtttgtttttattttttattggatagatttaagataaaatttggtattttgtagtgtagttattagtttatagtagaggaaatttatattagaatttggttgtgtatttatatgtatttaatttggaggttattttgtttattgttgatatattagttatattagatgagtttttaatgagatattagaaatttcggaaatattattaggtggaatagtgtttttaatgttttattaagtgttataggtaagataaagtttagtattatttgtggtattaaggttaggtgtttaaagatttgtatttttttattgttatgttgaaattgtttttttgatgtagtaatagaaaattttagattaggtttaagttaattagtaaataaagataaaagtttgatattattttaaatattttgtgtttttaaataatttaatagtgatttaattagttatttttgtagaaatgtaattgataaattttttatttttttttaaattgttattttgaattttatttgttttttaaagttgttttaagttttttttaaaaaaaggtagttatttataaatttagaaaagtttgatagtatagaaagttatagaaaaatgtaaatatagtttaaaattgaattgtatataagttattagaagtatttttattaagtttataaatattagtagagtggaatttatgtatttaatatgtttgaaatttttgattaaatattgtgttatgaaaaatattttagataattattttttaattatgtgtgtgtaaaatgtggttttttttgataattaagtagtttttttgtgtgttaaattgtgattttaaaattttaaagtatttaatagagtaaataaattataaatattatttaaattgtatatatttgtatatgtattttttataaatagtatatgggttttaagtttttatttttgaaatttagaaatgggttttttttttttttagtagaaataaaaatttgatttattttatttatttatttattttatttttgagacggagtttcgttttgtggtttaggttatggtgtaggagggtgattttagtttattgtaatttttgttttttgggtttaagtgatttttttgttttagtttgtcgagtagttgggattataggtgtttgttattatgtttagttaatttttgtatttttagtagagatggggtttttttatgttgggtaggttggtttcgaatttttggttttaggtgatttgtttgttttagttttttaaagtgttggggattataggtgtgagttatcgtatttagttaaaaatttgatttttaaaaatttaaatcgaagatagaattgtgtattttagtatatttattagtagttttgacgttatattatatggttgtttattatttaaatagtttgtaaaagtaaatattttaggatttatgagtggtagaaggattgagtattttgggaaataagagagaatttttgttgaggatggttgaggaagagtttaagataataataggtagaataagtaaaaatttagagatttattgtaggtatttaagtatgtatttgttagaatgaatggttgaatttggtatattgaggaatattgagaaagttatattgattggaagatagtttttataagaaattggtgagatatatgttatagtttagattttggtgagttttgttaaagtttgggttttatttttatacggggagaaagttttataggggtttggaaatgaggtttggagttgttaatggggatatagtgaggttttagggtagtggtttttaaattgtttaaatttaaattttgatgataattttgatataattattgtttataatttttattttagttgtattggttttattaaaatatttttattgattttattgattgttttttatgtagattaatattataaatttgaatgtataaaggaagttttagtagtaaaatagtaatttttatttgttttacgtattggaggttttgtataagatttaattttttttttttttgaaatggagttttgtttttgtttacggggttggagtgtaatggtgtgatttcggtttattataatttttgtttttcgggtttaagtgatttttttggtttagttttttaagtagttgggattataggtatgtgttattatgttcggttaattttgaattttagtagagacggggtttttttatgttggttaggttggtttcgaatttttgattttaggtgattcgtttgttttagttttttaaagtgttgggattataggcgtgagttatcgcgttcggttaagatttaattttttaaaagaaaatattttgttaagggtttggaaatttttgttttagtaagaatggattaagattgattaaaattaaaggtaaagaggaggtttttatgtttggaattttttgttaatatttatataatataattttttttataaatatttaatggtattagatattagatggttataatggtaaaagtgtttaaaggatgttattatatttatgatttatgattaaaatgaatattataaggttatttttttttagaattaaatacgttatttttgtggaaaatttgtttttaatgtagaagttgttttagagttttttttttttttttatgtttttttatgtttattgttgagttaatatgggttttattgaatgattaagaaaaaatattttaggtggggagttttgtatatagtaaatgtttaatttattggggtggtgaacgggaagtgttgttggtaagagaggatgggaagagaaatttatttaaatttttattcgttttatagaatataaattttttatttagtagtatataataatttaacgattaaggtattttaatttttttgtttttagatgaaagaattatcgtttggtttgattaagtatttagtatttattcgtttatttaagtgtttacgtttttttgttattttagggttttacgttagttattaattaaaagaattagttttagttttggaagtttaaaatatataagagaaggtgaggagtaataagagaagatgaagggagattttcggaatggtttatgaatttttagtaattatattattttaaaatagataaattataatgtagttatgaagatatgtattttttagtgaagataattaaaatgtttgtatagaatttttttttttattgagtgttagaaattttattttggagatattattttgtataatataaaaagaaaaagtgagtgtggaatttaggaatttacgtggttttaggaaattttttaagtgtggaaattgaaggagagtaagagaaagggagtatggtatttttttgtttgtagtttatgaggtgggtttaaattgttttttgttaatgtagttgtatattgaggattatagaattttttttaaatgtttgtagaattattttttatttattaggtaaaacgtgtattttttgattttttttaattttagtttttttatgttgttatgtttaattttgtatattatatatagttttgttaaattgataaagtggtgttttttgttttttttttttttattggttaaaatttaaagagaaagtggaagttagaaatttatttaaaaaatgtaattttttttgtaattattaaagtattaatttaaatttgaattttttttgtgtataatttttttttaagttatttattatgttgataaatttgtttttttgtggtaaatatattagtaatacgttataaatatgtaatttttaatttatttatagttgatgtttttttagttttttggatttaaaatataagtattgaagaggtgaggaagtattattgttgttttagtattatttcgaaattttgtttataaattatataatttttaaggttatgaatttagtatttttttaggtattaattattgggataaagatagaatttgattttatttatttatttattgattgaagtttaatttaaattttgtatttagtaagattttagaaataacgtgtgtattttgatttgtaaattaattttagtattttgtgtgtatatttttttttatttgggtttttaaaaggaaaagtaacgtatatttgatgattattagtattgagtttttttagtaaaaagtatatgtttataaagaagtataggataatttagtaatttaataatgtgataatatttgcgtgtgtttttttttttgagaaatataaattgtgagaaatagaaaagtaaaagaagtagtagtagaaatattattataggattaaaagattgtaggaattaaaattttaaaattattgggtataatgtattaaaaatagggtagtggaggaaagggatagtttagattagttttgagggtttaaagaaagtattaaatattgttattggagtgatttgttttgttatttgggtttgggaattaagtgaaattgttgatatattagatagatattttttatttattttttttttgataattagggtttattttttttattttttatttttttggatgttttattttttaatattaatattaatattaagtttttagtttttatgttaaaaattggttatttaaaataatttaaattaattttagtttaattggtttaagtttaaatttattttaagatcgatattgtgttttttaaaaattttatttaaaagatatttaaattgatgagaggatattatttattttattgataaattattattgtaagtttgtttattgagggttagttatttggtttaaaaatgttgagattatggaaagtggattggaatattttggagtaatattaaaaatagtatttgtaataatttaataaatttataaatttttttttttttgttgatttattttgaaaagatattttatgtttttaggtattttttttttgtggtgtgattggtagatagggagtaaataatttattgtaaatgggtattatgttagttggttttaggtagtattaagtttgtgatttatagttagggttaggaaaatgttttttaatttgtttgtttttgttttttttaaatattaaaggtataattgtattaattattaagtattttataaggttttttagggtttataagattttttaggaatggtttggaagttattagtattgttttattgaatttgaatatttttaatatgataatgagaagtttttaaagggtggttttatagttaaacggaattttttaaattggtttgttttttatgttgatttatttaggattatatttgggagtttttttgttttatttttaatgtatttaatttattgattattattatttggggggaaaatgttatatgatatttagaaattaagagttttggagttttttttttattagatgtatttatttatttatttattattttttaaagatagggttttgttttgttatttaggttggagtatagtggtatgattttagtttattgtatttttgaatttttgggtttagattgtttttttattttagtttaagtggttaagtattaagtaagaattatttggtaaattttaaggttgtatattagattttttaaattagaattttggggttgggtatttgaattttagtaaagttttttaaatgtttttggtattgtttttaagaataattgataatataatagttgtggttattataggggtattttgttatatttagatataagtatattttgttttattgtattttttaaatattgcgtgtttattttgttttgttttatttataaattgaaggtttgtggtaattttatattaagcgagtttgttagtgttatttttttaatagtttgtgtttattttgtgtttttgtgttatattttggtaatttttttaatatattaaatttttttattatttttgtatttgttacgattagtgattagtgatttttgattttttttttttttttttttttttgagacggatttttgttttgttatttaggttggagtgtagtggtttaattttggtttatagtaatttttgttttttaggtttaagtaatttttttgttttagtttttttagtagtcgggtttataggcgtgtgttattacgtttggttaatttttgtatttttagtagagatggggattttttatgttggttaggttggtttcgaatttttgattttaggtgattcgtttattttggttttttaaagtgttgggattatcgtgttagtttgatgttattattttaattgtttttaggtattataaattttatttgtataaggtatcgtatttaattgataaatattgcgtatgatttgattgtttttttaattggttattttttgtttgtttttttttttttgggatttttaaatttttgagagataataatattaaaattaagttaattaataattttatagtggtttttaagtgttgaagtgaaagagttgtatgttttttattttaaataaaaagttagaagtggttaaatttagtgaggaaggtatattaaaagttaagataggttaaaagtaaggatttttgtattaaatagttaaattgtgaatgtaaaggaaaagtttttgaaggaaataattagtgttattttagtaaatatgtgaatgattagaaagtgaaatagtttttttgttgatacgaagaaagttttagtggtttggatagaagattaaattatttataatatttttttaagttaaagtttaattttttttaattttatgaaggttgtgagaggtgagaaagttgtagaagaaaaattggaagttagtagaggtcggttgatgaggtttagggaaagaagttagcgttgtaatataaaagtgtaaggtgaagtagtaagtgttgatatagaaattgtagtaagttatgtagaagatttagttaagattattaaataatagattttttatgtagatgaaaaagttttttgttggaagaagatgttatttaggatttttatagttagaaaggagttaatgtttggttttagaggataggttgatatttttgttaggggttaatgtagttggtgattttaagttgaagttaggttttatttattattttaaaaattcgaagatttttaagatttatgtttaatttattttgtttgtattttagaaatgaaataataaagtttggatgatagtatatttgtttatagtatgttttattgaatattttaaggttattgtaaagatttgtttaattgtttagaaaaaaatgattatttttaaaatattgttgtttattgatagtgtatttgggtttatttaagagttttaatggaattgtataataagatggatgttgtttttatgtttgttaatatattatttatttgtagtttatgaattagggagtgattttaagttttaaattagtatattttgtaaggttatagttgttatagatagtgattgttttggtggatttgggtaaagtaaattaaaaattttttgaaaaggattggttattttagatgttattaagaatttgtgattcgtaggaggaggttaaaggattaatattagtagtagtttgaaagaagttgattttaatagttatagatgaatttgaggggtttaatattttagtttaggaagttattgtagatgtggtagaaatagtaagagaattagaattagaagtggagttcgaaaatgtgacggaattgttgtaattttatgagaaaacgtgaatggatgaggagttgttttttatggataaatgagtaaataaattttttttttgagatggaatttatttttggtgaagattttgtgaattttgttgaaataataataaaggatttagagtattatataaatttaattggtaaagtagtagtatggtttgagtggatttattttagttttgaaagagtttttattgtgggtaaaatgttattaaatagtatttcgtgttataaagaaattttttatgaaaagaaaagtgaaattttattgttgtttattttaagaaattgttatagttattttatttttagtaattatttttttgattagttagtaggtattaatattgaagtaagattttttataaggaaaaagattataatttattgaaagtttaaatgattgttagtatttttaagtaatattttaagattaaggtaaatatatttttaaagatataatgttattgtatatttaatagattatagtatagtataaatataatttttatatgtagtgggaaattaaaaaattcgtttgatttgttttgttgtaatatttattttattgtggtttagaatcgaatttgaaatattttagaggtatgtttgtattaatattattttgtaagtaaaaaatttagtatataaaaaaaacgtagaatatgttgagagtttagtaatatggatgaaaatgtttttttttaattgaagaatatgataaattataattagggaaggatataaattaagaaaatatgtttgagatagttaatttttgtagtttataatatgaaaatttattatattaattttagtaagaatatttttaatagttgttatttttttgggatatagaatttataaagtatatagtaatttttttatgattaattttaggattattttataattatttattttatattataatgtagtattaagataagtagattaaattatagaaggataaagtttttgttaagtatattttgttattagtatatcgtattgtgtgtgtatgtatgtgtgtgtttgtgtatgtgtgtgattgtataaaatattagaaagttattttagaaaagttaaatgattaggaatgttgtgaagggattaagttatttttaaaattatataataaaattttttttatttattattaggttatttttagaatatttttttttaaatttgttataggttttttttatttgtttggattaaaattggtttgaaagtttaaaatggttttttatttatataattattttttaattagtttgtagtataggtgtaaagttattatatttgttaggttagtgaagtatgtaaaaattattattttttaattaggaattatcggatagtttttataggattgttggggagaatttttataaagaaagttatatttttataaattttttgttattttatttagttgagaatataaaataagttagttaataatagagtagaaatgttttttgtaatagattaatattgattaaatgtgttattaaatgttaaaatattattttttttttttgtaagttatgtgttttatgttataatataaaagggataattgtttgtgttttatgatagttttgttttgttagatgttgtttgtttattttggtgaataaatgaagagagttttggatatatttttttttttttaataaaagaggaaaattatttttgtttgtatgtttataattttgattttttgaatggttttaatttttttaaagttagtatttttttataaagataggtgtttggaatgtgggcgatatggttggatagttagattgggattaaataatggaaggttttgaatattatgttaagaggtttgggttttattttgaaggtagtagagaattattatgtttttaagttaggattgatttgttttaagttgtattttagaaatattattttggtagttgtatataggatgagttgtatgttgttttgttttgtttggggagatagttttcgaagagagattatatacgaaggtagttatatgagttattattaaaggtttggtaagaagtagtaaaagtattaattggagtggtagtagtagggaaggaaataaaaggatagatgtgggagttatttggaaagtatgaggtaatttattgattttatagaattattggttttttgtttttattttatttatattgatttttttaaggttattagtgatttgtttgtttttaaatttagtgggtattttttagtaatttattgttggtattagttttgtgttagatattaggattttgtttgtaaaggtatttgttagtggtttttgtgatataattttgtttttagtttttttttttttatttttttagttttttggtaagttttttttttagagttttttagagttttgtgttaggttttttttttattttttttttttttaagtgattttatttttttttgttgttttagttattatttgtttttatgtaaaggatagttatatttattgtatttttagtttagatgtatttttttgttttttgatttatatttttaattatttaattgggtatttttttttggatgagttataggttttttaaatataatatgtttagaataatttattgatttattttaaggtttgtttttttttttttttgtagtttttattttaggaaatatatggtgttattaattttaaagtagaaatttggatataatttttaattattttttttttttttttgtgtatataattttagttattaggttttatagattggattaaataaatatttcgtaaatttttttatttatatttttaattgtttttattttaagttaggttattataattttgtagttggatgattgtattattattttgattggtttttttgttatttttaatttatattttatattgtagttagagtttttaaatataaatatgtgattagattagttttttttttagaatattttagggtttttattgttttgagtatagtttaagggtttattatggtttatagggttttttatgatttggtgagttttttattgtataatttttttaaattgtttttattttttttttttttggttttgtgtttttgtataatgttgttttttatattttattttacgtttaatttttattttttttttattttttttttttttttaaaatttagttgaatattatattgttatgtaggtttatttttgattttttacgtttgggttagatatttttttttagtattattatcgtattaggtgtgttttttattttagtatttgttttattgtattataattattgtgtattcgtttttatagtttttgttagtttaaaagttttgggagagtaaaggtttatgtttgtgttttttattgtggtatattttagtgtttagtatatgataagtttttaaaatatttgttagatgtatgaagaaatgagaaagagaataggaagagggtaagttttaagattaggaaataaggttatgaaagttgtaggaaagtagtaggttaaaatttagaagaagagtttgttttaggaaatattgtgttttaaattattataattgaagtaaaaatttaaggtttgggtgtggatagagtttattatttgataatagtggatattgatgtatggtagagttggagaggaagagagttagattttaaaatagaaggggtaaagttttttaagaagatagattatagtaagaaggattaggggatagaaatatgagtttgttttatttatagattttaaatatgaaatgatgagttattatgaagagagtaggtaattgtttagtgaagaaggggatgttaattttttttaattttgaattttttaggtagaagtagttagagaaggaatagttattattagatagtgttgtaaggaaaatgatatttttggggaaatttgtattttggtaaagtaaagtaattaagaaagaatatattattattgtttaataatcgttataaaaagatagtaggattatttttgattttttttatttttttttaggaatttggaggattaagaagagagaaatttgtagaagaggtttttttttttgattttttttttattttagttttattatatgtaatgtaataataattaagaatttgtgtaaaattttattaggttggtatgtatggagagaaaaattatttagatgtttttttttgttaataatataaggagtatttgtagggaaaaatatttataaatatagtaagatttattttttttttatatttatgggaaaattttaagttgtgtttttgttttatgtgtgtttttatttaaagatattatatttaatatatattgttgatttattaatattgaatttatggttaatagtattataaattatgtttgattaaaatttatgatatatgtatttttttcgtaaggtatattatagttttttcgtatatgggaattttaggtagtattttaggattatgtatagaggttattttaaatagtaaaatttttaataaaaagtataaaatttaaaaaatgtgttattaaatttattatgaaaaggatatttgtttatagtttgagagttaaaataagaaggtggcgtgttatttcgtttgattttagttgggaatatgtatattagtcgatttaaattttttgttattttgtgtttatttacgaatcgataggaaagtaagtgtggatttgggggttataaataaaatgtagtaaatgtgtaaatttgtagatgtggaatttataagtagttagaattaattatgttagtttgattattaaattagttttttaaagtattattgtaatattttataatttgttttatttattgagtgttgtagtttatagttttattgggtatttttagtagttttatttgaagttatattttaaattttgtaattgaagttttaaagtatgttatcggaaatacgagttgatgttgtgagataaaattaataggtaatttattattataattgtgggttagaatgtttaagaaattttggaggtttagagagttgagatgaatattgaagaattataggtaggtttattttgttaagttgtttgtattttgagggtgtagtttttaaattaaaaagatattaaatgaataaatttagatggttttattggggaatagagattgaaagttgatattggaatgtgtatttaaaaaaatgagagttcgttttggaaaggtagattgggtatagaatgtggagagttatatttgttaattgaagaaatttagattttattttttataaaataaagttattggtttttgaaggttgtataaaagttgtattttagtagtatatattttggtagagttgttatttgtttgaaaatattaatgttattttatataaatgatatttattttttggtgtttgatttaaatttttataatgagaatgtgattttatagtttttattggggaaggaagtaggttttttaggtcgaaatttttgtgtagtaaaaattaatatttaagttagtttttggtaatttttagttttataatggtaaaatggattttttagaaagttattttttatttttttgaatagatattagaaataatatgtattttaagtgggatttatagaggaagggggtttttaattttttattagtgtgatgttttgtaaaaaaataattaatattagagttgaggtttagaaatagtagtattgggttaaagtttgtttttaagtgtaagtttttttttttattcgtgtgtgtgtgtgtttgtgtgtgttttatatagaaggaggaaatgttaattttagtttttataaatattaatgattgtaatttataaaaatgttatagattatattttttttttttgtaatagatgagaagattttgaaatttagtttttattttttagtttggtaagataatttgaataaattgtaataattgtaaaagaattttgaatatttgaatatttgatattttttatgttaaatatatattttttgtattatataaatattttagaaaagagagataggtagggaggaaagtgtttattaaaaagagttttattttttttgaaaagggattttttttatagtgttgtgtattaaagtttgtgttgtaaattagaaagtattgagtatatatgttgttgttttggtagtattagaagtcgatttttattagttttatattatttattatttttgttaagtaattttaaattataaaagaattttatttgattttgtgatttttttgttttttgtttataaagaaaatattttaaattgaataatggtatgttacgtttttagtttttaagatagttaatgtgtaaaaagatatttaaagtatagttgtgttaagtttttgaagtttatagttgttttaattttgttgttatattttgttaatatattttaggaatattttattttagttataattaggatataaatattattttggtggcgatttttttgtaattacgacgttaattaaatttgggaaattttgatttgttagatttataaattttatagtaatataaaagtttaattttttatatatttttaaggtttttatatttttgttaaaataaagtattaatgaaaaatgaaaaaattataaattatgtttaggttaaattgatattgattttgttaaaaggttagatagaaatttgttttttttttttgttatatttttttttttggagattattttgtgtggattgaaggtttgagattttaggatttaggttagaatagattaggagattgtgttgtatgttaagtggtagatattatggaattttaagtttgttacgaaggaggagaagaagaggtataatgattttgatatagtttttgggttgattatagtagatattttatttgagtaagtagatattattttaattgtttgttgattatttttaatttgttagtaatttattttgataatttagatttaggagtttgatagtatgtagtgtatgttttataataatttgttgtttatgaaagttataatattgtatgtttagtataatggtgaagagtttgttatttggaatggtttatttatttgggatttatatatagtaagtttttatttaatattattagtaggtttttggaaattgtgattttaagtaaaataatttttaatgaaattaattttattataggttaattgatataaataagagttaagtttttgtggtatatttttggttataaaaatattattaaatttttaaataaagatttaaaatatttataatattaattattgaaataaatgtgagttatatatatatatttaagaataataaaaataaaaaataattatttatttaatttttggtgaattagtgagtgatagtgattatagtgatggtggatgaaattaaggaataaatatttgtaaagtgaaaattgtaagaagtattttttgttattatatagtttagaaataataattagggtaggtttgttgagtatttttaaattgtattgtttattgttatgtatttgaatgattatcgtagattttatgaatttttattttatattaatttgtaggttaggtatagtggtttacgtttgtaatttcggtattttgggaggttaaggtaggcgggttattggaggttaggagtttaatattagtttgattaatatggggaatttttatttttattaaaaatataaaaattagttaggtgtggtggtatatatttgtaattttagttatttgggaggttgaggtaggagaattgtttgaatttgggaggtggaggttgtagtaagtcgagattgtgtttttgtatttcggtttggtgatagagttagattttgttttaaaaaataataataataatttgtatttatttattttttaatgtgtttattttagtttagggtttagggggtttgtagtttatatttatagtttagagtaattgattttatagataggacgttattttattgtagggtgtatttaaatgtatatttatatttaaattgggattttttagatatgttagttatcgtattatatatagtttcgggatgtgggaggaaagcgaagtatttggagaaaaattatatagatatgggaagaacgagttaattttatatagatagtggttttggatagagttgggtaggtattagtttttttttttttttttgtggggggtgagggtggggtatggagttttattttgttatttaggttggattgtagtgtagtggtgtgattttagtttattataatttttatttttcgggtttaagagttttttttgttttagttttttaagtagttgggattataggcgttcgttattatatttggttaatttttgtatttttagtagagataaggttttattatgttggttaagttggtttggaatttttgattttaggtgatttattcgttttggttttttaaagtgatgggattataggcgtgagttatcgcgtttagttagtattatttttttttttttattaacgttaaaataatgttgaataaaatattatttaaagatttgtcgtatggttattttttagttgtgtgattttttttgggaaagttagtaattttttttgagtttaaatgtttttatttataaaatggggttagtaataatgtataaggtttttgtaagaattagaattaataaagtatttagattataataattaattagtattagttgttgtttttgttattattttgatgtggtggttgtttggttttatttgtgtattattaggatatgttgaaataaaatttaagaattggttttataatattagaaaagtaaatttttgtacgatatgggtatgaaaaattgttgggagtttatttttttttttttatttaatttgttttagtttttttaaagtttagattttttaaatgagttatagtaaaatataatgtttaaaaatgtttaaattttaagtattatgttatagttaaataatttaaaggtgttatattttatatagtttaaaaggaatataattagtaaaattttataatttagaaaaaaaaatagttgatagtgattgatttataaaagtaaaatattttttgttaatattaatattttttttataaattaattgatgataaaaaattgagtgaatgagatttgtagtttatttatttatgatgttggtttatttaatttttataatttgttgtatttgaaagagtatagtgatagaggttatgataaaatttaggtttagtgttataattaaatttttgtaggaatttttaaggttttgattttatttttgaatgggaataatattttttaagaatattatgaagattaaaaagttacgtattataaatatatatagagtaataatattgggaatattgtaatttgtaagaaagaggaagtatatggtatattttgatggttagggatatggattttgtagttgggatgtttgaaagagaattttgattttattaatggttagttatatgaaattgtgtagataatttaatttttttgagtttgtatttttttttgtttatataatggggataataatagtatttattttatatatagtgttaatttttattagtggtttttattaagatagtattgttgtttatttttggttgttagttattatgtatttgagttagagagttattgattttagaaagtttcgaggagattattaggttaagtaatttgttttttgttagataattagttttatttatgagttattaaagagggagtcgaaatttagggaagttgaaagagttgttgattgttattttgtgagttggtgatagaaagatatttggaattttagtagttgtttattttttagttttgggttttgtattgtattagaatattgtgttattttaaatatgaaaaggtagtatgattattgtgtttgttattttttattttttagatgttattttatatttgtttttatgaaatttaatttgtgatttttagattatttagaattttggttggatagtgttttttagtgttatttagtatatttttttgttattttttgttgtttttgggtttttttaaaagagttatattttgggtgttaggaaattttatatatgattgttttttttttttcgatttttttttttatttatttttttagttcgtagtaaattagaagatttttttgatatttttttatgtttaaaggttttttgatatttttatatggcggtatgaattatagtgtattttaattggttttttttttgtatgttttttataatgagttgttgaagttttatgaaaatataatttgttttatttagggtagttataattttaattataaagtatattttttggtttttggttaggaattcgattatttttcgatgtttttttgtttaggattttttgatttttttttaaaatattttggggtattttttttttttggtttttggaaatatatttttatattgttatgaaggtttttattgatatttttaattttttttaaattgatttagtaaatgtttttttataataaatgttattgatatgttattaatatggagagtaataatagaatgtattgagtaaattttttttttggaggtttgagaatttagattttagtttttatagagttattattttggtgattttggatagtagattttttaagttttagtttttttattttttaagtggggatattaatagaatttatttttagagatgttgttaagattaaaataattaagataatttttgtagatgatttggtatagtgtttgttacgtattaagtaagagttagttttcgttattatagtatgattataaaaaatgaatagattaaacgaagtaattagaaggaaagaaattttaatttttaaaatgtaatagttttttggtttttttttttttgtgaaatatttgtatggtatttttttgttatttatattgttttgattgtggttgtcgtagatttttgttgaaagtttgagagattgagatttgttattttgaatatggtattagtggaatagtttatgatttaataattgtattattttggataagtattagtagaagtgagttaggatatgtgataaaaagatatttattttgttttttttttttttttgtattttttttgttataaaattattgatgttaagtttatagtattaatattttagtttaatttataataaaatttgagggtatttgaatatattatttgttgtaaattataattttatatttgattatagagtatttgaagtgggttttttttttttttaaaattttattttaataattaaaaaatatttttaggagaagtattatttaagaataggtttatattaaataatattattttatttttaattttttggtggttaaaaaatatgttaatattaattaggatatgatatatatgttttgttagaatagttttggtagttagaagatttttttttttgtgtttgaaagggatgttatttggggtagttatgagttatgtatttagatgttttgaaaggattagtggtagatgtatttttatttttgtttttttttttttttttttggtattttagttgttgagtgattgatttttgtttttagttttttttataattattattgttttaataattttgtttaaatagaatgtttttttttgttataagttatggggttatttatcgttaattttttaaagtattgaaatgagaattttataaattaaagaatatttttgattttgagttagtagattttattaagttttttgtagatggaaattttttttaaattggtttgtttttttttaatattttattattttattgtttattttttggagttgtgatttgtttaatatattttaggttttttaataaattaagttatgtaagttattatttggattatttcgaaattataatagtttattaaatttttgaaagaagaattttgtgtttgtttatagattgaagaattgatttagttttattggttgagttatttttattatttatatttaatttttggtattgagggtgggaggagggagaggagtagaaaagatataattattgggtattgggtttaatatttgggtgatgaaataatatgtataataagttttcgtgatatgtgtttatttatttaacgaatttttatatgtatttttaagtttaaaagtttaaaaatatatatttggtaaattaattgatgtgttttaaaaaatatcgttttttggtcgggtgtggtggtttatgtttgtaattttagtattttgggaggttaagtcgggcggattacgaggttaggagtttaagattagtttggttaatatggtgaaattttgtttttattaaaaatataaaaaatagttgggcgtggtggcgcgtatttgtaattttagttattcgggaggttgaggtaggggaatttttttaatttaggaggcggaggttgtagtgagttaagattgtgttattggattttagtttgggcgatagagcgagattttgttttaaaaaaaaaaaaaaaaaaaaaaaattatttttaaagagataattaatttttttttagaaggtagggttaaagtttaaggtttttttaggttttttgtattttttataaattttagagttagtttgttaatttttatatatatataaaaaaagtttgttgggattatgattggtattgtattgaaattaaattaatttgggtataagagattttaatttggggattgagtttatattgagttttttaatttaggaatattgtatatttttttatttagttagatatttagtttattttaataatatttttagatttttagttttttttagtaatatttttttattttttttgtaaagtttttgtatattttttgttttatatttattgtgtatatgtgttttgttagttattaaattatattaatataaattttattttttaattgtttgtcgtatatatagaatgttttaaaaatattgtgttttgtgattatgttaaattaattaattttagttattatgtttttattattttttttttgaatttttattgttttttttttttgggattttatttatatgtaaggttatttgatattgttttttaggtttatgaagttttgttaatttttttttatttttttttttttttgtgttttttaattgaatgaatgttattaataatttggtatgtaatggtttatttaaatttttttttgtttttaagatatttttatttttagttgtgtttggaattttttagttcggagttttattaatttttagtttagaaggaaggaggagaaggatagggtgaaaggaaggggagagtttttagttttaggatagagattagaataaataatagagtagttattttggataaggaaattttttttaaatttattatttatatttttagaaataagaaaaataatgtatttattaaattaaaggattttgaaaaagggaatatttagagaataaaattaaatttttgaaagttaaaaggatgataatataaatgaaaagtttagttgaaggattgaaagataaaagtaagaaaatattttagaaataagagtaaaaagatagtaatgtaaaataggggagaagataagagaattagagaattagtttaggagttttagaaagagaaaatgtagataataaaaggtaagaaattattaaagattggagtaggggaggttatgttatttgtttttttttttattttttattttgagttatatttttttttattgtgaaataagtatatgtatatgagaatgaataaaataaatatgtagttatgtattgtttaataatagagataggttttgagaaatgtattattaggcgatgttattattgtgtagatattatagagtgaatttatataaatttgaatggtatgttttatagtatatttggattatatggtatagttgttgtttttaggttataaatttatagtatgttattgtattgaatattgtaggtatttttaatatatcggtaagtatttatgtatttaaatatagaaaaggtataataaaaatataatataaaagaggaaaaaaatagtatatttgtataggtgtttattgtgaatagggtttttaggattggaagttgttgtgagttattgagtagtgagtgaatgtgaaggtttaggatatttattatatgaagtttattgtagtgtaaattttgtagatttaggttatattaaatttatagaaaaattttttttaataataaattaattttagtttattgtaatttttttattttgtaaatttttaatttttttaatattttgatttttttttagtaatatttagtttaaaatatatatattgtatagttgtaaagaaaattttatgttttttttttgtaagtttttttttatttttaagatgtttttatttttaaaattgttattaaaaattaatatataaatatatatattaatttaggtttatataaagttagtgttattagtgtttaatttttatatgttattttattggaaggtttttaggggtaataataaatatagagttgtcgttttttgtgataatagtgtttttttttgatatatttattgaaagatttggttgagagtgtttgatagttaataaaaaaaaaaaaggataagaagtatattttaaaataatgaaaaaagtataatatagtaaatatataaattattaatatagttatttattattattatcgagtattatgtattgtatatagttgtatttgttgtatttttttataattggtagtacggtaggtttgtttatattagtattattataaatataagtatggtgttgtattataatgtatagttgtagttaagtgataggatttttttagttttattataattttatgggattattattataaatgttgtttattattgattgaaatttatgtcgtgtatgattatatatataatttaatgaaaaataataataataaagttagtagtgtgtaattattaattagggtaagaaatagaatattgttaatattttggaggtttttagtatgattatataagtttataaattttattttgttttttttttttagaggtaattattgttttgataaatgtgatcgttgtttttttgttttttttattatttatataaatatttttaaataatataatttagtttgtatattttgaattttatgttaatagaatattatatgtatatgaattttatgtgaatagaatattatatatgttattttgtattttgttttttttatttaatattgtaggatttatttatgttgtagtgtatagttgtcgtttatttattgttgtatagaattatatttttagagataagatatatggatgtttataaattattttattattatgaatatttgattagtttgtagtttttatttaattaaaaaaatgttgttgttaatatttttatatattttattgtatatgtatattaatttatttataagtataaatttttttttgaatatatatttattgatggagttgttatattataggatatttttgtttttgattttattggataatattaaattgttttttaaaatgattatatttttaaatttaggatatattttattgttaaatgtttaatttttgttagtttgatgggtatgtaagttattttattgtcgttttaatttgtatttttttgattattaattaagttgagtaattttttatatgtttattggttatttggagtttttgtattgtaaagtataagtttttttgtttatttttttagttttttgtttttttagttgaaatttaaatttgtttaaatttgttattttttgagtataagtaatttgggatgtttttttttagatttagtttaattttttattattttgttagtttgatggtgtttttaaggagatatatatgtgtgtgtgcgtatatatgtgcgtgtgtgtatatatatatatgtatatgtatgtatgtattttttgagatagggttttattttgttatttaggttggagtgtagcggtatagttttggtttattgtagtttttattttttgggtttaagtttttttttgttttagtaattcgagtagttaggattataggtatgttattatattcgttaatttttgtatttaatagaaatagggtttcgttatgttgataggttggatttgaattttttatttgaattttttacgttaagtgatttgtttgttttagttttttaaagtgttgggattataggtatgagttatcgcgtttggtttggatattttttaaaaatattttttatttagtattttggtttttggtaggtaggttggtatttatagtttgatttattatttttataaaaagaaatttgtaaatgtttttaaatagattttgaattagtttttttgattttgaatttttatttttatttttagtttttgagttttttagaatttttttttataataattaggttgttttttagttttttttattggtgatttaatagattttaggaagttaataatttttgtttatttgttttttgttttgtgaattgttgttggtattgttttttttttttatttttagaggtgtatgtttttaaaaatatatattgggtttgagagggagttgaaataaaagtatgtgttaaatatattatttttaattagaattatatttgattggttattttatttttaagtttatatatattttaaatagagatatggttaaaggaattattatgtgaataatagttagggttttgaatattatagattatattattatatttgaaatatttgaaattttgatttaaaatgagagttttatagttatgtttttaatggattaagtgtttaagtatttaatatttaaaatatttttattaattaagagaagataaatattttaatagagaaataggtaaattttattaatagttagtttattagatttgttttttgttagaagcgaatatggggaaatatatgtgtttatgttttgtttattttttttggagtaggtaaggagaggtagtttaaggatttatgtgataaattttaaagttgtttatcggttttttagttttttttaggaatttaatttagggaaataattagatatttgtaaaggtgtgtatagtggtatttataatagtgaaaaattaaagaatgattaataacgggagaatggaagttatagttaaatattttataattattaaagaattatgtaaaatatttattgatataggagttttattaaaatgtgaagtatatagatgaatagtattatatataaaaagtaaggtgtaaattagttatttatattgttatttttaaaataaatagatgtagtttttttaaaagatgtaggttatatatggaagtgtttgttggttttttgttaaaagaatggcgattttattttttaatttaaattttttgttgttttttaaattgtttaaatagttatagtttttataatgtaaaagtattttttaatttagttttatttgataaattatttttttattttatttagttatgtaattttaaatgaatttatagtagtaattttagagtagatgaatttataataataattttagagtagattacggattagatgtaaaaatatgagttgggttttatggttatagagagttttttttagtgtggggattatagttgtattgagtttatttagttttttttttttatatgaatgaaaaatggggttagtttataattggaagggtttcggtatgtattattgtattgtgtatgatgtgattttttgatgttagtagggagagaattaaattgttttttatttaaattaagatttataaatagcgttaattagttattttagttattttttgtagtgttaagaaggtgtgaattttttatgttttttattgtatatttttgtttaatttagtgtttttttttttttttaggttttggttttatgttatattttagaaattataataattttttttggtattattttattttttttcgtattgtgagaaaaattaaatttttaagtggatgttttttataaattatttatatttttttgtttttttttgggaggtagggatagggatagagtttttttttaggttaattaagaaaatttattgtttttaatgtaatttaaaagatttttttttttttattgttttttgtatttttaattttttttttttttttttatagtagagataagtgaatatttatttttatgtttttttttttatgtgtattttaagtttttattaaaataaggttttaggattttttagatttaattatgtttttgggtttggtcgattgttgtaggagttttagggagttttttataaatgttagagtgatttatttattaatattaaattttaggatatatgtaataaagtaggatttttttttttatggaatgtgtcgattttagatgatatagtatttaatgtagaaaacgttggaatttttttttggaattagattgtgatgagaggtgtttgatatgaatataagttattgttttttttttttttttgagatagagtttcgtttgttgtttaggttggagtgtaatggcgtgattttagtttattgtaatttttattttttaggtttaagcgatttttttgttttagttttttgagtagttgggattataggtacgtgttattatgttcggttaatttttgtatttttagtagagatggtatttttttatgttggttaggttggtttcgaatttttaattttaggtgatttgtttgttttagttttttaaagtgttgggattataggtatgagttattacgatcggttagttattgttttttttttgattttttttttttagtttttgaagataaagtaggaaataattttttttgaagatatttgataaaaatttttaaaataataaaacgtatgtttttattttattgataaaaaatttatcgtagtttgttatttaagagtatgataatagtaataaaaagtaattttaaaaagttaagatttttttagtaaaatagatgatttatatttttaagttttttttgaaattagttattaatattattttttttttatttttatttgaatgattgtagtaatagttttttgtttgtttgtttgtttgtttgtttgttttttgagatggagtttcgttttgtcgtttagttggagtgtattggcgtaattttggtttattgtagtttttgttttttgggtttaagcgatttttttgttttagtttttcgagtagttgggattataggtacgtgttattatatttagtttatttttgtatttttagtagagatagggttttattatgttggttaggatggttttaattttttgattttatggtttgttcgttttggttttttaaagtgttgggattataggcgtgagttatcgcgttcggttagtaatatagtttttagttattcgatatttttaagtttataatttttaggttatgtatagttttatgttttaattaggtatttattgattttagtaggtttttatttatttgtattagttttttttttttttttaattttaaggttatttttaaatattagtaaatgtaaaaagaatttgtaaagtggtaaggtatggtttattaaaagttagtttaagggtagtttttagttttgttttatttgggtttagtttagttgacggatgagttgattgatgcgtttatttcgatagttaggtgtgtttatttttttgaggaagtttattttatttttggtagtatgatgggttattgagaggtggaaagggcgtaagaattatgagattttttggaaatgtttttttgggaaggtaattttatgaatgaggttttttaagtaaatgaagttaaatttttttaggtgttttttaattattgtgttgtttgttagagggatggttttatttttgattttggtttgtttacgttttaaaatgagttttcggatagattttagatttggaaatttttaggttatataaggttttattatatgtagtatttttagattttagggggtaatttttataaagatattattaaaaattttttttaggcgaagttttgtagtggttttttgtattcgtaaatttacgttattaattttttcgatgcgtataataaaggttaaggaatgtttatttggtaattttaaggtatgaggttttatttttagtcgtttgagacgtattttgttacgtttttgtcgttaggaattatgtaggaatgattttagtcgtttaaatttgagtttttttttttttttttgttttgttattgttatttttttagtggtgtagttatttaattttttttttaattataatttttattttaagttttagggtatatgtgtaggatgtgtaggttatataggtaaatatgtggttatggtggtttgttgtatttattaatttattaggtattaagttcggtatgcgttagttattttttttaatgttgtttcgtttttttatttaacgggttttagttatatttttaatttttatagtttagatgttatgatttatagtgtggtttttatagaaagttatggattaaaaaaaaaaaaaaatatttaaagtgttcgaatttttttaaaataattttggtatagttaaatttatgtattgattgtttatttaatatttaatagtttgtgttgtgatatattgttttaatgttttgaatgtttgttagtttttagtattgaagatgtgaattatttattagtaatgatatatttagtttaaggttgttagttatttatgttataaattaatgatttgtttttaaaatattaattttgtgatttatgttttggtaggtggttagatgttttgtgttttaattttaaattatggataaaggttttgttataattattgttttattggtttttttttttttttgtttattttttaaaaaattttgtaatttttttttgttaaatttttattttaggtttagaggtatatgtgtaggtttgttatataggtaaattttgtgttataggggtttgttgtatagattattttattatttaggaaataaatatagtatttgatggataggtttttagtttttattttttttttatttttaagtaggttttagtgtttgttttttttttttttgtgtttttgtgtatttaatgtttagtttttagttataattgagaagaatatgtggtatttggttttttatttttgtgttagtttgtttaggataatggttgttagttttatttatgttgtcgtaaaggatatgattttattttttttatcgttgtgtagaattttatggtgtatatgtattatattttttttatgtagttttttgttgatgggtttttaggttgattttatgtttttgttattgtgagtagtattgtagtgaatatatatatgtatgcgtttttatggtagaattatttatatttttttgggtatatatttagtgatgggattgttgggtcgaatggtagttttgttttaagttttttgagaaattattaaattgttttttataatggttggattaatttatatttttattaggagtgtataagtatttttttttttttgtaattttattaggatttattattttttgattttttaataatagttgttttgattggtgtgagatggtattttagtattatttattgaatagggagttttttttttattatttgtttttgttgattttgttgaagattggatggttttaagtgtgtggttttatttttgggttttattttgttgtattggtttatgtgtttgttttgtattaatattatgttgttttggttattttagttttgtagtagtttgaagtcgggtaatacggtgtttttagttttgtttttttggtttaggattgttttggttatttgtgtttttttttgattttatatgaattttaaaatagtttttttttaattttgtgatgaatgttattggtattttgagagtaatagtattgaattcgttaattgttttgggtagtatggcgattttaataatatcgattttttttattttttgtaattttttgttgttgtatttaattatttttatttgtgaagtttttttagggatgattttgttgaaagtgataattttaaaaattatgttggtaattaaaattttaagtaatgatttttatttttagagattttattttttttagattttggagttgttaatagtagtgtttaatttgtagtggtatttagtagtttttgttttttgtatgtagaattgtttatatgaaaatatagttttaaaaatgtttttttatggttgatatttatatttttattttttttgattttttttaagagggatttggtttgttaaaattaatttttgtaatatttttatgaagatataaattttgataaagtttttaaaataagtttgagagaatatagtattgattttatttgtaaatttgacgattattttagaaaaaaggaaaatattatttattattattttgtttataaatgtttattaattttaaagtttttatattgtatattttttattataatagtagttattatttatttttttttaaaaaaagtgttaagtgtgtttttgaaatttttatattgtgtagaatatttttaaaattttaaaataaaaattatattattatttgttttaaatgttttttttttatttaatatatagtttttaaaatgttagtaaatagtattttagaagagatacgttatttttttaatgaatgttttaaaatgaattatagtaatttatatttatttagattgtgaaaaataaaatttatattttattgttaaatttttaaaagtgaaattatacgatagtttatttggtatattattttgttattgtgaattgataaatgtatatgtagataaatatgtgaaaattagagtatatatatattatatgtagtattataatatattttttagtatgttttgattgatatttaattatataatttattaagaggattttattagaatgtagaaaagtattgaattttagaataatttatatatttaaaaaaaatgtagttagtttttttatttgtatttggagaatgtagggtaaaggaataatatatgagtattggtatttaaaaaaaggtgttaattttttatttatgatatttgttattttgggtattatttaatttttatttttgtgaaatagaggagttttaatattttttaattattataatattgttttaatttaatttattttaatttgtgatatagtttgaaaattaagtttttattattggtatgtgtaaaaaaataaagtagtagtagatttggaattttgaatgtaaatttagattttgttttttaataaatgtataatatagtgttttgggattaattttttaatatttttgagttttagtttttgtatttgttaaatgggattagagatatttatttttaggatgtgatatggtttggttttgtgtttttatttaaattttattttgaattgtaatttttatatattgagggagggatttggtgtgaggtgtttggattatggaagtgattttttttatgttgttttcgtgatagtgtgggagatcgtaaaatatttgatggtttaaatatggtagttttttttgtgtttttttttttttttgttattatgtaagattttttttgttttttttttgttttttgttatgattgtatgttttttgaggtttttttagttatgtagaattatgagtaaattaaattttttttataaattatttagttttagatattttttatagtagtgtaaaaattgattaatatagagaattggtattggtagggttgggtattgttataaagataatttgaaaatgcggaagtgattttggaattgggtaataggtagtggttagaatagtttggagggtttagaagaaaattggaagatataggaaagtttggaacgttttagagatttgttttgaatatttttgattaaaatgttgatagtgacgtggataatgaagtttaggttgaaatggttttagagatgaggaatttattgggaattggagtaaaggttatttttgttatgttttagtaaaaagattggtagtattttatttttgttttagagaattgatgaattttgagatgatttagggtatttggtagaagaaaatttttaagtagtaaagtattttagtggtgatttggttgattttgaaagcgtttagttatgtgtatttacgaagatatggtttgaaattggaatttaggtttagaagtgaagtagaatataaaggtttggaaaatttgtagtttgattatgtagtagaaaagaaaattttattttttggggaggaatttaagttagttgtagaaatttgaataagtaataaggagtaataagtaataataagtaaaaagtaataagtaataagtaataaggagttaaatgttaataattaagataatggagaaaatgtttttagggtatggtagagattttcggggtagttttttttattataggtttgagaattaggagggaaaaatggttttttgtttagggttttgttgttttgtatagttttacgatatggtgttttgtatttttgatgttttagttttagttgtggttgtaaggggttaagttatagttcgtattattgttttagagggtgtaagttttaagttttggtagtttttacgtggtgttgggtttgtaggtgcgtagaagataagagttgaggtttgggaatttgtgtttatatttaagaggatgtatagaaacgtttggatgtttaggtagaagtttgttatggaggtagagtttttatggagaatttttgttagggtaatgcggaagggaaatatggggttggattttttatatagagtttttattggggtattatttagtggagttgtgagaagagggtttttgttttttaggttttagaaaggtagatttatcgatagtttgtagtatacgtttggaaaagttatagaatgttagtttgtgaaagttataggggtattttgttgagttataggggcggagttgtttaagggtatgaaagtttattttttattttagtgtgttttgaatgtgagatatggagttaaaggagattttggagtttttagatttaagggttgtttagttgggttttagattttatggggtttgtggtttttggtttgattagttttttttatttggaataggaatatttatttaatgtttgtttttttattgtattttggaagtaattaatttgtttttgattttataggtttatacgtggaagggatttgttatgttttagatgagattttggttttggatttttgagttaatgttgtaataagattttgggggattgttgtgaaggtataattggttttaaaatgtaaaaagatatgggatttgagagggagtaagtgtaaaataatatggtttggttttgtgtttttatttaaatttaattttgaattgtaattcgtatgttttgggggagggatttggtgggaggtagttggattatgggggggttttttttatgttgtttttgtgatagggagtttttaggagagttgatggtttaaatgtggtagttttttttgtgtttttttttttttttgttgttaggtgagacgtgttttgttttttttgttttttttattatgattataagttttttgaggtttttttagttatgtagaattgtgagttaattaaatttttttttcgtataaattatttagttttagatagtatttttatagtagtgttagaatggattaatataggatagtaatgaagattatagaatatgtagatgaagaagtgttaagtaaatagtagttattattatgtagttaaattgaatgtatatattgtggtattttagtgttttttaaattgaataattagaaatttgttggtttttttaatttgtttatattagatgatatgttaatttatgtttatatttttttttagttaatagatataaatttatttatttaatttttattgatagaattggtagtgtggtaagatattttatttttagttaaggttgtataatattaagtttattttatttaaattaattatggtttgggaaatgttttttatgttattatgtatgtttaatttgatattttagtgggatagtatattttagaaaaaaataaatgtttttttaaaaattttagggttgaatatattagttagatatataataatgtattttagagtttttttaagggtaaaaatcgtggtatgaatatataaaatatttttatttatatttttgtatttttgaaatgtagtttttatgttaatttagtattttaatgattagtatgatattattttaataatttggaatgttaatatgtttatttaagatttaatatagtaagtatttaaagaaaaaaatggaagtgattgaatgtttttgtattttttaattataatttgtgttttattgtgatatgaaggatagaaggggtaggatagatagaaaatagaaattaattttgatgtttaattttattttaagattgtttgttaagtgatttatataattttaaaaaattttgttaagtttaatggatgttattttgtaggtttttgttaggtaatagttataaggttatgaggtgtatagattttggaattaggtagagttgaatttagatttaggtgttgttttataatgcgattttgggtaaataaaaggtttaatttttgtatttttatttgtaaaatggatttagtaaaaattatttgagataatttatttgtgtattgtatttaggtatgtagtttgatatatagaattataagttagtagtttttagtatgattattattgtgaaagagatattttgttttatttattgaaaattttttttagttttaaattttttatttaattggttgtattgtagatgtttgttatataatttttatataattttaaaaattattttttttttttttgattttttaggggtaaggttattaatgtttttattatttattaaatatagtagtttttattttttatttatggaggataggttttaaaatttttagtgtatgtttgaaattatagattatagataattttaaattttatatgtatattgttttttttatatatatatatttatggttaatgtttaatttattaattaggaagagtaaaagagtaatagtaattaataataaaataaaataattgtaataatattttagtattattatttttgtgttttagggttattattaagtaaaataagggttatttgaatataagtattgtgatattgtggtagtttaattggtaatagagatagtgatgcggtttggttgtgtttttattagaattttaacgtgaattgtattttttagaatttttatgtgttgtgggagggatttagggggagttaattgaattatagggtttggttttttttttgttattttcgtgatagttaataagttttatatgatttgatgggtttattaggggtttttttttttgttttttttttattttttttttgttattattatgtaagaagtattttttgtttttcgttatgattttgaggtttttttagttttgtggaattttaagtttaattaaatttttttttgtttttagttttgggtgtgtttttattataagtatgaaaatggattaatatagtaaattggtattagtagagtgggtgttgttgaaaagatatttaaaaatgtggaagcgattttggaattttggaggatttagaagaagacgggaaaatgtgggaaagttaggaattttttagagatatgttgaatggttttgattaatatgttgatagtgatatgaataataagatttaggttgaggtggttttagatggatattaggaattttttgggaattggagtaaaggttattatgttatgttttagtaaaaagattggtagtattttgtttttgttttagagatttgtggaattttgaatttgagagagatgatttagggtatttggtggaagaaatttttaagtagtaaagtatttaaaaggtgatttcggtgttgttaaaagtattttgttttaaaagggaaatagtataaaattttagaaaatttgtagtttgataatgtagttgaaaagagaaatttattttttgagaagaaattaaagttggttgtagatatttgtataagtagtaaggagtttaatgttaatttttaagattatggggaaaatgtttttatggttatgttagagatttttatagtagttttttttattataggtttagagatttaggaggaaaaagtggtttcgtgggttaggtttacggtttttatgttatgtgtaggttagggattttgtgttttgtgttttagttgttttagttgtggttgaaaggagttaatatagagtttaggttgtgattttagagggtggaggttttaagttttggtagtttttatatggtgttgagtttgtgggtatatagaagttaagaattgaggtttgggaatttttgtttagattttagaagacgtatggaaatatttagatgtttaggtagaagtattattgtagggtagggttgttatggagaatttttgttagggtagtgtagaagggaaatgtgggattggagtttttatatagaatttttattggggtattgtttagtggagttgtgggaagagagtcgttattttttagattttagaatggtagatttattaataatttgtattatgtatttggaaaagttatagatatttaatgttagtttgtgaaagtagtcgggaggtaggttgtaaagttataggggcggagttgtttaagattatgggaatttattttttgtattagtatgatttggatatgagatttggagttaaaggagattattttggggttttaaaatttgattaatttattggattttagatttgtatgggtttcgtaatttttttgttttggttaattttttttatttggaatagttgtatttaatttgtgatatttttttattttttgttttttattttttcggtttttgtatttggaagtaattagtttgtttttgattttataggtttataggtagaagagatttattagttttgttttagatgagattttggattgtggatttttgggttaatattgaaataagttaagattttgggggattattgggaaggtatgattggttttgaaatgtgaggatatgagatttggaggggttaggggtggaatgatatggtttggttgtgtttttattttaattttaatttgaattgtatgttttagaatttttatgtgttgtgggagggattcgggggtgggggtgtagtaattgaattatgggggttggttttttttgtgttatttttatgatagtgaataagattgacgagattttatgggtttattaggggtttttaaaatttttgttttttttttattttttttttgttattattatgtaagaagtattttttattttttgttatgattttgaggtttttttagttatgtggaattgtaagtttaattaaatttttttttttttttagttttaggtatatttttattagtagtgtgaaaataattaatatagatggttagtaagggattaatcggtagggagcgtttttagtgtggatatgttggataaagggatgatttacgttttagggtataagattttattatttagaattgtatagaatttaaaatttattaattatttttggaattttttatttaatgtttttaaattgtggttgattgtaggtatttgaaattgttaaaagtgaaattatagataagtggggagttttgtatttaagattatttttttaaattgttttagtggatatgtagggatttgagtgtgaagtgagagtagtagtattaaaatttgagggaaatttagatagtaaaagaaatttgtttagtatattggtatgatagagaaattaaaaagtttttaagttaatgtgagaatttaagaattaaagaattaagtttttgtttttgagggaaggaaaggggtaatgtggttttaaattaggttgagattggttttgagggtttttttttttttttttatattgatatgaatatagatataattgttttgtatttttatttgtttttataaatgtttttttaggatttaggaattgttaattatgtaatatgagatatttgttagtttgaggaatatttgaaaatttggttaaatgatatagatcgttatatagttttaagataaatgtttttatttatttgatttagtttggtaatttttatttgggtaaaaatttttatttgtaggttatgattggaggtaggtatagaaaaaaaattgttattttttttgtattatgttattaagatattaaattttagtttataaagtagaaagtgttattttttaagttgaaggtttggatatattttagttttttagttttgatattttattatagtggaaaatgaagaagattgtttaagaatattgatgttggtgttagaaagatttgggtttgaattttgattttattagttatttagattattttaggtaatttaatttttttaaattttgtttttttatttgtaaatgttgaaaatagtatttattttttaggtttgtggagaggattaaatgagataatttatataaagaaagagtttgtataatagtgttaagtaatggtgaggttatatttgtattttgattataattttataaatatttattatgttagttgttttagagtttttttgtaaaatagataaagatagaaagtataaataagaaaaataagtgaatatatattgaattttgtataagatgttggcgatatggagagatttaagatatgggttttatttaaaagagattattgatagaaataggatatatatatattaaaaggtaatataggattatttgtgtaaagtgttatatggtagtgttttaggaagtttagaagttgttatggattaggaatattatggtggatattttaggtagggaaaatagattttagtaaaagttatttttattataggtatttgataaatatttgtagaatttaggatttttgtagtgataaagaaattatatggattatgtaggggagtgataagatatatgattggaaaaataaaaagattaaattatggattatattgagtttgtattataaatagtggaggagttttttagatttttaattatgttgagaaaagagttttagtagtgtgtgggggatagaatggaaagagaagttagtgttagaaggattatttagtattaattattgtagtggttaaagtaagaggtgagagaaggtatgtattagaatggtagcggttagagtggatgggaaggaataggttttgatatagtgttatagggagtaataaataggatgtggaagatgggttagaattggtaaaatttttgtatgtaagtttgggttattaaatatagtgagagaaatttaaatttttttttaagaatcgaataaaatatttagaaataagttattgttgtatttgaggtgaatataaatggtattttaaagatgttcgagatattttgttggaaaaagttaataattgtattattgtttttaatatgtttttgttttttttgaagatattatgtttttaattttgaattatgaattatttattatttttgtatgtttttatgtgtgaggaattataaggtgggaataaaattcggtttttattttagaaataattatgcgattaaaaagtttttagtttttttttttattatattggtttttggtattttgtttattatttaatgtattattattgtttttgtttaaaattcgtattttttaatgtaagtttgagtaaatagaattgataatatatagtttgagaagggagtgtttggggttttaagatttattttgtttttttttatttttgatatttggtttgaagagtaaagaaggatatagttgttaggaagtaagttatttaaatatagtgattaaattggattaatttttttaatgagaaagaaatatattatttttgtgagatagattagattttaagtagtatagataatatgattatattttttttataaataaatatataggatttaagaaattttttatagatttaagtgtttttttttttatttttttatttttaaatttattttgtaagatatggttagtttatttggagttaattaaattaagattttcgttttatagatagggaaattaagtttagagatattgagtagtaggttattggtgttttagaggtttgaaaaattttttattgaatatttttttgatttattaatgtataggttttgttgttgtaattttttttttaagaggagtgaatataaatgatgtagagtttggatgaattattttaataagaatttaaagttgaaattaatgtaaattttttttaataaatgtaaagtaaagagaataattagtttttttttggtttgttaaataagataaaatgtgttttgttaaaattatttaatagaaatattgtgaaaggttttttttaaagtatttttttatttgatttgaaaattattttatagtttattattaaataaattagtaattttttagttaatgtagagataaatgggtagttagaaaatataattatttggtgtgtgtagttgagtatttatattttttttaatgaataaagataagaaaagtgtaggtgattttaatgtgtaaaaattattttttagtgttagcgttagagggaaaaagaaattattggtttaagttaattttgtatttgataattaagtcgtatagtttatggtttggttttagttttgttttgaatttttttttggatttgttttgaatggattgtttagggttgttttagtagtgtagttgttgtatttttaagtatagtttaggttttaaaatgtttttggttttttttttttttttttttttattttatgttgtttaaagttttatggttaggtttttttatttttagtattattgatatttgaagttggatatttttttgtggtgggggttgttttgtgttttgtaggttggttagtagtatttttcgtttttttttatttagatgttaatagtatttttttaatcgtgataattaaaagtgtttttagatattgttaaatgttttttagagagtaaaattgttttttgttgagaattattgtgttacggtgtttggataaaaattgataagttaatgggaatattttattggtagttgtaaaaaattaatttagttatagtagttgtatttttggaatttttttttatattaatatttgttttttgaggtgataatatttttgtttttttttttttaaatagattttttgtattatattgaaaaattgttgattaatttatttaaattgaagattaagttaattatgttatttgggtaatagtttattaattttgtttttttttttgttagggaagtttttaatttagtaagcgatattgtatttttttgttaggtatattattatttttattagtaatagggtaattgagattgagaaagattaaaaggttattaagttattatattgtagaattaggttatgaattgtagtttatttggtttagaatttttattttattagtttttataataataatttttttagtgtggtttatggggttttgggagtttttttttaaagggtagattatttttatagtaatacgtattttatttgttattttattatgttagtatttgtaataatggtataaaagtaaagatgagtaaaattgttggtattttagtatatagtagttattgtatttattgttatgtatttaaaatttttgaagaagtaaaaaaattattaattatattaaattttaatttttaaatatatgtggttttttttatgttagtgtgataaaatgagaaggtgtataatttatttatatcgtatatagtatttgatagttgttttaaagaaaagtgtataagattaaattgtgagttaatttatttttttttatggagtattatgagagataaattttggtttttagttttgggtatttggcgatgtttttttaaaaatgattgaagtaaatttagtattttaaggaaaataatttaaagtatttgttgttaattgataaaatataggttttaagtaaaaattagaatttttgaagatttgtatttgttattgtgagtttgataaatgtgatttttttatattatataatgaattatgttaatatttgaaagatttgtataatttagtgaattagtattttttagatgattaatgtatgataatataaaattatgtatgggtaaaagatatatttaaagtgtaagatagattgatatattttaatgtaataattaaaagtttattgataatagttttggattttatattgtaatattaaaatttttaaaaaacgaaattgtttaattttggtgtagtaattagaaaaggtaatttataattatttgaatttaagtttttggaggattattaattttttataggtttatggggaagattgtagtatttttttttttttaagattttttagaaaggaagaaggtaatttttgggggtagggtagagatttattgtgtgatgattattaagtatgtaataatgttttatataattttaatatatataatttatataaattttttaaaatggtattaataagggaatggatttaaagaagttaagttagttagttattgttatagttattagagtattggaattaggatttgaatttagatttgtttgtatgtaaagttgatttttttcgtaatagtattgagatataagaggcggttataaaatattttggtattttattttagattagagttttaaggttcgttattatttgtagtatgatattggatttttatagtgtttgttttttatttaggtgttaggaaacgtttgtttgaatgaatgggtgtaatttatttgtatattttatatgtttttttaggtgtgtgattaatttataatttatttatgatttttatttataattttttttgtagtaattgttttgtttgtaataaaattaagtagatatatttagttttatgtatggttttttttttttgaattttaatataaatttagttttaggaattattcggtttttattatatttgttattttgattgggaattattagtatttaggtatttatttggaataaggtattttgttttaagggttttttatttaaaagtaagtattttagtaatagtttataatggaattttttaatatttttagaatgtttggtatagttgtgagtgaatatatattgagtaattaataattattatagataatgatgtttttaagattaggatattttagtttttttatttaaagggggtgaaatatgtatttttattatggtatatttttggttttttttgttatgtatttttaataaaagatgttaattttatatggtttttttttgagttttaattattttgttgtattttagtttttttaataatattaaatttgtaattgaatattatttagtatttatttattttttttaatggtgtttattataggttattttattttttttatttgtatgataaaaattggttttttttatcgatgtttatggtatatttggtagttttttatgtatttagtttttatttgatgtagtttagaacgattgtttgaagggatgttaaaagtttgattgaggttttaaatttttagttattgtattattaatttatttgtttatttttatttttttttgttatttgtagtttatagttgagtggtttgaatatgttttgtatatattgtaatatttaagaatttgggaatacggttttaggatttagatttaatattattttttatttatataatatttatttataaaatttttagtgtttttgaaaaagaaaaaggaatatgtattgagtgtttgttagaagtaggaatttgtagtagattttttatgtgttattttatttttataatatatatataggtgatattttttttagtttattgatgaggaaatttaggggttaaagtagtagatatttatttaaggtaatagaagttgtgaagtggtatagttgggatttaaaatatgttagttttatcgtagataggttttttgatgaattatttgttacggttcgtatgatcgtatttaggggtgatgatgttatttttatagggttattgagagttaaaattacgaagtattataaattattatttaaaatataaatatatattatatatgtatatgtgtgtatatataattaatggggtaaatattatagaatattgttttaatttttaaataatgtattcgttttttgtaaattaatatataaataattgtttggtttttaaaaatagatgttaggtgatagagattggttgagtaagaataggagtatttttagaatagaagttagaggagtttttgtttttttaatatattgtcgtattatttattgttttaggatttttttatttttttggaaaattttggtttaaagtagtttttttatattagttataagtttttattaattaggggtggtttgtgtcggatttatagtagagttattttaggttattttgttataggttttcgacgtgtagttagtttattcgtttaaatttagtagggaatgaatgttttgtaatacggaagtatttataaattttttttaatagtgtttagagaataatgtgaaattttggggtttttttttagaattagggtggtgggaatgttgttttattgattaagtttgttaggtaagtaggtagttggtaagatttaggaagttttatttgaagatagaatttagggcgatcgtttggatttattggtttaattatttaaggtaatatttataaaagaaattgttattttattattattattttttaatttttatttttaaacggaatattagtaataaattatattatttgataaatgtaatttttaattagattgataattagaaaaaaattttaagttattttgttttgtgaattagtttaaatatatttgtaattgagatttattattgttattggttgaaataaataaaagtaagagataataaagaataatagagataacgaatatttaatttaagtttatttttaagttttattttttttagagaaaaggtaaattaagaaaagtttagagagaggtattagtatatttatgaatttgtatagatgataagtaaaacggattttaatatgtagaattttagaattaataggttgttagtatttatgtttttgaagatttgtttaagaatataattaaaaatggaatgggtagtttttaattataagtagaaggttataaaattattttagttgtataatatagttttggttttaaagttagtacgtaagaggaaaattttttaggaaaatataatattgaaaattattgtgttatgtaatatgaaatgtaataattaattttttttttagtaatagaaagattattgttttattggtttataaaaatatatttttattattaaatgtggtaaaatgttaagatttggtgaatattggtgaaaagtatatatttattgtataattttttttaattttttttgagattgaaaatttttaaaataataaattattttttaaatagttaataattattagatttgtattttttgtggtgagattatgaaaaatgttagagatttagtaagagaagtagatttatatttttgtttttttttttaagttaaatagttatagagtggagtgggtagaatggaatttatttttgaaagtttagtgttttgtttaattttattgtaagttagataggaaggttatagaaaatgtttttggattagttttttttgagttatatgaaattgtggttttagttaagatgatattaggaattagagatatgggataaaaattttaagattgtaaaaaaattttgattttagtaggaaatatgggtagaattgtaatgatatttgattgaattttaaaagatgtttgtataagattttaaaattaggaaaaaaattatggtttaagtaattaaaggtataggaggtatttttttgggatgatggaaatatttttttttttgattgtgatagtagttatatgaatatttatttaataaaaattataaattatagatttagaaaatagtaaatgttattgtatgtgatattttaataaacgtgattataaaaataaattttaagtatttaaaaaaaaaaaaaaaaagaagaagaagtgaattagaattatattattttattttggagatattttaaaagaaatgattttatttttaattttgtttaaagaagaatataatatgatttgaatatatttagttaggatattttagtgtttgttagtatttgaagttagagtttattgtgagtattttgattatgaagtgagaagttaagagaattgtattttgatatttttttgatagttaaattataatattgtttttttttttttttagttttagtatgagattagatgtaagtttttttttatttagttttttaatagtaataataggattattttttaaattttgtttggtgtgttttgatgaagttttaggatgttattatggagttttaatttgtggaagttgtaaagttttttttaaaagagtagtggaaggtagtgtgtgttttgaagagtttattttttttttatttggtttttattttttagggtggattttgaaatttttattatatgtaaagtttatgaaaggttaaatattagttaagaggggagaggagggtggtttttaggttttttaatgggtaggaaagtatttaaaataataatataaaaagatttagaataaaatagaaaagtataagttgatgtttgggagtttggttagggagtataaggtaatattataagaaagtgttattatatgaaatgatggtgttaagtttgggtataatataatgtttattgtattagaaatatgggttttaatttttataagttaataggttttaaagttattaattttattggtttggtaaaaatgagttatagtgagaattgtgataggaaaaaaaaaagatatttattttattttttatttattttttttttttattaagttagggtattgtgttaagtggtataaatattaataagatttgatttttattttttgggaagttatattttattgaagtgaaagatgagttaataatgataaggtatagagattataatatagatgagggagagagaaattcggtttgaggaggttaggaaaggtattttagagaaattgattttattatataaatgttgtattaatataaattttattttgttatggatttagattgttgatagggtaatagtattatttttttaaagaatgagaaatttattttatagtaaatttattagaagagagtttaaaatgttttaatattattagtgatttttttaggaaaaaaattgttatataatttagttatttttaaagtagtttgaaagtagtttggtttaaagttttgattatattaattttttaaagaaataattatttatttattgtatgaggattattattatttgttttatgttgtgtttgtatatttatgagagttagatgagttatttttttttgttttattttttaatatattagtaaattataaaattatttatattatattataaagattataaggatggtagttttggttagtgtagtagttttatttattgattagagttaaaagtaaagtttagttttgttttgtgtattgtttttaataaagtggatgttatttaatatatacgtagaagatagaagcgttttcgtgtttttattttattttttatttttttaattgtttaagtatttttacgatataaatgtagtgataataataatacggatagtttttgatttaacgattttttaatttttatgatggtgggaaagtgatacgtatttagtatggtttttcgatttataatggggttgtttttagataaatttattgtgaattgaaaatattttatatttagtattttatttttaatatttgttagaattatagattattttttaaaattggtatagtataatatgggtattagtaagttgttgtattttatttagagttttatattaggtaggggtgggttttatttttgattttaattaataggtgggattattatattagttaaagttggtatttttgtggtttttgtggagtaacgtgagtagtattataatttatattttttataataaatgatttaagagagtatgtgattaatgtagtagaattattgttttttattatttgattttatatgtaatatgttattatttttgttatattttattggttatatagattaattttggtaaaggacggaaagggattgtataagattatgtatttaaggaggtagagattattgggggttattttgggaggttggttattatatttattataaatagaaaattagaattatttgttaaaaatagattttaattataaaaatgaatattatataaataaaataaagttataaaattttagttgatttgaagatttatttttttattagttagaaagggaatttattaagtagtagaagatataggaattttaaaataagatattttattgttttattagaagggttgataggaaaatgggttgggtattgtggtttaaggaaaatgggttgtgtattgtggtttatatttattattttagtaatttgggaggttaagatgggaggattgtttgaggtttggagtttgagattagtttgagtaatataacgagatttcgtttttataggaaaaaaaaaaaaaaaaaaaacgttatttaggtatcgtatttgtagttttagttatttaggaagttaaagtaggagatttaggttgtaaagagttatgatatattattgtattttagtttaggtaacgtagtaagaatttgtttaaaaataaataaataaatgagttaaggaatgaatgaatggattgataggaaatgattattagttgtacgtggttatgtgttatgaaatagtgaatattagttaaaattttttattttatagataaggaatagatagatagatttgtttaattttatgttaataattataaagggttatttttaatttatgaaggtatattgtttttgattttatagtttagagttttagttgtgtataagatatatttgggataaagaaattaagattggcgtaatgtgtatattttgatattttagttggatataaataaaattttggaattttttatttttagtagtgggtgatttttttttttttttttttttagtaattgtaggatagtgatttagagattttttatagggtataatttttttgtattataattattttattaatagatgtatttgttgatcgtatttttgatttataggggatagaattgggttagtgtttttattttttgtttaagtaaagaagttaggatatttatagagtataaaaagaaattgaaatagttggtatagatatttggtattggagagtagttttgaataaaggtgaattatagtttagtggttaattttgtggtttattttttataaagaattgaatttgatatagttaattatttattttaaattattatttgtttaaaatataatttattggttgggcgtggtggtttatgtttgtaattttagtatatcgggaggtcgaggcgggtggattacgaggttttgagatcgagataattttagttaatatggtgaaattttgtttttattaaaaatataaaaattagttaggcgtggtggcgtgtatttgtaattttagttattcgggagtttgagttaggagaattgtttgaatttgggaggtagaggttgtagtgaggttatgttattatattattatatttttagtttgggcgatagagcgagattttattttaaaaaaataaaaataaaaaaatataatttattaaattgtgtaaaatatagtttattaaaaaagtagttatttttggtgggtattggttggaattgggtagaaagggggtttgttggggtattgttttgttttttgatttgagagttgattatataaaggtttttggtttgtaaaaatttattaaatggtttattgatttgtgtattttttttatatgtgaatattgtaataaggttttttattgtattgtttttagtttgttgaatagaaaaagggagattttttttgttgtttttgatttttcgattttataatggtaatgtaggtaagaatatttttttaaggtaatatttgtgggtgttttggttatattttatcggaaataaagatagaggttgtttttataaaatatgtttgaagatttgtgaaattttaatagtgttttttattttatataggatagtataattatttatgtgttggaaggaatgattgtattatcgataaaattcgaagaaaaaattgtttagtatgtcgttatcgaaaatgtttttaggttggaatgaatttggaaggtaatataaatatttgaaagtaattgtttgtttttgtagtttataaaaatttattattttatttttgaagatatacgtaagtagatgtaattaatgtagttagtttagtatatatatgtttgattagtataatgttattgtttaataaaaatgggaaattttttttatgaatatgttatattgtttgtttatttattagttttttttatatatattgaatttagtatagttagattatatataaagaaaggaaattatgtaataatgaaatttatataatatgtagtaattttattatttttatttttttttttagttttaaaattattttttagggttggaaatgtttttgtattagatatatttatatgtttatttttttgtttgttttttaaaagtatattttttatttggagatttgtgttttattatagatttttaagcggggggtggtgggaaaaaaaaaattttaaggaagaattggatgggttttgttttggtttttaagtaaagaagaaatttgggtcgggtgtagtggtttacgtttgtaattttcgaagtttgtgagaatttttttgtttagtttttatgtgaagatattattttttttatcgtaggttttaaagcgttttaaatatttatttgtagattttataaaatgagtgtttgaaaaattgtttaattaaaagaaacgtttaattttatgatttgaatgtatataatagtgagaagtttttgagaaagttttttggttttttcgtattttgggagattaaggtaggcggattacgaggttaagagattaagattattttggttaatatggtgaaattttgtttttgttaaaaatataaaaattagcggagcgtggtggtgttatttgtagttttagttatttaggaggttgaggtaggagaattatttgaattcgggaggtagaggttgtagtgagtcgagattatattattgtattttagtttggcgatagagtaagatttcgttttggaaaaaaaaaaaaaaaaagaaatttgaaattagttataagttagagttttatatttttgtttatataataagttgtataattaatattgattttagtattaaaaaatttttttttgaaaaaagtttggaattttgttgtggttgaaattgtaagttttgtgaaggtagtggtgattttataatatatatgtttagtatttattgtgaaattagtatttttatttaataaatatgtattaataaggtagttattaggtataaaatgaataaaatagtgtttgtatttaagtagtttatttgttagttaggttgtagagttagttataaaatagtatggtatattatagagggtatagggttataggaataagaggaaggttatttaattttgttttggaagttaaggaagaagtaatattgaattttaaatttataagttgagtaggaattagatagatgaaaaataagggtagagatatgattagatttgtattttataaagattaattttatatggagagattaattaagtgaatatggtagttttttagataagagatggtagtattgagagagaatggaaattatgtggttttttttatgattatgatgattattattattttagagatagagtttaatttttgttatttaggttggagtgtagtgatatgaatatggtttattgtagttttgaatttttagatttaagttatttttttatttagtagggttacggatgtatattattatgtttagttgatttttttttaatttttgttttaattttttgtagagataaaggggttttgttatgtttttaggttggtgtttaatttttggttttaagtgatttttttaacgtggttttttaaagtgttggtattataggtgtgagttattgtaattgatttatgtggtttttttgataggagagattaattgttggtgttatttagtatatattgtgtgtagatattttgttaaatagaaaatagatttatgggtatgattatgaagagtttaattttttaaattatatatataattttatttacgtttgattaggttatttaaatttaattgtagagtgttagtatgttaaatattgatttatataaaatgatagttgtttatttttttgtaaatgttataaaaattgtagagattaattaaaaaatgtatatagaagtttgtttttagttttataagggtagtttatttttgttataaaaatagtattttttatttttttagatattagatttttgtttagattttatttagttttattttgttgttttttaattttttatgtatgtaatatattttgattatttaaatatgtattaagatatttgagtttttagtgttttttggtttatttttttcggttttaattatttttaatttttatttttttattttatttattttatatttcgaaataggttttgaatgaagtttaaaggataaatttaaataaaattttgtcgtatttttaatatattgtggttgtttatttagtaatatttttaggtgtttttttgaatatatataaagtttaagatttttggagttttaagtatataatgtttttttgggtaatttttttttatttaaattatgagggtttttttttattaaaagaaaaaagatatattaattataaagtaatgattttgatggattaggttacgaaatttgtttattttttttttttttttatagtttaatagtaattgtagtgttttttgtttttattgtattagaagacgattttaggtagtgattgatatttgatttttttattaattatattattattgttatttttagttgaattttttgttggatattagaaattttttttatatgaataaaatttaagtatacggttgggcgcggtggtttatgtttgtaattttagtattttgggaggtttaggtaggtggattacgaggttaggagatcgagattattttggttaatacggtgaaatttcgtttttattaaaaatataaaaaattagttaggcgtggtggcgggcgtttgtagttttagttattcgggaggttgaggtaggagaatggtattagtttaggagttggagtttgtagtgagttaagatcgcgttattgtattttagtttgggcgatagagcgagatttcgttttaaaaaaaaaaaaaaaaaaaaaaaaaaaaaaaaaaaaaaaatttaagtatataatttaggttgtagttttttaaaatattgtattaaaaataattaattatatgtttttatagttagtataacgtatttagttagtgtagaaattggtatttgttgaaaattattatatgttagtttttgatatatatttttttattttttggattttgattattaaaaatatttttgaatagggttatgatttattttatatttatttttatattatatagtggaagaaaattttgatttgttattttttattatgatatgtatcgtgtggtatatattatataaatgatttaattttatttgtagatgaattgaaagaaaggtttaaaaaagtttttagggtttgtgtgtgtggttttattgtaaaattattatttttgtattgaattaattttagtatatataaaatttttatttggtttggtatgtacgtatgttaggaatttttggtagattttaatatttataatatagatgagttatgtgttttatattttttttttaataatttttagaaatatttttttgtttattagagtgttttttttaagttaagtagtttcgatgatagttttagaataattttgtttaagtttttttataaatgtaatttaggattttaagtggtgtatttttatatttttgttttatattaagtaaattttaagatttattttaagggagtggtttttattgtttaaagggtttagtatttaagaatagataagatttttaatggtgattttaaatgtttttttttaaaaaatttgtttgttttttttttgaaattaaatgtttttatttattttattttaagatatattgtaattaatttaaagtatggttttatttttagtataaatagttaaatgaagtttagttttgtggtattgttagatttataattaaatattattgaaattaatttttttaagtttaaaaatttaatttagtagttttttttttatttttaatttttattttagattttaggggtatatgtataggtttgttattaagatatattgtgtgatgtcggtgtttggagtatgattgaattttttatttaggaagtaagtatagtatttaataggtgttttttaatttgtgtttttttttttttatttttttttttgtattttttagtgtttgtttttatttttatgtttatgtgtatttaatgtttagtttttatttataaatgagaatatggtatttgtttttttgtattagtttatgtaggatattggtcgtttgttatatttatgttgttgtaaaggacgtgattttattttttttgtggttatatagtattttatggtatataaatattatattttttttatttagtttattgttgatgggtatttgggttggttttatgtttttgttattgtaaattatgttgtagtgaatatatgggtatatgtgtttttttgatagaatgatttatttttttttgggtatatttttagtaataggattgttaggttgaatggtagttaaatttttaattttttgaagaatttttaaatttttttttatagtggtgttattgtggttttgatttgtatttttttgatgattaataattagtatttttttatatgtttgttggttatacgtatgtttttttttgagaagtgtttgtttatgttttttgtttatttttaatggggttgtttttgtttgttaatttaagttttatataaattttggatattagggttttgttagatgtatagtttgtaaatatttttttttattttgtagattgtgatagttttttttgatttgtagaaattttttagttaggttttattgttaatttttgtttttgttgtagttttttttggggattagttataaatttttttttaaggttaatgtcgagaaggttattttttaggtttttttttaggatttttatagtttgaggttttatatttatatttttaatttattttattaatttttatatggtagtaggtaggggtttagttttatttttttgtatatggatagttagttattttagtattattaatggaatagggagttttttttttatggtttatttttattaattttgtgtagattatatggttgtaggtgtgtgtttttatttttggattttattttgtattattgtgtgtggtttttttttattagtattatgttgtttcggttattatagtttgtagtatagtttgatttggggtaatgtgatgttgttaattttgttttttttgtttaggattgttttggttatttggggtattttttggttttataggaattttagaatgttttttgttaattttgtgaaaaatgatattgtagtttgataggaatagtgttgaatttataaattgttttgggtagtatgattattttaattatattgattttattagtttatgagtatggaatgttattttatttgtttgtgttatttttgattttttttagtagtgttttgtagttttttttgtaaaaattttaaattaatttagatgtatttttaggtattttattttttttgtgattgttataaatgggattgtatttttgatttggtttttagtttgaatattattggtgtatagaaatgttattgatttttgtatattgattttaaattttgaatttttattaaagttgtttattagttttaggagttttttgatagagtttttagggttttttaggtatagaattataagtgaaaagagatcgtttgattatttatttttttatttggaagttttttattttttttttttatttgattgttttgattaggatttttagtattatgttaaattggaatggtgatattgggtatttttgttttattgtattaaggggaatgtttttagtttttgtttatttggtatgatgttggttgttggtttgttatatagggttttttattattttgaggtatgtttttttaatatttagtttggtgaaggtttttattatgaagagatgttggattttatcgtaattttttttgtatttattgagatgattattattttttttgttatgtggtgaattatatttattgatttgtatatgttgaacgagttttgtattttagaaataaagtttatttgattgtggtgaattaattttttgatgtgtagttggatttagtttgttagtgttttgttgaagatttttgtatttgtgtttattagggatattggtttgtagttttgttgttgttgttgtttttttattaggttttggtattagaatgatgttttttttgtagaataagttagggatgaggttttttttttagattgtttttttagaatagttttagtaggattagtattagtttttttttgtatatttggtagaatttggttgtgaatttatttggttaagggttttttttaattggtaggttttttattattgatttaattttagaattcgttattggtttgtttagaattttagtttttttttggtttaatttaggtaggttgtgtgtttttatttttatatatatatttattttaaataatggttttatatatacgggggttagttgaaaataaaaatgatatttttatagtaaattttattcgtttttttatttatatatatatatatataaattttagattttttaaagtttttgttttaatttatttattttttttagattgtttattttgtgtgtatagaggtgtttgtaatagtgtgaagattttttttatttttgtggaattttttgtaatgttattttttatattttttattgtgtttatttgggtttttattttttttttttttgttaattttgttagtggtttattaattttgtttatttttttaagtaattaatttttataaattaggttttaagttaattaagatttttttatttttattaagaaggaagtagtgttattatagatttatgaatatttttgtggagtttttgtattgattgttaattaattatatgttttaatgggttaggaatttatataaagttgtattaattaagttgttttaaaatagtgattgtttaattaaatgatttagtttagttaatttttttttgaagatattttgaaaaattaattagtattattttttgttttagttagtatagtatagttgggtttaattgtattttttgagttgtattgaaaaatattagtttttttatttagaattatatataagtagtgagaaattaattataaattgagttatagaaaatgtttttttttaattttttagtttgttatttttttttttttgttttaatgtggagtaaagaaatatgtattttaaattatttaaagttatgattaattgaggttgttaaagtattgttttagtgtattgatttggtatatgtgtgtttttttttatattgttaataaaagtatattttatgattttggattaagattttattgagatatttttggttgtttaaagagtttttttatgtattggtgttttttttttttaaaattttattatttttttattaagttgtgatatttaaatttaaaatattttaaaaatatgtttttttgtaagttgaggtaatgatagttgttatgtggtatttattataatatatgttaggaattgttttaagtattttatatatttaatttttataataattttatgaggtagggattaatattgtttttattttatagaaggggaaatgaagagttagggagtaatttgtatagatatttagttataatatggtagaattaggatttaaatttaaatatgttgattttaggtttttgttttttagttttatattatattgtgtttttaagagagtatggtaaattaattagtatggttttattatgattttgtttttattttgaattattaataaaaatttttgtaatttttagttattttatttagtatagaatataataagaatggaattattttattttaatattgtatattgagatatcgtttttattattatatttgttttttatagattatatggtgtgttattttaaggatagaggatttaaaaatgatttttaaaggtgatttatatttatttttttttttgtaaaatggtttgtatttttaataatttagataagtatattttttcgtgatataaattatattttttgtttttttttggaattttgagtattttttttttgagagaataatgtaatttttatttatttagttattaaaataattttaggagtatgaataagtttattaaaaagtttataggatttatgttgtagtttgagtagatggttttatattaagttaaggtaaaagataatttatatataatatgaaaatggttgttttaggtttatagagtaattaatataaattttttttataaaagggaaattttttatttataatttatgtaatgtaaagttttttattttatttttttaaatgtttttagttttacgtagtatttatgttagtatttatgtaaaggtgaaaagtgaattttttttattggtagaattaatattatttttagtatgtaatttgttgttatttttttatttttataagtggttttgaataagtgtaaatagtgtaattttttttattatatatattattatgatttagattaattttaaattatagtttgtaattcgttattttaagtttagattttttttttagtttatagtaagagtaatttgttttatataattaatgaaattgttgtatttagagtgaaagtgagataaaaaaataatttatagaagaatttataaaagttatttatttagattgttttaatatatcgttataatattttgtataaggaataattttaatgaagtttttggtttatttgtaggtaaaattaattgggaataggtttttttggattttttgtttttagaaaaaaaaaagttttttttttttttttatgttattttattataattgttaaataaaatattttttttattttaatagttttagaaagtaaaaatattttttgaataaattgtgtagcgtagatttttttattatagtttatttttatgtatttgtttaaatatttatagttcgaaaaataaagaaaaaaataaaaggaatttagtaggttattataggagttttataagaaatttttgaaaattttggtaataaaataatagtttttgtaacgttattataatttatttttattttggtgttattgttggaggttattgaatttgaagtgttatatgtaggatatgatagttttgttttagatttaatttggaggattatgattacgtttaatatgttaggagggcggtaagtgattgtagtagtgaaatgggtaaaggtaatattaggtaagatgtaaaatataaaagagtaattatataaatttttgtgttttttttagtaaaaatattttggtttttatattatcgtgagtttatggtttattttgttttttttagttttggggattatgaaggggagagttaggtgaatataggtgatagggagtttataataaaatatttatattattttttgttttttaaattattatgtataggatggtaattttatataggatgatgtaatattagaatttaagttataagatttatttaaaattttttttatattgaagtttggggaaagaaaatgtttttagttaattttatttgtttttttttattgtgttatttttaaaaattaggttgtttgtaagattggtaaatattaagtatgttgattgttaaaatttgtattaaagtagaatgattttaattttttattaaatgaaatgttatatattgaatgtaattttaaagataattttaaataaaagttattttattggaatttggtgtggaatggtagaggttaatgttagtgttagttttgattttaaagatagggaattgataagtttgtgtttacgtaaatagttagggagagagtaagaaagtaatttgattttttgttatttttgttttattaagggggaaagaggtgtgaatagtagggtaaatgttttgtttaatttattgattaatattttaagttaagatttttttttgttttttaaaattaatatataatagttgtatatatttattgtatatatttatatttagggggtatatgtaataatttaataaaagtatataacgtgtaaggattaaattagagtaattgggatatttattattttaaatatttgtttggggaatattttaaatttttttttttagttattttgaaatataaagtaaattattgttaattatagttattttgttgtgttattgaatattaaaatttattttttttaattgtatttttgtattcgttaattattttcgttttatttttattattattatttttttcggttattggtaatcgttaagttaagaattttggttattttattatttagtttatgtttatttaagtagatagaggtgataaaattggttttttttttttttttttatattaaaagttattaaaaagtatttagggggttgggtgcgatggtttacgtttgtaattttagtattttgggaagtttaggtgggtggattagttgaggttaggagttcgagattagtttggttagtatagtaaaattttatttttattaaaattataaaaattagtcgggtatggtggtatgaatttgtatttttagttatttgggaggttggtattgagaattatttgaattcgggaggcggaggttgtagtgagtcgagatggtattattgtattttagtttgggtgatagagtaagattttgttttaattaaaaaaaaaaaaaaaaaaaaaaatataagagggtttgtgagttttaaagtgttagatgatagaagaaaattgtgtttatttagtatttaatttttattttttgttaggggtgtttttgttttgatagggttaattgattttattgttttttggtaatttttatagagatgattttttgaagagtgttgttttatatttttattttttttaatttaggttttaggaatttatatttggatgattaaatgattttattgtagtatttttggatgttttttatggtatttgttttggggtggagattatatagataattaagtgtaaatttgttgtgttttgtttttgatttgattattaatgagtaagttgtatgtgtgttattttttttgtatttatagggtatttttaattagttgatgtttttttgattgattgttattgtgataatttaggattgaaataattttattaggtatttaggatttaggtaaattggaaatagagttatgagtgtttggggtaggataagtgtaatgtaaagtaaatgtatatgtggtattattattgttttaggatatgtttgaggatatttaatagtatatttgaggttagtaaagtttgtcgtaagtaataaggaattttattgtgatattatttatataattttattttagaaagaaaaaggagtatggtaaaatttatgtggatttagtggggataattgtagatgaggatatttaggttgatggggtgggatatatggatttagatataagaggtatttttttgtatggtaaggtttatttagtgtttgtggtttaagaatatgggaataaatttgttttgtttaattgagagaagattaagtttttaagattttataaattagttatttttttattttttaagtttatttttgtgtttgcgaaatattttaggtgtttatttttttttattttattgtagttgtttttttattcgttttttttttttagtgtaacgtttattatgttggttaatgtttgtttttttaagtatagtttgattgtattatatatttttttagtatatagattgtttttagtatttttttattgattttttagtatatattttgtatgattttagattttttagaatttgattttatttttttttttattgtttttttttatatattttttatttttatttattttttttagtatatttttagatttttggtgtttatattattagatatatagtagagaagttatattttagttatttttattttttattttgtattattatttttcgtatttttagtttattgttattagtataatgtaaatagggagtttatatatatatatttttggtttaagaagaataaaaaatgaaggagatttttgtttgtatagaaaatagaagttattttgatttttattgttaaaaagaggattgtttaaattattgtattataatgtaataagattaggtagttggatttaattttaaattaattggtaaatatatttagtttttggggaaattgaagatattattatttattataattttattatgttgtttaaaaaatattatgttggtagtatttgttttttagttattttttaatatgtaatttgaaggtatttaagtggaattaaaagtataaatagatttgtatgaaatattaatttattttggtttataaaattaatttaatttagggtttttattattagggtatttagatttagttttaagtagttatagtaaaatttaattatgttatatatattttttatataaagtgggatttataattttttttttttaatagatttatattagttttatttttattaagggatatgtattttttatttttgtgtttttatgttgttgtttaaaagatgggtagttttttattttttttttttttttttttttttttttttttttgagacgagttttattttgttatttaggtttaagtgtagtggtgtgattttggtttatggtaatttttgtttttagggtttaagtgattttttgttttagtttttcgaatagttgggattataggcgtattttattatatttggttaattttttgtatttttagtagagacggggttttgttatattggttaggttggttttgaatttttgattttaagtgatttatttattttggttttttaaagtgttgggattataggtgtgagttatcgtatttagttttttattttttttttttagtttattatgtttttatattgttttggtgtttgtgataggtagatattgtatattagaaagtatgtatttaagttttgattttttatagagttgttaaatagttttttatggttgtttttaggttagaacgttgtgggggaaaaaaaaattgttgttgtttttatagttaataagaatgagtttttatttattttattatattataattttgttgaaatttttagttatatgagtataattatgtataagaaattaaaggaaaaaaaggtgttttttagaaaaggagtgttttatttattattaaggattagggaggtgttttttcggtaagagtagattttaaatttgaagagtttttgattattttggtagtatataagttatgtttaatttattttatataaaggaataaattatatatttagtagagaaaaataataatttttttgttgttaagtttaagacgattttttgttagaaatttaaaaaaaaaaaaaaattttgaagtattttaaaagttgtgaattgggtttagttttaggtttttagtgttattttataagttaggaaattttagagatttatttgaaaattataggtatgtaatgattttagaattataagtaagaattggtttagtatttttagtttaaagaatattaaggtatatgtttgttagaggtagattttgagtattagaagtttagaattaagttttaggtttcgttttttgtataattgtgaatagtgttatatatttttgtttttaggatggattgttgtgaaaaaatttatttttaaaaattaagtgtgtaggatttaaaattgtcgtttaattgatcgtatttaaatgataaattttgatttaaatgagtaattagtaataagttttataagaattttaatattttaattaaataataaaataatatatggtatgtatgatagaaaataatatttttattgttatattagattatttattagtttatttaaatagttaagatgtaggaagtttaaggaaagttttttaaaattttgattttatagggaattagtaataatattattgtagtagttgtttttttttatgagtttatagttttgtaaaataaaataaaaatgtgttttttggggggaagtagtagtatttttaattaatattttgttatttattttttataggtagagaatgattttattttgtatgtacgattaatgtaaatatatgttgtatgttttttttgagttatataggttttaggtattttatgaagagtatttttgtatgaaaattttattgtttttttttttaggttggtagaatatttttttattttatgttaaaagtatgaaatatgaaggtttagaaataaaggttaatttatatatatagtattaataattatattaagtttattattattttttattagttagatgatttttatgaatgtaaaatattagaaaggtatagtaagtgatattaagattaataagataaataggtatggtagaaatagagaggtatatgagttgtatagggatttttgttgataagaatttgtgtagattttttttttttttttttttttgatttttgattatgggaagatatggaaaaagaaagttaattatagtgattttgtttattatattgttatttggttaaaaattttagttttttaatgagtattagtatgtatgagaaattatgggagaaaaaggcgtattttagaaaaggtgtgtttaattattattggggattggttaatatagtatgggagttggattgttagagatttattatttagaaaatggtaataagagtttataaaacgaatttttgtgagattattttttagttagtaaagataaagatgttttttagtaggtgaagtgataaattatgatatatttagatgatggaatattattgaggattaaaaagaaataagttgttaagttatgaaaatatatggagggacgttaaatgtatattattaagtgaaaaaagttaatttgaaagggttatatattgtgtgattttaattatataatattttataaaaggtaaaattgtgaagatagtaaaaaaaaattagcggttgttagggtttagaaggaagggagggataaatgtgtagagtatagaggatttttagggtagtgaaaatatttcgtatgatattataatggtggaaatatgttattatatatttatttaaatttaaagaatgtttattattaagagtgaatttttaattatggattttgggtgatgatgtgtgggataggaggtatatgaaaaatttttgtattttttttttaattttgttgtgaatttaaaattgttttaaaaaaagttttttttaaaaaaagttttatgaattagttggtattataaattttaggttattttaagtaaaaattatatattaatgtttattaaatattgagttaatagttgaatattttttttatatataaataagtatatttgtaattttttaaaaagttttaattttattagtaattgtggttttatagttgttaaataattgtaagttatggatgttgtataagattgtgattttatttaattattttatatttatttaaatatttttaaagcgtatatttattttaatgtttttatattatttttgtttaataaaaagttattttatgttaatggatataagaagtattaataatattttagttaaggtaagagaattcgataaagattattgttagagacgtttaatgttatttgtagcggtatatttgttaaagaagtgattaagtagttatataaaattttgattatagttttgattgatattatgaaggtataatttagtgtttggatattaataattttatttgtttaaaaaaaaaaaaaaaagaatggttttaattgtatatattttagattaattgagttatatgattttttttattgtaaataatattacgagttttttttgttaaaaaataatagaattataaggatggaaatatatattttaagatatagatttttattatgatagattattggaataggtatataattttttattaaaaatgttagattaaaaaaattaagaattaagtgaaggtaggaatttatagagataagtggaatttaagttaatttgttttttgacggtatttgtagaatttggtaaattagtaagtttagtaagttggggtttttttaagtttataattttttttaaaatgattttaataggtttttggggaataggtagtggtaggttatatgaataagttttttagtggtgatttttgggattttggtgtatttattattcgagtagtgtatattgtatttaatgtgtagttttttattttttattttttttttaattttagtttataaagtttataatattatttttatgtttttgtatttttatagtttagtttttatttagaagtgagaatatgtaatatttggttttttatttttgggttattttatttataataatggtttttagttttatttaggttgttgtaaatgttattattttgtttttttttgtggttgagtagtattttatggtatatatatattatattttttttatttattcgttgattgatgggtatttggattggttttgtatatttagtaagtttaaaaataagggatggaaatataaatgtagttgaaaaggtagtggatggatttaaaagtagaagaatataattgtttttaatgattgtgtatatgtttgtgtatataaattataagggaaatttgtaggtattgaaaattataataggaaaatggtaataaagttatagaaattggaaaagtaatgattttttttagattttttagagaatggaggttataggataaattattattttaaaatttagaagaatagataaatatagagaaatagttaagattagtttattgggaaaagatgttattgaagttaggaagattatggtaatttgggaaaagatgttattgaagttaggaagattatggtaattttgatgaattgttggaggttgagtgaggattagttttagagttaaaaatttttagggatttagttttagtgggggttttttgtaattttttgggtttattttataaaatttttaatttttagaaattttataaggtttttatggtgaagatgtaagaaaaatttttttttttttttggtaggagtagagggaaggtaaaatttggaaatacgtagtagagtgtttataataaaaggtttgttttgtaaggaaaattaatttaataggtttttatgtgatttgggggaaaggtaaatagaggattttagtttttttttagtttttttgttttatttttgaaagttatagtttagggatttagatttattaaaaaaaattgagatttaattataaagattaaaaaataatttttttttttttttttaatattttattattatataaatagggttttaggataaaataatagtggattataattgagagagttgtaagatataagttgtttaaggagtttttaggaaatttaaaaataatagaagaaaaagtaaataaaaataaggaaattagaggaaattgaagtttttagtatttataattatggtaaatattaaatatagtttagtttttagttagattagtatgaaattttatattaaaagtttaattattttagttttgatatattaattatgtttagtttttagtaaaaaaattataaggtatgttaaaaggtaagaaaaatttacggtttgaagagataaaataagtattagaagtagtttttagatatgatataaatattttaattattagatagggaatttataatatttatgattagtaggttaaaggttttaatggaaaaaagtagataatatgtaagaagtgatgtacgtagagagatggaaattttaaaaataaatgttaaggaatgttgtaaggaaatgtagaatgatgttgatgggtttattagtagattgagtatagttaagtaaagagttagtgagtttgaagatagataggttaaaggaaatttttttaaatttaaatgtaatataaatatagtagatattaatttagttgtattagtaattattttaaatttgaatgttttaagtatattaattagttatttttttaattaggaggtgaaaataaagtttgttattagatgtttattaaaaaattattagaggatatattttagttaggcgtggtggtttatatcggtaattttaatattttgggaggttgaggtaggtagattatagagttaagagattaagattattttggtttacgtggtaaaattttatttttattagaaatataaaatttagttgggggtggtggtgcgcgtttgtagttttagttatttaggaggttgaggtaggagaattatttgaatttgggacgtagaggttgtagagagttaagatagtattattgtattttagtttagtgatagagggagattttattttagaaaaaaaataataaaagtaattttatttttaagaaggattgaagaataataaaagtggtaaataatatagatatatttaaattgatatttattatgtatataaaataataatagtaataatttttttgagggttaaaaagtagaattaaagtaagttttaaggatgataattagaaatagggtatgtagggtatgtaaagtattaaattattgggggaagagaatatttaagaaaaataatttaaaagaatgaaagatatgagaggagggagaaaaaaatgtataaataagggtatgataataggaagtaatagataaggtatattagtatagttaaatttaaatatattagtagtttagttttattaaatatagagatggggttaggtgtagtggtttatatttataattttagtattttgggaggttgtgggtagattatttgaggttaggagttcgagattagtttgattaatatggcgaaatttcgattttattaaaattataaaaagtcgggtgtggtggtgtatgtttgttattttagttattcgggaggttgaggtataagaattatttgaatttgggagatggaggttgtagtgagttaagatcgtgttatttttttttaaattgggtgatagagggatattgttttaaaaataaaataaatgtagagatggattgaatgttttaagttaatttgataggattttagaaataatttaaatttatgttatttaaaaaaagttatatttgaataaagatattgaaaggttgaagtaaaaggatttattttgtatagtataatttaagatatggttaattttttttgtaaagggttagatggtaaatgttgttagttttgtatagtttttgttatagttattaaattttgtttttgtggtaggaatatagttattgacggtatttaaatagaataggtatggttgtgttttaataaaattttatttataaatataggttgtaagtaggatttggtttataggttaaagtttgttggtttttatattgattaaaataaaatcgaaggagttatattattattaagtaaaatagatgttaaggtaaaatattttttaaagtatttgtttaggaaaaataattgtaaatatatagttttaaattatataatataaaaatttatagaataagaatatttagataaatttagtaaaaataatgagattttattatattttttttataaattaagtagataaaaaaataaggatatggatgtatattttattttttttgggttaatattgaggtgtgagattattgggatataggttgagtgtgtgtttaaatttatttttaaaattgttaaattttttcgtaattgttaatatttattagaaatgtatgagattttttaagatttattttatattttttttagtatttggtattgttagttttttttatcgtaggtatattgatgattaaaaatattaagtatttttttatgggtttattggttatttatattttttatttggtattgtgttttttttaattttttgtttattttttaattgggttttaagaattgtttaaatatttttaatgtggttttttgttaaatatatgttttgtatgttttttttaagtggattatatttatagtttttttaaaaaaatgtagagatgagtaaaagtgtataattttgaagaaagtttcgtgtttttgtttattaagaaagttttgtttaatttagggttaaaaagattttttattatttgtttttttatagaaattttgtagttttagtttatatgtttaagtatatgatgtaaggtaagggataaggtttatttttttttttaaaatttatatttggttgttttagaatttgatttttttttttttattgagttatttggtaattttgtagaaaattagttgtttgtatatgtgtgggtttatttttagatttttttttttatttaacgatttgtattttttatttaatgatttgtatgtttatatttatattgataatattttgttttgattattgttgtattatagtaaattttgaaatttggtaatatgaattttttaaatttgttgtttttttttaaattgttgttttggatattttagtttttttgtatttttatttttttttttttttttttttttgagatggagttttattattgttgtttaggttggagtgtagtggtatgattttggtttatcgtagttttagtttttttagtagtgggattgtaggtatttattattatgtttggttaatttttgtatttttagtagagacggggtttcgttatgttggttaggttggttttaaattttgattttaggtgatttatttatttcggttttttaaagtgttgggattataggtatgagttattgtgtttggttttttacgtattttttaattagtttgataatttttattaaaaagttttttggggttgggtgtggtagtttatgtttgtaattttattattttgagaggttaaggtaggtagatcgtttaagtttaggagtttgagattagtttgggtaaaatgtcgaaattttgttattatataaaatagaaaaaattagttaggtatggtagtttgtgtttgtagttttagttatttaggaggttgaggagggaggttaaggttgtagtgagttatgattatgttagtgtattttagtttgggtaatagagtgagattttgttttaaaaatatagtttgatagaatttttattaggatagttttgaatttatagatttatttgaaaataattaatattttaaatttttaatttttggtcgggcgttatggtttacgtttgtaattttagtacgttgggaggtcgaggtgggtagattattaagttaggagttcgagattagtttgattaatatggtgaaattttgtttttattaaaaatataaaaaaattagttaggcgtggtggtatatgtttgtagttttagttatttaggaggttgaggtaggagaatcgtttgaatttgggaggtagaggttgtagtaagtcgagattgtgttattgtattttagtttgggtaatagagtgaggtttcgtttttaaaaaaaaaaaaaaaaattttagttgttgagaaagaataggaattttagttttggaggagtggggagattattaaattttttttttaaaaatattattaaaatattattgagtagagtatagttttataaatagttttttgtaaagagatttatagtatatatttgtttttgtaggttatatagtttttgttgtaattttttaattttatagttataataggaaagtagttatatatagtatgtgaatgtttgtgttttaatataaatttatttgtaaaattaggaaaatggtttgaaatggtttaagatttagttttttgattagattatggtatataattttttttatatatattttgaatttggtttgttaatattttgttgattatttttatatttttttttatgaaggatgttgatttataattttttttttttgtgatatttttttttggttttgttattagggtagtattagttttttaaaatgagttgagaagtattttttgtttttttaaagagtttatagagtattgattttatttattttttaaatatttgatatatgttattagtgaagttatttgggtttgtgtttttttttagggaagatttttaattatttgtttatttgttatatagatttatttagaatttatatttttttttgatatagttttgtaatttgtgtgtttttatgaaatgagttattttgtttgagttgtttaatttgggtataaagttgtttgtaattttttaagttttgtaggatttatagaggtgttttttttattatagatttttataatttgtgtttgattattttttttttatggttagtttagttaaaaatttattaattttgttggtttttataaagaattaatttttagttttattgaaatttttagttttattgattttttttttttgttttttatgttattgattattatttttttttttttgtttgttttttatttaatttgtttttttttttttagtttaaggtagaagtttttattgttagttgaagattttatttttttatatagatgtttaaagttatatattttttgtatatttttatttattttattttttaatgttttttatgattttttttattgatttatgtgtattgtttaatttttatatatttggggattttttatatttttttttatttatttttaatttaattttattgaggtaggaggtatattgaaggattttaatattgaatgattttaataagttttttgagatttttttaggtatttgtatatggtttattttgagtgttttatgagtgtttgaaaaaaaatttattgtgtttttgttaagtagagttttatgaacgttagttaggttaagttgattgatagattaatttaagttttttgtatttttgttgattttttgtttagttgttttagattttataattttgtttatatttttgttagagtttggtatggtttttttattatcgttattttagagagtatgtagttgatttttgtgatttgttatgtatttaatgattgtttatgtttatagtagtattatttataatagtaaaaaaaatttttattatatgtttttgtgttttaagattatatatttttcgtttttagttattaatatggtataatggtataatatattgtttaatttttgagtaattgattagttttttatttcggggataaattttatttggttatgatatagtattttttttatatatagttgaatttattgtattaaaattttggtatttttgtatttaaatttatgagggatatattttatagttttggtgttatgataatatggtattattttttttttaaacgtttggtaaaatttagtagtgaagttgttttggtttgtttggagttttttttgtagaaaggtttttaagtataagtttattaaatgtttattgataatatgtttatttttgagtgagttttgttggtttatatttttgaaggaatttaattgttttttttaaatgttgaatttattggtataaagttaagttatttataatatttttataatatttttttaatggttttagtatttttagtgttatttttttttattttcgatattggtatttaatatatttttgttttttttttttttttttaattagtttggttaaaagttttttagttttattaatgtttttatagaattagtttggttttgattttgttgttgtttatgtatgtttttagttattcgtttttattttttattttttttattttttttgtgtttagggtagaagtatatataattaattgagattttttttttttaattaaagtttttaatgttgtaaattttttaagtattgtttttattgtattttatatattttgatatgttgtgtttttagtattagagatttttaattttatgatattttatttaattatgatgttttatttaatttatagtttattaaatgttaaattttaaatatttgggtttttttttagatatgtttgttattgatttttattttaattttatttttgttagatagtatttattgtatgatttaatttttttaaatgtatttagatttgttttatgttttagattaatgttttgtgtatatttgaaaagaatgtaagtttttgggtagattgttttagaaatgttagttaaatttaagttttgtttatttttattgattttgagataaaggtgtttataatgttagatttgtttgttatatttttgatattgttaaatatttttttggaggtaaaattttttttttttttttgagaattattgatttatgtagttttttttttgggattaatttagttttgtttttgagatgtggtttttaggtttttattgaatgttcggtatatttaattagattttttttttttttatggttttaagggattttattttaagtatgtataaatttttatttagtcgaagattgtatagatttttggaggtttttttttgtgtatttttttcgtttttagtagtttgatttataaattgtatagatttttggaggtttttttttgtgtatttttttcgtttttagtagtttgatttataaattgtatagatttttggaggtttttttttgtgtatttttttcgtttttagtagtttgatttataaattaaagttgttttagtttttttaaattttaatttttttttttttaatttagtaagattgttagattttgggttttttttttttttattgtagtatgataattatttttaagtataaaggtttagaattaagattttttatttttgggttaggtatggtttatcgtatttgtttttttttttttagggattataattatgtattgtttgttgtttagttttttagtaggaggggaattttaggttgtatttattttttgtagttaaaagaggaagtaatgttagtgattttaatattaaaatattaaaaaaaaatttaagatggatgaaatttttttatatgtatattgaattgggttttattatagttatttttagaattaggattaatcggtagggaaaaaaattatacggtagggaaaaaaattataagttatcgttgttttataattttgtaataattagattttttgtagtatagtaatgtgtaaaattaatttattgttaatatagaatgtcgttattatttttgattaagcggtttttatttttatgttaatattgatgttttgtaatgttttatggaattaaatatttttatatatatttattagtttaattttaattataatttaatgaaaaagagtaggaaagatgtttaaggaggttatatttaagtttatatggtaagtaagaaataagattattcggttgggtatggtgatttattgtttgaaattttagtattttgggaggttaaggtgagcggaattgtttgaatttgggaggcggaagtggtagtgagttgagattatgttaatgtattttagtttaggtaatatagtaagattttgtttcgggaaaaaaataataataataagatttttagaagtttttaaatttatagttttttttttatattagtattttttaaaaatgttagtagtagtgaagttttagtttgggaaataatgtattttttttttttggagagtgtatagttatatttttaagaagtattgaaatttagaagtttgtttaatatgtattaaatatttagttttttttaaattttgattattaaattttttgtttcgttttaattatagttaatatagaattagtgtttttaggagtatattgtgaaaaatgtagtattttataaaagttttaatttttataggattaagtgaaattatgattaattttttgttttttgtttttattagtattattttttgaagagtaatgtatttttttaaaatttttatattagttttattaattagaatttatgtatataaggaaggatagatatttgttttttattaagatatatttattagttatattaaaaaaagtattgtatgtcgattttaaagttataattaattggtgatattatagatattttaagatataattgttggaataaatattgttgttgaagttttttatttattttagtattagaattaaatttaagtgtagaatggtagataaagttaattaaaaattattgtattattttatttggttttttaaatagttttgtgagttaaggaggagaaggtgtattattattatttttattttatagatgagaaattaagtgatttatttaaggttaagttttttaattttttgttattttgtatttttttttggttgtagtttaattaataattttaagaaaatgtttatattttagagtgtagtaagagtatataaataatgttaaatgtttattttgtatgtataaaaagttatagtaagaaatttggttgggaatggtggtttatatttgtaattttggtattttgggaggtcgaggtaggaggattgtttgagtttaggagtttaagattagtttgggtaatatagggagattttgtttttataaaaaaatttagttagatatagtggtttgtgttttagttatttaggaggttgaggtgggaggattatttgagttaaggaggttaaggttttagtgagttatgattatgttatttagatatggtggtttgtgtttatagttttagttatttaggaggttgaggtgggaggattatttgagttaaggaggttaaggttttagtgagttatgattatgttattgtattttagtttggatgatatagtgagattttatttattttaaaaaaaaaaaaaaaagaaaagaaaagaaaaagaaaattttttaattgattttattttaattttttagtttttaaggacggtttgaagagttaagagttatttgatgaaattagaatgatttatattaaagagttaggaaaagttattgttaagagggaaggaaattttagttagaattggtagcggttttattaattgataaaatttttggattttatgtatgaagtaagtgttaaatataaagttaaatataagagttttttgggataaagtatgttttgattagtgaatataattatatattagtagcgtttttattttcgtttttagtttgtggatgttggtgatagtttgagtttaatttatgaattttagttttgtagatattttttttaaggttaattatgaaatatttttttatttagttatgtgtatataaaattattatgttattatagaatttagtaatattgtttttaaaaagtatgattaatttattaaattagaataatgtattttttatatattatggtattatagtgatttatgaaataattttatataattttatatataattaaagaaatataaaatgtgttttgtacggaagtgtttattttttatttggggaattttagtgagattggtatattttaggttagataatttttttaaaatagaggataataaatatgagatgtttttattgattaatttggaagtttgattattattatatttttttttgtaggtggttgaaaatttttttaattattgtttttaaatatttttggataagattatgagtattgaatttttcgagatgttagttgaaattattattaattagatattaaaatatttaaatggaaatattaaaaaatttttgttttattaaaagtgattgttttaataagaatggttgttttaaagaaagtcgaattaatagtttttattgtataaattattagtttgttttgtagaggttttgttgttttattttttattgtttttatttgttgttttgttttaaatacgtattatatgtggtttatagagggttaagatttggtaatagaagtagttgagtcgttattattttttagtgatgggagagtagatggtgaaatttattagttaatatattttagaaattagaaattttaatatgtggacgtaatttttatagttaaagaaggatggtatttaaattattagtgtttaaagtttgtgtgatgaattttttttttatatttttttttatagttggttggatgaaattttttagattttttgttggtgtattttttttttgtatagttaggatagtatttttgatttatgtatggaaatttgaaaaaaagtttataagtgtatattagaaaagggaagttgtgttttttatagttattattgtttggttttaataattttttttatatttagtgaattacgtttgtttatttttttttatataattttttatttaagttattgtatagttgtttaagatgggtagttagttcgtagtttttttaaataaattttaaatattaattaattatttgtgtgaaaatgggttggtgtttttaatttgatggtatttagttattagaagattataaaaattgatttaaatttttagtatttttgttaaaaaaaaaaaaaaaaaagtttatattttgtatatatttgttttagtggagaattatataggttgtgtaaattaatagttttaattggtatagagtatttagtttagtgatttgttgggtaaattgtggatgatggttgtaaaagattaatttaaaaaataattattaagaggttttgtttgtatttaacgttttatttttgtaatggttatatggtaagaaagttggtaaattatttgttttttaggattttttgaagtagtttgtataattttttaaaagttgtgattttagataattagttgtaatatagttgagagatttttaattagataaagtaattttttttattaaattttatttaaaaattaaatttttaatatggtaaaaatggttagatatttatttttatatttttatttgttattaattggttaattttttttgatggtataggaaagtttagttattgatttttgtgatttagaattgtatgttagatatttatgtttgtaaaattatatatttttaatgtgtgttatagagtttaatataagttttgtgaatttttttattgttgaaaattattttaaataaaatagaagttgtagtagttttttttgtgtgtattttattaattttttgtaaatttaaaatttaatatatttattaagttataagaaatttgatttttatttaaggtggttaaattatttgtgtaatagaaaattgaaaatttaatattaaaaatatggaatttttaatatatttttatatttagttatagttttagatatatattatattggtatttattaatttgggaagggaagggttattgtagttttatatgtaatttattaaaatgattgtaaaatagtttgtatagtgtaaaataagaatgatttttagatgagattgttttattatgatatgttatatattttttgtaggggttaaagaaatgttgatggataatttatatgatttatagtttgtatatgtatttatataggtagcgatggttttagaaattaaatagtttgttttaggggaagagggagatggagattggttttgtgtgtagtgaaggttgttgaggttttgatttagtgagattatagaggaagttattttttgttttttattttgattattttttttattttaatagtgagtttgttagcgtaggtttagtttatttaatttttttttgtattaaagtatgtaaagtatgtaaataggagataggaaggtggtgtttatatttttaaaggtattatttaatagcgggttatttttatatatagtttttttttagtagttgaatgataatagaagttttagaagtttggtaatagtttgtatagaggtattagtaatatgtaaatagtgtagaattttataggttgttaataatatattaatttttttttattttataataagagtttatttttaaataaaatgaggatatgtttttgttttttttgaatgttttttgaatgttatttgttatttttagtattttggagaaattatttaataaaaaaataattatttgttttttgaatgttttttaaaagggaatgtaatattttaagatggtgtgtaattcggttggataaatttttggtgtttaagaaaattgtttgaatatttttattaatgatagtgttaagttttaaaaagagtttttaaaacgtagattattatttttttatagaatgttatgtggttaaaattagaaagtatattttatatattaatttgatttttattttaataattttggcgtttaaaaaatagaatttaatgagaaaaagaagattatgtgtatttcgttgttaataataagttaattgatgtttatcgataattataggaggttttttattaaatgggaaaagaagttgtgtttttttaggatacgtgggggaaaagaaagttattttaattatgtttaattgtggatttaagtgttatatggtggtgttgtttgaaagtagatttattttttatgtatgtgttatttggttattttaatttaaattgttgaagtttgtagtaattttagtgagagttggttatttataataaattttgaaaagtatttttagtgtttgtaggtattttgtgggatattatataagtagaattgaggtatttaggatataatatttttggggtatatatatttaaatgtttaaaattatgggaggaaattttggttattttaaaaggaaaattaatatgatttgtgtttatgaagtgttggataattagtatgggatgagttttgggtatgttatgaaggaaagttacgttttttttagaatttagaggtagggagtaattttagttttatttaagttttataattttagtttttttttaaaaattttgaaaattatattattatggaatgaaaaatattgttatataatatattgatttgttaaatttttagaattatggtagtttttagtgagatttttattttggttggttattttttgattgtagttgtaggtgaatgtgtttttgtgtgtgtgtgtttggttttagtgttagaagggaaataaaagtgtaaggaggatattttaaattttttgggtggagtttcgtaattttttagattatttttaagtaatttggtttatttaggattagtgattaggtttttaggaaaggatttgtttttttttagaaaatgtttgaaaggattttattttttgatgaaaggttgtatgaaaatattttttttaaataatttgtttaattatatatagatttaagtgtgttaatattttattttgtatattaaatgttatataatggggataaatttatattatattgtgtatggtattattaagaagtttttttattattttttattatagtaattttaaaatgtgtaaaaattaaaattagtgatttttgtttaaaaataaaagttgtagttttttatttatgttgaataataatttgtagttaaaaaaaaagtgtttttttatttacgtagtgaaatgttagattgtaaaattttgtgtggaaatgtttaatttttatttttttatttaaatttgttgttttggtattattaaattatatatttgtatcgaattggtagtaaatgttagttatttatagtaatgttaaatatggagaaatattataataaaaaaatttgtttttttattatgtgattttaatatgtttttgtagaatttgtatagtttcgattgtttaatttgatttttgtttattgaaagtagagttatttttgttttaggaattttaagataatatggtgggtatttaaatgttagtgtggtaatgttcgtttgttaatatggtatagatttaaaataagtttaattttggtgttaaagatttgaaga

SEQ ID NO: 194 - DNA, 67667 bp, Artificial Sequence
  Chemically-Treated DNA
ataggagtaggttttatcggttgttttgtggttagggtggtttttgcggttatttttgaagaagttggaagtaaggagatgaaggtgttgggtgtttttgtttttgttttttttgggtaatagtaggaggtttttatttttttttttattttattttatttttatgtatagttttagaaatcgggtattggattttttttatatattttagagttatattattgtaataaattagttaaaattttattttatagttaaatagtatagaagatagtttattgtataagtaagttgtgcgttaaaaataaatattaagtaaacgatagtgtaaagtagtttttatttagttttattttttcgttagttttgggatggttttatattagatgagtgtagtaggtgttatattttagtatgataatatgttataaaagattggtatttattattgataggtttatagtaatattatattaaaacgttttttttttttcgtgttttttatattagtgtgtttgtttagtataattttaacgtagttttgtaaataaggatttatttttattagtttaggttgtttgtatttattttgggttttatagatttagtacggttgtcgttattttttgttaggggatgggggatggggtaggaagagtaatttatttattatttttgtttttttaggattaggaagggttagtaatttgggatgagattataaagtgttgggtattgggaatttaaaggtgttttttacgttgatttgggattagttataattagagaataggagggaagaaattataaggataatggatttatagttgttttttaagaaggtatggagaggttttttgggtgtagggagttagtaattattttgaggagatggagattgtttttttagtgaggataggttaagagaaatcgtagtaggagggaatggaataggattattagaaggattgtttaatttgttagtgtgtttttggtgtatggttttggtcgttgtgataggttgggtggggatagtgtttttatagagataattaatgaagagtattttgtagggtagatttttgtatttatagaggtcgaggtagaaagttaaaatatcgtatgttgttagtttttatgagtttttttacgttttttttaagtttttttagggttagagaattttgatgtgagaatttatgtagtttggtttttgggtaagcgtttatttttttattttgtaaaatttaggggtaagattttatttcggaacgtagtgtagttgagttgcggttggagagttttttatagtgtttttgttttgttacgtatagttagtattttttattttttatattttgtttattttcgtttagttttttggatagatgttttagagttatagaggagagatgtttagcgttttattagcgtttttttcgtttttttaggggagtttgtggtgtaggttggtgggatgttgtttgatggggagtgtagttttttgagaaagtattgagattttaataattttatatttttaggaggtagttgggggttcgcgggggggagagggggcggggatgttgtttataattatagagttattataattacggaattatatttgtaagagattttgtgtttgaaaacgttagattaagtttttttttttaaaattagttttaaaaattgttttgttttttttttgtttttttgttttttttttttttttgtttaggattatttgtttttagagtataaaataggttatagataggtgtgtgttaggagtcgtaagatttggttggatttttttaggaggtttgggggatggggtatagtttggttggatttaggggggatagggatattgatgtttgatttaaaatgattttttattttaatgttttttgttaggatttatttatttggtttttttgttttttttataaatggaattatgagattatttaggggaaaggggattttttattttttttttttcgttttgttaagagaatagagagtggatgcgttgagttggtaaagtgtatggaggagtcggtttgtaggtgtttttttgggtttaagaatttgatgttatagatttattttttttggggtttgggattcgtgcggttgggggaaagttaatagttaggaacggaggggaagttgggttggggggattggtttggatgtgtttttaaattatttttgttagtagcgtgttgggttttgttttatttgtataatgaggggaatttcgttcgagggtggtgggggtgggggatattttttagttttgatttaaatttgtgtaaatgtagagggggttggatttaggggatgtaggggttttaacgaaggtgtaggggtcgggaggttttttagggtttgaggtttattttgtgggttaatgttgtttttttttggaagagagatggtttttgttttaggagatatgggttttatgtagtattgggtatagttggagatagtgaggttttttcgggggggtggtaggaggttgattttttatagaagtatgggatgagacggttaggatttgggtcgggggtagtatttcgggtcggggtgggggtggtaatttatgtttttgtataaggatgtggttgtatagatgtagttagaggtttttattagttgggattattttgggatcgagattattttggagcgtaggttttattttcgttcggagtttcggagtcggtttattattggttttgaaggttgttagggttttcgtttttagcgggaggagtttattagggcggttagtagggtcgttatacggttttatttatgcggtttggcgtgtttagggtcgtgggtgagttgttgtggttgtcgtcggtttttacgttattattttggtcgtttaggttggggtttatgaggttgtcggcggcgatagaggtagcgttgttggtgtaagaggttagtatgcgggtaggtgagcggtcgtttttattgttgttgtcggttattatggagaattggtaggagttagaggatgtttcgtagtagaggtggtagggggacgggttggtttggaagggttcgttttggttttgcggggttttcgggtagggtggcgggaggtaggtatggtggaagcggttggtggtcggtatgttcgttacgttgaggttgttgatgttcgtgttcgagggcgtggcgttgtaggggaaggtagttgatatggtttcgggataatgtattttggggtttgggaagcggtttttcgtgagggttggtagcgtggggaaggagcggttaaattggcgggggtcggagaatgggtttagtttcgaggtgtttggaggatagtagggaagaggttagttttagttcgagataattttaggagggttttttgaagaatgattttgggttttggtttttaaggtttatttgggggatttttagttttagatttggtttttttttttttgttttaggttgttcggggtttttttcgttaggatttcgaatatagatttgtcgggaagttggttggagcgtgtttcgggttaagaggggttatgggagtttttttatagtagtaatagaatagaggagggggtttatttttttttttaaatttttttttttagtttcgtagaggagaggtttaggatgcggtggtggggttgagggtagagttagtttaggttttttagtagttttgtttaggtaggtttttttttttatcggtttatgttaatagttgggaaggtcgtggatgtgtaaagggttttaatgatcgtgtgagattgggagttggaattcgtttttgaagataagaaaatggaggtagagagagagtaagattgagtttttgtggtagagaaaggattggtttttattataaggtttttgttggggatatacgtgttttttttgtttaggtgtagtacgcggaggttttgtgcgtttatatttgggttgtgggtattgagtttataggagttttggtttttattttattttgggtttgtgtttttggagtcgattcgtggttatatagtgattggatgttattttaatttgttttggtagtaaagtgagatagtagttagataaatttggggatttagattttaatttggttatagtgtttagtttagattttgtttttgtttttttaggaatgtggttttttaatgggttttaaggtaagggtgttttattttttgtttttaatttttgttattatagatttttaaaattttagtatttaaaggggtttagggattgagtttaatatttttgatggggaaattgaggtttagatagggtgaggtattttttttagggttatatagtatattggatttggtatataattttagggtttttggttttgagttttaatacgtatttgagagggagttgtttcgtttttgaggtagtataggattaaggtttattgtgtggtttttggagtcggatagttattttggtttggatatttattagttttgtgtttttgggtaagttatttaatttttttgcgtattagtttttttatataaaatatgagacgataatagtttattaggatttagttaatttatatcgagtatttagaatggtattgggtatagagtaggggtttatgaggttttgtaaggttattgtggttgtggtgttttttattttgggtatttaggagaattggtttatttagggttttgttaagttgaggttttggtgtagggttttttttttattttggtagtcgggggaggtggatgagtttttagtagtggtttagaggtgtagtttgtttagtttagtaatttttttgtgttatttattaaaggataagggtcggtgttagtcggagtgggttttgtttgttacgtcgaggtttggttgaggacggagagttatgagtttgaggtgtgtgtgatttcggttgggatttggaatttttcggggttttggggtttttttaagttagttggggtatgttttttttagtagcgtattttggttttgggcgtggattcgaacggagtgatgtttttggtttaaggtaagaagatgtggggatagtagtttgggtggcgggggttttttgggatatttgggatgttttttagtaggttatttggttgtttcggttttttgaggtcgagagttttcgaggtatttggttgttagtttttatttggggagtttttcggggggagaggttttgttgtaggtgttgggtacgttagtatagttgagatgggtggggtggaagtgggtgttggtcgtttgatgggaattttatttttaagacgaaggaaataaatggggatcgtaggatataacggtaggattgtgttttttagagtttacgcgggttgtagggcgttgggttgggtttttttggatttgttattattttttttagtttttttttttagggttattatttttttttcggggtggtgggggaagtatttgtttttagtatttttttagattttttagtagtttttttggagtttttgtatttttattttgcggtttcgtagttttaggaaattcgagttgttcggggtattgtcgagtggttaattttaatagtggaaagaaatgtttatttttttttttagattgttcgggttgttgtatggtggttgaatgagtttttttagttgtgagaagtttttattgtgggcggttgcggttgggggttggggttggggtatgggaggtgttggggtttttgtattgtttgttagtgattaatattggagggttaaagtatttaataggtatcgagggaagtggtggtggggtgttttaagggggatttttaggagggagttcgagggtagagggaggagggtttgtgagagtgattttttaagtttaggtttgttagtaatttttttttgttagggatttttttttttttattttatagatgagaaaattgaggttgagtttaagtgatttgtttaagattatatagttaatgtttggtagagtttgaatttttagtttggtttagttgattgtagagtttatgttcgttttgttttggttattcgaggtttttttttttatttaaaggggatgggtttgaggatggagatgtttggttgtttgtggtttagtgttgtggggggttagcgagggattgggttaggttttaggagggagtaggtagagaagtagaagttagttattgttttatataggttgggtttttttttttttagtttaggatggaagtagtagttgtgtttgtcgtggggttaggtattgatttttaagttgtgtttatttagtagtggatgggtagatgtgggttttttttttatgggggttggtggataggaagttattgtttattttattttttggattttggttttttcgttgagtttcgattttttggtttggttttgtttatggtagagaaaggttggtttttaggttattgtatttcgatagatgttggtttatgggtagtagaagtagaggtagttacgcggtaggggtgggcgtgagtatagcgtgtagggtttttttcgttattttttgagagtagatttttaatttttgggttcgagagttgagagttttaaatgtattagtttttgggtttagagaggttgggtttggggttttttttaattttggcgttttagtaggattaaggttaaaagttttgagtttaggttagaaggggaggggttttttttttatattgaaggtttgtatttagtttttggttgtagtattatgtttggaataatgttagtagagagatttagtcggtttttattttagcgtggtatcggaaaagggggtggggtaggtagatcggttggtagttttgttttaggtttttttatttgtttttttagaagtatagaaagtttttgggagtaggtattgtggagattgtggatttggttatagatgggttgtgtgattcgagggtggttttgaattttttaggttttttaatttatttatttgttaaggggttttaattaggttttggggaattgagaaagaatgggtatagttcgtgacggtagttagttgtttgtttttgtttattcggttattaagtatttttggtattttatttagtttaagggtcggttgtgtatatagttttttatgtttttagtttattgattgagagaatagaggagagatgtagtcggtagtcgtttagtgagcggttattatgcgttaggtatttcgatattttagaagatttgtttgaggtttggttgtaattgtgtttgttgtattcgtttaggtagtggagatggagattttagttcggtttttttttttattttagttttttttgtttgggaggatgttttgggtagggtgggagattttttttaggaatgttatgtgtttttttagggttggaatgttatttaatagtgtgtaaagtttgtgtgagtatagtaatgttatttgaatgttattttagttttgggtggaggtattcgttttaatttatttttagatgaaaaatcgtaggttgtggggtaggggtggggaaattgtatatggtaggggcgagtttgttacggttttttggataagttatgttttaattttaataggggtattatggggttaattttatttttttaggtatagtgaatttttggtatgtagatttttggggttaggtattaggtatgtgttagtaatgttagtgtttgttgagtgaacgaatgatggttagtatatagaaagtttataggaatcgtttgtaggtgttaatgagtattagtagtttttttataaaataagggggtgtagtgattgattttcggataggtttttggtttggggtagattggattatatcgaggttttttatttttattttatttcgttgtagttttttttttcgtgtcgtattttggattggggtttggggttggttgttgaagtggtttgtggtgttgagtgagtttcgggggttgggtgtgttcggtgttattcgtatgcgtagtcgttttaggtttttaaagcggttagggaacggtttggtttggttttttagtttttgtcggtgttttgtagagtataggaagtttattagtcgttgtttttttagagttttagtggagatagaaatgttttattttgttgggaagttttttttgaggtttgattttaggtttttgttgggagaattttgaggttatcgttagtttttttatagaggtttttaaaagattttttgaatagagaatggtcgttatgtgttattttatatatttaaatttttataatatacggtgatttaaatttttataatacgcggtgatttaaatttttataatacgcggtgatttaaatttttataatacgcggtgatttaaatttttataatatattgtgatgtaaatttttataatacgcggtgatttaaatttttataatatacggtgatttaaatttttataatatacggtgatttaaatttttataatatacggtgatttaaatttttataatatattgtgatgtaaatttttataatacgcggtgatttaaatttttataatatattgtgatgtaaatttttataatacgcggtgatttaaattttaattatacgcggtgatttaaatttttataatacgcggtgatttaaatttttataatacgcggtgattcgaattttaattatacgcggtgattcgaatttttacgatatacggtgattcgaatttttacgatacgcggtgattcgaatttttacgatacgcggtgatttaaatttttatgatacgcggtgattcgaatttttacgatacgcggtgattcgaagttttacgatacgcggtgattcgaatttttacgatacgcggtgatttgaatttttatgatacgcggtgatttgaatttttacgatacgcggtgatttaaatttttacgatatgtggtgatttaaatttttacgatatacggtgatttaaatttttataatatattgtttggtagaagaggaaattgagggttaggtgtagtggtttacgtttataattttagtattttgggagattgagatgggaggattagttgaatttaggagtttgagattagtttgggtaattatcgagatttttgtttgtataaaaattaaaaaaaaaaaagaaaaaagaaaaatttagttaggtggggtggtataagtttgtagttttagttattgggatgattgaggtaggaggattatttgagtttaggaggtggaggttgtagtgagttgattgtattattgtattttagtttgggtaacggaataaggattttagatttaaaaaaaggaaattgaggtaatagatatgagaaagtggtttatgtttttaagggaggtagggagataatttaggagtattgttattttttgttttttagtattttagtttgttttgtatattgttttttatgtttataagaataatgggaggtggttttaggaggggattgtaggtttttttagttttaagttattttgggatttttagaatatgtttttttttttttgggttttaggtagaaaaataattttattaggatgttgggtagaggtgtagggggtttgtatgagggattagatagttatttttgtttggaagttggggttaggggacgagatgttatatttggagaaaattgttagtattttttattttttatttgttagagtttatataggaagaattttagttttatattcgaggatttagaggtgttgggagggttaaggtggttaggtttttatttttttgcggtttgttgaggtcgagggatatttttggagtgatattaagtttgtagggatttttttcgttatatatatttttttaattattaattttatattttataagtaatacgtgaatatttataaaaataaaagtattatagataaggttttgtttatcgttttaagtttttttttagagtttttatcgtgattagtttttttttagatattttttattttttatgaatggaaaacgtaaagtaggttttttatggaatttttttgaatagttttagttcgggtgtgttattttgtaatttgtttttttagtagtatattttggagtttaaatttagtttttttatttgtaaaatggggatagtaatttagttttatagaaatgacggagtttttataaaattttggggattttttttgttacggaagggatttaataagtatggcgagaatgacgttgtttttttttttttttgttggttattggaggtatagtttatttcgtagttttttttatttatattttagttttttttaagttttttttttagtttttttatatgtaatattttcgggaacgtttttgttcgtattttttagtggttgtagtttttttagggttgattcgaggaaaggacggtttttttggaggattgtgtattttagggttcggttgattaattttaatacggttacggttattttattttacgtgatttggtgggaggttgttagttaggtagggtggttaggtttttttttataagtaagagaattgtaattgcggagaggcgaggaagtttgttggaggttatacgtcgaataaggggtgggattttttggatttgggattttttagaaaagatggaggttaggtatggtggttacgtttgtaattttagcgttttgggaagtcgaggcgggcggattatttgagtgaggttaggagtttgaaattagtttgattaatatggtgaaatttcgtttttattaaaagtataaaaattagtcgggcgtggtggcgggcgtttatgattttaattatttgggaggttgaggtaggagaatcgtttgaattcgggaggcggaggttgtagtgagttaagattatattattgtattttagtttaggtgatagagtaagattttattttaaaaaaaaaaaaaaaaaaaaatgtgggagggggtaagggggaggagaaggtttgtttaaggttttgggtttagaatgatatgtgcgttttttagtttggtagagggagaagaggtaagatgtaggtgggaggtaaaatagaatttattgcgttttttggggtttgaataagtgattgttggggattcgaaaagtgggaaaagtttgtcgattattgtagggtatgaggggatagagttcgaggtttcgtatgggtttgatttttgatttttagaatgggaacgtaatggattttggtatttgtaggtttttaagttttttacgtatttttgttggaagtttaaataggtatttgggagttttagaaagaaagtagggggtttgggagttataggggtttagttagttattaagaattagggagttttatttttttttttaatgaggttttagattaggaatttatgggatatttggtggtaggaataagattatttggtttttggttaggtttttattgttgttttttagggtttttggtaataaaggggaaaatatgggttgggggcgagtttagttggagttggggttgtaaatttagatgtttatggggatggggtaagttacgtgaacgaggtaagtgggatgggtggggtttggagcggatggggaggagatgttttgtggaaagtatttgattgttattttgaggagggtaggtttagtacggttagagtttttaattttagatcgagtttttagttttaataggttttggaggaaatgttgtttttgtttttgaggttattggaaatggtagggagatgtggatgagttgggggataagtgagtagaagaattttaataggtatgaagtttgtcgggtggacgtggggattatagattgattcgataatagtttgagtgtaaaggatttgggtgttttagttagttataagtttgaagggagttaatagggttggtgtaaaattttaggttttgttattttcgttataggagaataaagttttttgtttttgagttatattatgtataaagagtgtttatagttatttttgcggtttggcggaagagggcggggttgatagttagtttgggttcgaggacgggttttgttatttgtagtttggtggttttatttaagttatattttttttttttatttcgagttgcggtgtttttattatattgtttttgtgggttgaggtgttggtttaaggtgtggatattttttagttacgtgggttattattattatgattatcgtttttatttttgtttatgtttaaaggaagtagaattattatttttatgttggagatcggggtgtggaggttaggatgttgaagtcgtgtgaggaatatagagtttgagtagtaaggtaggatttatattcggatttttcgattttaagtttagggttttttttttgatatttttttttttgtttttattgtttagacggggttatcgaggttttattatgagatcgacgttgagcgtttgtttcgggatttaggttgtgggttaggtaatttgatttcggaatttacgtttttattatatgtttttttgtttttcgtagggtagatttttcggaggaggggagtttaatagtatttcggaaatagtttttttgttattgtggaacgttggagttattgttagggaggggagaggggagttaaggcggttttacgtggttagggcgttagagagttttagagttatagggttagggtttttatattgggaataggatagaagttttagtgtttgaggaaagaagatggtttttagaaaaagttttttttattcggttatttagagtaagagttgcgtggggagttttggttttaatttatttcgttattttgggtttagttttgttacgttttagttttttttttgtatagtttgtttattgaggttttttttttttgaaagtttttgatttaaggtagtaaagattagtcgttggttagaggggttttagaaagaaaagaaggtagggttgttggttttagggtttatttattattatttttttttgttgttgttgtttttagtattttttgaatattttttgttttttattttttagagttttagtttaggatagtttttgttagtaatgttttttgttttgtgaagtttagtttaggagttttttttttaggaagtttttttttttttatagtagatttttattatatttttgtaggttagggttgttttttaaagtagtcgttagtaggagtggaaattattaaaacggtagtagatgtttgttgggtgttttttttacggtagcgtttaagtagttgataagtattattttgtttcgtttggtagtatttttttgagtaatgtttgttattattttattatatgggtgaaaaaattgaggttttggatagttagtgagtttaaggttaagtagaagatatatagttatttgttttttttagagtttgtgaaaatatatttattgtggcggaagagggcggggtttatagttagtttgggttcgatatattaatagatgtatcgggattttataatagatgttagggtttcgtttagttttaggtttagagttgttatttgtaggtttaggaggataggatttgggagaggaagatgagaaggttttagtggattttattaggggtttttttttgttttgaagtttagggttgagagtgtaatttttaattatattttgttttagattattaagttattttttgtttttgggttatagtttttatatttgtaaagtggttattatattgtttaatttttgagggtgtcgatgagttggaggataggttatatgtttttaaaagtagaggattgagatggttggggaaagtttcgcgttggtttttagggtttgttttggttgttgttagtttttagttgttgggtttagattagatagtttttttagtatggtttggattagtgtttatgatttttatttatgggagggtagattttagtttgttttttttaagggtttagtggttttaagtttatattaggtagtttttatttattagtggttattgttttgggtaagttatttttgttttttgggttttagttgttttatttgtaaaatggggattatatttttaattttcgagggttaggaaaggttttaagaattatatagtttattaggttttggtttttgaggaaggtgttttgggtttttattttgatttggttatttgtttttaggtaaatagtttttttttgatgcgtttgtgtagtgggggtgatttattttataggtatatgataaaggttaaagtgggagtaggaatgttgggttttagttagtttggggatttattagggttacgtagtgtgggagttagaggattagggttggattttgggttggtagtttttttattattgtttttagggaatttttttttattattagtttggttagtttggggttttattttcgttaggtatttgatgtttttgggggaattaagagattattagggttatttttttgtttttatgtaggtttaatataagtttttgttataggagtggtaattattttagtaggtatttatgatgtgtcgggtattgtgtaaggggggttatgtatgtcgtttttaagggttatatttttttgataggttgtgattattattttcgttttatagatggaaaagtggaggtatacggttaaggttatacggtgtgtggtatttttgagatttaaatttggaaaggttatatatggagtttagttgttaaggttatcgttttttaagatttttatgagagaagagttgggttatttggtcgtaaggtttagttggtaagaggttagtttagtgtttagttttttgggaaaagtagagtcgggtagggttataggaatagtatcgtttgttggggatagtgtgggttttaatgattaggttcgttatttatttgaagttattcggtagtttttttggtcgtttggtgcggttgtgatttagatatagtagttattgtttatttagtagtagggtggggcgtcgggttcgaggtcggttttgcggtttgttaggagatttatattcgatttttaatagtttcgcggaatcgtaggcgggtgtcgggtttggggtggtttgttgtgaatcggttttttgtgagtagatgaaagtcgggtcggtggttgggtagggaaacgggttggtcgggggttagcgggtagggaggcgagcggtttttttttagggttgtaagtggggtttttagaggtttggggttgattaggagaatttaggaggtttgtggttaatttttttttttttgttgggtagatttcgttagttttgtttttagcgtaggagatatttttgggggttgtggggattttgggagttagggatttggagtagttgtttttttttagtttaggaagaaattatagaaattttaaggtttttaaaggtttaattgcgggtttagggttattttttttgtttacgttaaattttcggtagttatattttgttggttgtttattttaggtttttgtttaaaggttatttttttaggaggttttttcgttttattttttgttttattttttgtacgttttatttttttttttagttttgtttttttttataggattttttattattcgaaatgatattaatgaattatttgtttatttattaacgatttatggagtagttgtgaagggtttttgtttatatttttagggtttagttatattagggtttggtaaattagagtaaagaattttgtttttgtagagtataaataatagggggtcgggtgcggtggtttacgtttgtagttttagtattttgggaggttgaggtgggcggattatttgaggtcgggagtttaagattagtttggttaatatggtgaaattttgtttttattaaaaatataaaaattagttgggtgtggtggcgtgtgtttgtaattttagtttttagggaggttgaggtaagagaattttttgaatttgggaggcggaggttgttgtgagtcgagattttgttattgtattttagtttgggtaatagagtaagattttattttaaaaaataaaataaaataaaatgggagaaatgaataataaatgaaataaattatcggattagatagtattttagaaggtggtagtggtaagtgttcggggtaattttaaagttaggaaggaaaagggggagaggtgaggaaggttgtgtgtgtgttatttgaaataggcgggttgttgagaagtgtagaggttttagggtgtgaaggagtgtgttatgtatttgggggtgttcggggaggagtgttttagatagaaaaaagagtagtgtaaaggttttcgaggtaggagtgtttttggtaagtttaaagattagttaggatattagggtggttagagtaggatgtgggagggagggtagggggtaacgggtataggttaggggggcgtgagggttttttttttatcgtggtttatgttagatttgttaggtgttatcgttttttttgttgggattttggatttggtttagtaatttgttttttaattagtttttagtgattttgagggatattagtattgagaattttagaaatcgaggttatataggtaggaagttattaagttagtttttaaatttagttggttatttggttgtaggtcgggtacgttttgtagggtattagaggggaacgattcggttatagaatttatagtcggttttagggatttatagatttttagtttttggtttttaggattagtttttatttttattttattttatagcgggtttagattttagagggtcggaggtggtaaaataggaaaaaagtcgggaaaggaagtttaggagtataaaaggtttgtaataatttgtgaaggttgtgggggtattttttggggttaggtttcggtaaatttagttaatttttatagcgatttttttaggtagatattaatattatttatttgatagttgagtatattgaggtgaaaaggtttttttaagtggtttttatttttcgtagttttcgggtcggagtttttagggtgtgttgatagttattttgggtaaaaggttttgcgttttggtttttatttttttttggggttgtttaagagattagttattggggattttgtatagggtttgacgtaagggagggggttgtttagtgattaggagtcgttgagttggtttttttatttttatagatggggacgttgaggattcgaaaggttaaggatttgtttagggttaaagataaaggagtggggttgtaatttagggtatggggggggatttgattttagggttaggatatgttagggataggaataggtaggttttaaggatgggggatttagtagattgtttttcgattttatttttgttttgttttgtaaataaaattattgatttagtcgttgtcggggtttagagagggaggttatttgttttaggtggtgtagtaagtttggtttttgacgtcgtgggtttttaggtttagtttttgttttttttttttgttgtttcgttttgagttacgtatttattttttagtttattttagaaggggttattttaggtttgggagatttaggtagggaagagtaggtaggggattttgttggaattttttataggtagggttgagtttttatgtttatttaggggttttagtagggtagagtgggcggttttggggtgggttgggttgagtatggagggtttttagaggggttaattttgttcggttttttggatttttttattaagcgttaagatttcgtttcgtgtttttttttttttggagtggtttttttttttttggagtggtttttgagtgtcgtatttttatttagagtttaattgaggtttttgtttatgttgattttgtttttggagatatagggtagggttgttattttttttaatggagatttgatatttgtatttttattattaaggtagttatttagttgttgtttatgagagagtttatcgttgattaatggtggtggtgggagtgtaggaagggggttgggtattgaggacgataaaacgttgcggatttagtgatttatgggatttttttgtgttacggttacgtgttgtttatatgtcgtttttgatttttaggttcgtagggtgggtggtattattatattttatggaggagggagttgaggtttagagaggttagtgatttgttttaggttatattgtagataatagttttggttaaagtgacggattttttgttaatttttatcgttaagtgttttttatagattaagttattgttttttcgtaatagtattatgaggtagttgtttgtgcgaatattattttttagtttaggaaattgaggtacggagatgattagtttaaggatttatagttaggaaggttggtttggaaattgttttttatattatggtggtttatggtttatgagggttttttagttattattattttgagatttttggagttattgatttagtttttagatgataaaattgaggttataaagaagatatgatttgtttagggttatgaagtttaaggttaagggtatgggttggtttatgtttgattttagtaggagggaattagtaggagtgtggttagggtaagtgttggttgggagttgacggtgtaggtttgaggatgcgtgtcggggtttagggttggtagaggtgattttgagagttttggagggaaatttttttagggttgttggatttagttttaagttttttttaagtggttagatgttgggatgggtttaggaattggatgatggggtgttaggtttagttgatttttaagaagggaggggttagtttagggttaggttttttgttttaggttttttgttttaggtttgtttagtttagaattttgtttttgggaagattgaagtttggggcgtttttttgttttttgtatagtattaggttttatttaggtatttaatttttttaggtttggattttttttttattggaatttgggtgatttttttggttttgttgttattaagattttatttaatagtgattgttaaaaggttttttaaattataaagggttatatttttgagaaagagaggggtgggttaatttttagtgtattaagttgaaaatgttttggggaggtgggatggagtttaggaagttggttggttttattttatttatttatttatttatttagttagttagttagttagttatttatttattttgtggatatagagttttagtttatttttttatttttttagttttaatttgatttttagtaagtagagagaattaaatataaattcgttttgatggattagaattttttgtttatagggtttgggtgttcggattttgggtgatttgagtaagttatatgttaagatttaaagatttagtttttaaggaagaggtttggttttatagttagattagtttttgatttttgattatttttgttttttatgtattttttagttattcgtagagaagttgggggtagagtaaagtaagtttggtttaatttttatttagaaatatataagtattcgataaatgttatatttgaaagttttttttattttttttttttttttgatttttttagtagtttttatggatagttatttttatttttagttttttcgttggttttttacggttttaggttaagtttagagggtttaggggtttgttagtaggtacgtagtgtgtgggggtatagagttaaggattgtaatttttcgaggagggttttatttgtttgatttagttgttgtttttttcgtattggatttttttttttcgcgtaggggtttagggggttcggtggtatttacgtttgggttttcggggttcgtttacggttattttgatggttcggtggtaggtcgttatttgggtggggttggtgaatatagtgatggttagggtgaaatttttttttggggagagtggggaatagaggtaggtggttggtatttggagtttttataatattttgtttttttatttgtatttatttttggaagtttttaattgttaagaaggggtattttgttttttttgaatatgggtagaagatagggttttgggtgaagtttaagtttttgggtttggtatttaaggtttttgggggtttgacgttaattttgttaatttttcgttttatgtcgtgattattttggtttatgtttttttttttttggtttttttgttgttttttttatttagagatttatacgattttgtggtggggagtaggatgggtatattttattttttgaaagtaattggtgatttttgtagaaaaatttaagaatatataaaatataaataaagaagaaaagatattttttttttacggttttattagttggagatagatatcgttattatttggtgtttttttttttagttttttttgtatgggtttgtatatttatatagtcgtagtggtattaaaatatagatttttatattgtttttttttttatttaattttatattagaagtatttttttacgttattaaaattttataaatttcgtttttaatggttgtaaaatattttaatttaaggaagtttttttattttttatttatttatttttttattttcgggtatttatatcgttgttaattttttattgatgtgtgtagttggagttgaaaaaggattgatttgggagttgtagatattttttttgtagatataattgttatttttagaatgttttatttttagatagatatttggttttaaagtttttatttaaaatttttgagaggggaaaaaatttttaaaatattatttttttttttttttattatttaaaataaaatgaaagtgattttttgtttataaaaatttttgtttgtatttttgtttatttttttagaagagattttaagaagcggtgagtgattttacggtagtagagggttgggatatattacgggcgcggattttttttggagtgagatgatttttcggagagatttagtcgttattttcgcgtgtgaggttgcgttatattttagggatgtgtttattaagatggaagattttttatacgtttttgattttgtttgtttttttttttattattagtgagaatgaaattttttatatgattattatttattataatttaatataaattattgttttatgtttttttatttttttgtgaaggttttagtgttttttaaaaattgttatatattaagtttgttaatattttttatgttgtatttgtggttattagttttttcgggtataggtttgtatattttgtttttatacgttgggtggttttttatttttatttttatttttcgtttttttatcgttttatgtttagacgggttttttcgtgtagaaagtagtttatgaagatttattttcgatagttttttttttattttttatagtgaattttttgatgtgtttgggagtttgggggtttgggtaagagttttttttttattttattttttattacgatttatagttttatgttttatgagattggtggtcgggagcgggggagatttgcggattttttaagttagattttatttttttatttttgtttttggattttacgtataggtttgggaattttttgtgggtaggggttaatggtttcgtatttttatttgtattttagggttggtataggatggttaaggagagaggttgtttaagcgtatttttttggtgtttttttgatacgtttttaaagtgagtaggtaggttttaatagttttacgttgtaggtgggagatgaagtttagggtggagattagtattttatagttttttttgtatggtcgggtatttgttagttaattgattaagtgaaaattttagttttagaggtaggagaattcggaataaaattaaattagttaggttgttaggagttatgttataggatttaaggttttttgagatattagggggaatttaaagtttaagatttattgagtgttattttagttgggaaatgaggggtttttttggaagtttttttttaagttagtcggttgaggtagggatagaaattttgattgtatttgttttcggagttttaggttagaatagatttggttttttatttttaggttataggggttattttgtatgatttttggaagtagaagtgtagatggtttagggaagtgttaggtagatgtttcgggttttttgttcgattttttttattgtttttttttattttgaggttatttttttgttggattttttttttttttaattagtttagtatttttttggggtttttgagtttttgattttgttagtattgtttagtatttttttggttatgacggggagtttaggtagatagtttagagttttaggggttagattggagatacggaggattaatgggttttagtgttttgttatagggtttcgggtttatagtagtatttgaaagtttattaaaatttttttttaggtcgtttatttttttagttaggttttttttggttattttatttgaagtaggtatttttaattttaattaatttttttgagataaggttttgttttgttatttaggttggagtgtagtggtatgattatagtttattgtagtttggatttttcgggtttaagtgatttttttgttttagttttttgagtagttgggataataggtgagcgttattatgttcggttattttttttttttttttttttttttttttttttttttttttttttttttttttttttttttttttttttttttttttttttttttttttttttttaagtttttattatgtgtttaggttggttttgaatttttgggtttaagtgatttttttgttttggttttttaaagtgttgggattatagtcgtaaattattatatttggaaggtatttttaatttggtttcgtagagttgaatgagtttgagaattagggtaggaaaaaattataattgtattgtttttaatttttaattgaaatttagtattatttttaagtacgagcgtaggtaataaattatagaggtattattagtcgtatttgtgattttgttattaatagacgttatagatatttatatattatattatagttgttgtagattgttttaaatattttttatgtttattataattttaaaattatggttgttattaggtttaatgttagattttatttaatatattgaataaagtagtatatttattataatttttaaagtattttgttatgttttaatagaaatggtttttattgtaatattttgtatttgattttatattttaaaaatattattgttttgagaaaggtgtgcgggttttattagttattagaggggtttatagggtaaaaaaaaaaaaaaaaaaaaaaaaagcgttaagtagtttaatttgaagtattataggttttattattttttttttttattttttgtatttgttggaatttttttataatgtatatgtttttaataatttatttatttattttgtttttttttattagattataatttttttaggggtttaagtttttgttttgtttatgtagtgtttttagtttttaggacggtattcggtatagagtaggtgtttaataatatttgttaaataaattaagggtagagataatggtttttattttgtatataggtattaacgtttcgtttttgagaagtgagaagtttttatttatattaggtagtaaattatatgttatttttgaggttattagtatttttcggtcgtttttattagtttttacgtttgttattattttttttaggtataaaggagaggagtgtggggtttaagaggaggagtgagagggaggggtaggagttttggatttcgggagatagggagtttggggagtaggggtgggagaaagttgtttttttgagtgttttttagttatttcggttttgtttagttttttttttgtttggtagtggtaaatttatttattttttttttttagtttttagatataattttgtgtaggagttttaggtaaatttgtaatttattaggagtttaggaagtgtaaatttaggttttttgagggttggttttggttgtaggggagaagttttggtttgggaaatgggttttttttagggttttagaaatttttttaggatttattattaattagtcggggtggtagtagggttttaggtaagtttttgagtattttttgtttgggtttttatgtgtataaggttttcgttttatttataggagttgtatgggtggggggaggggacgtgttttagttttaggggatttcggggtttttttagttttagttaagaagttatttattttttttttaattagcggttttttttagtttgtatcggtatattgtatttcgaatttttgtcgatatatagttgttttttaattagttgattatagttcgagagtttatgtgttttttatttttatttaggttagtggtcgtttgttagaggggtatttttgggatttgtggtggcgtgtggttaatatagtgttggggtggtattgttagcgttaggggtggggtgcgtgtatgtggtgggggatgttagtatttaacgttgtttagggtggtgaagatttaattttttttgggagggaaaaatttgtttataaaagttttttggttggtcgtagtggtttatgtttgtaattttaatattttgagaggttgaggtaggaggatcgtttgagtttaggagtttaagattagtttgagtaatatagtgaataatatttttatttttataataaataattttaaaaaattagttgagtatggtggcgtatgtttatagttttagttattgaggtgggaggattgtttgagattaggaggttgagattgtagtgatcgtattattgtattttggtttgggcgatagagcgagattttgttttaaaaaaaagtaaaagaaaaaaaaattatttgagttatgaatttaatttagttttatataaaataagggttttttttgtatttttaatatttattgaattttttagaaggaaagatagttttttttttttttttaattttgtttagcgttttgttaataggtgttgataattttagaaagttatggtattggtagtaaggttaggtttagattgagttttgttattttgtttgttttttttgttgtgggtttttgtatggagggtattcgtttattttatggagttttgtggttttaacgtttatatatttaaattagtgttttattataaattattttttttttttttttttattatagttatggaataatatagtttgtaattgtatgtaaataggtaggttttattatttatatattttaacgtagaatagtaaggtttgatataaaatatgtattgtaagaaaggtttttcgtgtttggtagggtagggattttagttttaattattgtaggagatagtaatgatttggtttttttttttttttttttttggtttatatttttagttttgttgttaagagttttgtggtgttattgggtgcgtgttttttatggaaagttatttttttggaatttagatagaatgtagaattaaaaattgaggtaataagtagaggtttttattagattttttagttttggtagaagttaagagatttaggtaagggttttgggttttaatttttagttttaatttttaaagtgttttattttttaaagtggtttagattgttattgttaattattgattgtttttttaggtgggaattttttagttagtaggatgggtattgtagatgtgtgtttgtatgttagcggattcggtatttttttttttttttgttaatcgtttttattttttttatttagtagtttatattttttgggttttttttattttcgtttaaattatatagtaattagagaattagtggttgttatcgtttaaagggattttaaagtttttttttagttttaggtatttgaagtaataaaatttttaatatgtatttagtttttaatatgcgttagttgatatatttgtgttaatttttttaatttttttaaaattttatgaggtaggtattattattatttttattttatagatgaggaaattgaggtatagagtggttaagttatttgtttaatgttatttagtaagttattagtagagttgggatttaaacgtagggtggttgatattagaatgtaggtttttaaagatttcgagtttttgaaggttgaacgttttagttatagttttttagatatcggaatttttttttagattattttttgttttttaggattattgagattggttatggatttttgagaggagatggatgagagaatggtttataaatttagttttttgtattttttagagttatagttttagtttcggttatttttgttataaggataagtttttaattaacgttttggaaatttatttttttttttgtaggtttggggaggggggtttaaggtttgtgggtatgaaaatttttaaaaaaattatttttagtgtgtagaatggttagataaggtttcggtaatttagaaaatcgtcgttttttttttttttttcgttttttaggagagagagtgggaagggagaattaagtttttgatgttttgttgggtttttagatcgatagtattttttgttcgtttcgtaataggtagtagttatagtgtttttgatatatatttgggttagtagatttggttattgtttcgtagttagtagagtttattagttttgtttgttatcgattaaggattagtgattgtttttttagggttgggattaagtcgtaaagggtttgagagattggggatgataaaagggatttggagattaattaggagtagtaatgaaagtttaatttataaaagtaaatattttttatttattaatttgtaattagttaagggtatcgtttgaaagaaatttgtgtgtggggaagggagttaataggaataggaaatgtttgaaagaatgtaaattattttagttttataaaaagtaataagtaaatagttattatatgtaaataatgttttggttttaattaatgttgaaaagttaaaatatggttgatatttgtatgtatatatcgaacggttggaaaggaaaaaatggtgtttagatgtttgttttagagcggggttggtagtttagagggaattagaattttgagaaggttttgtttattggtgatgaaaagtacggttttgttttagttattttagtttgttgtggagttggggagtagagggaatttagtttattttttaataaagttagaggcgggtttggtgtttgggaagggcgatttttattttagttatttttcgtaggtaggttggttttaaagggttagtggatttttaggttttcgttttataggggtagggtttttaggatttttttatttaggagttaagtgatgatgggttttaggttttagaagttttttatttaatagttttttattttcgtttcgttttttttttgttgtttaaggtcggttagataggtagggtggtatattcgttttgattttggggtaggagatggtagttttcgagttgtgttttttaatatttagttgcgttagttttcgttttagattatttagggtttaaaggcgttgggaaattgggtttgggagattatagttggagagatagttttagagtgtgggggatattttgttttttatggagagagtggttggggtgtttgggttttatagattagggatttgttttgtaatcgttttgttgaaagatttataagttttttttttgagtttgttaatttattattttttgttagtattttttgtgagattaggtgtgtttaatcgggaaagagggggtggtatgaacggttttaggagttggtaaattttagaaattgggagaaaattgtttttttttggtaagagattataattttttttatttttttaaagcgatttgtaatattttataggattataaattgttgtttttagatagagttgtatttggagatttgtttttcgggattttaaggttttttttttaatttttttttttgttgtttttgttattgttaatgttgaaatggcgaggttttttttttatttatttcgtttattgcggtttacgaagcgaaggtcgttgaatttggttatttggttttttatgacggtcgaggtattgcgtagtttagcggagtagttttcgttattgtttgttattatagttattatcgtattattcggtacgttttttaatgttattatttgaagatacggggcggggggatgtagggggatagtttagaaaggaagagggtgattagggaaaggaggggaggggttgggttgggtagtttttttaggttttaggtatattgagtatttttttaatgtagggtggagaagaggtttaaaaataataaagatttttttttaaatattacgaaaataagaagatggaatttcgagtttttatattaaaattttagattaattgtttatataaattgtgttttaagaaattatttttttaatgaaatttaagttagagttgtgaattagtttagttattatgatgtggggtgtagtttttttgttgttttcggttgtagcgaaagaggaattaatatgtttttagtaacgaagtttttaaatgagaaagagtaataataataataataatagggttgttatttttatttaatttatgtaagagttgtttagggtatgaaatttggttttgaaatgtggattaggtttagtttattggtttttgtagagtttaaattcgttatgtagagaaaatgtagaatgtaaaatttattggtgttttgaaaaaggttattagaaaatttttttaaagtgagagtggggtttttgataatggaaggatgtatttgtcgggaattgtaggatgggggtggcgatgtttttttaaatattattttttttaaattttttatttttaggagtacggagaggcggatgttttttgaaaaagaattagattttaaatagagttataattatttaaacgtggtcgtcgcgtgtagggattggggatttatatggtaaaaattttaaggagaaaatgtttgggatttgattaagaagattagattttttgttaatattttgtttttttttaattttaaagattttttttaagttttaagtgatagtaaaattttcgatttgacgattaaagttatacgggtttttcgtttttttcggcgagattttttttattggtattttaagatgttattcgggagattttaaagagttatttttttttttttttttatttagagtcgttttaatgggagtagggacggttttagtttttagttatttcgggtagtattatttttagtcgtcggttttttttgttttgttttttttttacggtagttgtgagaggtttaggggaaaatcgaggcgttttcgttttatttcgttgtttttttaaaaaaatgaaaatgaaatagtcgtttattttttggtataaagaaaaaggttttttaaatggttgggggttgttagggttaggggttttttaattttaattcgttattcgggacgtataatattttcgagtaaacgtttggagagtagtgtttcgatttcggtttagcgtcgttcggtaaaatttcggaagttcgagggtgtgagtaggaagtttttgcgaagcggcgcgggaggaggggtgttggaggcggagggtaggtttttttatcgttcgtattttattcgcggtgtttttgtttttgtttcgggattttttttttcgttattcgtagggttgtatttgagcgattcgggttaggggggcgtaaaattttattcgtttattttcgtattaacgtttttacgtaaggcgttttaaaatttaggtggagcggggtaatttcgttaaaagttatttttgtagggcgtatttaaaacggaacgtcgaggtttcggagtcgagcgcgtagttagattgaatcgggtgttcgggtgtcgtcgcggcgtttcgggtattttttatttttattgttttcgaggttttggttttcgtagtttagacgttcggagttttagggtcggcgttttttcgtttcgggtttcgtatttattttgaaggcgacgggtagcgttttgttgtagcgttagtgcgagggtagtacggagtagaggaagttggggttgtcggtgcgtacgagttcgtttgcgtggttcgttagtacgtttattatcgagcgtatttcgggtcgggcgcgtttttcgggttttacggtcgtttgcgcgtttagcgcgtcgttgttttcgtttattttgtcgtcgtcgtcgtcgtaggggaaggtcggggagggaggtgtgaagcggcggttggtgtttgggtttacgggaatacgtataatagcggtcgttagggcgtcgggtaggcggagacggcgcggtttttttcgggggcggtcggcgcgggcgttttttcggtcgtcgttgtcgcgagaagcgggaaagtagaagcggcggggttcgggttttagggcgtagggggcggcgttcggttattattcgttagggttcgttcgttgcgaggtttcgttggttcgacggtcgttcgtagtttgttcggttagtttcgtattttcggcgcgcggtttcgcgtgcggtcgtttttcgtggttgtttcggttgtttgggtcgcggcggggttcgcgcggggttgtgtcgttgtcgtcgtttttcgtttcgaagttcgttcgcggtcgtttcgatttcgcggtcgtagttttagaataaattttttagaattaagtggcggggtcgcggtcgttcgcgcggggttagtattttcggggttcgcggggcggggttggcggagcgacgcgtcgtatagttaatcggcggagtttttatcgcgggtatttcggtggcgttcgcggggaggaacggggtttgtcggaggtcgtttaacggggaggggcggaaggcgttatttcgcggaggaggttttagtgttatagtttagggttttcgagagttttgggagttcggggtaaatgttagaaatttgtttagaacgttcgggttttacggaaggcgtttttgtcgttttttttcgggtcgtagttttttgacgttggggcgtaattttttcgtttttttttttcgttggtcgcggtcgggtttttttagtttttgttgtttcgggtttgtgatttttgtaatttcgggttgggggtcgcggggttttagggtcggtgacgtcgtattgggagtcgttttaaagaggttatttatttttttcgtttcgtatattattttgatttaagagtttttattttatacgggattttgcgcgtcgtttacgttcggtcggcggtttttgttgtttttagttttgcgcggttttggttttagtttcggtggtttttgtgttaaatcggggataggcggaagggagttttttagggattttaagtagtttggggttaataattttttttttttttgttttttttttaaaataagttttaggattttgtaggtttcgcggcgtcgtttttcgttgtggcggtttgtggttttttgaaaaatacgacgaggtttgtaaaatgcgttttttttttttttttttacgtatgtaattacggttttgtatcgtgaaacggtacgcgcgtcggtggtaaaagaaaaatagtagtggttgtaaagttaagggttttcgtttttagaggagagaattttttttttttatgcgggtggaaagtggtttttgcgggtttaattttatttttttttgggttcgtgcgtttcggttgcgtcgtagggatcgcggatagtttcgttaaggtattgtttgttcgttcggtttcgggttttcgtttttatttttagtcgcgtggtttaattttttttgggttttattgtaaattatttttttttttttcgttttttaagtttgtcgagtagatttaggggtcggttatagttgggagggtaacgggaaagattaagttataattatttcgaattatcgttttagatatttttttagattttggggaacgaacgcgtgttgagttttttcgtcgttttggagacggggttagattttcgttgttttcggttttcgataggtgtaaaataatgaattttaagtttcggaagtaaagaagtttaggattcgacggtggtcgtaagattttattatggatttgatttttgtttagcgcgcgttatttcgtcgttgttaaacgaaattaagtttcgcgtgcgttttaggggcgaaggattttggatttatttcgattatcgggagagttggtttttatttatttcgggattttatagtacgtttttaggtcgtgtcgaaaggaaggacggtaaaggttttttattgaattttttaagagagtttgcgtttggtagttgtcgattgcggatttaggttcgcgcgttttcggacgcgttggtacgagtagtagaattagaggaaagcgagtgatttagtttgggcgtttttattttcgggaacgttttcgagaaggcgtagcgcgtcgtggttaggtagggttttggtcgggggcgggtaatacgtgttgttttcgagtaggttgcgggattatgattcgttgttttaggtggtggtaaattttatttgtcgaatggtttcggtttgtatcgtgttttttgtttgttttttcgtttgattttttttttttcgtttacgatgggtttatagataagtttttagagaatgagggatttttgtgggttttggtatttggcgtagggttcggtacggtttcggtttttcgtagggcgttggtttttcgtgggtattagatttaagggattagggcggcggggggagggggggcgggtgtaggtttttgggtttttagattaaggtcgcggggtcgtttggtaggtatagtggcgggagtcgtcgttagttggcgttcgcgttttgttagtcgcggaggtgcgggttcggtcgggttatagatgcgcgttagttgcggtttcgggtgtaggcgcggcgatcgttttcgaggagttgttttttttttgttatttatgcggttaggttttagataaatcgatggttttgtgttaaattaaggtcgttttttttatttttgataagatggacgttttttgttttcgcgtttttaggtattcggggaagatttatagaataggttagtttgtttttaatttttatttgttttttttttatttcggatcgataaaaattgtcgtttgtttgatgggagggagaatttcgatttttttatttggggtatgtagatattttcgtttttttttagttggtatggatcgtcgtttttttttttttttttattagatcgatggataaataggttagtttttttttagtggtttttatttaagagtattttaagttgtttatagtagggttaggaagtagaaggttaggatatttttttattttattttgatttagagttgggtaaatttagaatttattttcgggtaaatagagttagtttttttgttttaggaaggggattcgtttttttttggtatttaggagtgttttttaagtgcgtttttggtagtgagggtgtcgtttttttagggtaggtgtgatttatgtggattttgtggcgtttgggtagggatttttaggtatattagataaggggtaggtgtgttttgggaaatcgtttaagaggtttatgggttatggaaggagttggggtttatagtttttttgtttgagcgtgttttttttttttatttatagcgttttagggaaagttgtttaaatttttttgagttttattttttttatttgtaaagtggggtatttatagtggttttttatagaattgtgtgtaaagtgtttagtataggtttggtatatggagggtgttttagttttcgggagttattattgttatgaaaaaataagattttttaatttttgttgggggtttttgatttattttttttttttttgggttttatatttttatttgtgaaatgtttagtttttatatttaaagtttattaggattttaagttagtttatgttgttttgattttttaattcgtttataggttgtttgggggaggtaaggattggttgtgatttatttttacgtggagttagtttatagcggggtttttagtaattattatagggcggttagagttgggtttcgatgattgtttgtttgattattttttttagaattttattttcgtttttagtcggtcgtttttttgtgggtagatttttttttgagtagtaattgggttttagcggatattgttagggatttcgttttttttttaggaggtttttgttttttatatttcgaattatataggagtttagtttagcgaagagagtagaggatttttttttagaattgaaaattttttttagtttggttttaaattttttgtttagagggattcgtggtgaaatttattttttgtttagtgttttagaatttaaaggggatatttatgttttttattgagttttaatttttttttttgttaatggaggttattttaattattttattttacgggagggggattaaggattttttttaggaggggaggggtattattgtgattgatgatcgattgtttgaagaaatagaaagaaaatgttgttgagtaaattaggatttatttgtattttgattttagataatgatttttgaatatataagcgagaaatgttaatgaaaaatggtaatatatttgggttgaggggttgttttttgtaggtcgggggtttagttttagagagtttagttttggggttatttattttgggtagtttttttggaaggatttagaatgtgtgggagtataaatgtgttttttaaattatagagatttttttttttttttggaaagttttagatttggaggggagggagaaggagtaagggagagtagggtggtgagggtgttaggatttagatgttgtttgtgcggtttgagatttttgtttggtgtttacgtttttttgagttttggttttcgagggtaaaatgggaagaatagtaatagttgggggtgttgaggttttattttgtgttaggcgtcgtatatgggtattgtttatggtatttaatttttacggcgttatatgtggtaggtgttatgtttatgtaagtaaagaggaacgttgttcgaggttagttaggttagagagggttagattcgggttaaaagtttgttttggtttaaaatgtggggtatgaacgtattatttggttaagtatgttagtattttttttttagtggttgagtaatgggaagagttagtatttagatatagaggaaagagttattgtgatggggagagggagttgggtttggtaaattttgttaagtagttttgggtttggaaattagtaaattttttaaatttgtagggagttaggaaggatttgttagggttattcgggagggttttgtgatagttaaggtgtatttattatttgtttttttttggttttagaattagtttgcgaggaggtaggattggtagtagtttttagtttatagatgggaatattgaggtttagaaaggggaaagggcgtgattaggatttggaatgagttttagtaaggttaggagtaagtatttcgaggtaaaacgtagttggataggatttttgttttgtaggagattgtagtttagttttgggttttatatattagtattttgatgttatatttagtgtttttcgtttaggggaagtgttaattagacgtgtttttttttgggttttagtgtttgtatttgaatgcgggggtgtatttttaaggtttttttatatgttatgcgggttttataggattttagggtttggttgtgattcgaggttttttttttttatttattttttttttatttttcgcggggcgttagtttttttgcgtttatatgatttcggatttttttacgtttatttttattttgttttgtaggtgggtggttagagggtgttttgttttgaggatgggagagagaaagggaggtaaggacggagaaaagagattttttttgcgggagcgtagagtagaaaaatcgtttttatcggttattagggaaggggtttttggttttagattttattatttggtggggtttttttattattttttttgttattcgtttttgttatttgtaaattagggaaatatttttggaagatagttatttggtttgtgattttgattattggtttatgattaataattgttttaattttttgaatatttgtcgtatgttgggagtttttcgttaattgtcgtttatttttaggtgtttttgaagggtagagattttattttttttattttatagatggggaaatttaagtttcgaaagtaaagagttttttttttgtgggttttagaatttgagaagtttaaataggtttttaggagtttttttagtattttatttttcgattagggaggggttgtttgtattttgatcgttgtttttagcgtagagttttttatttaaagtagtaggtgcgtgtagagttatttgttagtagagttattaaatacggatttttttattgggagttatggagtggtgagagagatttgggtagtttggagttaagggggtttttgggaaatatgtgttttttttttagggtggggtttagttttggcgggtagggagagaaagggtttttttgagtggttgttgttttatatatatttttgttttatagtatttttagggagtagcgatagttattatttttattttataggaaagaaaattgaggtttagagagtttaagtaatttgtttaagttggtattattgggaaattataggggtaggattttaacgaggtagtttggttttagagtttatgttgttgtttattatattttatttttgtggattaaaattagatgtttagagttatagttatggaatagaattagaattttggtagaagaattgtgggtaggattcggaattttataatgttagattcgaaagggttttgagatattaaatttaaatttttattttttaaatgatagaattgaggtttaggaaggaagagttttatttaaggttatagttagtgttagggatagagtttgtattttttgtttttttagttatttttcgttgatttcgtatttttttttttcgtaggtttttttttttttattgtttatttagtagtttttgggtttagttaggtttattagggattttttatttttttaaaaaggttttgatgattgttagtttttgtgaagttttaattaattttagaggtcgatggttcggaggagattgggggttttggttttacgtagatgaagattgcggttttattttatgtggtggtgaaagaacgttttagatatttttgttagtaataaaagttatatggttttttagtatcgtttttggaaaagaaaaaaaagtgtagttttttgcggaaataaattaattatgtgttgtacgtatggtatgagatataaatgggtatacggaggtgggtaatagtcggttttttatgtcgtttttgatgtttattgatagtggtagggttagcggttatggttttagttgtaattttggggagagggagtgatttttagtgtggtgggggaagttttagtttttttatttgaattggatttgagttattttagatattttagaggtagggtcggttttttggtttgtgatttatgtagtcgtatagggttttggttttagaagggttttgagtttgttttaatgttttgttattattgttttgaatttttgaatatttgtttaataaaggttttgcgtttttattttgtattgggttttttaaattatatagttagttttgattataaatttattttttattattaattgttacgttttttttggtttttgttatgtatttaatttcggggagtagggttttttgagtgtttattagttagtttgtttatattatttgagatgaattttagaatgattttgtgaattgggtagatgtggaaaattgaggtttagagaggtttttatatggtaaggaagtttagatttgaatttaggtttttttgattttaaagtgagtgtttttagtagttttatattttgtattattttatttttattatgtttagggggatggggatatatatagttaggttgttttatttttagataatagaaggtataattgaggttagagaagtgaaggtttttaagttagtgttaaatcgagggtttgggtaatagtggatttgggtttggatttatagggttggggatggagttttagttttatagttgtttgtgttatttgtaaatttattagttttttttatgtaggttattgttttgagtttggtttggaatgtggttggagttttattttgttttttttttttatagttttttattttaaatatttggaagtttttttttgtgtttttttttatttttttacgttgtagtttttttttgttatttttattggttgggaagtagttggatttggtattttgataaatttaaaagagtttaaatttttgatgaaagttggggttgaatagagtttatagattgttatgttttataattaggtttgggtttaaggtttatagagttaattgttagatttagggtagttatttttttgttttttgttgggtaattttgagtaagttttttttttttttggtttttagatttttttttagggagataaatgtattggattatatttgagttttaggaggtttttttgtttttaatattttagaattttatattaatttataataggtttgtttattttcgtatttaatagttggggaaatcgaggtttaggaaggattagagatttgtttatcgttatagaaggtgtttattgataagtggatttgattttgaggtttttgttagttggttcggttgtttttgtataaattttcggaggatttggttttagtattagtttagtttgtttttgtttcgtcgtttttagtttaggtggtttgttaggtatttttagtgtttaggtttggaaattatagttaagagtttttggtaggtaataaagttttttttttatggtttgaatgttttttaaaagttatatattaaaattttatttttattgtgatggtattaagaggtagtggggggtttttcgggaagtgattaagtggtgaaggttttgtttttatgaatggattaggttttttttgtttttttgattttaggatataatgttttgtgtttttcggaggatatagttagaagatattgttttggaaatagggagtttaggattttattagatgcggaatttgttagagttttgattttggattttttagtttttagaattatgtgtagtaagtttttatttttttatttataaattatttcgttttaggtattttgttatagcgatatagagtgaattaagatattttttttagataaaagtgggttaggggatggtagtaatttttttttttttaatcgtatttgggttgtgttagtgttttcgtaataaaggttttttttttaggggttataatttggttggaaaatgaggaggaaagattagattttaggattggaggggtatatgaagtaggaggttaggatgggaaaagtttttattggattttgggtacgtagagtgtatatatatacgtatatatatttatattttatatgtgtgtatttatatatagtatttacgtttatgggtatagttttttatatatttattggtagtttatatttatatggataagtttttatggaggatagtattgttatagtgtagttataggtgtaaatagttaagtgtaggtgtgtgtaaagatgtttttaggagatgtttttgtttgtattattatgtatggatttattggtatagatgcgtagatagatgtatagataggttttattatatgagtggtgtggatatatatatgggtagaaatttatattatagttgtgtaaatagtagattattgtgtggataaatttttatatatagaggtaggtatggaattagggtttagagttttggatttgttttatagagtagttttgggaggagtcgaattttggttttggaagtttttgtttttttttaatttagaggtatggattttttgggtggtttgtttttttggggtttttaaattattttttagtatttgagtttaattcgtttttttattgttcgatggggataaggagagtttgtttttttggtttagagaaaggtagtgggaggggagaagtgggagggttgtagttagggtgttttacggtagtatgggtggaagggtagggtattagtttaggggtttagagatttgagtttgggtttaggttgagatgttttaggttaatatatggtttttttgggttttattttgagttttttttgttagggttatgtgatatttttaggggttttagtatggggaagagtattgaaattatgttatatgatgaattattaaagtaattggagattttgttttggaggagagtaggtttggggggtaagagtttttttggtagatttatgaagagtttttaggtggtagggattatatggatgttgggggttttatattaggaatagaaatattgagagttggtttggaatagggatacgtttttttagaggtagagattaagttgagattaggatattgtgtagggagttcgagtgttagatggggtaggggtcggattagatattagtgttttaaacgtttagtttatagtaaatacgtattgaataaatgagagagcgattgtagagttttatttttgagttaattattcgtgatttagagtatattagttttgggtttttattttgttatttgtatgattttggttttttttaaattttagtttttttatttatgaaatggggagaataaattatttttaagagttttagtaagttatattttttattgttggttttttaggttattttagaatttttgtttttataaatagaaaatgatattgaaggtgaaaagtagatagataagtaagagaatagttaatataaaaattatagttaggcgtggtaatttgtgtttgtaattttagttatttggaagggtgaggtggggggatttatttgaggtttagagtttaagattagtttgggtaataaagtgagattttgtatttattaaaaaaaaaaaaaaaaattaggagagtggtttttattatttgttatttgtgatgagtagggagagggatgtagttagggaagggatattggtgggagttttaaggttttattagtgttttgttttttaaagttaggtggtaggtagatagatgtttgttttattttttttttttaaataatatttatattttatatatttttttgtatatgtattttatatgtttaaaaatattttaaaggaaagtaaaagataaaatatagaaaaagtttttttgttttaaatttttgaaaaaatggataatatgtttaaatgtgtataatatcgtataattatttatgatgtagtaaagttgtattgttttattcggatggttttgtgtattattatatttttagttgaatttttgtaggtttttgtagttgtttttattatggtaatttttatttaggtaagtatttttaggtaatagtttttgttgagtacgttttttaagtattttttatggtcgattagtagttttttaggtatgtgttagtgggtttattttataggtaaggaagttttttgtatttatataggaaggggtagagttgggatttgaattagttttgttaatgttaaagttgtgtagtaattttattcgaggagttaggttttttgattatagtaattagcgttatgtatatttatatatgttgttgaattttcggagttatttttgtattaggtatatttattattatttttattgtaatagtaggataacggaggtatagtaaggttaggaacgtgtttaagtttatattttaggtgagtattagagttgagttttgaattttagtagtttgattttagattgtgttttttggtttggttgtgtggggagtttagattttatggaaataaaagatagaacggtggttttagggtttatagcggattttaagggattagaggttagtaggggggttggttggggttggaggatgttgtttaggagatttgtttttagagtgatgttagttttgtgtgatgatttgagttttcgtttttttatagggttatggttgttggggaggtgttgaggttgtgggtatagttaaacggagttagagtaggttttggattttttgtttggtaagtttaggtgataggtttagatattgggtattttgttatttgttgttggtataagtttttattggtaggaatgtgatatttattatttgagtgggtttttagaagtttattgaatgtttttagatttggggtggggggtttttttattgttttatttttgagttttaattaaatttagggtggttggatgatttgaaggtttttttagtttacggaggtttgggtttgtttttgtttttattcgtgtttttaggggaaaaggtttttagttttgtttttagtagttttgagtttagatgagggggggagatgagatggaaaggaaaaggagaagtaagaaatagatagaggaaaaggagttggtattagattgaagtagttaatatatatttattaggtatttagggttattttaggtgttggggatataagtaatggattagaaagttatggagttttttgggggttttgattttagtagggtagatagaagatagataaggaggtaaataaataagtacgttaatatttgatagtgttttgggatatttaagaaaatagatgggggtaaagttagagagagtgattgggtggatggggagagaggggtttttggtaatattttagatagggtggttagggaaggtttgtcggagtaggtgatatgcgagttgagattagagggttgagagggatttaggaagggagaagggggttggtaggagggtttattgtatagtggaattggttttatttatttgttttttttttatttttttgtattgttagtatttttagtttttaaaatttttattgttttttttttttgttgttttttttataatagttttgagagttagatggggtgagtttaagtagtttgatttgtagtgtaggaaattgaggttagagtggggagggttagtattagcggtgttttaatgttaggatttgattcgggttttcgttttttagtttggtgtttttcggagtttgtttattgtttggtatgttatttaattattttagtttaggtaggttgtagttattgtggagttagttcgtgggtatcgtttttgagaggttataggttggaaatgtgggtagttgggtagggtttaggagggggtagcggtttaggattgggcgggggttcggagcggaaggcgtttagttttgattggaataaggtggtagtatcgggagtcgagtcgggtgttattgattttgttcggtgttttagttattaggcgggattagcgtcgggtagattgtcggtttttttaggtgtggggatattttgagggaatgattttttatgtggttgtggggtaggtatgttatttagtacgtgggggaggttagggttttgggagtatgttggtagtagggtggaggggggtgtttggagatttagaattttatagttagtaaatgtgaggtttttggagatagggttatggatttgaggttttgagattttgaggatgttagaatttttatcgtagtagtttttattgatggtgtgtttacggtgttaggtacggttttgagaatttatatagtttaattttttatttttgttttattttaagagggggttttgtgattatttttatttatagttggggaaattgaggttcggtaaggttaagtagtttgttaaatatatagttattaggtttttgttttaggaaataagagttttggaatagttggttagtgcggagaggattttcgaagatttttgaggttagtttttttgtgtcggaaaaataggtttggagaggggatgtgacgtgttggggtttaggggagtttaaagttaggatttattttttttttaggttatcgtgggattttcgttggtttttgaatgttaggttttttgagggtagggtttttagttaggatttaggtttttagatgttattaattttaattgatagttttttgttagtatataggaagtttttttgaatatttaatttgaatttttcgtttgtagggaaagtttttttttttttattttgtagtattttaagaagagtttggtttttgatgttagggaagattattagttttttggtgttgtgggaggtgagattgtgtttttttttgttataaaatatttttttattgtttatcgttgggtttaaatattagcgatttagtttttggggttttatagagttttttattaaaatgtgagtatttttggaatgggtgttagtttagtaggatagggtggtattttaggggtagggtttgggggtcgttgaggggtaggagagagttgattttttttttttagttaggtttgatggggtttatatgatttgttattttttatttttttgattttatttgtttttattttgttttttttttattttgttttagttattttgtttttaaatatgtttattatatttttattatagggtttttgtttgtgttgttttttatttggaaaattttttttattttgtttgtttggtttagttatttattttatttaggtttttgttgttttttttaagaggttttttttggttttttgtggtaggtagaataatggttatagagatgtttatattttaatttttaaatttgtggttatgttattttatatggtaaaagggatttcgtagatgtgatgaaggataaagatttttagatgggagattattttggattttttaggtgggttttatatgattataaggatttttatatatggaatagggaggtagaaaaggatagtcggagggagatggggtgtggaaattgattagggaatttgagagatggtagcgtgggaaaaatatggtttaaagttgtgggttttgaaggtggaggaaggggttatgagttatggaaagtagatagtttttaggagttggataagataaggaaataaattttttattagagtttttagtaaggaatatagttttgttttgattttgattttggttaagggagatttatagagaatttttgatttttggaattgtaagattataaatgtatgttttttttaaggtattaaaagtgggttaatttatgatggtaggtataggaaacgaatatgttttttttttttgattgatagttttttagtatatttattagtgtttgatatataatagtttgatttatgaattgtttttttttttttatagaaggttagttgtaggagggtagggattttttgtttgtttggtgttatattcgtagatagagttgttatatttaataaatggaaatataaaatatttagttaaattgaattttagataaataatgaatttttttttagtataaagttgttttaaatattgtaattatttatcgtttatttgaaattaaaataatttaggagttttgtattttatttggcgaatttatttttaatatataaaattatttttgggtatgtattaggattttaataaatgtttgttgaatgagtgaaatagataagtaaatgaatttatattaatttttagtttaaaaattttttttggtttttagaatgtttatagggtaaagtgtaaattatagtaaatgataaaagtagatagttttatagtcgttttaatatgttagattcgggttgagtgttttatatttattaatttattcggtttttgtaataatttaatgaggtggttagtttattttttagatgaggaaattgaggtttaggaggtttagtaatttgtttaaagttatataattattgagtagtagagttaggtaattttaggtttttgaaaatttggtttatggaatgttttaatgttatttttttatttatttttttgaatattgtggattttttttttttaatagttttcggtttttttttagggtatgtgttttcgtattttttgattgttgaatttttttttatatattaaagttttgttttatttttttttttttgtgagattatttttaaaatttttaggaggatttggtttttttttttttttttttttattatggttttttgtttgaatgcgttgtaaggatttgttattgtgttttttacgttttttgattgtgatttttttgagaacggagatgggttttttttagttttttggtatggggttttaaattgagtttggttttaggggggtttttagaagtatttgagaatgaatgaatgaatgaatgaatgagtgagtgaatgaatggttgagtgaatgaacgaatgttgtttgtttttattttgggttttagttttagagtttataaaaggggaagaataattttgaatcgttttttattttttaaaataaaatatatttttttttgattataaaaataatatatatttattaaagaaaaattggaaaataataaaattatgaagaagaaaattaaaattatttataattttgttatttagaataatggtttttattgggtgtttagttttttgttttttttattgtatgtatagatttattatttttttttttttttcgtttttttttttttttttttttttttttttttttgagtgttgggaatatatagtatggggttttttaaatttgtttttgaaattttttaatatgtgtgtatgtgtgtttttttgtttttttaaagtttttttgatggtaggggataagtggttgttagataagtttggtaggggttagggtgtggaaagtttattttttttttatttatggattattatagtttttttgtgatgggttgtttagggggtttttagatttttgttagggaatattttgcgtggatgttttagttgtatttttggttttttttttaggatagattttgggattggggttgttgagattagtatagatattgagaggtttcggatatcgttttatattttttttatagttgttttttagttttatttttattggtagtttggattttttagtttggtagaaagtcgggggtagtattttattttttttagagaaaagttttgtttatatttaaggttttattgattttatttaacgttgaaaatatttatttatttagttatttttttacgttatggtttaaggtttagatgtttagttttaattaaaatagttatagaggttattgtggtttgagggttttttggattttaggtttgtgtagatattatatttggtaataattaatttacggagtttattacgtgttagattttttgcgtttttgtgtgtttttacggtaattttgaagttagggatggttgttttttattttataggtgagaatattgagggtgttttagagagttgtgggttttaggttttgttatttgggggtgtaaaggcgttgttttagtagttcggttgtttgttatttggttgtttgttatttaatggggtaaagttttagtattatttcgaaataaggataagttttggtttagaagttgggtagttaggttttgtgtttgttttttttttatatgtgttttgggtagtttatttttttcgtttgtgaaatgggagagtagggagttagagatagttttttaggtttgtggcggttttgagtatagtgggtgtagatatttagtgttgagttaaagagagagagaattttgttagatgggttagtttattataagtagttaagttcggtttttgaggggttggagtgggtaggtttttgattaaggttgagttaggagggatttgacggttttagatggaggttggtttattttgttttagtagatgggaggttattttttaattttataggaagaagaggatagaaatgattgtagggggttaatttaggtttttggggacgttttttgtttgtatttttttttttttataatttagagagttatgtgggttttatttggagttttttgaatttttttggagtttttcgtagattatagtcggagttggtagggtttgagtggtttttgtttgttaggcgagggatttagagtttagagaagtttgattaggattggttttttttgttttttttgttgtgtgtttttattaggtgaggttgtttttttcgtttttatttttttttttggggtgatttggggaggttttattttttttcgggttagtttttttatttgttagataatgggattttttagatattattgaggttttttttagttgggaaatttttttttgagttggggttttgattttgttatattagttttggatttttggaggttttagttttttagaagtatttatttagtggataggagttcgtggtaggtgtttggggatttttaggaagaggaaggattttttggttagagataagaagagtagcgtgggtaggggttaagtattttttttttgtagttttttttagattacgttattaggtggtttttggtttttttaaaaggagtttttgaaaagtttgtgtttgttgtagtaggtgcggtttgtgaagtgtgtgtatgtttgtgtgagggtggtgtgtgtttatatgtatatggtgggggtgggtatataaggcgggaggtttaatatggtggtagggatagattttggttgttgagttgggatagtttgtgatagaggttttagtatattcgtaggttttattagaaatttttagatggtgttggtttgatttgaaggtgggtatatgtagggaaggggtatatgtaggataggggtgtatgtgggggagggttatgtatagggtaggggtgtatgtggaggaggggtatatgtaggatgggtgtatgtcggggagggttatgtgtaggacggggtgtatgtggggggtgcgtgtaagatagaggtgtatgggagagaagggtttgtatatggtaggggtgtattgggggtgtatgtagggtaggtgtgtatgtgggggaggggtatatttaggataagggtatatgtggggaggttatagggtttaaatgttgttagggtttttgggaagttgggattttagtgaatgtttgaggggagttaattttgtttgatttttttttatgattgtttatttaaataatattgtaaattaattatattaatcgaatttatttttttgttttttgttgtttgtttttgtgatataaataatatgagtataatgaaaaattttggaaaatatagaaaatatataaaaaatgttaaagtttgaagttttataattatagtgaatattgcgagtgtttttgaggggatgggggtttgtaggtttttttgatataattatatttatttttatatattggagtattttttacgggcggttgtggagttgagtattttaggtttgttttagtgaattttttaatagtttgagagggaggtattgttattttttttattgtatggttgaagaaatagtaaaaaggaggttaaatattttttttagggtgtaagaagtagagttaagatttgaatttaagtttggttaaatggaaagtgtaaatcgtttagcgtttagggttgtattttagttatgtttcgtttttcgtgagtagattatttatttatttatttttttaggagtatttattgagtattttttgtgatttagattttgtttagtatttatattaaggatttggcggatgtgaacgagatagagagaggttttaatttgattttttaagcggttataaattgagttttaattttgattatagtttgatttttagtttaagttgttattgatttttattggtttttattattgattgaattgtgatttggttttttgtattttgtagtggtttttgtgagttttttatttttcgtgatgtgtgtgaaagttaaggttagtagtttattttatttagtttattatttacgcggtttgggttagggaggtcgttaggagtttatttattatttttggtttgttattttgggttaggtttttttggagcgggggtttggttttggtttttggtattttgtttggtagaagggtgggttttggtttagagtatggggttattttaggaggggttagtatagttgagtttagggtatttgtgggcggggtttttatgttttagggtttttatattgtagttttttttttttgtttgggttttggaattttaggagattttaggagtcgttgttttttttttttatttgtagaaatttaatagggtagtttatttgagttttttcgatgtttgtattgtatttttgggggttttgtatgtttttttaatttttaggtagggttagttatttattttataggatttagtgtaaaaagaaaatataggatttttttttaaaatgtaggaataaaagtttttttttttttttgtggatttttaatttacggtggtgttttttatttgttgtttaatgttatacgtatttggatttggggagatttgtgtagaaagtgtagatttttatagatgtttaggggttattttaaaatttggtgtgtagattttaattttttttttttttttatgtttgttttagtggagggcggtagtgtaggtagtgggttgttgagaatttatttttggaggtagtaggaggtagattggattcgggttttaagtttttaggtatgttgtattagtttattaggttttatttataatatattaatttagagcgaaaatgatttagtattttaatatggtaattgttgagcgttaaatttaagtataggaggtgggggggttaggtagttttggaatatagtagttttataggtggttgggcgtggggtggatttttgtttttggagtagagggatgtggagtatttttttttgtttggagtatttggggtatttggataagtatagggggttatgaatagggttatgtttgtgtgtttgtttttcgtttagaagagggtatttgacgggaatattagggtatatttgtattatgttcgggtagtaggtttgggtatgattttggattaggtagatttgtagtaggtggaagggttttaggagagttgaggagtttaggggagaggaatttagaggtttttgttaaagtgtttgatgtgttgtcgtaagaagggtagtataggtcgggcgtggtggtttacgtttgtaattttagtattttgggaggttgaggtgggtggattacgaggttaggagattgagatttttttggataatatggggaaattttgtttttattaaaaatataaaaattagtcggttgtggtggtgcgtgtttgtaattttagttattcggaaggttgaggtagaagaattgtttgaattagggagttggaggttgtagtgagttaagattatgttattgtattttagtttggtaatagagagagattttattttaaaaaaaaaaaaaaaaaaataaggtagtatgggtgtttgttgagagagagagaaagaagttttttttttgtatgtgttgttatgggattttggtttagttttttggggtgttttttgagtttagttttggttttgtttttttttttttgtgttttaatttttttaattatgtattgagtaaggagaagattattatattttaagtattttttgtatgggttatatattgagttttatgaatttttttttttttgttttataaatgattattggtttattttttagacgaggaaattgaagtttagaggaggtaatgatttatttagtaagaaggtggtggagttggttttgtttggtttttttttattttttgagtcgttttagtttttttaggtttgggtggaggacgtgggaattaagttcgtgggggtattattagtttttgttagaaatggggttaagagaagattaaggatgttttttgatttgaggaaacgtttattaatttatagttattgtgttttggcgagttacgtaggttttggatgtaggttgtttgggtgggtgatttgagtagatgttttaatttttttggggtttagtttttttatttgtaaaataggttttataagagtttttgttttatagggttgtgaggattaaatgagttaaggtatattatttgagtttgggaggtagagattttagtgagtaagattatgttattgtattttagtttggaagatagagttagaatttgttttaaatatatatataaataaaatgagtaaaggtatggaaaatatttagatagtggttgatatagagttaagagttatgtaaatgtttattgttaatggaattatttaaaagttgagttataatttatattttttagattgttaattacgaattgatttattttaatgttgtgttttttttttttgtatttaggatttagtaaatttttttttgaaattttaatataattttttaggtttttgagaagataattttttcgtttttatagtgtttatagtttatggtggatttaatagttttttttagagtagtttttttaaaagtggattttgtatatattagttttttttagatgtattattttattttaagagataatttaataaatagttgagtatatattattttagatttttatggtttaataaggtagttattagtatattaaagattttgataagttttgtagtaaaatattattgaatattgtttgaaataattaattttaattttgtttgattatagagttttattatttttgtttaatagttgataatatttgaatatacgttgggagatgttatttttattttttgttttttaggaaatggtaaggggagttagagttgtgaggaatattttttcgtagggatgagtggttttatttttatagaaattatttttagttatgtgtattatcgttaggttattttttttgtttttattttttttgtttgatttagtttttatagcggtttggagaggttattagtattaatgtttttattatatagatgaggaaattgaggtttataaaggttaagtgggtatatagttagtaagtggtagattcggtagataaatttatagtttttgattttaaattttatattcgtttttttgtatgttgattggaaaagtaaaaatagattttattttaataggattaatttttttttattataggtttttaaaaaatttaggtatttttttttttcggtagtattgaatgttttaaaaatttaaaatttttattattttttttttgattattaaagtagtacgtgtttgttatgtataaaattttttaaatattttgagttgaaaaatgaaaaaaaggtagggcgcggtggtttaagtttgtaattttattattttgggaggttgaggcgggcggattacgaggttaggagatcgagattattttggttaatatagtgaaatttcgtttttattaaaaatataaaaattagttaggcgtagtggcgggtatttgtagttttagttattcgagaggttgaggtaggagaatggcgtgaatttaggaggcggagtttgtagtgagtgcgattgcgttattgtacgttagtttgggcgatagagttagatttcgtttgaaaaaaaaaaaaaaaagaaaagaaaagaaaagaaaaatgaaaaaaaaaaaaaaatagatttgtatagttttataaagtagttattagtttttaaatgaaaatatttaaatgttatttaaatgaaaatagttaaaatgaaataagataaaaaatttagttttttagttatagtagttacgttttaagcgttcgggatttacgtgtttttggtggttattgtgttgggtagtatagatatgggatattattattattatagagaattttacgggacggtgtcgttttagattttttttagatatattttaatatttatataggttgattatttttaatttaaaaatttaaaatttgaaatgttttaaaatttaaaatttttttagggttaatatggtatttaaaggaaatgtttattggagaattttggattttggattgaagtataatttaattatttcgaaatttgataaaattagaagttttaaatttgaatgtttttggttttagttattttgggtaagggatgtttaatttgtaatgattgttaatgtgtggtttttttttttggagattaggttttgttttgtcgtttaagttagagtgtagtggtacgattatagtttattgtagtttttattttttgagtttaagttatttttttgttttagttttttaaagtgttgggattataggcgggagtcgttatgttttagtttattgatatttttgttgaggtttttagatatatttgtatggttttatatatggaggaaagagatttatagaggtaaaaataagatatggggtaaaaatagattggaaggaaatatatcgaatgatagtggttttttttgggtgttgagattatcgagtttatttttaaattttttagattttttaggtgttttataacgtaaaatgtagatagggtggggacgttggttggagttatgttttttttaatgtttttattggttttaaaatttttaagttatgtttttatttaaggttttatttattattattttaatattgtggatttataaagaatggaagtttatataagtttagggaaggaaggaaaggtagatagaggtttatttttaggtttgggtagttgtatagggttttttgtttagaagggttttatgtttggtttcgtgttttgtggtcgttgttttgaaatttttattgatttttgaataagggattttgtatttttattttgtattgtgttttgaaaattatgtcgtcgttattagttttgggattttttttaggataggtttttttttagttgttttaagttttcgtttttgtttttgtttaattacggacgtggttatttacggagttttttacgtgttttagagtaagtgtgtttcggttgtttaggtgtgtgtttagagattgataaaaatagggttcgtgagtgggtgcgggaggtttttgtggtttttgtttatatacgtatttatttttaaggttatgtttatattggtttattttagagaatcgttttgtgtattatgggatgttttgttttatattacggtttagtttggtttagttttggagttttgtgttttgaagttatgattaattttaggtttggtttatttttttttttagtttttttttttttaagttttttataggatttataaattttttatttttatgtaatttttttgtgtgattttttttttatatttttgtttatgttgtttattttgtttgtattagtaaggtttttttttttttagatttgttttttttagatttattttagattttattttttttagaaagattttaggaagtatttgagaagggtttgaagatgttgtggttgtatagaggaggatatgaattatttcgtttagaggtatcggggagggttttatggaggtggtgtttttaggttaaggaagagaagatatttttcgggtagaagggagagtttgacgggttggtttgatgttagatagattataggatgatttaaggtttttttttttttttttaaatattagttgtagtaagttttattatttgtttgagtttgtttttatttttataatggaggtggtgatgtttagtatacggagttgtgatgaggatttaatggggaatttagagtatttatggaagtgttaggaggttaagattttgtataggtaggaaggatttaagttagaggggtgtgggtggttagaggagagagtttattttagtagggtttggtaggttaaggtttgggttgaatttcgaggttttggagtttagaatagtatttgtaattttttggttgtcggggtttaggtaaggattgttttttttttgagtgttagtttttttatttataaatggaaagttgggatattgaaaaatattgggggggagggtggtttttgaggtagtttttttttatatattataggaatgtggcgttttagggagaaggtatttttgtttattgtgtttatttttgtatttttagtgtttagaatagtgtttgtatgtagtagatgtttaataaatgtttattgaatgaattagtagtaattaattcgtttattttatattttaagttcgttggggacgtaggtttatttttttagggaaattgtttgtagattgggattatattttaggttataagtattttttgagtatttattgtatgtatggttttgcgtagttcggggtagatttttgttttatagttcgatagggtagagttaaggaggtaggtgatagatatagtgatttgggaagaagaatagagagtagggtggttagtagggttttgtttgggtgggagtaggtcgtttttaggttggagtttaggttgatgggagttttagtttgtttgtttttgggagggtgggattgtttttttttttttttttttttgaaaataaaaattgtttttttttaaatttataagtattaaaagtttggaaaatatataataattaaaagaatataaaataaaggttatttgttattatggcggattatatagtattaattattatggattttttagtgtttttttttagttttttttttgaggtggttttgtttttagaggtggttttttttttttttgggaagggatatagttgttttgtaggagatgtgggggtattaggttttttttatgggttttttattatttttgatttggaggttttttttttattttttttggatttagtattttttttcgagatataggggtgcgaagagttgggggaggtacgttagtaggtttttttttttgtttttgtttattttacggaggtggggtgggatagaatttaggtttgaggaaggagtattggaggttaagttataggtgttggtttttagttttggtgtttaggtaagttgggtttgggaataggggtatgattaaaatggatttttttttttttttttatttttttttattttattcgtttttttttttgcgttttttaagcgtttcgttttttagatgttttttgttttttttgttttagttttttaattttttttaataaaggttaaggaattaggtagattgtggatatttaggtgtgtatgatgggaagggatttgtatttataaaagtttttttttatagggattgtatgtgttggtggaattttagttattatgttttacgttgaaggatgtttggagggggttgattttggttattttttaaattataagttatatgcgtttgtttttttcgtttatacgtaagtttgaattttttgttaaaaatattttttttagattcgaaagaaaattttaaagaggaatttaaatttttacgttgtttgtatcgattggatcggagtgtttaggttcgcgttaataagtgttttaaagaagaagttagatagtgaagggggaagtgagggagaagttggaaaatttttaggttgattaatcgttagtttatttattcgtttatttatttatttatttatttatttatttatttatttatttatttatttttttttttttttttttatttatttagtgagaagggttgaatattatttgtgagtttgtttttgtttttaagaatattttttggatatttgtggggtgagtagtgaggggtagtaatggtagagtatttttatcgtttggaggggagaaagggaagggttgggaaggttttttaagggggcggttatgaagttgggttttgagaagataggttagggttttttattttttatattttgtttagagttagatagaaggtttttgtagaggaggaggaatattaaatagtagtaatttttggtattttatgagggtttgtttgtgtcgggttttgtgttgtgtacgtgatatatattattttattaaatttatttaatatgttttgagggggtgttatttattttttttattttataggtaagaaaatgaaatatagagaggtgaggtattttttttaacgttatatagcgaggaagtggtagagtttggttgtagttgaggtttatagtcgtattttatattgtttttttttcgaagagtgtttttttttatttttgggagttattgataaggggtttgatagtttttttagttttgtgtttgtttagttttttttagttttgaaaaaattagggtttggcgttggagaaagagtaggagggtgagatgtggaaatatttgttgagtggtaggggattacgttggcgtagaggggttcgagtcgattaggaggtcggtttgtgttaggttagtgttttttgtgtattaggtgttatatgcggggtttagggtagggttatagttgttttttttaattattttttgaggttagtgttattagtttattttatagaggaggaaattgagattttaagaggtgaattaatatgttaggttatttagttattatgtagtttaagtttagattgttttgatttttaaattgtgtgtaaggcggatgattggattttagggaggtaaggaaagttagtttttttgttgttgaatttaatgttttataagattatatatttttttagattttagtttcgttatgtatgaaatgaggaggggaattttttgttttcgggttttgatatgtttttggattgatttattgttttttgtttttgtgattttttaaagtaagattagagttttatttttagttttaggttcgagatttttatttttattgtgtttaggggttttaggaggtgttattttagggtagatggtaaaggtttgggttgtagatttattgagggttaaaggtaattttttttttttttattttttttttttttttttttttttttttatttttattaagtaaggtagggaattattcgttgagttttagggtaggtttacggattgaagtttaggaggatagggttttttagtggttgtaggtgttttagtattgatttttagtagagggggtgtttgggtttagtttggaagattgggtgagattttttaattacggggggtgggggtatattttgggtggtagatttgaggaagagtttgtagataaggtatttttaggagatggtaataagagttggtgttggggttgttttattgaatttagagtttaggtttgtttttttatttatggaggagttcggattggtttagtggtaaggtcggggttagaggttgttattttttttttgttttttatagttcgttggaaggttaggtttttaggttttgtttattcgtttttcggttttttttttttaggtaatcgagggagttttcgttttgatgcggttatttttaggtttaggcgttaatgagttttttatatgattagtggggttgttgggggtttttagttcgttagagtgggtgcggtgaggtttggatatatagtttcgttgtgtggggtcggtttatgtttgtttagattttgtgggtagtggggggtttttaggaatgtttttttagtttggggggtattttggataggtagggtggtttggggagacgggtgtgtgtagggtagttttagaagtcgttattaaagggatttagtagacgtggcgttaggtaagcgttatagtgggtacggaagggttggcggttagtttgttttttttttagggatggcggggagggggaggttttatggatatatgtgtttagggtgattagttattaggggttgtttgggatgaaggggttttttgggacgtggagtttttagtgttaaaatagagagttttttgttattggaattttttggattttcggaaaggatatagtgattgatttttttggtttgggtagttttttttttgttcggtgatttttgagttagattatttcggttagatttgtttagggttattttgtttattttttgtttttatataggtttgttttatatttaagagtttattttttattttttttaggtatttttaggggaggagttgtcggttaattttaattattgttagggggatttcggttagatttatattacgtttttagttttttttgtggttttcgagttagtttatatttttttgtttttatatttttgtttaggacgttttttttgtttggaatattttttttttgtttttgttatttttttatttttagggatttagtttttaagttatttttttagaggatttgtttttttttttttaaggttgggttagtatttttttttgaatttatagttttggttttttttttaaaaaatttttgttacgttttagggtaattttttgttgatttatttttttttatattagatggtgagtttttaggatggagattttgatttagtttttttcgggtttttagtataaggttatgtttatggtgtttattaaatggaaaatgtttattgagtaattattttgtgttaggtattatgtttttttaattttttttatagttttgtaaggttggtgtaatttttatagatgaggaaattagagatagagaagtgaagtaatttatgtaggtgacggtagagggtagagttaggatttgaatttggagagtttggttttaaagtttaagttggaatttcgatattttatatttcgataagtttttgggaaatgattgattaaatagatgaacgcgtttgttttttcgtcgttttagagtttttttaaagtttatatgtggtagtttgggtttatttttttggtttttttttttggaggggtatttattgttagtgtttttggtgagtgtttgtttgtgggggtataagtgagggtttagtaaaggtgatttggtgtgaggggggggtgttttagggggtgtagaggagggttttatgaggtagatttagaatgaaggttttggtttttagtggaatcgtgtatgggtaaggggtttttagggttattggtttataattgttagacggggaaattgaggtttagagagaggaagggatttgtttttagttatatagagtgtttggattatagtttttaggttttagtttttttatttgttatatagggagaataaattttttttgttttgtttgggggtagattttagggggtttttgtgtttttttatattttttattttagtttttagaattttattatttatgtattagttttgagggtaggcgttgttttttttttattttttgtttacgtttttattgtaggatgggaattaaatgtttttttattttttttttatattttttttttttatagtgaattgaggggagtttttgattttttagtttaaagttagagaaattgagaggggagggttgggtgggagtcgtgggaatgttatgtataagtagtcggattttttaggggtttggattttttttttgttgttttgaaggtttttgtataggttgtggtattggttgagtataggtgtttgaaggtagaggtatggatgggatgttttatttttagtttgtttttgttagtgaagataaaagggaagttatttttcgttggtttatggggattttgaggtagtaggagttcggtgataattttagggattattttgggttgttaggtgggggagatagagaagtttatataggaggtattaaatgtaatttattcgtgtttttttatttatgagagaatacggatttagagatgttaagtgatttagatatagttttatagtatataggcggtagaggtaggtaggggattgggtttttttggtagtagtttttaagtttgtttgagaggtatattagaatcgttttaggggatttgtaaaattatatttgtttaggtttaaattttagagattttgatttcgtagtttgaggtaggaatggagaattttttatagtttgaggtaggaattgggaatttagtgtttaaaattttttaggggcggtgattttagaaaatttgttggttttattatattttgtttagggattgagatgggatggtatttggaagatataggtaggaggaagaggaggtagtggggggtatagggagatttttttttttttggtaaaagtttgtggacgagagaatagttcgagtaagattttgagaattcgagattcggatggatttggagtttttgttttgcgtataatttagggggtttgtgatattgggttggagataatcgtgttttttttttttttggtttttagttgaaatttagtattatattttatggcgattttttattagtggaaattataggtgttttttggtattatagcggggttagggatgatttgaaatattgtttatgtttattataattgtatggtttatcgcggggttttgttatttagtgagtttttgaagaggtatagataaatggagtttaataaatggaaaacgtgagttaatatgttattagtttgttttttgagtttgataatggtatttttatcgatttttttttttttgtaattttttggattttgttttacgcgtttaaaaacgtaatttcgaggaggaatttgaaggttttttgagattgttaagggtcggtgggttagggattttgtagggggtagcgtggggttggtattttgtaaatgggattttggggttgcgtttttttgaggaaggaattggtagttggagttttgtaagtttttagggatgggatttgggagataggtttttatggcgagtacgtcgtgagtagaaatgaataggagagagaaggttgaagaggggagataggtttttataaaagtggagggaaggttttcgggttatagattttagatttaaatatttttatagattttagtttatgaggcgttttttgtgttattgttggttaggattagttcgttttgtttagcggttttttgtttttgggcgtatatatgatatgttgggttaaagttatttttttttttgtgttttttgtgttattgttagttattttttaggtttcgaggattaggatttagtttaggtcgatcggggttttagttttgttttttaaggtttttttgttttaaattttatatttttttattttgcgtacggaaggagaaatatagattataaagattcggtaaatggattttataaatttttatttttttgttatagaattgtttttaattagtttcgaggattataaagggaataacgttataatagtagtaattttaaggaagtagttatagtttttagtttttagatttggggttgtcgtttattattagttatagttaggtttgatgggagtgtttttattttaggggatagtaggttttttttatttttcgatttagtttttatttgtagtagtatagttttttttggttttattagggaagaagaataggtttcgtttttagataagtttttttagaagtttgaggatttaaatatttaaatgtgtttgggtttttgtttcgagtcggttatttaggtagtagttttgaattattcggttagttagcggtagggtaggttaatgggttggagggtaggtaggtaggtagatttatttttgtatttttgttgattgtttcggttgaggaaaggtagtattagtttttaattttgaagttttagattttatgtagtttttttgttttggaattatttagaggtattgtttttatatatggtttatttttaggtttagataatgagaattttataagtagaggggattttatttggggtatagagaggttaagtaattttttttttaaggttttttagtaaggaagttattgagtcgtgggatttgagtttagggatttttgatttttagttttaggtgttatagttttatttgggtttttgttagggaggaggaaggtagtagggggtgtttgaggttagggtgtattagttttaaatgttagatagaggtaggagaagtttttttatgagttttagttttattagaggttttaggtcggggattttagattttttatttttgttgggagatataatttagaattttgtatttttgtagttattaaaaaaggtaaaagttgtttagaaatatttttttttttttcgtggttaaatttacgaattttttcgaggtttgtttttttgtttcgtgtaggtttagttttagtgtagtttagttttgtgtagttttttataaaagtttgtggttttttttttttttttttgtttttgatattttaggagttatatataaaatgttggcggtggtttttaggaagatttttgtattttatagttttttttagaagttgttagtagtgattttttgagtttaggtggggagttttaggtaggataggggttggggttgtaggttttggggttttgttagtgaagtagtaagtcgagggtttttgagagttttttttggtttttttgagggttgttttttgaggttttgaggttttggagtatttatcgtttttacggtttattgtttttattagcggaggatgaaagtgttatagcgatgttttacgttaagagattatagagattattaatttttttttttattttaggtttttagaggttagcggatttaggcggataggttgtgcgtttgagggtagttagggcggttagtggagggacgtggttcggggtttggttatagttttttatttagggttttgggttattgttatttatcgcggatgaaggtcggcgagtaggtcgggaaggagtcgaagatgttgttcgatgttatgtttcgttttgaagaaggcgagaatttttagttttttagggggttgggttgggatttatttggttggttgttgttttattttttttttttttagttatttttgaaaataaaaggggggggtgttgttttttgttgttttttgttttgtttttgtttttttttttttttttgttgttacgaaaaagaaaaaaggaaagaacgcgagagtgtgtgtgagtgagagagagaaaaaaatttttaaggaaagtaagtttttgtttgtatttaagaatttggattttcggttttataggaatgtttagttataaatttttaatagaagcgtatgtagagtgtattattagatggcgggaaggggttttcggtagttagggtggaggagtttcgaagttgatagagtagagtgggtcgtttttagtgttacggggaatgaatgaatgaggtttatttttgatagagtttaggttttggtgggtacgagggcggtcgggggtggggagtattaggagttaattagttttcgcgtagggttttggaggcggtaagggtttggttttgtggttttgtggttgagggattaggtttttttagtgttaatttaattttagtttataggatgcgagaagtttgttcgcggttttggtttattggttgggtcgcggttatttgggtcgtgatgttacggttttttagaagattttgtggttgtttttttttttggaaaagaaaaaaaaaaaaaagaaagagagagagagagagaaatagaaaagtgatggtttttatttgtgaggttggttttagtacgcggtttaagaaatagaattgaaagcggttgtagtgggcgtggttaggagggtggtttggtttttgggtgggagatttttttttaattaaggttagtattggtttgggcgggttaggagtttcgcgggttttttatcgagtgtttagagttcggatttattagcggtcggagagttttttgttatgttatttcgtttttgggttgcggttgattttttgttattgtttattattattgttgttagggagaggtgtttatatgtgtggttgggtggtatttttggggtttttatgggagttgggattaagtataacgggaaatatatgaagtggtattgttagtatttacgtttggtttcggtttgtttatcgagaagggtttttttgtggaaatttggtggtttgttcgtattggggggttttttgtagggttgggggttgagtttttagtatgttatttagggttttttattttttttgttgttatttgcgtatttttttgggggtttttgttttagtatgatgttcgggagtttttttgttttcgggttttcgtttatgttgttttttttattagaagcgttttttgtgtttttatgtttttgaggagttaaggtttagagaggtttaaaagtagaaaagttatgaagacgattgaattttatatttgtatgttttttaaagttatgttaggatgggagagagggtggagagtgggggaaaggtggcggtttttattattttttttgtaagttttatttttttattttataggttaggttgcgaggtttagggtggtgacgttagtttgtttaaggttatgtggtattttggaatgggattggaattttagtttttgatttattagtttcgattttgggtatgatattagagtgtttttttatgttttttaaatgaagattttagaaagtttttttgtagtttggttattaatttttggttttttttagggattttaggtttggggttagaatttagtattagtttttgatttatagtagtttttgtaggttaataaggatggggtggggatatttttggaagaggatgggttggtttaaggttttaaagagatttgtttttgtttaaggtatatgtgtagaagatggttttggaaacgtttatttagttttattttaagttttatgaagatttagttttttgtttttgaatggtgggttaattggtgttgagggtgggggtggtggggataagagttttaatttggttagagaggaagtaggtttatggtgatagttatagagttttagagttagatttggtttttagttttagttttgttgaatttgagtagttagattttggggaaagttattttttttttttgggttttagtttttttttttgtaaaatggggataatattttttttaaagggataggtacggggtgagggtattataaatattggtttttttggttgagtttttatgacgtaatttgggtttcgttatgagttagtttaagtaaggagttatgatagttatgtagggggagaggttgtttcgtttttattttgtgttgtaaatttattagttggttagtttgtatgggatttttaggggtta

SEQ ID NO: 195 - DNA, 67667 bp, Artificial Sequence
  Chemically-Treated DNA
tgatttttgagggttttatgtaggttggttagttgatgagtttataatatagggtgggggcggggtagtttttttttttgtatgattgttatagttttttatttgagttgatttataacggagtttaaattgcgttatggaggtttagttaaggaaattaatgtttatgatgtttttatttcgtgtttgtttttttgaagaaggtgttatttttattttatagggaagaaaattgaggtttagagaaaggaagtgattttttttagggtttggttgtttagatttagtagagttggggttggaagttaaatttgattttagagttttgtggttgttattataaatttgttttttttttggttaaattagaatttttgtttttattatttttatttttagtattaattgatttattatttagggatagaagattgaatttttatgaggtttgagatgaggttgagtgagcgtttttaaggttattttttgtatatgtgttttgggtagaaataagtttttttgggattttggattagtttatttttttttagggatgtttttattttatttttgttggtttatagaggttattgtgagttagaggttggtgttaggttttagttttaagtttggggtttttgggagaggttaggggttggtggttaggttgtagagggattttttgaagtttttatttaaagggtatggaagggtattttggtgttatgtttaaggtcggggttggtgagttagaggttgaagttttaattttattttagaatattatatgattttagataagttggcgttattattttgggtttcgtagtttggtttgtgaaatgggagagtagagtttgtaagggaaatggtaaaagtcgttattttttttttattttttatttttttttttattttgatatgattttggggaatatgtaagtatagggtttaatcgtttttatgatttttttatttttgagtttttttgggttttgattttttaaggatatgaagatataaagggcgtttttggtgaggggaatagtatgagcgaaggttcggaggtagggaagttttcgagtattatgttggggtagagatttttaaggggatgcgtaggtggtaataagaggagtaaagggttttgaatgatatgttggggatttagtttttagttttgtagagggttttttagtgcgggtaggttattaggtttttataggaaggtttttttcggtgggtaggtcgaggttaggcgtgagtgttggtaatgttattttatgtgtttttcgttgtatttagttttaatttttataaaagttttagaggtgttatttagttatatatgtggatatttttttttggtaataatggtggtggataatggtagggagttagtcgtagtttaggggcgaggtggtatggtagggagtttttcggtcgttggtggattcgggttttgggtattcggtgaggggttcgcggggtttttagttcgtttaggttaatgttggttttaattaagaaggagttttttatttaggagttaaattatttttttggttacgtttattgtaatcgtttttagttttgttttttgggtcgcgtgttgaggttagttttataaataaaagttattatttttttatttttttttttttttttttttttttttttttttttttttttttaaaaagagaggtagttataagattttttaaaaggtcgtgatattacggtttaggtgatcgcggtttagttaatgagttaaggtcgcgagtaggtttttcgtattttgtgagttgaggttgggttgatattgggaaggtttggttttttaattatagaattataaggttaggtttttgtcgtttttagggttttgcgcgggagttggttggtttttggtgttttttattttcggtcgttttcgtatttattagagtttgggttttgttaagggtaagttttatttatttatttttcgtggtattggaggcggtttattttgttttgttagtttcggagtttttttattttggttgtcgaaagttttttttcgttatttaatgatatattttgtatacgtttttgttgagaatttgtggttagatatttttgtgggatcgggaatttaaatttttgggtataaatagaaatttattttttttggggattttttttttttttttatttatatatattttcgcgttttttttttttttttttttcgtagtagtaggggggaaaaaagagataaaaataaaataaaaaataataaaaagtaatattttttttttttatttttaaaagtagttagaggaaaaaaaaataaaataatagttaattaagtgaattttaatttaattttttgaagggttgaaaattttcgttttttttagagcggggtatggtatcgaatagtattttcgattttttttcgatttattcgtcgatttttattcgcggtgagtaataatagtttagggttttgggtggggagttgtggttaggtttcggattacgtttttttattgatcgttttggttgtttttaagcgtatagtttgttcgtttaaattcgttggtttttgaaagtttgaggtgggaagaggggttggtggtttttgtggttttttggcgtggaatatcgttgtggtatttttatttttcgttggtggggatagtaagtcgtgggggcgatggatattttaagattttaagattttaaagggtagtttttagaggggttaagggaaatttttagggattttcggtttgttgttttattaatagggttttagggtttgtagttttagtttttgttttgtttgggattttttatttgggtttaggaggttattgttggtaatttttggggagagttgtgggatgtaggggtttttttggagattatcgttaatattttgtgtgtaatttttggggtattagaagtagagggaggagaaggaagttataggtttttgtggaaaattgtatagagttgggttgtattgaagttggatttgtacggggtagggggatagatttcgagaaagttcgtggatttggttacggaagaggagaaagtgtttttgggtagtttttgttttttttggtggttgtagggatgtagagttttgggttgtgttttttagtaaggatagggggtttgggattttcgatttggagtttttaatggggttgggatttatggggagattttttttgtttttgtttggtatttagggttgatgtattttggttttagatattttttgttgttttttttttttttagtaggagtttagatggggttgtgatatttgagattggggattaagagtttttgagtttaagttttacggtttagtggtttttttgttgagagattttaggaggggagttatttaatttttttgtgttttaaatagagttttttttgtttgtggaatttttattgtttgagtttgggggtggattatgtataagggtagtgtttttggatggttttagaatagagaggttgtatgagatttagaattttagggttgggggttggtgttgtttttttttagtcgaggtagttagtagagatgtagaggtgggtttgtttgtttgtttattttttagtttattggtttgttttgtcgttggttgatcgagtgatttagggttgttgtttgggtggtcggttcggggtagggatttagatatatttgggtgtttgagtttttaggtttttgggaaggtttgtttgagagcggggtttgttttttttttttggtgaggttaaggaaggttgtgttgttgtagatggggattgagtcggggagtgaagggggtttgttgttttttgaaatgggggtatttttattaaatttagttgtagttgatgatgagcggtagttttaggtttgagagttgagagttgtggttgtttttttggagttgttgttattataacgttgttttttttgtagttttcggagttaattaaaggtagttttgtggtaagaaaataagagtttataaaatttatttgtcgggtttttgtaatttgtattttttttttcgtgcgtaagatggagaaatgtagggtttaaaataaaggaattttgggagatagggttagagtttcggtcggtttgggttgggttttgattttcggagtttgggaggtggttggtagtagtataaagggtataaagggagaggtggttttggtttaatatgttatgtatgcgtttagagataggaggtcgttgggtagagcgggttgattttggttagtagtggtatagaaggcgttttataggttagggtttgtggagatgtttggatttggggtttgtggttcgagggttttttttttatttttgtggagatttgttttttttttttagtttttttttttttgtttatttttgtttacgacgtgttcgttatgggggtttgttttttaaattttatttttggaggtttatagggttttagttgttaattttttttttaaagagacgtagttttagggttttatttgtagggtgttaattttacgttgttttttatagggtttttaatttatcgatttttggtagttttagggaatttttaggttttttttcggagttgcgtttttaaacgcgtaagataaaatttaaaggattataaaggaaaagaaatcgatggaaatattattgttaaatttagaaagtaagttggtgatatattgatttacgttttttatttgttgaattttatttgtttgtgtttttttaagaatttattgagtgataagatttcgcggtgggttatgtagttgtgatgagtatgaataatattttaggttatttttgatttcgttgtgatattagagaatatttgtgatttttattggtggaaaatcgttatggaatatgatgttaaattttagttagaggttagggaaaggaaagatacggttatttttagtttagtgttatagattttttaaattatacgtaagataaaaattttaggtttattcgggtttcgggtttttagaattttattcgggttgttttttcgtttataggtttttattagaaggggaagggtttttttgtgttttttattgtttttttttttttttatttgtgttttttaaatgttattttattttagtttttgagtaaagtgtgatggagttagtaggttttttgaaattatcgtttttagagagttttaaatattggatttttagtttttattttaggttgtggaggattttttatttttattttagattgcggaattagaatttttagggtttgggtttgggtaggtgtggttttgtaaattttttaaagcgattttgatgtgttttttaggtaggtttggggattgttgttagggaagtttagttttttatttgtttttgtcgtttgtgtgttgtgagattgtgtttgagttatttgatatttttggattcgtgtttttttatgagtaaaagggtacgagtgagttgtatttggtgttttttatgtgggtttttttgttttttttatttgataatttagggtggtttttagaattattatcgagtttttattattttagggtttttatagattaacggaagatgattttttttttgtttttattggtaaaaataggttgagaatgaagtattttatttatgtttttgtttttaggtatttgtatttagttagtgttatagtttgtgtaggggtttttaaggtagtaagggagagatttagatttttggagagttcgattgtttgtgtatgatatttttacggtttttatttagttttttttttttagtttttttgattttgagttaagggattagaaattttttttagtttattgtggagagaaggggtgtgggaaaagggtggagaggtatttggtttttattttgtagtagaggcgtgagtaggaggtgagaagagggtaacgtttatttttagggttggtgtatggatggtggaattttagaagttggaatggaaggtgtgagagggtataggggttttttggggtttatttttaggtaggataagggggatttattttttttgtgtgataaatggggaagttgagatttaagagttgtgatttagatattttgtgtaattaaggataagtttttttttttttttgggttttagttttttcgtttgataattatgggttaatggttttgaggattttttgtttatgtacggttttattgggggttagaatttttattttgaatttgttttatgaggtttttttttgtattttttggggtattttttttttatattaggttatttttgttgaatttttatttgtatttttataggtaaatatttattagggatattggtagtgggtgtttttttagggagggaagttaaggaaatgggtttaaattgttatatgtaggttttaagggggttttggggcggcgggggggtaaacgcgtttatttgtttagttagttattttttaaaaatttatcgaggtgtagagtatcgagattttagtttgggttttagagttaggttttttaggtttaagttttgattttgttttttgtcgttatttgtatgagttattttatttttttgtttttggtttttttatttgtaggggttatattaattttgtagagttatggagagaattaaaggagtatgatgtttggtatagagtagttgtttaataagtattttttatttgatgaatattatgagtatggttttgtattgggagttcgggggaaattgggttaggatttttattttaagagtttattatttggtgtagaaaaagatgggttaatagaaaattgttttggggcgtgataaaggttttttgggagaagaattagggttgtgagtttaaagaggggtattagtttagttttgggaaagagagaataagttttttggaggagtgatttggaaattgggtttttaagggtaaagaggtaataaagatagggaaaggatgttttaggtagaaggaacgttttgggtaaaggtgtggaagtaggaaagtatgagttggttcgggagttatagggagggttgggagcgtggtgtgggtttggtcgaggtttttttagtagtggttggagttggtcggtagttttttttttgaagatgtttgggagaaatggaaagtggatttttgggtatgaggtaggtttgtgtggaggtagggggtggataaaatggttttgggtaggtttggtcgagatggtttgatttagaggttatcggatagggaggaggttgtttagattagagaggttagttattgtatttttttcgaaggtttaggaagttttaataataggggattttttgttttagtattgaaagttttacgttttaggaaatttttttattttaggtaatttttgatggttggttattttgagtatatgtgtttatggggttttttttttttcgttatttttgggagaggaatagattgatcgttagttttttcgtgtttattatggcgtttgtttggcgttacgtttgttaggtttttttgatggcggtttttgaggttgttttgtatatattcgtttttttagattattttgtttgtttaaagtgttttttaggttggaaaagtatttttaggagttttttattgtttatagggtttaggtaggtatgagtcgattttatatagcgggattgtgtgtttaggttttatcgtatttattttggcgggttggaggtttttagtagttttattggttatatagagggtttattgacgtttgggtttggaggtggtcgtattaaagcggaggttttttcggttatttggagggaggaggtcgggagacggataagtagagtttgaaaatttgattttttagcgggttgtgagaggtaggaggagagtggtagtttttgatttcggttttgttattgagttagttcggatttttttatgggtggggaaataggtttgggttttgggtttagtggggtagttttaatattagtttttattgttattttttggggatgttttatttgtagatttttttttaaatttgttatttagagtgtgtttttatttttcgtagttggggaattttatttaattttttagattgaatttaaatattttttttgttaggagttagtgttgggatatttgtagttattggggagttttgtttttttgagttttagttcgtgggtttgttttgagatttagcgagtagttttttattttgtttagtggaagtaaagagaaggaaggaaggaagggaggggtggagggaagaaagattgtttttagtttttagtggatttatagtttaggtttttgttatttgttttaaaatagtattttttgaagtttttggatatagtggggatgggaatttcgggtttagggttgggagtgggattttggttttgttttgagaagttataagaataaggaatagtgaattagtttaggagtatattagagttcggaggtagagagtttttttttttattttatatatgacgaaattgaggtttaaagaggtgtgtggttttgtaaaatattgaatttagtagtaggaaaattgattttttttgtttttttggggtttaattattcgttttgtatatagtttaggagttagaataatttaggtttaaattgtatggtagttgggtgatttgatatgttaatttattttttaaggttttagtttttttttttgtaaaatgggttagtaatattgattttaaagggtggttgggaggagtaattgtggttttattttgagtttcgtatgtggtatttggtatatagggagtattggtttggtataggtcggttttttgatcggttcgggtttttttgcgttagcgtgattttttgttatttaatagatgtttttatattttatttttttgttttttttttagcgttaagttttggtttttttagggttagagagggttgagtaggtataagattagagggattgttagattttttgttaatggtttttagggataaaggaaggtatttttcggagagaaagtaatgtaaaatgcggttataagttttagttgtagttaggttttgttattttttcgttgtgtggcgttgggagaggtgttttatttttttgtgttttatttttttatttgtaaaatggagaaaatgaatagtatttttttaaggtatgttgggtaggtttaatgaggtagtgtgtattacgtgtatagtatagggttcggtatagataagtttttatggaatgttagaaattattattatttaatgtttttttttttttgtaaaagttttttgtttgattttaagtaggatgtggaaggtgagaaattttggtttgtttttttaaggtttagttttatggtcgtttttttggggagtttttttagttttttttttttttttttttaggcggtgggggtgttttgttattgttgttttttattatttattttataggtgtttaaagggtgtttttgggagtaggggtaggtttataggtgatatttagttttttttattgaatggatagaggaaagaaagaaagaatggatggatggatggatggatggatggatggatggatggatggatgaacgaatgaatgggttgacgattggttagtttgagagttttttagttttttttttatttttttttttattgtttggttttttttttgaaatatttgttggcgcgagtttgagtatttcggtttaatcggtgtaggtagcgtgaaggtttaggtttttttttggggttttttttcgagtttgggaaaagtgtttttggtaaaaggtttagatttacgtgtgggcggaaagggtagacgtatataatttatgatttgaagggtgattaaagttagttttttttaaatattttttaacgtgggatatggtgattgagattttattagtatatgtagtttttgtgggggggagtttttgtaaatgtaggtttttttttattatgtatatttgagtgtttatagtttgtttgattttttggtttttgttgagaggagttaaaaggttggagtagaggaaatagagggtatttgggggacggaacgtttggagaacgtaaagggaaaggcggatggagtggaaaggggtggggaggaaaggaggggtttattttggttatgtttttatttttaaatttaatttgtttgggtattagggttgaggattagtatttgtggtttggtttttagtgttttttttttaagtttgagttttgttttattttattttcgtggggtaagtaggggtaggaggggaggtttgttgacgtattttttttagtttttcgtatttttgtgtttcgggaagaggtgttaggtttagggggggtggagaaaggatttttaagttagaagtgataaagagtttatggagagagtttggtgtttttatattttttatagagtagttatatttttttttagggggagagaaagttatttttgagagtaaagttattttagaaaaaagattagagggaaatattgaaaagtttatagtagttaatattgtgtggttcgttatgatggtaggtaatttttattttatatttttttgattattgtgtattttttaaatttttaatatttgtaaatttaagggaaaataatttttgtttttagagaaagaaagaggaagaggtagttttatttttttaggaataggtaagttggggtttttattagtttgagttttagtttgggaacggtttgtttttatttaggtaaggttttgttggttattttgttttttgtttttttttttaaattattgtgtttgttatttgtttttttggttttgttttgtcgggttgtggagtaagggtttgtttcgggttgcgtagagttatgtatatagtaggtgtttaggaaatgtttgtgatttgaggtgtggttttaatttgtagatagtttttttggagaggtgggtttacgtttttagcggatttaggatgtgaggtgggcgaattggttgttgttgatttatttaatgaatatttattgagtatttattgtatgtaagtattgttttgggtattggagatgtagaagtgaatataatggataaagatgttttttttttggggcgttatatttttgtgatgtgtggagagagattgttttaggaattatttttttttttagtgttttttagtgttttagttttttatttatagatggggaaattgatatttagagaggaggtagtttttgtttgaatttcgatagttagggagttgtagatgttgttttaagttttagagtttcgagatttagtttagattttagtttattaagttttattaaggtaggtttttttttttggttatttatatttttttggtttaggttttttttatttatgtagaattttggttttttggtatttttataaatgttttggattttttattaaatttttattatagtttcgtgtgttgggtattattatttttattgtggagatgaaaatagatttaggtagatggtgggatttgttgtaattaatgtttaagaagaggaaagaggattttgagttattttgtggtttgtttgatattaaattagttcgttaaatttttttttttgttcggaagatatttttttttttttggtttgagggtattatttttatggagtttttttcgatatttttaagcgaggtgatttatatttttttttatgtaattatagtatttttaggttttttttaaatattttttgaagtttttttagaaagggtggaatttgagatgggtttagaaagggtagatttggggaggaaggaattttgttggtataagtagagtgaatagtatgggtaaaggtatggaagaaggattatataaaaggattatatggagatggaaggtttatgggttttgtggagggtttgagggagaggagattgaggaagaaggtgggttaggtttggggttggttatggttttaggatatagggttttaggattgaattaagttgggtcgtgatgtggggtaaagtattttatgatgtatagggcggttttttgaaataggttagtgtagatatggttttgagggtaggtacgtgtgtgaatagagattataggggtttttcgtatttatttacgagttttgtttttattagtttttagatatatatttgagtagtcgaagtatatttgttttgaggtacgtagagggtttcgtggatggttacgttcgtggttggataaggataagggcgaaggtttagagtagttgaagggaaatttgttttggggagaattttagggttagtgacggcggtatgatttttagggtatagtgtaaaatgaaaatataggattttttgtttaaaaattagtaagaattttaggatagcgattatagaatacgaaattaagtatgaggtttttttaagtaagggattttgtgtaattgtttaggtttgaaaataagtttttgtttgtttttttttttttttttggatttgtgtgggtttttattttttatgaatttatagtgttaaaataataataagtgaagttttgggtgagagtatagtttgaagattttagaattagtaagaatattagggaaaatatgattttaattaacgtttttattttgtttgtattttacgttgtagaatatttgaaggatttaagaaatttaaaaataagttcggtaattttaatatttagaaaaaattattattattcggtgtgtttttttttagtttatttttattttatgttttgtttttgtttttgtgggttttttttttttatgtgtgaggttatgtagatatgtttgagaattttaataagaatattaataggttggggtatggcggttttcgtttgtaattttaatattttgggaggttgaggtaggaggataatttgagtttaagaggtgaaggttgtagtgaattatgatcgtgttattgtattttagtttgggcgatagagtaagatttggtttttaaaaaaaaaaattatatattaatagttattataggttgaatattttttatttaagatggttgggattagaagtatttaaatttaggatttttgattttgttagatttcggaatagttggattatattttagtttaaaatttaaaattttttaatgagtattttttttgagtattatgttggttttaaaaaagttttggattttggagtattttagattttagatttttgaattagggataattaatttgtataggtgttaggatatgtttaagaagaatttagaacggtatcgtttcgtaggattttttgtgatgatagtaatgttttatgtttgtgttgtttaatatagtagttattaggggtacgtgaatttcgagcgtttgaaacgtggttattgtaattgaggaattgaattttttattttattttattttaattatttttatttagatagtatttaagtatttttatttaaaagttaatggttattttgtagggttatgtagatttgttttttttttttttttattttttttttttttttttttttttttttttttttttttagacggagtttggttttgtcgtttaggttggcgtgtagtggcgtaatcgtatttattgtaagtttcgttttttgggtttacgttatttttttgttttagtttttcgagtagttgggattataggtgttcgttattacgtttggttaatttttgtatttttagtagagacggggttttattgtgttagttaggatggtttcgattttttgatttcgtgattcgttcgttttagttttttaaagtgatgggattgtaggtttgagttatcgcgttttgttttttttttattttttaatttaaaatgtttgaaaagttttatatataataagtacgtattgttttagtaattaaaagaaagatagtaaaaattttaagtttttaaagtatttaatgttatcggaaaaaaaaaatatttgagttttttaaaagtttatgatgggggaagattgattttgttagaataggatttatttttatttttttagttaatatatagaagaacgaatgtggggtttagaattagaagttgtgggtttgtttatcggatttgttatttattggttatgtgtttatttaatttttgtgaattttaatttttttatttgtatgatggagatattgatgttagtgatttttttaggtcgttgtgggggttgaattagataaggaaggtgagaataggaggaatggtttagcgatggtgtatatgattggagatgatttttgtagaggtggagttatttatttttgcgagagggtgttttttatagttttgattttttttgttattttttagaaagtaggaaatgagggtggtattttttaacgtgtgtttagatgttattagttgttgagtagaaataatggaattttgtggttaaataagattgggattggttgttttaaataatgtttaatggtgttttgttgtaggatttgttagagtttttgatatgttaatggttattttgttgggttatggagatttaaaatagtgtatgtttaattgtttattgagttattttttggggtgagatgatgtatttggaaggggttggtgtgtgtaaagtttatttttggaaaagttgttttagagagagttattggatttattatgggttataagtattgtgggggcggggaaattatttttttaaggatttaggaaattgtattgagattttaaaggaaaatttgttggattttaaatataaaagggaaaagtataatattgaaatgaattaattcgtaattgatagtttagaaaatataaattatgatttaatttttaaatagttttattagtagtaaatatttatatagtttttaattttatgttagttattgtttaagtgttttttatatttttgtttattttgtttatatatgtatttgagataggttttggttttgttttttaggttggagtgtagtggtataattttgtttattaaagtttttgttttttaggtttaagtgatatattttagtttatttaatttttataattttataagataaaagtttttatgaggtttattttatagatgagaaaattgaattttagagagattaaggtatttgtttaggttatttatttaggtagtttgtatttagagtttgcgtggttcgttaaagtatagtagttatgaattaatggacgtttttttaggttaaggagtatttttggtttttttttggttttatttttggtaagagttggtggtgtttttacgagtttggtttttacgttttttatttaaatttagagaggttggagcgatttaaggggtgaagggaagttaggtagaattagttttattatttttttattgggtgagttattgttttttttgggttttagttttttcgtttgagaaatgggttagtaattatttgtggaataagagaggggagatttataaaatttagtgtatggtttatgtagaaggtatttgaggtgtggtggttttttttttgtttagtgtatagttagagaaattgaggtatagagagagagggatagggttaaagttgagtttagagagtattttagggagttgggttagaattttatggtaatatatgtagggaaagagttttttttttttttttttagtaggtatttatgttgttttatttttttttttttttttttgagatggagtttttttttgttgttagattggagtgtagtggtatgattttggtttattgtaatttttaattttttggtttaagtaatttttttattttagtttttcgagtagttgggattataggtacgtattattataatcggttaatttttgtatttttagtagagatagggtttttttatgttatttaggagggttttaattttttgatttcgtgatttatttattttagttttttaaggtgttaggattataggcgtgagttattacgttcggtttatgttgttttttttacggtagtatattaagtattttggtagggatttttgggttttttttttttaggttttttagtttttttggggtttttttatttattataggtttgtttgatttagggttatgtttaggtttattgttcgggtatggtgtagatatgttttggtattttcgttaggtgtttttttttgagcgaggggtaggtatataggtatggttttgtttatggttttttgtgtttgtttaggtattttagatattttaagtagagggaggtattttatatttttttattttaagaatagagatttattttacgtttagttatttgtgagattgttatgttttagggttatttggtttttttattttttgtgtttgaatttaacgtttagtagttgttatattgaaatgttggattattttcgttttgaattagtgtgttgtaaatgaagtttgatgggttagtgtagtatgtttggggatttggggttcgggtttagtttgttttttgttgtttttagggatgggtttttagtagtttattatttgtattgtcgttttttattgaggtaggtatggggaggagaaaggggttggaatttgtatattaagttttggggtggtttttgagtatttgtgagggtttgtattttttgtataagtttttttaggtttaagtacgtgtgatattgaatagtaaataaaaaatattatcgtgggttgagagtttatagaagaaaggaaaaatttttgtttttgtattttgaaaaggggttttgtattttttttttgtattgggttttataaagtaggtaattggttttgtttgaggattggagagatatgtaggatttttagaaatatagtgtaggtatcgggggagtttagatgagttgttttgttgagtttttgtaagtgagaggagggagtaacggtttttggggttttttggggttttagggtttaggtaaaaagaggaggttgtagtgtgaggattttgggatatggaagtttcgtttataggtattttgagtttagttatgttgattttttttggggtggttttatgttttgagttaaggtttatttttttgttaagtagggtgttaagggttaaggttaaattttcgttttagagaggtttggtttagagtggtaggttagaggtggtgggtgggtttttgacggtttttttggtttaggtcgcgtggatgataggttgggtgaggtgggttgttggttttggtttttatatatattacggggaatgaaaagtttatagaggttattgtagagtgtaggaggttaggttatagtttagttagtgatgaaggttagtgggggttagtgataatttggattagaaattaagttgtggttaaggttgggatttagtttgtggtcgtttggggagttaggttggggtttttttttgtttcgtttatattcgttaagtttttggtgtgggtgttgggtagggtttgagttataggaggtgtttagtaaatgtttttggaggaatgaataaatgagtggtttgtttacggggggcggggtatggttggagtgtagttttggacgttggacgatttgtattttttatttagttagatttggatttaaattttggttttgttttttatattttgagggggatatttaattttttttttgttgtttttttagttatataatggggagaataatagtattttttttttaggttgttagagaatttattaagataaatttgaagtgtttagttttatagtcgttcgtgggaaatgttttagtatgtgggaatgaatgtgattgtattaagaagatttgtagatttttatttttttaaagatattcgtagtgtttattgtggttataagattttaggttttaatattttttatgtgttttttgtattttttaagattttttattgtgtttatattatttgtattataggggtaagtagtaggaggtagggaggtgggttcgattaatgtgattaatttatagtattgtttaaatagataattataagaggaggttaggtagagttggttttttttaagtatttattggggttttagttttttagaggttttgatagtatttgagttttgtggtttttttatatgtatttttgttttggatatgttttttttttatatgtatatttgttttgtatgtatttttaatgtatttttgttatgtataaattttttttttttatgtatttttgttttgtacgtattttttatatgtatttcgttttgtatatgatttttttcgatatgtatttattttgtatgtattttttttttatatgtatttttgttttgtatatggtttttttttatatgtatttttgttttgtatgtattttttttttgtatgtgtttatttttaggttagattagtattatttgagggtttttggtaagatttgcgggtgtgttggggtttttgttataggttgttttagtttagtaattaaagtttgtttttgttattatgttaggtttttcgttttgtgtgtttatttttattatgtgtatgtgaatatatattatttttatataagtatatatatattttataggtcgtatttgttgtaatagatatagattttttaggaattttttttggggggattaagggttatttggtggcgtggtttgagggaggttgtagggggaggatgtttaatttttatttacgttgttttttttatttttggttaggaaattttttttttttttgggggtttttagatatttgttacgagtttttgtttattgggtggatgtttttggagggttgaggtttttaggaatttaggattgatgtgatagagttagggttttagtttagaaggaggttttttagttgggagaagttttagtgatgtttggagggttttattgtttgatagatggggaaattggttcgggagaaggtggggtttttttaggttattttaggaagaaaggtagaagcggaggaggtagttttatttggtggaagtatatagtagagagggtagaggaagttagttttggttaaatttttttgggttttgggtttttcgtttggtagataggggttatttaggttttgttagtttcggttgtgatttgcggggagttttagaaggatttagggaattttaggtgaagtttatatagttttttgggttgtggggaaaggaggatgtaaatagggagcgtttttaggggtttaggttaattttttgtaattatttttgtttttttttttttgtggggttaaaaaatagttttttatttgttggggtagggtgggttagtttttatttggggtcgttaggttttttttagtttagttttggttaaaggtttgtttattttaattttttaaagatcgggtttggttgtttgtggtgagttggtttatttggtagggttttttttttttttgatttagtattgagtatttgtatttattgtgtttagagtcgttataggtttaggaggttgtttttgattttttgtttttttattttatagacggagagggtgagttgtttagggtatatatggagaaaaaataggtataggatttggttgtttagtttttaggttaaagtttgtttttgtttcggggtagtgttgggattttgttttattgggtagtaggtagttaggtagtaggtagtcggattattggggtagcgtttttgtatttttaggtgataaggtttagggtttatagttttttggagtatttttagtgtttttatttgtaagatgggagatagttatttttagttttagggttatcgtgaggatatatagagacgtagagggtttggtacgtggtgagtttcgtgggttaattattattaagtatgatgtttatataggtttgaggtttagaggatttttagattatagtgatttttgtggttattttggttggaattaagtatttgggttttagattataacgtggagaaatagttgagtaaatgggtatttttagcgttggatggaattagtgaggttttgggtgtagataaggtttttttttggaggaggtggaatattgttttcggttttttgttaagttgagaagtttaggttgttagtgggagtggggttggagagtagttgtggggaggatgtggggcggtgttcggagttttttagtgtttatattggttttagtaattttagttttagaatttgttttaaggaaggaattagggatgtagttaagatatttacgtagggtgttttttgatagaaatttggaaattttttaaatagtttattataagggaattatggtggtttatgagtagggggggaatgggttttttatattttggtttttattaggtttgtttagtagttatttgttttttgttattagggaggttttaagaaaataggagaatatatatatatatatgttgggggattttaaaagtaggtttaaaggattttatattgtatgtttttaatatttaaaaaaaaaaggaaggagagaagggagggagggcggggaagagaagaagataataaatttatatatatagtaagaagagtagaaggttgaatatttagtgggaattattgttttgggtggtaggattatggatggttttaatttttttttttataattttattattttttaatttttttttaatgaatgtgtattatttttataattagaaaaaaatgtgttttgttttaaggaatggggggcggtttaggattgtttttttttttttatagattttgaaattgaggtttagagtggaaataaatagtattcgtttatttatttagttatttatttatttatttatttatttatttatttatttatttttaaatgtttttgggaatttttttaaagttagatttagtttgaagttttatgttaaagagttgaaaggggtttattttcgtttttagggaggttatagttagggaacgtaaaggatataatagtaagtttttataacgtatttagataaggggttatggtggggaggggaaagagagggggttaagtttttttgggagttttagagatggttttataaagagagaaaagtaggatagggttttgatgtatgaggaggagtttagtagttagagaatgcggaagtatatattttgaaaaggaatcgggggttgttagagagagaggatttatagtgtttaggggaatgggtagggagataatattagaatattttatgagttaagtttttaaaggtttggaattgtttggttttgttgtttaatggttatgtgattttgaataagttattaagttttttgggttttagtttttttatttggaaaatgggttaattattttattgggttattgtaagaatcgagtgagttaataagtgtaaagtatttagttcgggtttggtatattgaagcggttatgaaattgtttgtttttattatttgttatgatttatattttattttgtaggtattttgggagttaaagagggtttttaagttagaagttaatgtgaatttatttgtttatttattttatttatttaatagatatttattgagattttaatatatatttaggaatggttttatgtgttggggatgaattcgttagataaaatataagatttttaaattattttaattttagataaacgataaataattgtaatatttggggtaattttatattaaaaaggagtttattatttatttgaaatttaatttaattgggtgttttatatttttatttgttaaatgtgataattttatttgcgaatgtaatattaagtaagtaaaaaatttttgtttttttgtagttgattttttgtgagagaaaagagataatttataagttaagttattgtgtattaggtattaataaatgtgttgaggaattgttaattaaggaagggagatatattcgttttttatgtttgttattataaattaatttatttttagtgttttaaaaaaaatatgtatttataattttatagttttagggattagaaattttttatgagttttttttggttaagattaaggttagggtagggttgtgttttttgttggaggttttggtggagaatttgtttttttgttttgtttagtttttaaaggttgtttgttttttatggtttatagtttttttttttatttttaaagtttatagttttgagttatgttttttttacgttgttattttttaggttttttaattagtttttatattttattttttttcgattgtttttttttgtttttttattttatgtgtgaggatttttgtgattatatggggtttatttggggaatttaggataattttttatttgaaagtttttattttttattatatttgcgaagttttttttgttatataaggtaatatagttataggtttggggattaggatgtggatatttttgtggttattattttgtttattataggagattagagaaggttttttggaggaggtagtagggatttgaatgaagtgggtagttgagttaggtagatagaatgggaagggttttttaggtaaagggtagtatagataaaggttttgtggtgggagtatgatgggtatatttgaaggtagggtggttggagtagggtgagggaggggtagagtggaagtagatgaggttagagaggtggagggtggtaggttatgtagattttattaagtttggttagaaggggagaattagtttttttttgttttttaacggtttttaagttttgtttttgaagtattattttgttttgttaagttgatatttattttaggagtatttatattttaataagaaattttgtaaggttttaagggttaagtcgttaatgtttaggtttagcgatggatagtaaagagatattttatggtagagaggggtatagttttattttttataatattagggaattggtgattttttttaatattaaaggttaaattttttttagagtattgtaagatgagaaggaagaggttttttttgtaaacgagggatttaggttagatgtttaaaagaattttttgtgtgttagtagaaaattgttagttaaggttggtaatatttgggagtttaggttttggttgaggattttgtttttagggggtttgatatttagggattagcggaggttttacgatgatttgggggaagaatgagttttgattttggatttttttgggttttagtacgttatattttttttttagatttgttttttcgatataaggggattagttttagagattttcgggggtttttttcgtattggttaattgttttagggtttttattttttaagataaaaatttggtagttgtgtgtttggtaggttatttaattttgtcgagttttagtttttttaattgtaagtggggatgattatagaatttttttttaggatggagtaaggatgaagagttaagttgtgtgagtttttagaatcgtgtttggtatcgtgagtatattattagtgggagttattgcgatgaagattttaatatttttagggttttagagttttaagtttatgattttgtttttaggagttttatatttgttggttgtgggattttgagtttttagatatttttttttattttgttgttagtatgtttttaaagttttggttttttttacgtgttgggtggtatgtttgttttataattatatgaaaagttatttttttagggtgtttttatatttgggaaaatcggtagtttgttcggcgttggtttcgtttggtggttggaatatcgggtaagattaatgatattcggttcggttttcggtgttgttattttgttttaattagggttgggcgtttttcgtttcggattttcgtttagttttgagtcgttgtttttttttagattttatttagttgtttatatttttagtttgtgattttttaggagcggtgtttacgggttggttttatagtggttgtagtttgtttggattggggtggttgaataatatgttaggtaatgggtaggtttcgaggagtattaggttgggaggcgggagttcgggttaggttttggtattagggtatcgttgatgttgattttttttattttagttttagttttttgtattgtaggttaggttatttaggtttattttatttggtttttagggttgttgtgggagaagtaatagagagaaagggtagtaagagttttaggaattggggatattagtagtgtagaggagtggggagaaggtaggtgggtaaagttagttttattgtgtagtgggtttttttattagtttttttttttttttttgggttttttttaattttttggttttagttcgtatgttatttgtttcgatagattttttttgattattttgtttaaagtattgttaagagtttttttttttttatttatttagttattttttttgattttatttttatttgtttttttgagtgttttaagatattattaaatattggcgtgtttatttatttgtttttttgtttgttttttgtttgttttgttggaattaaagtttttaaggagttttatggttttttggtttattgtttgtatttttagtatttaaaatagttttaggtgtttaataagtgtgtgttgattgttttaatttagtgttaatttttttttttttgtttgttttttattttttttttttttttttattttattttttttttttatttaagtttagagttgttaagggtaggattgggaatttttttttttgaggatacggatgggggtaggggtaagtttaggttttcgtgagttaaaagggtttttagattatttagttattttggatttgattaaggtttagaggtgaggtagtgagagggttttttattttaggtttgaggatatttagtgggtttttggaagtttatttaggtgataaatgttatatttttgttagtggaaatttatgttaatagtaaatgatagagtgtttagtgtttgagtttgttatttggatttgttaggtagggagtttaaagtttgttttagtttcgtttggttgtatttatagttttagtatttttttagtagttatgattttgtaaggaggcggggatttaggttattatatagggttagtattattttgggagtagattttttaggtagtattttttaattttagttaatttttttgttggtttttggttttttgggattcgttgtggattttggagttatcgttttgttttttgtttttatgaagtttgagttttttatatagttaggttaggaaatataatttgggattaggttgttgaggtttaaggtttagttttgatatttatttagggtgtgaatttgaatacgtttttgattttgttatgttttcgttgttttattgttataatggggatgatgataaatgtatttaatataaaagtggtttcggggatttaatagtatgtgtgagtgtatataacgttagttattataattaaggggtttggtttttcgggtgaggttgttgtataattttggtattgatagagttggtttaaattttagttttgtttttttttatgtaggtgtaagggatttttttgtttgtaaagtgggtttattgatatatatttgaagggttattggtcggttatgaggagtgtttggggagcgtgtttagtaggggttgttatttagaagtgtttatttaggtgggggttgttatgatgaggatagttgtaagggtttgtagagatttaattgagagtgtgatggtatataggattattcggatgaaatagtgtagttttgttgtattatgaataattgtacgatattatgtatatttgagtatattgtttatttttttagaggtttggggtaggggaattttttttatattttattttttgtttttttttaaaatatttttaaatatgtaaaatatatgtatagaagaatgtataaaatataagtattgtttaaagaagaagaataaagtagatatttatttatttattatttggttttaaaaaataaagtattaatgggattttagggtttttattagtgttttttttttgattgtatttttttttttatttattataggtggtaagtggtggggattatttttttgatttttttttttttttttggtagatatagagttttattttgttgtttaggttagttttgaattttaggttttaagtagatttttttattttatttttttaagtagttgagattatagatataagttattacgtttagttatgatttttgtattaattatttttttgtttgtttgtttgttttttatttttaatgttattttttatttataagagtagaaattttgggatgatttgaaagattaataataggggatgtgatttgttggagtttttggaaataatttgttttttttattttatagatgaggaaattgaggtttggagagggttaaggttatgtagatggtaaggtgggaatttagagttggtatgttttgaattacggatgattggtttagaaatggagttttgtagtcgtttttttatttgtttaatacgtgtttgttatgagttgagcgtttgagatattagtatttggttcggtttttgttttatttaatattcgaattttttgtataatattttggttttaatttgatttttatttttgaggggacgtgtttttattttaagttagtttttaatatttttatttttggtatggagtttttagtatttatatggtttttgttatttgggagttttttatagatttgttagaggagtttttattttttaagtttgtttttttttagggtaaagtttttagttgttttaatagtttattatgtgatatggttttagtgtttttttttatgttgaggtttttgggggtgttatatggttttaatagagggggtttaggatgaagtttagagaggttatgtgttggtttagggtattttaatttaaatttaaatttaggtttttgggtttttaggttagtgttttgtttttttatttatgttgtcgtggggtattttagttgtaatttttttatttttttttttttattgtttttttttggattaggaagataggttttttttgtttttatcgaataatgagggagcgggttaaatttagatgttggggaatggtttggaagttttaggggggtaaattatttagaaagtttatgtttttgaattgaggagaagtagaaatttttagagttagggttcgattttttttagagttgttttgtagaataaatttaaagttttgagttttgattttatgtttgtttttgtgtgtaaagatttgtttatataatggtttgttgtttatatagttgtgatgtgggtttttgtttatgtgtgtgtttatattatttatataatggggtttatttgtgtatttatttgcgtatttatattaataggtttatgtatgatgatgtagatagaggtattttttaggagtatttttgtatatatttgtatttaattgtttgtatttgtggttgtattgtaataatgttgttttttatgagggtttgtttatgtgggtgtgagttgttagtgaatgtgtgagagattgtgtttatgagcgtgggtgttgtgtgtgagtgtatatatgtagggtatagatgtgtgtgcgtgtgtgtgtgtattttgcgtgtttagggtttagtggagattttttttattttagttttttattttatgtgtttttttagttttggagtttggttttttttttttattttttagttaaattataatttttggaaaaggggtttttattacggaaatattgatatagtttaaatgcgattggggagaaaagggttgttgttattttttggtttatttttgtttaaagagagtgttttagtttattttgtgtcgttgtaataaaatatttgagacgggataatttataaatagagaaatagaaatttattatatatggttttggagattgggaagtttaagattaaggttttggtaggtttcgtatttggtgaggttttggattttttgtttttaaggtagtgttttttggttgtgtttttcggaggatatagaatattgtgttttgaagttagaagggtaaagagggtttaatttatttatgagggtagagtttttattatttaattatttttcgaaaggttttttattgttttttaatattattataatgggggtgaagttttaatgtatgatttttgggagatatttaagttatagaagaggaattttattgtttgttaaggatttttagttgtgatttttaggtttggatattgagggtgtttgatagattatttgggttaaaggcggcgggataagggtaagttgagttgatgttgaggttagatttttcgaaagtttgtgtagaggtaatcgggttagttgataggagttttagagttaagtttatttgttaataagtattttttgtgacggtgggtaaatttttgattttttttgggtttcggtttttttagttattagatgcggaaatgaatagatttgttgtagattaatatggaattttagaatgttgaagatagagaggttttttggggtttaggtgtggtttaatgtatttatttttttgaaggggagtttgagggttagagagggaagggatttgtttaaggttatttagtaaggaataaggaaatggttgttttggatttagtagttggttttatgagttttaggtttaggtttggttataggatatggtaatttatgggttttgtttagttttaatttttattaagaatttggatttttttgagtttattaaggtgttagatttaattgttttttaattagtgagggtggtagaggaaaattgtagcgtgaaagagtggaagaagatataaggaaggatttttagatgtttagaatggagagttgtgggggagggggatagggtagggttttagttatattttagattagatttaaggtagtgatttgtatggaaagagttaataaatttataagtggtataaataattataaaattgagattttatttttagttttatggatttaggtttaggtttattgttgtttaggttttcggtttgatattgatttgagaatttttatttttttggttttagttatgttttttgttatttgggaatagagtagtttaattgtgtgtatttttatttttttgggtatggtgaagatgaaataatgtagaatgtagagttgttaagagtatttattttggagttagggagatttgagtttaagtttaggtttttttgttatatggaagtttttttgagttttaattttttatatttgtttaatttataaagttattttgaagtttattttaggtgatataagtaaattggttagtaggtatttaagaaattttatttttcgggattgggtatatggtaggggttaggagagacgtgataattggtgatgaggggtggatttgtggttaggattggttatataatttggggggtttagtataaaatgaaaacgtaggatttttgttgagtaagtatttagaagtttaaggtagtggtggtagggtattaaaataagtttaggatttttttgagattagggttttgtgcgattgtatgggttataggttagaaagtcggttttgtttttgggatatttagggtggtttaaatttagtttaggtggagaagttgaggttttttttattatattgggggttattttttttttttaggattgtagttgggattatgatcgttggttttgttattgttagtggatattagaggcggtataaaagatcgattgttgtttattttcgtatgtttatttgtattttatgttatgcgtatagtatatagttgatttattttcgtaaagggttgtattttttttttttttttaagggcgatgttggaaagttatgtggtttttattgttggtaggaatgtttgaggcgtttttttattattatatgaaatagagtcgtaatttttatttgcgtaaggttaaagtttttagtttttttcgagttatcggtttttgagattaattaaggttttataaggattgatagttattaggatttttttggggaggtggaaaatttttaatgggtttggttgggtttagaagttgttgggtgggtagtggggagaggagggtttgcgagagaggaaggtgcggagttagcgggaggtagttggagaggtagggggtgtagattttgtttttggtattggttgtgattttgagtgagattttttttttttaggttttagttttgttatttgagaaatggggatttggatttgatattttagagttttttcgagtttgatattgtaaaatttcgaattttgtttatagtttttttgttaggattttaattttattttatgattgtaattttgagtatttggttttagtttataagagtagagtgtagtgggtagtaatatgggttttggggttaggttgtttcgttggaattttatttttgtggttttttagtggtgttaatttggataagttatttgagttttttaagttttagtttttttttttgtaaaatgggagtgataattgtcgttattttttaagaatattgtgaagtaaaaatgtgtgtaaagtaatagttatttagaagagttttttttttttttgttcgttagagttgaattttattttgggggaagggtatatgttttttagaagtttttttggttttaagttgtttaggttttttttattattttatggtttttagtagaagagttcgtgtttgatggttttgttggtaggtagttttgtacgtatttgttgttttggatggagagttttgcgttgagagtagcggttagagtgtagatagtttttttttgatcgaggagtggggtgttggaagggtttttgagaatttgtttgaattttttagattttgaggtttatagaggaaaagttttttattttcggagtttgggtttttttatttgtgaaatggaaagaataaaatttttgttttttagaggtatttgagggtgagcgataattggcggaaaatttttagtatgcggtaggtgtttaaaaaattagggtaattattagttatagattaatgattaaagttatagattagataattgttttttagaagtatttttttgatttatagatgataagagcgagtagtagggagggtggtaggaaggttttattaagtgatgggatttgaaattagaaattttttttttggtaatcgatggagacggtttttttgttttgcgttttcgtaaaagaagtttttttttttcgtttttgttttttttttttttttttatttttaaagtagagtattttttgattatttatttgtagaatagggtggggatgggcgtggaaggattcgaggttatgtggacgtaagggagttggcgtttcgcgggaggtggagaggaggtgggtggggaggaggggtttcgggttataattaaattttggggttttatggaattcgtatggtatgtagaggggttttgaaagtgtattttcgtatttagatgtaaatattgaggtttagagggaaatacgtttgattagtattttttttgggcgagaggtattgaatgtggtattagggtgttagtgtatgaggtttaggattgggttgtagttttttgtaaggtaaaggttttgtttaattgcgttttgtttcgaggtgtttgtttttggttttgttggagtttattttagattttgattacgtttttttttttttttgggttttagtgtttttatttgtaaattggggattattgttagttttgttttttcgtagattggttttgaggttaaaggagagtaggtggtgggtgtattttgattattataggattttttcgaatgattttggtaagttttttttgattttttgtagatttgaagagtttattgatttttaagtttagggttgtttagtaggatttattaaatttagttttttttttttattataatagtttttttttttgtatttagatgttagttttttttattatttagttattaggaggagagtgttgatatgtttggttaggtgatgcgtttatgttttatattttgaattagagtagatttttaattcgggtttggttttttttagtttggttgatttcggataacgtttttttttgtttatatgggtataatatttattatatatgacgtcgtggggattgaatattatgagtaatgtttatgtgcggcgtttggtataaggtaaagttttagtatttttagttgttattgttttttttattttattttcggggattaaggtttaggggagcgtggatattaggtaaaagttttagatcgtataggtagtatttgggttttaatatttttattattttgtttttttttgtttttttttttttttttttaagtttggaattttttaaaaaggaagaaagatttttgtaatttgagaagtatatttgtgtttttatatattttgaatttttttagagaggttgtttaggatagatgattttagagttggattttttggagttggattttcggtttataggagataattttttaatttagatatattgttattttttattaatatttttcgtttatatatttagagattattatttgaaattaggatgtagatgagttttagtttatttagtagtattttttttttgtttttttaaataatcgattattaattataatgatgtttttttttttttagagggaatttttaatttttttttcgtgaaatggagtggttagaatgatttttattgatagaagaggaaattgaggtttagtgaggggtatgaatgttttttttgagttttagggtattgggtaggagataggttttattacgggtttttttggataggggatttagggttaggttgggagaaatttttagttttagaagagagttttttgtttttttcgttggattaggtttttgtgtgattcgggatatggggaatagaggttttttgggaaggaaacggggtttttggtagtgttcgttgaggtttagttgttatttaggaaagggtttgtttataggagggcggtcggttgggggcgaaagtgaggttttgagaggaatggttagataggtaattatcgagatttagttttggtcgttttgtgatggttgttggaaatttcgttatgagttgattttacgtggaggtaggttatagttagtttttattttttttaggtagtttgtgggcgaattgagggattaggatagtatggattggtttggagttttagtaagttttgaatatgagaattggatattttatagatggaagtgtgaggtttagagagaggaggggtgggttaaaggtttttagtaaggattgagaggttttatttttttatgatagtgatggttttcggaggttggagtattttttatgtgttaggtttgtgttaagtattttatatataattttatgaagggttattatgagtgttttattttataaatgaaagaaatgaggtttagagaggtttaggtaattttttttagagcgttgtgggtgagggaaaaagatacgtttaggtagagggattgtggattttagttttttttatagtttatggattttttaggcggttttttagggtatatttgttttttgtttggtatatttggggatttttgtttaggcgttatagagtttatatgaattatatttgttttgggaaggcggtatttttattgttaagaacgtatttagagagtatttttaaatgttagagggagacgaattttttttttggggtaaaggagttggttttatttgttcggggatgggttttgggtttatttagttttaagttaaggtagggtaggggagtgttttgattttttgttttttagttttgttgtggataatttagggtgtttttaggtgggggttattggggagaaattggtttgtttgtttatcgatttgatggaagagggagaaaagacgacggtttatgttaattggggaagggcgagggtgtttgtatgttttaggtgggggagtcggagtttttttttttattaaatagacgataatttttgtcggttcgggatggggaggaagtaggtggaaattgggaataagttagtttgttttgtgggtttttttcgggtgtttgaaaacgcgaagatagaaggcgtttattttattagaggtgaggaaggcggttttggtttgatataaagttatcggtttgtttgagatttggtcgtatggatggtaaggaaagggtagtttttcgggggcggtcgtcgcgtttgtattcggggtcgtagttggcgcgtatttgtagttcggtcgggttcgtattttcgcggttggtagggcgcgggcgttaattagcggcggttttcgttattgtgtttgttaggcggtttcgcgattttggtttggggatttaagggtttgtattcgtttttttttttttcgtcgttttggttttttggatttggtgtttacggggagttagcgttttacggagagtcggagtcgtgtcgggttttgcgttaggtgttagggtttataagagttttttattttttggaaatttgtttgtgaatttatcgtaagcggagagggagaaattaggcggaggaataagtaaagggtacggtgtaaatcgaaattattcgataaatggaatttattattatttgaaatagcgggttatggtttcgtaatttgttcgagggtagtacgtgttgttcgttttcggttagggttttatttggttacgacgcgttgcgttttttcggagacgttttcggaggtgggagcgtttaggttggattattcgtttttttttagttttgttgttcgtgttagcgcgttcgagggcgcgcgggtttgggttcgtaatcgataattgttaggcgtaggtttttttaaaaggtttagtaagggatttttgtcgttttttttttcgatacggtttgagggcgtgttgtgaggtttcgaggtgggtaggggttagttttttcggtggtcggggtgagtttagagtttttcgtttttggagcgtacgcggggtttgatttcgtttggtaacgacgaaatggcgcgcgttgagtaggggttagatttatgatgagattttgcggttatcgtcggattttaagtttttttgttttcgaggtttggaatttattgttttgtatttgtcgagagtcggaggtaacgaaaatttagtttcgtttttaaagcggcggggaggtttagtacgcgttcgttttttagagtttagggaggtgtttggggcgataattcggaatgattgtggtttgatttttttcgttgtttttttaattgtagtcggtttttaggtttgttcgatagatttaggaggcgggagaggaaggggtgatttgtagtgaagtttaggagaggttgggttacgcggttgggagtgggagcggggattcggagtcgggcgggtaggtagtgttttggcgaagttgttcgcggtttttgcggcgtagtcggagcgtacgggtttaagaagaagtggggttggattcgtagaggttattttttattcgtatggagaaagaaaatttttttttttgaaagcgagggtttttagttttgtagttattgttgttttttttttgttatcgacgcgcgtatcgttttacgatgtaggatcgtggttatatgcgtaaaggaaaaaaagaaaaacgtattttgtaggtttcgtcgtgttttttaaagagttataggtcgttataacgaagaacgacgtcgcgaggtttgtaagattttgaaatttgttttgaggggagagtagagaggaaaggggttgttggttttaggttatttagggtttttaggagattttttttcgtttgttttcggtttggtataggggttatcgaggttgggattaaagtcgcgtagggttgggagtagtaaaggtcgtcggtcgggcgtggacgacgcgtaaaatttcgtgtggggtggaggtttttgggttagaataatgtgcgggacgagggaggtgagtaatttttttggggcggtttttagtgcggcgttatcggttttgagatttcgcggtttttagttcggggttgtagaagttataggttcgaagtagtaagagttggggaagttcggtcgcggttagcggggaggaggagcgaaggggttgcgttttagcgttagggagttacgattcgagagagggcggtaagggcgtttttcgtgggattcggacgttttaagtaaatttttagtatttgtttcgggtttttagagttttcgggggttttgggttgtggtattggggtttttttcgcggggtggcgtttttcgttttttttcgttgggcggttttcggtaggtttcgttttttttcgcgaacgttatcgaggtgttcgcgatgggggtttcgtcgattggttgtgcgacgcgtcgtttcgttagtttcgtttcgcgggtttcgggggtattaatttcgcgcgggcggtcgcggtttcgttatttgattttggaggatttgttttggggttgcggtcgcggagtcggggcggtcgcgggcgagtttcggggcgggaggcggcggtagcggtatagtttcgcgcgggtttcgtcgcggtttaggtagtcgggatagttacgaggggcggtcgtacgcggggtcgcgcgtcgaggatgcgggattagtcgggtaggttgcgggcggtcgtcgggttagcgaggtttcgtagcgggcgggttttggcgagtagtggtcgggcgtcgttttttgcgttttgaggttcgggtttcgtcgtttttgttttttcgtttttcgcggtagcggcggtcgaggaggcgttcgcgtcggtcgttttcgggggaagtcgcgtcgttttcgtttgttcggcgttttgacggtcgttgttatgcgtattttcgtagatttaagtattagtcgtcgttttatattttttttttcggtttttttttgcggcggcggcggcggtaagatgggcgagaatagcggcgcgttgagcgcgtaggcggtcgtggggttcggagggcgcgttcggttcgaggtgcgttcgatggtggacgtgttggcggattacgtaggcgagttcgtgcgtatcgatagttttaattttttttgtttcgtgttgttttcgtattggcgttgtaataagacgttgttcgtcgtttttaaggtgagtgcgggattcggggcgggagggcgtcggttttggggtttcgggcgtttgagttgcgggagttagagtttcgggagtagtggggatgggaggtgttcgagacgtcgcggcgatattcgggtattcggtttagtttggttgcgcgttcggtttcgggatttcggcgtttcgttttggatgcgttttgtaggaatgatttttaacggggttgtttcgttttatttgggttttggggcgttttgcgtagagacgttggtgcggaaatgggcggatggggttttgcgtttttttaattcggatcgtttagatatagttttgcgggtaacggagaagaggatttcgggataggggtaaggatatcgcgggtggggtgcgaacggtgaaagggtttatttttcgtttttagtattttttttttcgcgtcgtttcgtaaaagttttttgtttatattttcgggttttcgaaattttatcggacggcgttaggtcgggatcggggtattgttttttagacgtttgttcggggatattatgcgtttcgaatggcgagttgagattgggggatttttaattttggtagtttttagttatttagaggatttttttttttatgttagggagtaggcgattgttttatttttatttttttaagggggtagcgagatgaaacgaaaacgtttcggtttttttttaaattttttatagttgtcgtgagaaaagggtagggtaggaagggtcggcggttgggggtggtgttgttcgaggtggttggaagttgaggtcgtttttgtttttattaagacgattttaaatgggaaaaaaaggaagagtggttttttgaggtttttcgggtgatattttaaaatattagtgggggaaatttcgtcgggaggggcgggaggttcgtgtgattttaatcgttagatcggaggttttattgttatttggagtttaaaaggagtttttgaaattaaaagaagataggatgttgataggaaatttggtttttttaattagattttaaatattttttttttgaaatttttattatatggatttttagtttttgtacgcggcggttacgtttaaatagttgtgattttgtttaaagtttgatttttttttaaaaggtattcgttttttcgtgtttttgggggtgggggatttgggggagatggtgtttagggggatatcgttatttttattttgtaattttcggtaggtgtatttttttattattaaaagttttatttttattttaaaggggttttttggtggttttttttaaaatattagtgagttttgtattttgtattttttttgtataacgaatttaggttttgtagaggttaataaattgggtttggtttatattttagggttaaattttatgttttaaatagtttttgtataaattgagtgggggtagtagttttgttgttattattgttgttatttttttttatttggagatttcgttgttaggagtatgttgatttttttttcgttgtagtcgaagataataggggaattgtattttatattatagtgattgagttgatttatagttttggtttagattttattgaaaggatgattttttgggatatagtttatgtaagtagttgatttaggattttggtgtggaagttcgagattttatttttttgttttcgtgatatttgggggaaggtttttattgtttttaagttttttttttattttgtattggagaaatatttagtgtgtttgggatttgggggagttgtttagtttagtttttttttttttttttttggttattttttttttttttaagttgtttttttgtattttttcgtttcgtgtttttaggtggtggtattgggggacgtgtcggatggtacggtggtgattgtgatggtaggtaatgacgagaattatttcgttgagttgcgtaatgtttcggtcgttatgaagaattaggtggttaggtttaacgattttcgtttcgtgggtcgtagtgggcgaggtaagtggaagggaggtttcgttattttagtattggtaatggtaggggtagtagggaaggaggttgaaagaggggttttagaatttcgaaaaataggtttttagatgtagttttgtttaaaaatagtaatttgtaattttgtaggatattatagatcgttttgaggaggtgaggaaagttatggttttttgttagaaaaagataatttttttttagtttttagggtttattaatttttgaaatcgtttatgttattttttttttttcggttaagtatatttggttttataaaaaatgttggtaggagatggtggattaataagtttaaaaagggagtttataggttttttagtaaggcggttgtaggataagtttttgatttgtggggtttaagtattttagttattttttttatagggggtagaatattttttatattttgaggttgtttttttagttgtggttttttagatttagttttttagcgtttttgagttttaggtggtttagaacggaagttaacgtagttgaatgttggaaagtatagttcgaaggttgttattttttgttttagagttaaggcgggtgtgttattttgtttgtttgatcgattttgagtagtagaaggaaggcgggacgggggtggggggttgttgaatgggaggtttttgggatttgaaatttattattatttaatttttggatgggaaagttttggaaattttgtttttgtggaacggaggtttgagggtttattggttttttaagattagtttgtttacgagaagtggttgaagtgggagtcgttttttttaagtattaggttcgtttttagttttgttaagaagtaagttgggttttttttgttttttaattttatagtaggttgaagtggttgaagtagaatcgtgttttttattattaataaataggatttttttaaggttttagttttttttgagttgttagtttcgttttgaaataggtatttgggtattatttttttttttttagtcgttcgatgtatatatataaatgttagttatattttgattttttagtattaattaaaattaggatattatttgtatgtaataattgtttatttgttattttttatgaaattgaaatagtttatatttttttaaatattttttgtttttgttggtttttttttttatatatagattttttttaaacggtgtttttaattggttgtaggttgatggatggaaaatgtttgtttttatgaattaagtttttattgttgtttttaattagtttttaagttttttttgttatttttaattttttaaattttttgcgatttaattttaattttgagaggatagttattggtttttggtcggtggtagataaggttgatgagttttgttgattgcggggtagtggttaggtttgttagtttaggtatgtgttaggagtattatagttgttgtttgttgcgaggcgggtagaaggtgttgtcgatttgggagtttagtaaggtattaggaatttgattttttttttttatttttttttttgggaagcgagagaaagagaagagacgacgattttttgagttatcgagattttgtttggttattttgtatattgagaatgatttttttaggggtttttatgtttatagattttgagtttttttttttaggtttgtagggagggaaatgggtttttaaggcgttggttgggagtttgtttttgtagtaggaatggtcgaggttgggattgtggttttgggagatgtaagaggttgagtttataaattatttttttatttatttttttttagaggtttataattagttttagtggttttgggaggtaggaagtgatttgaggaggagtttcgatgtttgaggaattgtggttaaggcgtttagtttttagaggttcgaggtttttgagagtttgtattttagtattagttattttgcgtttgagttttagttttgttaatgatttgttggatgatattgggtaaatgatttaattattttgtgttttagtttttttatttgtgagatggggatgataatggtatttattttatgagattttgggaaggttagggaaattgatataagtgtattagttggcgtatattgagagttggatatatgttagagattttgttattttaaatgtttgggattggaggaggattttgaggtttttttgagcggtgatagttattgattttttgattattgtgtggtttgggcgggggtgggggaaatttagaaggtgtgaattgttgagtgggagaggtggaggcggttggtagggaggaaggagggtgtcgggttcgttggtatgtagatatatatttgtagtgtttattttgttgattgggaaatttttatttgagagaatagttagtggttgatagtgataatttgggttattttaggagatgggatattttgggagttaagattgggggttgggatttagaatttttgtttgggttttttgatttttgttagaattaagaagtttgatggaaatttttgtttgttgttttaatttttagttttatattttgtttgaattttaggaagatggttttttatgaaagatacgtatttagtaatattatagagtttttaataatagggttgaaggtgtgaattaagaaaaggaagggaggaaaattaggttattgttgttttttgtagtgattagggttgaggtttttgttttgttagatacgaggagttttttttataatatatattttatattaagttttattattttacgttgaaatgtataaataatgaaatttatttatttatatgtagttgtaaattatgttattttatagttatgatggagaaaaaaagggaaagtaatttataataaaatattgatttgaatatgtaaacgttggggttataggattttatgaggtggacgaatgttttttatgtagaagtttatagtagagggaataggtagggtggtagggtttaatttgaatttggttttgttgttaatattatgattttttgaagttgttaatatttgttggtaaagcgttgaataaaattaaaaaaaaaaaaagaattgtttttttttttggaaaatttagtagatattaaaagtataaaaaaaatttttgttttatgtaaaattgagttaggtttatgatttagataattttttttttttttatttttttttgggataaggtttcgttttgtcgtttaggttagggtgtagtggtgcgattattgtagttttaattttttggttttaagtagtttttttattttaatagttgggattataggtatgcgttattatgtttagttgattttttaaaattatttgttgtagagatgggggtgttgtttattgtgttgtttaggttggttttgaatttttggatttaagcgatttttttgttttagttttttaaagtgttgggattataggtatgagttattgcgattagttagagaatttttataagtaagttttttttttttaggaagaattgaatttttattattttgggtagcgttgggtgttggtattttttattatatatacgtattttatttttaacgttggtagtgttattttaatattatgttgattatacgttattataaattttaaaaatgtttttttagtaggcggttattggtttaagtgaaaatgaaaagtatatgagttttcgagttgtgattaattggttaaaaagtaattgtgtgtcgatagagattcggggtgtagtgtgtcggtgtaggttgaggggaatcgttggttgggggagagatgaatggttttttggttgaagttgagaaaatttcgaggttttttgagattgagatacgttttttttttttatttatgtagtttttgtgggtggggcggggattttatatatataggaatttaggtagagaatgtttaaggatttgtttgaggttttgttgttatttcggttggttgatgatgggttttggaggagtttttggagttttaaaggaaatttattttttagattaagattttttttttgtaattagggttagtttttagagagtttgggtttatattttttgggtttttgatggattgtaggtttgtttgggatttttgtatagagttatatttagaggttgagagagagggatggatgggtttgttattgttaggtagagagagagttgggtagggtcggggtagttgaggggtatttagggagatagtttttttttatttttgttttttaggttttttgtttttcgaggtttaggatttttgttttttttttttatttttttttttaggttttatattttttttttttgtatttgggaggggtggtgataggcgtggaagttggtggaagcggtcgaggagtgttggtgattttaggggtggtatgtggtttgttatttggtatgggtgggggttttttattttttaggagcgggacgttagtatttgtgtgtaaaatgggagttattatttttgtttttaatttatttaataaatgttgttgagtatttattttgtgtcggatgtcgttttaggggttggagatattgtatgaataagataaaaatttgggtttttggggaggttataatttagtagaaggagataaaatgagtagatggattattaaaagtatatgtattgtgagaaaattttagtaggtgtagggaatagagaaagggagtggtagggtttgtgatattttaggttgagttgtttagcgttttttttttttttttttttttttttgttttgtgggtttttttgatagttggtgaagttcgtatattttttttagaataatgatatttttaaggtataaaattaaatataaagtattataatagaaattatttttattaaaatatagtaaaatattttaaaaattgtggtaaatgtgttgttttatttaatgtattaaataagatttagtattgggtttaatgataattatggttttgaagttgtgatgagtataaaagatatttagagtaatttgtagtaattgtaatgtgatatgtaagtatttgtgacgtttgttggtgataaggttataggtacggttgataatatttttgtggtttgttgtttacgttcgtatttgagagtgatgttaaattttagttagaggttagggataatataattgtaatttttttttattttagtttttaggtttatttaattttacggagttaagttaaaaatgttttttaggtgtagtggtttacgattgtaattttaatattttgggaggttaaggtaggaggattatttgagtttaggagtttaagattagtttgggtatatagtaaaagtttgaaaaaaaaaaaaaagaaagaaaggaaagaaagaaaagaaaggaaaggaaggaaggaagggagggaaggaaaagaaggaagggaaaaaaagaaatagtcgggtatggtggcgtttatttgttgttttagttatttaggaggttgagataggaggattatttgagttcgggaggtttaggttgtagtgagttatgattatgttattgtattttaatttgggtgatagagtaagattttgttttaaaaaaattaattaaaattaaaaatgtttattttagataaagtgattagggaaggtttgattgagaaggtgggcgatttgaaggagggttttagtaagtttttaaatgttgttgtgggttcggggttttgtggtagggtattgggatttattagtttttcgtgtttttagtttggtttttagggttttgggttgtttgtttaaatttttcgttataattaagaaggtgttggataatgttggtagggttagaggtttagggattttaggagagtgttgggttggttggaggagaaagaggtttagtagagaaatgattttagagtgaggaaaggtagtaggaggggtcgggtagggagttcgaggtatttgtttggtatttttttagattatttgtatttttgtttttagaaattatataaagtggtttttgtgatttgagagtgggagattaggtttgttttgatttggggtttcgggggtaagtgtagttagaatttttatttttgttttagtcgattggtttaggaaaaggtttttagagaagttttttattttttagttggagtgatatttagtgggttttgagttttaaattttttttggtgttttagagggttttgggttttgtggtatggtttttggtagtttggttggtttaattttgtttcggatttttttgtttttggggttagaatttttatttgattagttgattaataagtattcggttatgtaaagagaattgtgagatattggtttttattttgagttttattttttatttgtaacgtggggttgttgaaatttatttgtttattttggaggcgtgttagggggatattagagggatgcgtttgggtagtttttttttttgattattttgtgttagttttggggtataggtgagagtgcgagattattggtttttatttatagggagtttttaggtttgtacgtgggatttagaggtagggatagggggataaagtttggtttgggggattcgtaaatttttttcgttttcggttattaattttataaagtatgaggttgtggatcgtaatagagaatagggtgagaggaggatttttatttagatttttaaatttttagatatattagagaatttattgtagaaagtagagagaagattgtcgaaagtaaatttttataaattgttttttatacggagaaattcgtttgaatataaaacgatagaagaacgagaaatagaagtgaaaatgaaaaattatttagcgtgtgaaggtaaaatgtgtaggtttgtgttcggggaaattgatggttataaatatagtatggaaagtattaataagtttaatatatagtaatttttaaaaggtattaaaatttttataggaaagtaaaagaatatgaagtagtaatttgtgttggattatgatggataataattatataaaaagttttatttttattagtaatagaaaaaaaggtaaataaaattaagagcgtgtaaaagattttttattttgatagatatatttttggggtgtgacgtagttttatacgcgagggtgacgattaaattttttcggagagttattttattttaagagggattcgcgttcgtaatatgttttaattttttgttgtcgtgaaattatttatcgttttttggaattttttttaaggaaataagtagagatgtagataaagatttttataaatagaaggttatttttattttattttaaatggtaaaaaaaaaaaaaagtagtattttaaaagttttttttttttttaggaattttgaatggagattttggagttaaatgtttatttaaaaatagaatattttggaaataatagttgtgtttatagaagaaatgtttgtagtttttaaattagtttttttttagttttagttgtatatattaataagaaattagtaacgatgtaaatattcgagagtaaggaggtagataaataaaagatgaggaggtttttttgagttgaaatattttgtagttattaaaaacgaagtttatggagttttaatgacgtgggaaagtgtttttgatgtgaggttaaatgaaaaaaaaaatagtatgaaaatttgtattttagtattattgcgattgtgtaaatatataaatttatataaaaagagttgaaagggaaaatattaaatggtaacggtgtttatttttagttagtggaatcgtggggggggggtgtttttttttttttatttatattttgtatgtttttgaatttttttataaagattattaattatttttagaaaatagaatatatttattttgttttttattataaaatcgtgtgggtttttgaatagaagagatagtagaaaggttaagaagaggggaatatgagttagggtggttacggtatggggcggggggttgataaagttggcgttagatttttaggggttttgaatgttaagtttaagagtttgaattttatttagagttttattttttgtttatgtttaaagaggatagagtgtttttttttgatagttaggggtttttaggggtagatataggtgggagagtagggtattgtggaagttttaggtgttaattatttgtttttattttttattttttttagggaagagttttattttgattattattgtgtttattaattttatttaagtggcgatttattatcgagttattaaggtgatcgtggacggatttcgggagtttagacgtaagtgttatcgagttttttgagtttttgcgcgggggaggagggtttagtgcgggaaggatagtagttaggttagatagatggagtttttttcggggggttgtagtttttggttttgtgtttttatatattgcgtgtttgttggtaaatttttaaattttttgggtttagtttgagatcgtgggaggttagcgaggaggttgggagtggagatgattgtttatggagattattgagggagttaaggaaaggaaaaggatggagaaagtttttagatatggtatttgtcgggtgtttgtgtgtttttgggtggaggttgagttaggtttgttttattttgtttttagtttttttgcgggtggttgagggatgtatggagggtaggagtgattaaaagttaggggttggtttggttgtgaggttaggttttttttttggaaattgagtttttgaattttagtatgtgatttgtttaggttatttagagttcgggtatttagattttatgagtagggagttttggtttattaaagcgagtttgtgtttaattttttttgtttgttgaaggttagattaaggttggggaagtgggagggtaggttgaggttttgtgtttatagaatgaatgaatgattgattgattgattgattgaatgaatgaatgaatgaatgaaatagagttagttagttttttgagttttattttatttttttaaggtatttttagtttggtgtattgaaggttggtttattttttttttttttagaaatgtgattttttgtagtttagaagattttttagtagttattattgaatgggattttgatgatagtagagttagaggggttatttaagttttagtgaggagagaatttaggtttgagggagttgggtatttgaataggatttaatgttgtgtaaggagtaggaaggcgttttaggttttagtttttttagaggtaagattttaggttgagtaggtttggggtaggaggtttggggtaggaggtttagttttgggttggtttttttttttttgggagttagttgggtttgatattttattatttaatttttgggtttattttagtatttggttatttgggaaaggtttggagttgagtttagtagttttggaagagtttttttttagggtttttagggttatttttgttagttttgagtttcggtacgtatttttaggtttgtatcgttagtttttagttagtatttgttttggttatatttttgttggtttttttttgttgagattagatatagattagtttatgtttttggttttgggttttatgattttaggtaagttatgttttttttgtggttttagttttgttatttgagaattggattagtgattttaggagttttaaggtggtgatggttgggaagtttttatgagttatagattattatggtgtagagagtagtttttaagttagtttttttggttgtgggtttttgggttagttattttcgtgttttagttttttgaattgaaaaatgatattcgtataagtagttattttatgatgttattgcgaggaaatagtggtttaatttatagaaagtatttagcggtgggggttagtaagggattcgttattttagttagggttgttatttgtagtgtgatttagggtaagttattgatttttttgggttttagtttttttttttatgaagtgtgatgatgttatttattttgcggatttggagattaggggcgatatgtggatagtacgtggtcgtagtatagaggggttttatgagttattgggttcgtagcgttttgtcgtttttagtatttagttttttttttgtatttttattattattattagttaacggtgagtttttttatgggtagtagttgggtggttgttttggtaatagaggtgtaggtattaagtttttattgaaggaggtggtagttttgttttatgtttttaggggtagggttagtatggataggagttttagttgggttttgggtggggatgcggtatttagaagttattttagaaagaggggagttattttagaaagagggaggtacgggacggggttttgacgtttggtgggaagatttaagggatcgggtaaggttggtttttttgagagttttttatgtttagtttagtttattttagagtcgtttattttgttttgttgggatttttggatgagtatggagatttagttttgtttgtgggagattttagtagaattttttgtttgtttttttttgtttgggttttttagatttgagatggttttttttggggtgagttggaaggtaaatgcgtggtttaggacgaggtaataagagggagggatagaggttgggtttggagatttacggcgttagaagttaggtttgttgtattatttgagataggtgatttttttttttgggtttcggtagcggttggattagtggttttatttatagaatagagtagagatggagtcggggggtagtttattaggttttttatttttaggatttgtttgtttttgtttttggtatattttggttttgagattaggtttttttttatattttgggttgtagttttatttttttgtttttggttttggataaatttttggtttttcgggtttttagcgtttttatttgtaagagtgaagggattagtttagcggtttttggttattgagtaatttttttttttgcgttaggttttgtgtaaagtttttagtaattgattttttgggtaattttaggagaggatagaggttagggcgtaaaattttttgtttaaggtgattgttagtatattttgggggtttcgattcgggggttgcgggaagtgagggttatttggaagggtttttttattttagtgtgtttagttgttaaatggatggtattggtgtttgtttaggggagtcgttgtgaaggttgattgagtttatcggggtttggttttaggaagtgtttttataatttttataggttgttataggttttttgtgtttttggattttttttttcggttttttttttgttttgttattttcgattttttgaaatttgagttcgttgtggggtgaagtgggagtaggggttggttttgggagttaaggattgggaatttgtagatttttgaggtcggttgtgggttttgtggtcgggtcgtttttttttggtgttttgtagagcgtgttcggtttgtagttaggtggttagttgggtttgaaggttggtttggtggttttttgtttgtgtggtttcggtttttgaggtttttagtgttggtgttttttagagttattgggggttggttaagaagtaggttgttgagttaggtttaggattttagtaggaggggcggtgatatttggtaagtttggtatggattacggtgggggaaaggtttttacgtttttttagtttgtgttcgttattttttgtttttttttttatattttgttttggttattttggtattttggttggtttttgaatttgttagggatatttttgtttcgggggtttttgtattgtttttttttttatttggaatattttttttcggatatttttagatgtatggtatatttttttatattttaaagtttttgtattttttagtagttcgtttgttttaagtggtatatatatagttttttttatttttttttttttttttttttggttttaaggttatttcgagtatttattattattattttttaaggtgttatttagttcgatagtttgttttatttgttatttattttttttattttgttttgttttgttttttgagatggagttttgttttgttgtttaggttggagtgtagtggtaagatttcggtttatagtaattttcgttttttaggtttaggagatttttttgttttagtttttttaggagttgggattataggtatacgttattatatttagttaatttttgtatttttaatagagatagggttttattatgttggttaggttagttttgaattttcgattttaagtgattcgtttattttagttttttaaagtgttgggattataggcgtgagttatcgtattcggttttttgttgtttatgttttataagggtagagttttttgttttggtttgttaggttttggtatagttagattttgagaatgtgggtaggagttttttatagttgttttataaatcgttgatgaataagtaaatgatttattaatgttatttcgggtagtaggaagttttatgaagaaaaataaagttgggagaaggagtggagcgtgtaagggatggaataagggatggggcggggaggttttttgaagaggtgatttttgagtaggggtttgaagtgagtagttagtagagtgtggttgtcgagggtttggcgtgggtaggagaagtgattttgagttcgtagttgggtttttgaaggttttagagtttttgtagtttttttttgggttgaggagaggtagttgttttaggtttttggtttttaagatttttataatttttaggagtgttttttgcgttaggggtagggttagcggagtttgtttagtaggagggaaggggttaattatagattttttgggtttttttaattaattttaggtttttggaagttttatttgtagttttgggagggaatcgttcgtttttttgttcgttggttttcggttagttcgtttttttgtttagttatcgattcggtttttatttgtttatagggggtcgatttatagtagattattttaggttcggtattcgtttgcgatttcgcgaggttgttaagagtcgggtgtaaattttttgataggtcgtagagtcggtttcgggttcggcgttttattttgttgttgggtagatagtggttgttgtgtttgggttatagtcgtattaggcggttaagaaggttgtcgagtggttttagatgggtgacgggtttggttattggagtttatattgtttttagtagacgatgttgtttttgtggttttgttcgattttgttttttttaagaggttgaatattgagttggttttttgttagttggattttacggttaggtgatttagttttttttttatggaggttttgggaagcgatgattttagtagttgagttttatgtgtgatttttttaggtttgaattttaggggtgttatatatcgtgtgattttgatcgtgtgtttttatttttttatttgtaaaacgggggtgatagttatagtttgttagagggatatgatttttggagacgatatgtatggttttttttgtatagtgttcggtatattatggatgtttgttaaaatggttgttatttttatgataggggtttgtgttgggtttgtatggaggtaagggggtaattttgatggttttttggtttttttagaagtattaggtatttggcgggggtaggattttaggttggttaggttggtggtggggaaggattttttggggatagtggtaaaggagttgttaatttagaatttagttttggttttttagtttttatattgcgtgattttggtgagtttttagattggttggggtttagtatttttgtttttattttggtttttattatatgtttgtgaggtgggttatttttattgtatagacgtattagagaggagttgtttgtttaggagtagatggttaagttagaatgggaatttagaatattttttttaaaggttaaggtttggtgggttgtgtaatttttgaaattttttttgattttcgggggttagaggtgtgatttttattttgtagataagatagttgaggtttagaaggtaagagtggtttgtttaagatagtgattattggtgggtgagagttgtttggtatgagtttggggttattgggtttttgggaggggtaggttgggatttgtttttttataagtgagggttatagatattaatttaggttatgttggaggagttgtttgatttgagtttagtagttggaggttgatagtagttaggataggttttgagggttaacgcggggttttttttagttattttagttttttgtttttaaaagtatgtggtttgttttttagtttatcggtatttttaggggttagatagtatgataattattttatagatgtggaaattgtggtttagaggtagagagtgatttggtggtttagagtagggtatgattggaaattgtatttttaattttgagttttagagtagggaagggtttttggtggagtttattgagatttttttattttttttttttaagttttatttttttgggtttgtagatagtagttttgggtttggggttggacggggttttaatatttattgtggagtttcgatatatttattgatgtatcgaatttaggttggttgtgaatttcgttttttttcgttataatagatgtgtttttataggttttagggagagtaggtggttgtgtgttttttgtttgattttgagtttattggttgtttagagttttagtttttttatttatatgataggatggtggtagatattatttaaggggatgttgttaggcgaaataagatggtgtttgttagttgtttagacgttgtcgtggaggaagtatttagtaagtatttgttgtcgttttgatgatttttatttttgttggcgattgttttaaaggatagttttagtttgtagaggtgtgatggggatttattgtgggagaaggggggttttttggaggaggggtttttggattgggttttataggatagaaagtattgttggtagaggttgttttgagttgaggttttgaagagtggggggtagagaatatttaagaaatattgggaatagtagtagtaggaagaagtggtagtgggtgggttttggggttagtagttttgtttttttttttttttggggtttttttgattagcggttgatttttgttattttaaattagggatttttaaaaggaaggggttttagtgagtagattgtgtagaggggaaattgaggcgtagtaggattgggtttaaggtgacggagtgggttagagttagagttttttacgtagtttttgttttgggtaatcgaatgaaagaggttttttttgaagattattttttttttttaggtattggaatttttgttttatttttagtgtgagagttttggttttgtggttttgagattttttggcgttttggttacgtggggtcgttttggttttttttttttttttttggtagtggttttagcgttttatagtaataaggaagttattttcgaagtgttgttggatttttttttttcgggaagtttgttttacggagggtaagggagtatgtggtgggagcgtgggtttcggggttagattatttgatttatagtttgggtttcggaataggcgtttagcgtcggttttatggtgaagtttcggtggtttcgtttaaataatgggaataaaagggaaagtgttaggaaaagagttttgggtttggagtcgggggattcgggtgtgaattttgttttgttgtttaggttttgtgttttttatacgattttagtattttggtttttatatttcggtttttagtatggggatgatagttttgttttttttgggtatgagtagagataaaagcgatggttatgatggtggtgatttacgtgattggaaagtgtttatattttaggttagtattttaatttataaagatagtgtgatggggatatcgtagttcggggtgggggaaaggagtgtgatttgagtgaggttattagattgtaagtgataggattcgttttcgaatttaggttggttgttaatttcgttttttttcgttaggtcgtaggagtaattgtaaatattttttgtatatggtgtgatttagaaataggggattttatttttttgtgacgaaagtaataaggtttgaggttttgtattagttttattggttttttttaagtttgtggttgattaaaatatttagattttttgtatttaggttgttgtcggattagtttgtggtttttacgtttattcggtaggttttatgtttgttaagatttttttgtttatttgttttttagtttatttatatttttttgttatttttagtggttttaggagtaaggataatattttttttaaggtttgttagggttgaggattcggtttggaattggaagttttggtcgtattgggtttgttttttttagggtagtagttaggtgttttttataaggtattttttttttattcgttttaggttttatttattttatttgtttcgtttacgtgatttgttttatttttatgggtatttgagtttgtagttttagttttagttaaattcgtttttagtttatgtttttttttttgttgttaagggttttgggaggtagtagtgggggtttggttagagattaaatggttttatttttgttattaagtgttttatggatttttggtttggggttttattggaggagaaggtggggttttttggtttttggtgattggttgagtttttgtggtttttaggttttttgttttttttttgaggtttttagatatttgtttgagtttttaatagggatgcgtagggagtttgggggtttataagtattagaatttattgcgtttttattttgaaaattagaaattaggtttatgcgaggtttcgggttttgtttttttatgttttatagtggtcgataggttttttttatttttcgagtttttagtaattatttgtttaggttttaagaagcgtagtgagttttgttttattttttatttatattttgttttttttttttttgttaaattagaaaacgtatatgttattttagatttaaggttttaggtaaattttttttttttttttatttttttttatatttttttttttttttttttttgagatggaattttgttttgttatttaggttggagtgtagtggtgtgattttggtttattgtaattttcgtttttcgggtttaagcgatttttttgttttagttttttaagtagttgggattataggcgttcgttattacgttcggttaatttttgtatttttagtagagacggggttttattatattggttaggttggttttaaatttttgattttatttaggtgattcgttcgtttcggttttttaaagcgttgggattataggcgtagttattatgtttagtttttattttttttaaagggttttaggtttaggaaattttattttttgttcggcgtgtggtttttaataagttttttcgttttttcgtagttgtagtttttttatttgtaaaagagggtttggttattttgtttgattggtagttttttattaagttacgtgaggtagaatggtcgtgatcgtgttagggttgattagtcgaattttggagtgtatagttttttaagggagtcgtttttttttcgggttagttttggagaagttgtagttattagggggtgcgaatagggacgttttcgggagtgttgtatgtaagggaattaaaggggaagtttgagaaggattgaaatgtgggtggagaggattgcggagtgaattgtgtttttagtggttagtaggaaagagggagagtagcgttattttcgttatgtttgttgaatttttttcgtagtagggaggatttttagggttttatgggaatttcgttatttttgtggggttggattattgtttttattttgtagatagggaaattgagtttgagttttaaggtgtgttattaagaaagtaagttatagaatgatatattcggattgaggttgtttaagagagttttatgagaagtttattttgcgttttttatttatggaagatgaaaaatgtttggaaagaaattggttacggtggggattttggagaggagtttagagcggtggatagagttttatttgtaatgtttttatttttgtaaatatttacgtgttgtttgtgaaatgtaaaattagtaattaaaaaagtgtgtgtggcgggggaggtttttgtaagtttgatattattttagaagtgtttttcggttttagtaggtcgtaggagggtgggagtttggttattttgatttttttagtatttttgagttttcggatgtgaggttgggattttttttgtgtgggttttggtagatagggagtggaaaatgttggtagttttttttaggtgtgatatttcgttttttgattttagtttttaggtagagatggttgtttagttttttatgtaagttttttatatttttgtttagtattttggtggagttatttttttgtttgaggtttagagagaagaaggtatgttttggggattttagagtgatttagggttggaaaagtttgtagtttttttttggggttattttttattgtttttgtagatatgggagatagtgtgtaaggtaggttgggatgttgggaggtagagggtggtagtgtttttgggttatttttttgttttttttgggggtatgagttatttttttatgtttgttgttttagttttttttttttagatttagggtttttgtttcgttgtttagattgggatgtagtggtataattagtttattgtagtttttattttttgggtttaagtgatttttttgttttagttattttagtagttgggattataggtttgtgttattttatttggttaagtttttttttttttttttttttttttaatttttgtatagataggggtttcgatagttgtttaggttgattttaaatttttgggtttaattgatttttttattttagttttttaaagtgttgagattataggcgtaagttattgtatttggtttttagtttttttttttgttaaatagtgtgttgtagaggtttggattatcgtgtgtcgtagaggtttggattattatatgtcgtagaggtttggattatcgcgtgtcgtagaggtttagattatcgcgtgttatagaggtttagattatcgcgtgtcgtagaggttcggattatcgcgtgtcgtagagtttcggattatcgcgtgtcgtagaggttcggattatcgcgtgttatagaggtttggattatcgcgtgtcgtagaggttcggattatcgcgtgtcgtagaggttcggattatcgtgtgtcgtagaggttcggattatcgcgtgtggttgaggttcggattatcgcgtgttgtagaggtttagattatcgcgtgttgtagaggtttagattatcgcgtgtggttgaggtttagattatcgcgtgttgtagaggtttatattatagtgtgttgtagaggtttagattatcgcgtgttgtagaggtttatattatagtgtgttgtagaggtttagattatcgtgtgttgtagaggtttagattatcgtgtgttgtagaggtttggattatcgtgtgttgtagaggtttagattatcgcgtgttgtagaggtttatattatagtgtgttgtagaggtttagattatcgcgtgttgtagaggtttagattatcgcgtgttgtagaggtttagattatcgcgtgttgtagaggtttggattatcgtgtgttgtagaggtttagatatgtggggtggtatataacgattattttttgtttagaaagttttttgaaaatttttgtgaagaggttggcggtgattttagggtttttttagtagaggtttaaggttagattttaggaagaattttttagtagagtgaggtatttttgtttttattgagattttggggaagtaacggttgatgggttttttgtgttttgtagggtatcggtagaagttggaggattagattaagtcgttttttgatcgttttggggatttggaacggttgcgtatgcgggtgatatcgagtatatttagttttcgaggtttatttagtattataagttattttagtagttagttttagattttaatttaaggtacggtacggagggaggggttgtagcggggtgaggtgggggtggagggtttcgatgtggtttaatttgttttagattaaaagtttgttcgaagattagttattgtatttttttgttttgtagaggagttgttggtgtttattggtatttgtagacggtttttgtgggttttttgtgtgttagttattattcgtttatttagtaaatattgatattattgatatatgtttggtgtttggttttagggatttgtatattaggagtttattgtgtttggggaaatggggttaattttatagtgtttttattaaaattggggtatgatttgtttaaggagtcgtgatagattcgtttttgttatgtatagtttttttatttttgttttatagtttgcgattttttatttgaaagtggattggggcggatgtttttatttagggttgggatgatatttaaatgatattattgtatttatataaattttgtatattgttaagtgatattttaattttagagaggtatatagtatttttgggaaaggttttttattttgtttagagtatttttttaaataggaggagttgaggtggaagggaagatcgagttggggtttttatttttattgtttagacggatatagtaagtatagttgtagttaggttttaggtaggttttttggagtatcgaggtgtttggcgtatagtagtcgtttattaaacggttgtcggttgtattttttttttgtttttttagttagtgagttggggatatgggaggttgtgtgtatagtcggtttttgggttaagtggggtgttaagggtgtttggtggtcgggtggatagaggtaggtagttggttgtcgttacggattgtgtttatttttttttaattttttagagtttggttagaattttttggtagatgaatgaattgagaggtttaagaggtttagagttattttcgggttatatagtttatttgtgattaggtttatagtttttatagtatttgtttttaagaattttttgtatttttgaggggatagataaaggggtttggaatagggttgttaatcggtttgtttgttttattttttttttcggtgttacgttgaggtgggggtcgattgggtttttttattgatattgttttaggtatagtgttgtagttaggggttggatgtaggtttttagtgtgaagagaggatttttttttttttggtttgggtttaggatttttggttttggttttgttgagacgttaaggttgggagaagttttaggtttagtttttttgagtttaggagttagtgtatttgagatttttagttttcgagtttaggagttggaggtttgtttttaagaggtagcggaaggagttttgtacgttgtgtttacgtttatttttgtcgcgtagttgtttttgtttttgttatttatgggttagtatttgtcgaggtgtagtagtttgagagttagtttttttttgttatggatagagttaggttaggggatcggggtttagcgggggagttagaatttaggaggtggggtgaatagtggttttttgtttattagtttttatggaaggagagtttatatttgtttatttattgttgggtgggtatagtttgggaattaatgtttggttttacggtaggtatagttgttgtttttattttgggttgggaggaaaggagtttagtttgtgtggggtagtggttgatttttgtttttttgtttgtttttttttgaggtttggtttagtttttcgttagttttttatagtattgggttataggtagttaggtatttttatttttaggtttattttttttgggtgagagaaagggtttcggatgattaggatagggcgagtatgaattttgtagttagttggattaggttaggaatttaggttttgttaggtattggttgtatgattttagataagttatttaaatttagttttagtttttttatttgtgaagtggggagaaggaggtttttgataaagaggggttgttggtagatttaggtttgggaagttatttttataggtttttttttttttgttttcggatttttttttggggattttttttgggatattttattattatttttttcggtgtttgttaagtgttttgattttttaatattggttattggtaagtagtgtagagattttagtattttttatattttagttttagtttttagtcgtagtcgtttataatgggggttttttatagttgaaagggtttatttagttattatgtagtagttcggataatttggagaagaaaataaatatttttttttattgttgggattggttattcgatagtgtttcgggtagttcgggttttttggggttgcgaggtcgtagggtgggggtataggagttttaaggaagttgttggggggtttgagggagtgttgagggtaggtattttttttattatttcggaggaggggtggtggttttgaggaaagaggttggaggggatggtggtaggtttagggaggtttagtttagcgttttgtagttcgcgtgagttttgaggggtatagttttgtcgttgtattttgcggtttttatttgtttttttcgttttgagaatggggtttttattaggcggttagtatttatttttattttatttattttagttgtgttgacgtgtttagtatttgtaataggattttttttttcgaggggttttttagatgaaaattggtagttaggtgtttcggaggttttcggttttaaggggtcgggatagttaagtgatttattagggaatattttagatgttttagaaggttttcgttatttagattgttgtttttatatttttttattttaagttaggagtattatttcgttcggatttacgtttagggttagagtacgttgttgagggaaatatattttagttgatttgggaagattttaaagtttcgagaagttttaagttttagtcgaagttatatatattttaggtttatagtttttcgtttttagttaagtttcggcgtggtaggtagagtttatttcggttagtatcggtttttattttttggtgggtgatatagaggggttgttgggttggatagattgtatttttggattattgttgggggtttatttatttttttcggttgttagagtagaagggaggttttgtattagggttttaatttggtagggttttgaatgagttagtttttttgggtatttagagtaagagatattatagttatagtggttttgtaaagttttatggatttttgttttgtgtttagtgttattttaagtattcgatgtgaattaattgaattttgatgaattgttatcgttttatgttttatatggggaaattgatgcgtagagaggttaagtgatttgtttaaggatataaagttagtaagtgtttaaattaggataattgttcggttttagaagttatatagtaagttttgattttgtgttgttttaaagacgggatagtttttttttaagtacgtgttggggtttaggattagaggttttaggattgtgtgttaggtttaatgtgttgtgtgattttgagggaagtgttttattttgtttgggttttagtttttttattaagggtgttagatttaatttttgagtttttttgaatgttgaggttttgggggtttgtgatgataaaagttggggatagaggatggaatatttttgttttggagtttattgagaagttatatttttgggggagtaggggtagagtttgggttggatattgtgattaggttggggtttgggtttttaagtttgtttgattgttgttttattttgttgttaaggtaggttagggtggtatttagttattgtgtggttacgagtcggttttagagatataggtttagggtgaggtggaggttagagtttttgtgaatttagtgtttataatttaggtgtgagcgtatagaattttcgcgtgttgtatttgggtaggagaggtacgtgtgtttttagtagaggttttgtgatgagaattagttttttttttgttatagagatttagttttgttttttttttgtttttatttttttgtttttaaaagcgggttttaatttttagttttatacggttattggagttttttatatatttacggtttttttagttgttaatatgggtcggtggggagaggaatttgtttgggtagggttgttgggaggtttgagttgattttgtttttagttttattatcgtattttaggttttttttttgcgaggttgggaaggaggatttaaaaagaagaatagatttttttttttgttttgttgttgttgtgggggggtttttatggttttttttggttcggggtacgttttaattagtttttcggtaggtttgtgttcggagttttggcgggggaggtttcgggtagtttagggtaggaagaggagagttaggtttagaattaggggttttttagatgggttttgggaattagagtttaaggttattttttaggaagtttttttggggttgtttcgagttggaattgattttttttttgttgttttttaggtatttcggaattgaatttatttttcgattttcgttagtttgatcgttttttttttacgttgttaatttttacggagagtcgttttttagattttaggatgtattatttcggggttatgttagttgtttttttttatagcgttacgttttcgggtacgagtattagtagttttagcgtggcgggtatgtcggttattagtcgtttttattatatttatttttcgttattttattcgggggtttcgtagaattagagcgggtttttttaggttaattcgtttttttattatttttattacgggatattttttggtttttattagttttttatggtggtcggtagtagtagtgggggcgatcgtttatttattcgtatgttggttttttgtattagtagcgttgtttttgtcgtcgtcggtaattttatgaattttagtttgggcggttagagtgatggcgtggaggtcgacggtagttatagtaatttatttacggttttgagtacgttaggtcgtatggatgaggtcgtgtggcggttttattgatcgttttggtggatttttttcgttggaggcggggattttaataatttttaagattagtgatgggtcggtttcgaggtttcgggcgggaatgggatttgcgttttagggtggtttcggttttagggtggttttagttggtgggagtttttggttgtatttgtgtagttatatttttgtatagaggtataggttattatttttatttcggttcgggatattgttttcggtttagattttggtcgttttattttatatttttgtggggaattagttttttgttattttttcggaaggattttattgtttttagttatgtttagtgttgtatgggatttatgttttttgggatagaggttattttttttttagagagaggtagtattggtttataggataagttttaggttttgggaaatttttcgatttttgtattttcgttggagtttttgtattttttgggtttagttttttttgtatttatatagatttgagttagaattggaaagtgttttttatttttattattttcgagcggggttttttttattgtatagatggggtaggatttagtacgttgttggtagagatggtttgagaatatatttaagttagtttttttagtttagtttttttttcgtttttaattgttggtttttttttagtcgtacgggttttaggttttagagaagatgagtttatggtattaggtttttaaatttaggaaagtatttatagatcggtttttttatgtattttattagtttaacgtatttattttttgtttttttggtagggcgggggaggggggataggaggtttttttttttttaggtggttttataattttatttgtggagagaataggagggttagatagataggttttagtagaaggtattgaggtgagggattattttgggttagatattaatgtttttgttttttttgggtttagttaagttgtgttttattttttaagttttttgggaggatttagttaaattttgcgatttttggtatatatttgtttgtaatttgttttgtgttttgaaagtaaatagttttgagtaaaaaaaaaaaaaaaataaaaaaataaaaaaaaaataaaatagtttttaaaattgattttagaaaaagaagtttaatttaacgtttttaaatataaggttttttataggtatagtttcgtgattatgatagttttgtgattataagtaatattttcgttttttttttttttcgcggatttttagttgttttttgagggtgtggggttattagggttttaatatttttttaaggggttatattttttattaggtagtattttattagtttgtattataggtttttttgggaggacgagggaaacgttgatgagacgttgggtattttttttttgtggttttaggatatttgtttaggaggttgggcggaggtgggtaggatgtgagaggtggggagtattggttgtgcgtggtaggatagaagtattgtaaagggttttttagtcgtagtttagttgtattgcgtttcgaggtgaagttttgtttttgaattttgtaaaatgggaaagtgggcgtttgtttaagggttaggttgtatggatttttatattagagttttttggttttagaaaggtttagaaaaggcgtaagggaatttataaaggttagtagtatgcggtattttaattttttgtttcggtttttgtggatgtagaaatttgttttataaaatgttttttattggttgtttttgtgagagtattgtttttatttaatttgttataacggttagaattatatattagagatatattggtaggttaggtagtttttttggtgattttattttatttttttttgttgcggttttttttggtttgtttttattggaaaaatagtttttatttttttaaaatagttgttgattttttgtatttaaggggtttttttatgtttttttaggaagtagttatgaatttattgtttttgtagtttttttttttttgttttttggttatagttggttttaggttagcgtgggaggtatttttgggtttttagtgtttagtattttgtagttttattttagattattaattttttttgattttggagaggtagggatagtaaataaattgttttttttattttattttttattttttgataaaaagtgacggtagtcgtattgagtttgtaaggtttaaagtgggtatagatagtttgggttggtaaaagtaggtttttatttataaggttgcgttaaagttgtattaggtaaatatattgatgtaggaagtacgaggaaaggaagacgttttgatatagtgttattgtgagtttgttagtagtgggtattaattttttgtgatatattgttatgttgaggtgtgatatttgttgtatttatttgatgtaaaattattttagagttggcgagaggatggagttgggtggaaattgttttgtattatcgtttgtttggtgtttgtttttaacgtataatttgtttgtatagtaaattgttttttgtattatttaattgtaaaatggaattttgattgatttgttataataatataattttgagatgtgtggaaggagtttagtgttcggtttttagggttatgtatggaggtggggtggggtgggggagaggatggagattttttgttgttgtttaggaggaataggaatagagatatttagtatttttatttttttgtttttaatttttttaggaatggtcgtagagattattttggttataggatagtcggtgaggtttgtttttgt

SEQ ID NO: 196 - DNA, 3966 bp, Artificial Sequence
  Chemically-Treated DNA
atatacgttaaaattagattaatcgtttttttttttggagagttgtgggtggaatcgtgagggatgtttagttatagggtaggtttcgtatattatttgtagtttagtaggttagttttaggatttttttttttggatttgtttagaattaagttaaatttttggttaaagtatattcgttagaaaatttatttttttttaaaaaaaaaatttttataataaagtttattatttaaattgattttaaaaaatataaaataggattttgtatagtagaaaaataaagttagagatttttttttaatttttggtttgtgtaaagatattgggtatatgtaaatatgaagaggtaggaggtgcgagtttaggttttggttttagatatagttaagttgttataataattagggggatttagagggagtattaggagggggaggatttttttaagaggtgagaaggggtttgcggtttcgtttttagtcgagggcgggaggcgtttcgtttttatatttattcgttttttttaatttaggtcggggagggtatttatatggttttaggtaagtaataataaaataatacggtattttagttaatgttgcgtgtacggcgggcgttgtcggttaaatttggaaggggaaggagtttaggtagtcgcggaggacggggttgagggggatgcgagttaggttttcgcggtttacggtggttacgatgcgttggcggtatagtttttgtagcggtcgtacgcggcgttggcgtagcggggtttttagtatgcggcgcggcgtcgttacgtagtgttttagtagttcgaagaggtagtcgaagttttcgcggttgttatttaggtgaaagcggtcggtttgaaagtgtacgcggatgttcgtgggtttcgaggttatttttacgttaagggcgaaaaagtagtttcgttggcggttgtcgcgtattaggaaggtgtttacgggttcggcgcgtagtcgttcgtgcgtttcgtgtacgtttaggggtttttagtagaattcgtaggcgtttaggagcgcgttggcgcgcgtgatgcgtcggtaatcggcgtgcgaacggaatgtgcggaagtgcgtgtcgtcgggggtcggggtcgggatcgcggggtacggtcgcgggcgcgcgggggtcgcgggcgaggaggaggaagaggaggaaggttttggtcgtcgtcggggttttgttgttgtggagattgtattgtcggttgttatttggttgtgtgttattattttatagaaggggttagtcggaggggtgggttatagcgttcgggggtgcgttgcgggagagataaagaggtgagttggggcgttgcggggtcgggtaggtgtgcgtcggtcggataatttcggagggcggcgttttcggcggattcggttttagggggcgagtacggagtattaagttcgcgcggattcgtttagttttagtggatatagttagaaaatgggttttgtatttcgcggagtttttttcggcgggtgggggttcggtggaggcggagttcggttttcgggtagtatcgagaggggggcgtggagagtagtcggttttggttttagtcgttcggtttcggttcgtcgtttcgcgttcgtcgtttgttggttaggttgggattcgcgtttggtttgggcgatttgggttagggtcggagaaaggttgtgttgcgggagtttcgcgcgcggggggcggtttgggtggggtcggcgagggttaggggtatcgcggtcgcgattttattttgtagttttcgaggttcgttcgatttttggttgttttggattttttttttttttttttttcgttttttcgtttagggttcggtttatttggcggcggggcgcgggacgtcgcgggcgggacggcggggggtttcggggcgtttcggggcggttttcgcgtatgtttcggggttaggagtcgtgtagttgttacggtcgtagttcgttttgttcggcgttcgtttttgcgttagttttttaaatcggttcggaggcggggttggcgacggcgggaggtttcgttttttgtcggtttcgtttttagttttatttttggttttttttttcgcggtggcgttcggcgaggatcgtttcggttttgttttttttttttttggattttttcgcggggttttttgttcgtttgttcgtatttgttttagtattcgtttttcgaggggttttggtttcgattttgcgtttttcggttatttttcggatttttttttcggatttggcgatttcgattttgtttcgttatttcgggttttattttttgtcgttaggtttttttgggacgcgttttgatatattttttttcgttttagttgtttttatattcgtcgggggtagagttttgttttttttttttttgtagttagatttttttaggaggttatagaaggtgtttttaattttgagtttgattttattcgtagatttttttttagtttttgttttattcgtcgtcgacgtttttagtcgttcgttttgttgtttcgaagtttcggtcggtcgcggtttttggttttggttcgggtttttcgggaagcggcggtttgattataggttttagaggaatttttggcggcgcgggcgtttttatttcggtttagtttttcggaaattgggcggggtcgggtaaggtttttggtggtttcgattgttttttttgcgtttttattattcggttgcggaagaaattgaggttggggaggggttgggatttgtaatggtttgtagattgggagttttggatttggatttcgtttttttcgtttttattttggggagaggtgtagttggacgatattaaattggagtttagtgaaaaaatggtgtatttttagacgtgatgaatttttaaatttggttttttagtttttttttttttcgattttttttttatagattttttttttttattgtttcgttaggtatttgttttttaaagattgtttttttattatatatacggtcggggtttgggatggtgggcggtcggtggtcggggttgtaatttgtatacgtgtttgtgatttagtgatttcgattgtcgtgcgaggttatggagtaggtgtttggttgtttcgtgtatttttgaatgaaggtatgtgaggagttttagtattataaggggttatataaaaatttggttaggttgggtatttggttattggttttatattgggatatattgttttttatagatagtttttagacggttttttttttggaagttttggtgtttagttttttttcgtttttttggttttacgatatttttttttttaggtagagtttaggtttttattaattttttgaatatagggagtggtttagaattagtttagtttagtattttattagtgttttgaatttgtatgtggttagggttggtggtggttattggtgtagttttttaggttgtgcgtgtgtgtgcgtgcgcgtgcgtgagggggtgagagaagatgtagaattttgtttgtattagaggttaggtgtgtgattattcgagagatgtttattgaatatttgttggaggttatattttgtggagggtgatggaatataaggagatttagttttaaatttgtatttttttatttttgtgattttgagtatgtaattaatttttttgttatggtttttttatttgtgaaatggggataataatagtatttttagtagggcgtagtagtttatgtttataattttagtatttggaaggttaagataggaggattgtttgagtttaggagtttgagaatagtttgggtaataaagtgagattttttttttataaaaaaaaaaaaaaaaaaaaaaaaatagtataaaaattagttagtcgtagtggattgtatttgtagttttagttatttgggaggttgaagtaggaggattgtttgagtttaggaggttaaggttgtag

SEQ ID NO: 197 - DNA, 3966 bp, Artificial Sequence
  Chemically-Treated DNA
ttgtagttttgattttttgggtttaggtaatttttttgttttagttttttaagtagttgggattgtaggtgtaatttattacgattggttgatttttgtattatttttttttttttttttttttttttgtagagagggggttttattttgttgtttaggttgtttttaaatttttgggtttaagtaatttttttgttttggttttttaagtgttgggattataggtatgagttattgcgttttgttagaggtattattattatttttattttatagataaagaaattatggtagagaggttaattatatgtttaaggttataagaatagaaaggtgtagatttggaattgggtttttttgtattttattattttttatagagtgtggtttttagtagatgtttagtggatatttttcgaatgattatatatttgatttttggtgtaggtaaggttttgtatttttttttatttttttacgtacgcgtacgtatatatacgtataatttaggaggttatattaatgattattattagttttggttatatgtagatttagggtattgatggggtgttaagttgggttgattttgggttattttttgtgtttaggaggttaataaggatttaggttttgtttggggaaagaggtatcgtggggttagggaggcgggaagggattgggtattagggtttttaggagagaagtcgtttgagagttgtttgtagagggtagtgtgttttagtgtgaggttagtaattaagtgtttagtttagttaggtttttatgtggttttttgtgatgttggggttttttatatgtttttatttaaaaatatacggagtagttaggtatttattttatggtttcgtacgataatcggaattattaaattataaatacgtgtgtaaattatagtttcgattatcgatcgtttattattttaagtttcggtcgtgtgtgtggtgggaaggtagtttttgaagggtagatgtttgacggagtagtaggagggggaaatttatgaggaaggggtcgggggagaggagggttaggaaattaggtttggggatttattacgtttgagaatgtattatttttttattgggttttaatttgatgtcgtttagttgtatttttttttaaaatgaagacggggaaggcgagatttaggtttagagtttttaatttgtaagttattgtaaattttagtttttttttagttttagtttttttcgtagtcgggtagtgggagcgtagggagggtagtcgaggttattagggattttgttcggtttcgtttagttttcgaggaattgggtcggggtggaggcgttcgcgtcgttaggggtttttttgaagtttgtggttaggtcgtcgtttttcgggaagttcgagttaagattagagatcgcggtcggtcggggtttcgggatagtagggcgggcgattgagggcgtcgacggcgggtggagtaggggttaggagggggtttacgggtggggttaggtttagggttggggatattttttgtggttttttagggggatttggttgtaggggaggagaggatagggttttgttttcggcgggtgtggagatagttggggcggaggagggtgtgttagggcgcgttttaagagggtttggcggtagaaagtggaattcgaggtagcggggtaaaatcggggtcgttaagttcgaaggaggggttcgagaagtggtcggaaggcgtagggtcggggttagagtttttcgagaggcgggtgttggggtaggtgcgaataggcgggtagagggtttcgcgggagggtttagaagagagggaaatagggtcgaagcggttttcgtcggacgttatcgcggaaagagaaattaaaagtggagttgggggcggggtcggtagggggcggggtttttcgtcgtcgttagtttcgttttcgagtcggtttaaaagattggcgtaggggcgggcgtcgaatagagcgagttgcggtcgtggtagttgtacggtttttggtttcggagtatgcgcgagagtcgtttcggagcgtttcggagtttttcgtcgtttcgttcgcggcgtttcgcgtttcgtcgttaggtgagtcgggttttgggcgaggaggcgggagggaggagggaggggagtttagggtagttaggagtcgggcgagtttcgggggttgtagaatggggtcgcggtcgcgatgtttttgattttcgtcggttttatttaggtcgtttttcgcgcgcggggttttcgtagtatagttttttttcggttttagtttaaatcgtttagattaggcgcggattttagtttggttagtaggcggcgggcgcggggcggcgagtcggggtcggacggttggagttagaatcggttgttttttacgtttttttttcggtgttgttcggaggtcggatttcgtttttatcgagtttttattcgtcgggaagagtttcgcggagtatagagtttattttttagttgtgtttattgaggttgaacggattcgcgcggatttggtgtttcgtgttcgttttttagggtcgggttcgtcgggagcgtcgtttttcggagttgttcggtcggcgtatatttgttcggtttcgtagcgttttagtttatttttttgtttttttcgtagcgtattttcggacgttatggtttattttttcggttggttttttttgtaggatggtagtatataattaggtggtagtcgataatgtagtttttatagtagtagagtttcgacggcggttagaattttttttttttttttttttttcgttcgcggttttcgcgcgttcgcggtcgtgtttcgcggtttcggtttcggttttcggcgatacgtattttcgtatatttcgttcgtacgtcgattatcggcgtattacgcgcgttagcgcgtttttggacgtttgcggattttattgggggtttttgagcgtgtacggggcgtacgagcggttgcgcgtcgagttcgtgggtatttttttggtgcgcgatagtcgttagcggaattgttttttcgtttttagcgtgaagatggtttcgggatttacgagtattcgcgtgtatttttaggtcggtcgtttttatttggatggtagtcgcgagagtttcgattgttttttcgagttgttggagtattacgtggcggcgtcgcgtcgtatgttgggggtttcgttgcgttagcgtcgcgtgcggtcgttgtaggagttgtgtcgttagcgtatcgtggttatcgtgggtcgcgagaatttggttcgtattttttttaatttcgtttttcgcgattatttgagttttttttttttttagatttgatcggtagcgttcgtcgtgtacgtagtattaattgggatgtcgtgttattttgttattatttgtttggaattatgtgggtatttttttcggtttgggttggagggagcggatgggtgtaggggcgaggcgtttttcgttttcggttggagacgaggtcgtagatttttttttattttttgagggggtttttttttttttggtgttttttttgggtttttttggttgttgtagtagtttaattgtatttggagttaggatttgaattcgtattttttatttttttatgtttatatatatttagtatttttgtataaattaggggttgggggagggtttttggttttatttttttgttgtgtagaattttattttatattttttaaagttagtttaggtaataaattttattatgaaagttttttttttaaaaaaaaataagttttttagcgagtgtgttttggttaaaagtttaatttggttttgaataggtttaggggagagggttttaaggttgatttgttgggttgtaggtggtgtacggggtttgttttgtggttgggtattttttacggttttatttataattttttagggagagaaacggttggtttagttttggcgtgtgt

SEQ ID NO: 198 - DNA, 1101 bp, Artificial Sequence
  Chemically-Treated DNA
taattttttagtattatagaggaagtagattgatattaataatatttattaataataatgtgttttatgaaataaagatttgaaaggaattggaataaaaattttttgtattttatgttaagggggaaatattagaattaagtgttttgtgtgattgaagatatttttttgtttaagaatgtaaagtatatttaataaaatagttggattataattttttttttttttttgggggttgtggggtgggagttggggtgagaggtgttgttggtttttgttgttttttttttgggaaggatggtgtatgttgggagaatagggtatgataattgggagatagtgatgaagtatatttattataagttgttgtagaggggttatgagtgggatgtgggagatgtgggtgttgtgtttttgggggttgtttttgtattgggtattttttttttttagtttgggtatatgttttatttagttgtattttgggatttggttgttaggattttgttgttgtagattttggttgtttttggtgttgttgtggggtttgtgtttagtttggtgttatttgtggtttatttgattttttgttaggttggtgatgattttttttgttgttattgttgtgattttgttgagatgtttagttagttgtatttgatgttttttattgtgtggggatgttttgttatggtggtggaggagttttttagggatggggtgaattgggggaggattgtggttttttttgagtttggtggggttatgtgtgtggagagtgttaattgggagatgttgtttttggtggataatattgttttgtggatgattgagtatttgaattggtatttgtatatttggatttaggataatggaggttgggtaggtgtatttggtgatgtgagtttgggttgaggttataggtttgagatgtgggggttggagtgtgggtgggtttttggggtaatgggaggttgtggagttggtgaaataaaattagagttgttgttttttggtgtttttatttttttttttggataaagtgtttatttttaatttgattgataatgtttgttatttaaaagtttttaatttgtttgt

SEQ ID NO: 199 - DNA, 1101 bp, Artificial Sequence
  Chemically-Treated DNA
gtaagtaagttaaagatttttagatggtaggtgttattggttaggttgggagtgaatgttttgtttagaggaggaggtagggatgttgggaagtaataattttgattttattttgttggttttatagttttttattgttttaggagtttatttgtattttaatttttgtattttggatttgtggttttagtttagatttatattattaagtgtatttatttagtttttgttattttggatttaggtgtgtaggtgttggtttaggtatttagttatttatagggtgatgttgtttattaggggtgatattttttggttgatgttttttatatatatgattttattgaatttaaagaaggttataatttttttttagtttattttgtttttgaagagtttttttattattgtggtaaagtgtttttgtgtggtgaagggtgttaggtgtagttggttggatattttggtgaagttgtggtggtagtggtgggagaagttgttgttggtttggtggagggttaggtggattataggtggtattgggttgagtgtaggttttgtggtggtgttgggggtagttggggtttgtagtggtgaggttttggtgattgggttttgggatgtggttggatggggtgtgtgtttgggttgggaggagaagatgtttggtgtgggggtggtttttgggggtgtggtgtttatattttttgtattttatttgtagtttttttgtgatagtttataatggatgtattttattattattttttggttattgtattttgtttttttagtgtgtgttattttttttagaggaaaagtaatgggggttaatggtattttttgttttagtttttattttatggtttttagagaaagaagaggagttataatttagttattttattggatgtgttttgtatttttggatgagggggtgtttttaattatgtggaatatttgattttggtgttttttttttggtatgagatgtaggaaatttttattttaattttttttggatttttattttatgaggtatgttattattagtaagtattgttaatattagtttattttttttgtgatgttgaaaggtta

SEQ ID NO: 200 - DNA, 1401 bp, Artificial Sequence
  Chemically-Treated DNA
ttttattatgtagttttgggttttttttaggtttttttttttttattttgtgatttttttgggtttttttttttttggtggtgttggttgattttttgggttgtgggatgggggagaaaattttttaagagtaattttaaattgttttttttattggaggggaggaaagaaggagattggttttgttttataattttggggtgggggattttttagttaatttttttttgtggatgggtagtttttgtattaagttttatttttagtgtttgtttattttggggtttatataaattttatgggtttttggtggtggagttatattgtggttttgattttggttttagtgtttagttttggtttttgttgtggtgttgttttttgttggttttatagtagtggtgggtgttttattaaagttttttgagtaggaggtggaggggtgtattgggttggtttttttgtttggtttgggagtttgaggtgttatggggtgtgtgggatagtgagtgggtgggtgtgtttgggtgtggtggtggtagtggtggggatttggagttttaggttgtgttttgtgtttgggttagatattatttagttttttggttgagttttgattggttaaatggtgttgttttttttttttgttttttgttttttgttttttgtttgtttgtgttattgatatttgtttgaggtggttgtttaaagggaatgttgtgttttttttttgtgtggggaattgaggggtgtttggaattttttgtttttttggggtttgtttttatttttttttttagggttttgtgatattgttttgtgagttttgtgtttttttggggtgttttggataggatgtttgtggttttgaggggtgttttagttttagttttagttttggggaattttgtgttttgtgttttttgtagaaattttggttgtgggtgttggggtgggagggagtgagtgagaattgtatgttttgaggttttgtttttttagtttttaatttttttttttttttttattttagtatttaagttttttgggagagggtgtgtgttttttgggttatagatatatttttttgtatttttttgtattatggagtttgtgaatgtgagtatataatgaaattgtatagagtatgggggttattggtttattttgttgttttaaatatgttggtttaaatagagtttgtgtattgatttttttagagtttgtttaataggaatttaattaagataataatagtattttttattgatgaatgtttttagataatgttatattaagttatttgttttagttaggaagtttaggtaatgatagattttgttaaagttatatgttttttagttgattaaatagaaaaatggaaagagaaagaaagaaaat

SEQ ID NO: 201 - DNA, 1401 bp, Artificial Sequence
  Chemically-Treated DNA
gttttttttttttttttttttgtttttttgtttggttggttagaaagtgtgtggttttagtgaggtttgttattgtttgggttttttggttggaataagtaatttggtgtaatgttatttgggggtgtttattaataaaaaatgttgttattattttgattgaatttttattaggtaaattttagagaggttagtgtgtgaattttgtttaagttggtgtgtttaaggtagtagagtaaattaatagtttttatgttttgtgtgattttattgtgtgtttgtgtttgtaagttttgtagtgtaggaaggtgtgggaaggtgtgtttgtggtttgggaaatgtatgtttttttttagagaatttgggtgttgggatggggaggaaggggagagttgaaagttaggggagtgagattttggggtgtgtgatttttatttgtttttttttgttttagtgtttatagttggggtttttgtagagggtgtgggatgtggggttttttggggttgaggttggggttggaatattttttgaagttgtgggtgttttgtttaaggtgttttaggagggtgtaggatttgtagggtgatgttgtggggttttaggggaggaggtgaggataggttttgggggagtggggagttttgggtgttttttggttttttgtgtgaggaaaagatgtggtgttttttttaagtggttgttttgaatgggtattggtagtgtgggtgagtggggagtggggggtggggggtggggggggggggtggtgttgtttgattaattgaagtttaattgaagagttaaataatgtttgatttgggtgtaaggtgtagtttggagttttgggtttttgttgttgttgttgttgtgtttgggtgtatttgtttgtttgttgttttgtgtattttgtagtgttttgggtttttgggttggatagaggagttagtttggtgtgtttttttattttttgtttggggggttttaatgagatatttattgttgttgtggggttggtggggagtagtattgtgatggggattggggttgggtgttggagttagaattggaattatgatgtgattttgttgttggggatttgtgaggtttgtgtggattttgaggtaggtaagtgttgggaatggggtttggtgtaggagttgtttgtttgtgggagagagttgattgggggattttttattttaaagttgtgggatgaggttagtttttttttttttttttttttggtagaagggatgatttggagttatttttggggagtttttttttttattttataatttagaaggttagttggtattattagggaaaaagggatttggggaagttatgaagtagaggagggaaggtttggaggagatttagagttgtgtgatggga

SEQ ID NO: 202 - DNA, 1968 bp, Artificial Sequence
  Chemically-Treated DNA
aggagattgtggtttttttttttttgtttttgtagttttttttttattgtttttatttattttttattaaatttggaaattaaatttagtttgttaattggtgtgggtagagtatagtttttaggtttttgaagttttttatatttggaggatgatgatttttttttgattatatttggagggtgtttagttgtgagttagtggggtatagttttttttttttggtttggatttttatttttttaatttaggaagattgaggtgtgtgtatgtaggtggggtaagtttgggttattgatgagatttgtttgtgtttttgtttttattttggtgtttttttttttttttggtagttttttttttatttgtttattttttgggtttattttgatttatttggtggtgggttttttttttttttgatttttggtggtgtggtttgttttttttttgattttgtgtttggttgttgtgttttgaaggatatgggttatagattgtgtggagatattagttttgtgggtggttgttttggtttaagtagaagaaaattattggggttagtgttgggtatggtagtttttttgttttggagtttgtgttgtttgggtttttttttgttgattttggttttggttggtttttggtttttgataggttgttgagttgtatgaagttttggggttgttttgattttttggtgtttgttttatttttttttttgtttattttttggttagttggggttttgggtgatttggagaggggtaagtggtgttttttagaggaggtgtttttatgtaatttgggggttttggtgggggtatatttggtgggttttagggtgtaagttgagtttttgggagggttagtttagtttagttttttttgtttgtaggggtatgttgtttgtggggtgttggggtgtagggaaattttgtttggtgtgagttttgttttttttgtgtttttggggttttttgggttagttggttggtttttttttattttgttttggtttttttgttttgtgtttaggttttggttgttggatttggtgttatttttggtgaagttgttttgagagggtgaatgaaaaggggggtagtggtggagggtgggggtttggggaggggtgttttttttttttgtggtgtagttggagttggatttaaggggttagtattgttttggttttgtgttaggtggtgggggaggggaggagggatttttttaggggtgggtttggagggggtgggggtggtttttttttttgttttgttgtgggtttattgtttgggaggggtgggagatagtggggggtagttttgggtgggagtggaggtggagatgttgttgttgtagttgttgtggtggttgttgttgttgtagttgttgttggtgttatagtttttttttttggttgagatgtggagtgagtgagtgaaagtggtggtgaggagttttgtgtatattatagttggattttttattttaattttaagttttggttttgtttttagatagttttgtagttaattgttggatgttgttggttttgagttgtgtgtttattggttgtttgttgtggtagtgtgggtgggagtgtagggagagaattatagttggaatttgatttttattttaaaatttaggattgttttttttttttttttttgtttttgggtttgtttttgaaggttggagttaattagattgttgtttagattgaatttatttttttattggttattggggtttttgggatttttttggagggagtttgaagaattagagtatttggtgtggggttttggtgtagggttgtaggttttaggtattttttgtttatgatttttgatttgggtagtagttggaggatggagtttagttttgggtgggtttggggaagaaaggagataggtggtatgggggtgagggttgttattagggggttttagagtgaaa

SEQ ID NO: 203 - DNA, 1968 bp, Artificial Sequence
  Chemically-Treated DNA
ttttgttttgggattttttggtgataatttttatttttgtgttgtttgtttttttttttttttaggtttgtttagagttgagttttgttttttggttgttgtttaaattaggggttgtggataaaggatgtttggggtttgtggttttatgttaggattttgtgttgaatattttgattttttgggttttttttaagggagttttaaagattttaatggttaataggaaagtgggtttggtttgggtagtagtttgattggttttagtttttgggagtggatttaggggtaaggggaggggagaggggtggttttgggttttggggtgggaattggattttagttgtggttttttttttgtgtttttgtttgtattgttatggtggatggttaatgggtgtgtggtttggggttggtggtgtttggtgattggttgtggggttgtttgggggtggggttgaggtttgaagttgaagtgagggatttagttgtggtgtgtgtggggttttttgttgttgtttttgtttgtttgttttgtgttttggttggaggaggaggttgtggtgttggtgatagttatggtagtggtagttattgtggtggttgtggtggtggtatttttgtttttatttttgtttgggattgttttttattgttttttgttttttttggatagtgagtttgtggtggggtgggggaaggagttgtttttattttttttaagtttatttttaaagagattttttttttttttttttgttgtttggtgtggagttgggatgatgttgattttttagatttggttttagttgtgttgtgggaagagggggtgtttttttttggatttttgttttttgttgttgtttttttttttgtttgtttttttggggtggttttgttgaaggtagtgttgaatttggtaattggagtttgggtgtgaagtgaagaagttggaataaagtgagggggagttggttggttggtttgggaagttttaggggtgtaggggaagtgggatttgtgttgggtggggtttttttgtgttttggtgttttgtgggtagtatgtttttgtgggtagggggagttgggttgaattggtttttttgggggtttagtttgtgttttagagtttattagatgtgtttttgttggggtttttgggttgtgtgaggatattttttttgaggggtgttgtttgtttttttttggattgtttggggttttggttggttagaggatggatgaggaggaggatggagtgggtgttgaggagttgggatagttttggagttttatgtggtttaatgatttgttgggggttgggggttggttggggttggggttagtagaaaaggatttgggtagtgtggattttgaggtggaggggttgttgtatttggtgttggttttggtggtttttttttatttgagttaggatagttgtttgtggagttggtgtttttgtatggtttgtaatttatattttttggggtatgatggttaggtgtggggttagaagggggatgggttgtattgttgggggttgggggggaagaagatttattgttaggtgagttgaagtgagtttggagggtaggtggatggggggggggttgttagggaggggagggggtattagagtgggagtggagatgtgagtaggttttgttggtaatttgggtttattttatttgtgtatatatattttagtttttttgggttgggggggtggggatttaggttaggagaagagagttgtgttttgttggtttgtagttggatgttttttagatgtggttaggggagggttgttattttttagatgtgggaagttttgggagtttgggagttgtattttgtttgtgttggttagtgagttgggtttggtttttgagtttggtggggggtgggtgggggtggtggggaggaagttgtggggatggaggaggggggattgtaatttttt

SEQ ID NO: 204 - DNA, 746 bp, Artificial Sequence
  Chemically-Treated DNA
gtgttatttgttggtgtttttattattttttattatttttattaatgattttaatgtaaatataagtgggatggttttgttggattttttaggttttggaagtatgagggtgatgtaatttaggggtaaaggatttttttgtttattggttgttgtgtattggtggaatttttttgatttatagtggtgggaataagagtagttgttggtgttgggaggtattagagatattgtttagtttaagtgttgttgttgtttttatagggttttggttggatgttgttgttgttgttgttattgtttttgatttaagttattttttgttaggtgagttttgagattttggtttaggtatatgtttttttttttttttttttttatttgttatttttttattttttttttttttttttttttttttttgttagtttttttattagatagtttttgttagtttgtgatttatattagtttgtgttttaggttggattggatagttttaattttttggtttgttttttttgtttggttgtggattttagttttatttttttgtattgtatataggtttaggttagttttgggatatttaggttttttagggattgtgtatagagtttgaggtaagagaaattttttgtagatggtgtgattagggatggtgtttggagtttagtagttttagggaaattggtttagaatttggaatagagtggatgggtggtaaataggtatgatgattgagg

SEQ ID NO: 205 - DNA, 746 bp, Artificial Sequence
  Chemically-Treated DNA
ttttagttgttgtgtttatttgttatttatttgttttgttttaggttttgaattaatttttttgggattgttgggttttagatgttgtttttgattgtattgtttgtggaaagttttttttgttttaggttttgtgtgtggtttttggggagtttgagtgttttgagattggtttaagtttgtgtgtagtgtgagagagtaagattggagtttgtagttgagtaggaagagtgagttgggggattgagattgtttgatttaatttagggtatgagttggtataaattgtggattaatagagattatttgatgaagagattaatggagagagagggagaggaggaaagggagtgagaaaatgatgaatggagggagagggagggagagatatatatttgagttagaattttggggtttatttggtgggaggtggtttggattagaggtggtggtagtggtggtggtggtgtttagttagagttttgtggaagtggtggtgatatttgggttgggtagtgtttttgatgttttttagtgttagtgattgtttttatttttgttgttgtgggttgggaaagttttgttagtgtatagtaattaatgggtggaggggttttttgtttttgggttgtgttatttttatgtttttagaatttggaggatttagtaggattgttttatttgtatttgtattgaggttattgatggaaatggtgggggatggtgggggtattaataagtaatgt

SEQ ID NO: 206 - DNA, 2098 bp, Artificial Sequence
  Chemically-Treated DNA
ttggagaaggggagggagatattttgttattttttaaataagtggtagtattggtgattatttttttatttggttaattaaatgtaatttttgtttatgtaaaaaatgaatgtataattttttgttttaatttattggtttatttttgggttgatgtatggagaaataaaaaaaaatttttgtttttgaggattaagagagggtaattagtttatttttttagttagaatttgttttgtttttggaaagattttgttgtttttttaaggaattaggttgaaggtgggaagggagaggtgatggggttattgggattgttaaaattgtatttagagtgtatttaggtggtttagggatttgggtgggtgtgggggatatggtgggaaaggaatgtaagagttgtggttttatttgtgatagagaatttggtggtttttgtaatttttttttttttttgtgttgtttgtgtttggtgttgtaaattgttgtaaaagttattgttgggaatgtggtgtaatttagagtttgttttttaagtgtggttgttagtattttgggaggtagtgtagggatggggttgagatggaatgaaggtaatattttgttttgagttaggggtaattaggatgtataaattttttttgtaaatagttagtgtatatattttgtaaggaaggtgtgttataggttgtaaagggagatataggtttttttagtagtagtgggttatgggtattgagtggggatatggggatgttgtagtggttttggggttttattttgtatttgtgtttgtttatggttttttttttaaagttttttttgattttgaagttgattttagtggtgtgtattgtggtggatgttttgatgtagaattgatttttgttttggtggatttttatgtgtggtttggatgtagttgttatggttattttttttagtatggtgtttatatttgtgtagggtgtattataggtttgggttatggggttttgttgttagttttgggattggttgggtattggttatattttaattttagaaaggggttttaaaattgatttatttgtttttttgtttttgtttttgtttttgagatgagagattgaggtatagagagggtaagtgattttttttgagttgtatagtgaatttgtggtagagtttggttttaaatttgagtttttaaatttaagtttttgattttttttgttttttagtaatttttttttgttatgatttagtatgagataaagtttgtattattgaggagggtgttaaatatttagtaaatgtttgttgaatgtgtgggttttgggatttttattagtttttttgagatttggtgtgtttgggagataaggtgatttattgttttggggatttttttttgtttgggttttttaatttttattttttttaggattggggtatttttgggattagggtatttttgggttgtatttttttgttggggtgtgttttttgtattagtttatttagtgttttgagtagtttgttgaaatttttgttgttgtgtattttttaggtgttggtgaagttgggtatggtggtggtggtggtggtggtaggtatggatagtggtggtgtagtgggtatattttgagtttgtaaggtggagattggtgttttgtgtttagtgttgtgtgttttgagttattaggagagtgtttttaattttgttgggtttttggttttgttttgttggttttgtttttgtttttttgtagtttttatttggtatgtgtttaatttttagtttagttgtgttttagtttttagaggtgtgggtatttgttttttaattggggagtttttattttttttaggatatttatattttgttttaaaatgggtggtgggagagggttagttgaaataagatgggtttggaggggataattgttgaagttgggtggtgtggatttgggttatgattttatttttttttttatttttgaatatgtttgaaaatatttataatataaatttaaagtggatagtgagtggggttattaggggatgggatttattttttttttatttttggttgtatttattgggtgtgtttaga

SEQ ID NO: 207 - DNA, 2098 bp, Artificial Sequence
  Chemically-Treated DNA
tttgggtatatttagtaggtatgattggaggtgaaaaaagagtgggttttattttttgatggttttgtttgttatttattttaagtttatgttatggatatttttaaatatatttaaaagtagagagaaaagtagaattataatttaagtttatattgtttagttttaatagttattttttttaagtttattttgttttagttaatttttttttattatttattttaaagtgggatgtgggtgttttgagggaggtggaggttttttagttggagagtgggtgtttgtatttttggaggttgaggtataattgggttgggagttgagtgtatattgagtaggggttgtgggggagtgggggtagggttggtggggtggggttagaagtttggtggggttgggggtgtttttttagtgatttaaggtgtgtagtgttgggtgtaaagtgttagtttttgttttgtgagtttagagtgtgtttgttgtgttgttgttgtttgtatttgttgttgttgttattgttattatgtttaattttgttggtatttggaagatgtgtagtagtgagaattttgatgagttgtttaaggtattgggtaagttggtgtagagggtgtgttttgatggggagatgtggtttggaggtgttttggttttggaagtgttttggttttggagggggtggaagttggggagtttaggtaggagggagtttttggggtaatagattgttttgttttttaggtgtattgggttttggagaagttggtagagattttggaatttatgtgtttagtgaatgtttgttgaatgtttggtgttttttttgatggtgtggattttattttgtgttagattatagtgaggagagattattggagagtaaggaggattagggatttaaatttggagatttaaatttgggattaggttttgttatgaatttattgtgtaatttgaggaaagttatttattttttttgtgttttagttttttattttgaaaataagggtgagggtagggaaatgagtggattaattttaaggtttttttttaaagttagggtatgattagtgtttgattggttttgagattggtggtgaggttttgtgatttaagtttgtggtgtattttgtgtaggtgtgaatgttatgttgaggaaagtggttgtagtggttgtgtttaagttgtatgtggagatttgttaggatggggattagttttatattaagatatttattatggtgtgtattattgagattaattttaaggttggagaaggttttgaggaggagattgtggatggatgtaagtgtagggtgaggttttagagttattatagtgtttttgtgtttttgtttggtgtttatggtttattgttgttggaggaatttgtgtttttttttgtagtttgtggtgtgttttttttgtagggtgtgtatattggttgtttgtagagggggtttgtgtattttagttgtttttggtttaagataaagtattatttttattttattttaattttatttttatgttgttttttggggtgttaatagttgtgtttaaagagtgggttttgggttgtgttgtgtttttagtagtggtttttgtagtggtttgtagtgttaagtgtaggtggtgtaggaggaggaggaggttgtaggagttgttaggttttttgttgtaggtgaagttgtagtttttgtattttttttttgttgtattttttgtgtttgtttgggtttttgggttgtttgggtatgttttggatatagttttagtagttttgatggttttgttatttttttttttttgtttttggtttggttttttaaaggaatggtggagtttttttaaaagtaaggtaggttttggttgggaaaatggattagttgtttttttttagtttttaagggtaagagtttttttttatttttttatgtattggtttagggatgaattggtggattgaagtaaggggttgtatatttgttttttgtatgggtaaaaattgtatttggttaattagatggaaaaataattattggtgttattatttatttaaaaagtgatagaatgtttttttttttttttttaa

SEQ ID NO: 208 - DNA, 1105 bp, Artificial Sequence
  Chemically-Treated DNA
taataaatatgatgagtgaatgaatagttgtttaataaattaaagaatggatgaaggtaggtagttaggtataaggttttgtagataggtttggttgtgttaattaaatttttttttatgggtttttatatttagtaagtttatttttaaaaggataatgttgaagatataaatgtttataatgattatagtgatgatgggatttgagagaaaggtaaggtggaaggggtgaggttggaagttgaagtgttgtagggagttagtggtgttttggttgttatggagattaggagttttaaaatgtggaggtttttagtgttttggattaatgagtgttaggggataatgtgggtgttaattttgttattagttgggtttagtagttttagttagtttatttggaagttttttttgtattttttttttgtttattttgaggttttttattatagttttgtagtttggttttgttgttttatgtagtttgtgttggtgtagtgttttgagttttagttgttttgtttgtgtttttttttgttgtgtatttaagatattttgtatttgtttattggtgttttttgtaatttgtatttagttgaggttattggtgatgaagtgagtgtaagtttgattaaggtttgtggtagtgagaatgagtgttatgaggagtttgtggattagttgtagtaggtaatgtggtggtggtgttgtgtttgtggatggtgttggggttttagtgtttggtatgtgttagtatttgttaggtgttaggtgttgttttaggatttggggttgtagttgagaaatagtttattatgttgaagtgggtttgatattttagtggaaggatgttttatttatatatatatatgtgtaaatattatatatattatataatgtgtggtatatatttgtagtatttgtttatatttttttagatatatatgttatatattgtatatattaatgaatgattgtggtagattgttgaatagttgttttatggagaggataaagttaaaagttatttggttttggggtgtttttgtattataaattataattttgattgggttatttatgtgtagattttaggaagtgtgtt

SEQ ID NO: 209 - DNA, 1105 bp, Artificial Sequence
  Chemically-Treated DNA
gatatgttttttaaaatttgtgtatgaatggtttagttaagattgtggtttgtgatataaaggtattttaaagttgggtgatttttggttttattttttttatggaataattatttagtggtttgttgtagttgtttattgatatatgtaatatataatgtatgtgtttagagaaatatagataggtgttatagatatatgttgtatgttgtgtggtatgtgtggtatttgtgtatgtgtgtgtatggatagagtgtttttttattagaatgttgggtttattttggtatgatgggttgttttttaattgtagttttagattttggaatagtgtttggtatttggtaggtgttgatgtgtgttgagtgttgagattttggtattgtttgtagatgtgatgttattgttatgttatttgttgtagttggtttatgaattttttgtggtgtttatttttgttgttgtgggttttgattaagtttgtgtttattttgttgttgatgattttggttgagtataagttgtggaagatgttggtgagtaagtgtgagatattttgggtgtgtagtgaggaggggtgtagatgaagtagttgaggtttgggatgttgtgttagtgtaagttgtgtgaggtggtggggttgggttgtgaagttgtagtggaaggttttagagtaggtgagggaggaatataaggaggatttttaggtgggttggttggggttgttggatttggttggtggtgaagttggtgtttatattgttttttggtatttgttggtttgggatgttaaagatttttgtgttttggagtttttggtttttatggtaattgagatgttgttaattttttgtggtattttggtttttggttttattttttttgttttgttttttttttggattttgttattgttgtggttattgtaaatatttgtgtttttagtattgtttttttaaaagtgagtttattaagtgtgaggatttatgaagaaaggtttaattgatatagttaggtttatttgtaaaattttgtatttaattatttatttttatttattttttaatttgttaagtaattgtttatttatttattatatttattg

SEQ ID NO: 210 - DNA, 3476 bp, Artificial Sequence
  Chemically-Treated DNA
atattttattaatttttttatagggatagtgttttaaaatatgatgatttttatatattaaggtgaagttgaatattgttgttgtttttttattgtatgaaaggaattttttagaatttatttttagggatggttttttttattttgaatttttgtatttgtagggaattttatggggtagaggagtgaagagggaataatgtttttaatttaaataaaattttaaattaagtttttagttttattggtgggatagtttgtgggggaatttatttttttttttggtagtattgttttgggggtgagtagagagtggatttggagttttttttttttgtttgatttttgtttgtttgagtagtatttttgggttagtggttgtagttatttgggtgttgttaggggatgtagtggtttaaaggattgagtgggtggtgtaggttggaatttgtggggtggattaattgtggtttggttatagttttgtttgttgattggtttttttaggttttgtttttgtttgttttgttttttttgttggggtgttttggagttgtgtgttttttgttttggggtgtttattgtgtagagtgtggtttggagatttgtgagttggggaaggttgttgtggagttttgattagaggttggggttggggttggtgtagattgagggttggtttttttgattgtgggagaaatgttgggagttggagtaagtagggttttgggtggggtgaaaggaaaagttgggtttttagagtgaagattgagttttttttgtttgtttatattgagtgtatttggggaatgagttagagttagtttttttttttttttttttttttttattttttattgttgttatttaagttaaaagtatatattgattataaatattaggtttggaaagggtagttgtaatagttgaagtgtgtttattttgggggtttgagagtgtagaaggtttgggaaagaggtgataatgataataaaattgatgtggatgttttagttaaaggtattttttttttatttgatgatttatttttttaggaagttggtttgagaggtaaattttaaaatattttgatatgaaatattttgtttttttgattaatttaatgtgtatgtttttttatattgatgtgtttttttaaatattttgtattagattttaataatgatttatgtgtgtttattttttaaaagtttgaaaaagaaaattttgtttattgaaatgaattttatgaatggggtaggttggttgtattgggatggaattgtttatttgatttgaatgaattggtaggagttgtggttatatttaaagggttagagtgtgtgtttttttttgtttgtttttaagttttgtgggttttgtttattttgtttgttgtttttttgttggtggttgttttttgtggtgtttttttttggttagtggaggggtgggaggaggggtgggggtgtgtggggtggggggagaagttttggagtgggtttgggttgtagtttttttgtgttggggattttgttttttatttgttagtgttaggttttttttttttggtgtggatgatattagaatttttttaagttgtgttgtgttatagttgtttgtgaatattgagttgtttggtgttgttttgatatttttagaaagaatgtattttttgtaaaaaaaaaaaaaaaatattgagagagggagagagagagagaagaagagagagagatggagggagagtgagatagagtgagtaatgtaatttgattgagtaggttgtatgttgttgttttttttttttttttgttttttgttatttaggttggtattggtgattttttttttttttaagtttgattttttgtttttaattatttgggaggatttaaattaattttaaaaatttaattttttttttttggaggttttttaggggttgagaggatggttttgggattggtgtttttgagggagggatttgttttttaagttgtaatagttagttttgggatttgttttttaagttgtttagttagttttggtttttgtgagttgggttgtagggatgtttttgagagttttgtgggttttgtggttgtgtttttgtgtttttgtgtgggttttgggtgtgttgggtgggtgggtggtgtgaggggaggttgtgttattttagtaatttaggggtttatttaggttttttatttttttttttgtaggtgatttgaggagggattttgtttttgagtggttgaggattttggtgtagaggagtttggtttgtagaattgtagagttgttgtttttttttataatttggttttgttttattttgttgtatttagtttttggatttttgtttttttttttttttttttgttaaatgatttttttaagataatttttaaaaaatttttttttttgtttatttttgttttttagtttttttatttttttattgaaagtaaattatttaatgatttttgattttttgatggtaggagttttttgattttttaggtggattgttttttttttttgtgtgtgggttttgggtttggtgagagggtgtgagtatagttgaggttatggaggtgatggtggattagttgtgttgggtgagttattattattttgttgtgtttaatgggtagtatttggatatgtattatttgggttttagttatttttatatggatgtggtgtagtatttgttgttggaggaggtggatgtgttttttaatattgatggttaaggtaattatgttttgttttattatggaaatttggttagggttatggtgtagaggtattttttgatttattatggtgagtgtgtttggggtgttggggtttttgttggttgttttagttgttttggtttggggaggttgggagggatttgagggtggggagaggttaagtgaaagtttttatttgttgtttttggtttatttataaaaaaattggggtttggaaatgggtgaggaaggtttttggtttgttgtgagagtgtgttttgaaagagttgtagtaggtgttttttttggttggtggttttggggtttggtgtttatttggtgggtgttaggttgtagttttttgtttttgtgtggttgtaggttttggggtggggggttttgggatgtttttaagtgtggggtgttttggttttgtttttgtgggtttgggttttttgggtttggtagttggtgttggataagtatggttggaatttggtttttttaaaaaatttggtgttttttgttatttgttagttttttttaggtgggtgggtggggtggagggggttttttgttagtgttttttaatttgtatatttttagaaaggttttagagatttatttatttatatttttttttttgatttttttttagagttagtgtttttggtttttagataggtttttattttttggttttaggaatggaattttgatgttgaaggggtt

SEQ ID NO: 211 - DNA, 3476 bp, Artificial Sequence
  Chemically-Treated DNA
aatttttttagtattagaattttatttttgaagttaggaggtaagagtttgtttaaaaattaaaggtattagttttgggaaaaggttaaggagaagggtgtgaataaataggtttttggggtttttttgaaaatgtgtgaattgagggatgttggtagagggttttttttattttgtttatttgtttagaaagagttagtgggtaatagggaatgttaggttttttggaagagttgggttttagttgtgtttgtttggtgttggttattgggtttagagagtttggatttgtggaggtagagttagggtattttgtgtttggggatattttgagattttttattttaaaatttgtagttgtgtagagatggagggttgtggtttggtgtttgttaggtgagtgttaggttttagggttattagttgggagaggtgtttgttgtgatttttttaaaatatatttttgtgatgagttagaggttttttttgtttatttttgggttttaatttttttgtaaatgaattaggaatggtagatgggggtttttgtttgatttttttttgtttttaggttttttttgatttttttgagttgggatggttgaagtggttggtgggagttttggtattttgggtgtatttattgtggtgggttggagggtatttttgtattgtggttttgattgagtttttgtagtagggtgggatgtggttgttttgattgttgatgttaaaaagtatatttattttttttggtagtgggtattgtgttgtgtttatgtaggagtggttgaggtttgggtggtgtgtgtttgggtgttgtttgttgagtatggtggggtggtggtggtttatttagtgtggttggtttgttgttatttttatggttttggttgtgtttgtgtttttttgttgggtttggaatttgtgtgtggggagggagggtggtttgtttgggaggttggggggtttttgttgttggagggttgggggttgttgaatgatttgtttttggtggggggatgggaaggttgggaagtaaaggtgagtaaaggagaaggttttttaaaaattattttggaggggttgtttagtaaagagaagaaggggaagataaaaatttaaaaattgggtatggtagaataaaatgggattaggttgtaaaaaggggtgatgattttgtaattttgtgagttaggtttttttgtattggggtttttagttgtttggaggtggagtttttttttgggttatttgtaagggagagaatgggagatttggatgagtttttgagttgttggagtggtataatttttttttgtgttgtttgtttgtttagtgtatttgagatttgtatgggagtgtggggatatggttgtggagtttgtagggtttttggggatgtttttgtagtttggtttgtgggagttggggttggttgagtaatttggagggtaagttttagggttgattgttatgatttggagggtaagttttttttttggggatattggttttgggattgtttttttagtttttagaaaatttttaaaagaggagagttgagtttttaaaattgatttaggtttttttaagtggttgggggtaaaaaattaaatttaaaaaaaaaaaaagttattagtattaatttgggtagtgaagagtagagaggaggaggaggtggtggtgtatgatttgtttggttagattgtgttgtttgttttgttttgttttttttttgttttttttttttttttttttttttttttttttttttagtattttttttttttttttatagggaatgtattttttttgaaagtattaagatggtgttaggtagtttagtgtttgtagatagttgtggtgtgatgtaatttaaggaggttttagtgttatttgtgttgggggggaggagtttggtgttggtgagtaggggataggatttttggtataaggaaattgtaatttaaatttgttttaggatttttttttttgttttgtgtatttttgtttttttttttgtttttttattgattggaaaggggtgttgtagagggtggttgttggtggaggggtggtgggtagggtgggtgaggtttgtggggtttgggggtggatgggagggaatgtgtgttttggttttttaaatgtggttgtggtttttgttaatttatttgggttgggtggatgattttgttttggtgtagttagtttgttttatttatgaagtttattttgatgggtagaatttttttttttagatttttaaaaaataggtatgtatggattattattaggatttaatgtagggtgtttgggagagtgtattgatgtggggaaatgtgtgtgttaaattgattagaaaaataaaatgttttatgttaaggtattttgagatttgttttttgggttgattttttaagagggtgagttattggataaaggggagatgtttttgattggagtgtttgtgttaattttgttgttattgttattttttttttgagttttttgtgtttttaagtttttagagtgaatatgttttagttgttgtagttgttttttttagatttaatatttgtaattaatgtgtgtttttgatttgagtggtaatagtgagggatgagaaggggggaggggaggaagagattggttttaatttattttttgagtatgtttagtgtagatggatagaaagaatttggtttttattttagggatttaatttttttttttgttttgtttggagttttatttattttggtttttggtgttttttttatagttaaggaaattagtttttggtttgtattgattttaattttggtttttggttgggattttatggtgattttttttggtttgtgggtttttaggttatgttttgtgtaatgggtattttggggtggagggtatgtggttttgaggtgttttagtgagaggggtggggtgagtgggggtggggtttggagggattaattagtgggtgaggttgtggttgagttgtgattggtttgttttgtgggttttaatttgtattgtttgtttggttttttgagttattgtattttttagtggtgtttgggtggttgtagttgttggtttgaaaatgttgtttgggtgagtaggggttaggtgggaaaagaagattttaaatttattttttgtttgtttttagggtaatgttgttaggagagggagtgggtttttttgtaggttattttattgatggggttgagagtttaatttggggttttatttgaattggagatattgttttttttttgtttttttattttataaaattttttataaatgtaaaaatttgagatagaagaagttgtttttgaaagtaagttttgaaggattttttttatgtggtgaaggaataataataatatttaattttattttggtgtgtgagggttgttgtgttttaaaatattatttttgtagaaagattagtgaaatgt

SEQ ID NO: 212 - DNA, 2101 bp, Artificial Sequence
  Chemically-Treated DNA
aaaagtttgtgttggagaagatgtttttgatgtgggggagtgataggttttttggtggttggtgtggagaggggataaggagttattatatgtagttagggttaggttttggtgtttttgtttatatgagtggtgaatgtattgaggtgagtttattgtgtttttagtataattttggtggtggtggtgatgttggattatgggagatgagagatttttagagtaaatagtgggagtgtattgggggtatttattatttatgtttgttttttgatttaatgtgtaggggttgtaaggtgtattgaagttttgtgagttatagtttggattataatttgagtgggagtaggatatttttaggtttttggaagtttggtaggtagttggttgggggtggtgatggtggtggtggtggtggtggtggggtgaattgatttgtatttttttgtttattaggaagtggttgttgttgttgtaattgttggtgttgattgtgtatgattggaaagttgtaattttatggtttgaggggtaggtttgggttgagtaggtttttgagttgttattgttaagtatggggtattttaggaaggagtttatttttgtattgtttatttgttattgagtgatttggttttgtgaagtttggtgtgattgtgttaatttttttattttttttatggggttggagaagaaaaatgatatgaatgtatagtgtgtaagagggggggtgggagggtggaggatgttggaggaggggtatgtgatggtgttagttaatggttgagttttttgtaaaagtttgttggtttttgtagtgatggattattgttttagtggtatttaaatttttggtgttttgttgtttaggtgatgtgtagttgtttttttaggtagtttaggtggtggtagttgttgtggtgattgtaaaggttgatttggagtgttggagtgaagaagagtaaaagttgtgttttgtgtgtgtttgattttgttgtttgttttgttaggtttttgggaggtgggggttgggaggtgttttttgtttttgttttttttttattgtttaatgaaagatgaattggtgagaggtgagaagggaagagggtttttggtttttttggggtgggaattagtgggttagagtttgttgggtggttgtaagtatgttggtttagtttgtagtgtgtttagttggaaggtggggaatttggttgatattgtgttttgggtttttaggttattttttttgttttgaggttgggttgggagattgtggggttgtgaggagtgtatagaattgtggtggagggtgaggttgggttattggttttttaagtttggaatggagggggaagagtgtagagggttggttgggaggaatttgggtgggtgtgaaggagatgagggtaagaaaagaaatttttttttttttaggagggtttttgaaattttttttttatagttttttttgttattagtatggtaatgaggagtttttgtaatttgatttggaggggtggatgagttttggaaatttagagtttgttggaaaaggttgggggtggttgggttttttttttttatttttttttttttgttgttttttgttttttttttttttttatttagttttgtattgggagttttttgggatgtggagttatttgattgttggatttttaggggtaggaggtgggggagagagatgatgttggtggatgtggttagtgtgggggttgggtggtgtgttgtaggttatttgttggtgttttgagatttaggagtttttgtgtttttgtgtgggttttatagggttggtttatagttttaatatagtagttgaattttttttgttgtgtttttttttttttggaggggaatgttagaagagagagagagtttttttttataattttttttattttgttgtatgtttagagtgggtgtgggggttggtaggtgggaggggtggtggataaatggttgatggtggatgggatattttattttaatgatatttttttttttttttaattggttgtgtagttgtttatgagaatttttaagtttttttttagagagatatatgtaaatttga

SEQ ID NO: 213 - DNA, 2101 bp, Artificial Sequence
  Chemically-Treated DNA
ttagatttgtatgtgtttttttagggaaggatttgaaggtttttataagtaattatatagttagttggaaaggggaggaggtgttgttggggtaaagtgttttgtttattattagttatttgtttattgttttttttatttgttagtttttatatttattttagatgtgtagtagaatgaggaaggttataaaaggaagtttttttttttttttaatatttttttttagaaaaagaggaatgtaatgaagggagtttagttattatgttggagttgtggattggttttgtgaggtttatgtgggagtgtggaggtttttgggttttagggtgttggtagatggtttgtagtgtattgtttggtttttgtgttggttatgtttgttagtgttattttttttttttgttttttatttttaaaaatttggtggttgagtagttttgtattttggagggtttttggtgtaaaattgagtgggaaagagaaaggggtggagagtgatgagagagggaaggtggggaagaagagtttggttgtttttggttttttttggtgagttttgagtttttagggtttatttgtttttttaagttgaattatagaaattttttattgttatgttaatgatgagaggggttgtggggagagggttttgaagatttttttggaagaagggaagtttttttttttgtttttgttttttttatgtttatttgagttttttttagttagttttttgtgtttttttttttttattttgagtttgaagagttggtggtttagttttgttttttattatggttttatgtgttttttatagttttatggttttttagtttagttttagaatagaggaggtggtttgggaatttggggtgtggtgttagttggattttttgttttttggttgggtgtgttgtgggttgggttggtgtatttgtggttatttggtgagttttggtttattgatttttgttttgagagagttgggagtttttttttttttttattttttgttagtttattttttattgaatggtggggagggggtgggagtgggggatgttttttagtttttattttttggaggtttggtggggtgggtagtggagttgggtgtgtgtagaatgtagtttttgtttttttttgttttagtattttaaattggtttttgtagttgttgtagtagttgttgttgtttaggttgtttgggggggtgattgtgtgttatttagatggtggagtgttggggatttaaatgttattaaaatggtgatttattattgtggaagttggtaaatttttgtaggaggtttagttattggttgatattgttatgtgttttttttttagtgttttttgtttttttgtttttttttttgtgtattgtatatttatattattttttttttttggttttatggaggaagtgagaaagttggtatagttatgttgggttttgtaggattaggttatttagtgatagatggataatgtaagaatgaatttttttttggaatattttatatttagtagtggtgatttggggatttgtttagtttgagtttattttttggattataggattataattttttagttgtgtgtggttagtgttaatagttgtggtggtgatgattgttttttagtgggtaggggggtgtagattggtttgttttattattattattattattattattgttatttttagttggttatttattagatttttgggaatttgggggtgttttatttttatttaagttgtggtttaagttatggtttatagaattttagtgtgttttatagtttttatgtgttaaattaggaagtagatgtaagtggtgggtatttttagtgtgtttttgttgtttattttggaaattttttattttttatggtttagtattattattattattagggttatgttgggggtgtggtgggtttgttttaatatatttattatttatatggataggagtattagagtttggttttggttatgtataataattttttgttttttttttatgttagttattaagaagtttgttgtttttttgtattggagatattttttttagtgtagattttt

SEQ ID NO: 214 - DNA, 4005 bp, Artificial Sequence
  Chemically-Treated DNA
aaatttttaattttatatggagaattttttttaattatttttttttataaattggttttttaagttagttggtttttatttgagatttttttttttatgtttttaattgtatggagtaattttttttattttttaaatttgtaatttatttttttggagttttgagtttagttattaattatggtttttatattaatggagtttttggggtttttttttttaggatatttatttgttaagtttgtaaggtagaaagaattttgttttgtgttttttaaaatttgggtattgtttttggtttgttggttatttattgtagtttttttaattttgtgtatagtgggtattggttttgggtttttttgttttttatgaagtttttagagtaatttggatttgggaaatttttttttagtgttgtttaaatatatttgggttggttgtgtgtttttaggatgtggatagggagggtttttttgtgtttaggaaagtgattgggtattgtttttagttttttttaaatttgggtattgtttttgggttttttaatggattgggtgttgtttttggatattgaggattggttttggggttttgtttatttttagtagtgtttattgtttgttatagagtgtttgattgtttgttgtttgagtttttggtgtgtttgtggatgtagtttttagttttgtggtgagttttttgttgtgttgattttttttgtttttgtgtttttgattggtttttggtttgtatttgttgttgttttgttggtgttggtgtttgtttttggttgttgttggggaggttggtgtggggtgtgggatatggttgtggatttgtggttggtggttgtgtttgtttttgttgggtgttttgaaatttgtgttatttttgtttgtttattgtaaagattttatttgtggggaaagtggttggagggttttaaagtggggtgggtagggggttggggtgagggatgtggaggagaggtgtttttgttgggtggtaaagtgtttttagtttgtgggtttaggattttgttgggaggtgtgtgtggagtgtgggtgaagtgattgatggtggagtgaggggggtgaggggggttaggggggtgtgagattttgttggtggttttttttttttggttaggtttaggtggtggggggttggtggggtgtgggattttgtgtgtggtttttgatttggtaaaaattatagtgtttttttatattgtttaaattttttaggagatggtttttttagatttttaaattattgtggtggtttttgagattgaatttgtgtttatgtaagtttaatgtattgaggatggggtaattattatttagatattttgggtgggttgtaaaggtgagttatttagatgtattttggtgagtttggttatgtaggtaggatttgagttgtgttttttgttttgatttttttttttttggtggttggagtttttgtaggttttaagtttggtttagatttggtttggtgtagttggttttttgtgtgttttgtatttggtgggggttttggggttttggtgtggtattggggggtgtttgggatttggttgaggttttaagtgttgtgtggttggttttttttgttggggtaggtggtggttgtgtgttttgtttgagtttaggggtttttttagttgtaataattagtaaggattttttgatttagttttaagttatttgtatttgtatttagatggggtgtatttgtagtgtagttttttggtggggtgttgggagtttgtttgtttttgtttgtttggagattttagtttatgagtataggttgtttgggtattttagaaatttgggatggggtttttgaattttttagaatgggtatttagtatggttttggtgttttgtggttttttgttttttatttagttttgtttttgtgtattttttagtttttgtgattgttgttttttttttggggttttagggtttttagtttgtattttttgttttgtttttggtttgggttgtgggggtgggttgggggtggggtgagggttttgtgggtgtttattggtgtgggtgtgaggttagtgaggtttgtgtgggttttgggttgtgggttggtgtgattataagagttgggtgtgggtgtttgtagtttgtttgttttttggtggagttgtgtgaggtttggttggttttggttttttttttttggttgtttttgttttttggtttatgtttgtttgtgttttgtttattagtgtttttattgggtaaggtggttttgtgttgatgttgtttgttgttttgttgttgatttttgttttgggtgttgtttgtggggttgtgttttgttgggtttgtggattttttgttgttttttttttatttattttaattttttttatttttgttttgtttgaggaggtggttttttttgtaggtagtttggtttgtaggttgttggtgttgttatttttttttgtgttttttttttagttttttttttggtgtgtagttttgggttgtttttttttttgtgttgtgttttggagtggttttggtgttgttattgtttgttttttttttgaggtttgggtttgtgatggtagagggttttgttggtttaaattgagttgggtgtttgtggtttgggtgtagtttttattttgttttttagttattgttttttttggttttttgatgtggtgtttttttttttgtttttttgtgttttttgtgttttttttggtgtttggttttggtttttgtttttttttttgtaattttttttttgtttttttttgttttttttagtttttagtttttgatttttttttttttttatgtttgtttttttgtttttgttgaattaaagtggattaattatatgttttttgtttttttttgtgttgtttttttttgttgtgtgtttgtttgttttttgttgtttttttttttttttgttttttttttggttttttttttttatgtttattttgttttttttattatttttgtttttttttatttttgatataatagttgattttattttttgatatttttttttttttgaaaagtataatatttggtttgttttagtttgaagatagtttgttttttttggataattagatgaattttttttttttttttaaaaaaaagttatttttttgttttgttttgttgtatatttggtttttgtgatttggttagagtggtgttggtagaggagtgtttggtaggagggttaatgtttgttgtttggtttgtgatatgtagtagggaggtgggtggtagtgttgttggtttttaggtaagtggtgtgtgtgggttgggttggggttggggttggggtggtgtgggtttgtgttggatgtttggttttttttttgtttgtttttggtttggggtttgtggggtttggtggggtggttgagtttgggggggaggaggaggaggaggaggaggatggatggttgtgggttttgttttttgtgtggagttttgtgtttattttggtggtggagttgggggtggggtgggggtgttgggaagggttgagggaggtgtgaggtgtttgtaggggtgattttttggttggtttgtgggtgtagggggtgttgttttatatgtgtgatttgtgttttgtgggttttggtttttggggtgttgggtaatgaggaggggtgtggagttgtagaagtttattttggtatgttgatgtggtgttagtgagattgtgagaggaagatgggggtgggtggggttaggatggagaggggttgagttggtaggagttatggtagatgttatatttgtgatattttttttatattttttttggttttgtttgtaatatttttaaataggagttttgggagagggggagaggggttgttggtttgaggttaagaagggtagagtttttgatttggagagaggttgtggtttttgtttagtgggtagtgtggaagtttttatataaggaggtgggaag

SEQ ID NO: 215 - DNA, 4005 bp, Artificial Sequence
  Chemically-Treated DNA
ttttttatttttttgtatggaaatttttatgttgtttattgggtaggggttgtggtttttttttgggttgaaggttttgttttttttagttttagattagtagttttttttttttttttttgggatttttgtttggaaatgttgtggatagagttagagggggtgtgggggagatgttgtgaatgtggtgtttgttatgatttttgttaatttggtttttttttattttggttttgtttatttttgttttttttttgtggttttgttggtattgtgttaatatattagggtgggtttttgtggttttgtgtttttttttgttatttagtattttggaggttagggtttgtaaggtatgaattatatatgtgaggtggtattttttgtatttatagattgattgggaagttgtttttgtagatattttatattttttttggttttttttgatgtttttattttatttttagttttgttgttagggtgagtgtggggttttgtgtagggaatgggatttgtagttgtttgtttttttttttttttttttttttttttttgggtttagttgttttgttgagttttgtaggttttgggttgggagtgggtggaggaagggttgggtgtttggtgtaagtttgtgttgttttagttttggttttggtttggtttgtatatgttgtttatttggaagttggtgatgttgttgtttatttttttgttgtgtgttgtaaattgaatagtgggtgttggtttttttgttggatatttttttgttagtgttgttttggttgagttgtgggggttgaatgtgtgatggggtagagtggggggatggtttttttttggggggggggggagaatttgtttgattgtttagggaggatgggttgtttttgggttggggtgggttagatgttgtattttttgggggggaaaaggtattgggaaatgaggttagttgttgtattaaggatagaggggggtagagatagtgggagagatagagtgaatgtgaaaggggggggttgaagagagggtgagggggagagaggatagtgagaggtgggtaggtgtatagtgggagagaatagtatggagagaaatagaaagtgtgtaattaatttattttggtttggtgaaggtgagagggtgggtgtgagggggggagggagttggaggttaggagttgggggggatgggagggagtgaagggaaggttgtgggagaaagagtgggggttggggttagatgttaagaggggtgtggggagtatagagaagtggagggaagggtgttatgttgaggggttgggggaggtggtgattggggggtggagtggaggttgtatttggattgtgggtgtttagtttggtttgggttgatggagttttttgttgttgtgagtttgggttttgggagggggataggtggtggtggtattggggttgttttgggatgtagtgtggaaaggggagtggtttgaggttgtgtgttggggggagggttggagggggagtgtgggggggggtgataatgttggtggtttgtgagttggattgtttgtggggggaattgtttttttgggtgaagtggggatggggggagttgaggtagatgaagaggaggtggtggggaatttgtaggtttggtggagtgtgattttgtggatggtgtttgggatgggagttagtagtgaggtagtgggtggtgttgatgtggggttgttttgtttgatggaggtgttggtgggtagagtgtgggtaggtgtgggttaggaggtgggggtggttggaaggggggggttggggttggttgggttttatgtagttttgttggagagtaggtgaattgtgggtgtttatgtttggtttttatagttgtgttagtttgtggtttagggtttgtgtgggttttgttggttttgtgtttgtgttaatgggtgtttgtggagtttttgttttgtttttggtttgtttttgtaatttgagttaagagtggggtggggggtgtgggttgggggttttggggttttggggggggggtggtggttgtaggggttggggggtgtgtgggggtgaggttgggtggggggtagggagttgtagagtgttaaggttatgttgaatgtttgttttagagaatttaggggttttattttgggtttttggggtgtttgggtggtttgtgtttgtgagttggggtttttgggtaggtaggggtaggtgggtttttagtgttttattaggaggttgtattgtgggtgtgttttgtttgagtgtagatgtaggtggtttggggttgagttggggggtttttgttggttgttgtggttgagggggtttttgggtttgggtggggtgtgtagttgttatttgttttagtaggaggagttggttatgtggtgtttggagttttagttagattttgagtgttttttggtgttgtgttggagttttggagtttttgttaggtgtgggatgtgtggaaggttggttgtgttgggttgaatttgggttaggtttggagtttatggaggttttggttgttagaggagagaggattagggtgggaaatatagtttaaattttatttgtatggttgagtttattggggtgtgtttaagtagtttgtttttgtggtttatttaaaatatttggataatggttattttgtttttagtgtgttggatttgtatagatgtgagtttggttttgggggttattatgataatttgggggtttggggaaattattttttggagagtttgaatgatgtaagaaagtattgtgatttttattaagttaaaaattatgtataaaattttgtattttgttagttttttgttgtttaagtttagttaaggggaaggggttgttggtggaattttgtgtttttttggttttttttgttttttttgttttgttattaattattttgtttgtgttttgtgtgtgttttttggtggagttttaggtttgtgggttagaggtattttattgtttggtgggagtgttttttttttgtgttttttgttttagttttttgtttgttttattttgggattttttagttgttttttttataaatgagatttttgtaatgagtaaatgaaagtggtgtggattttggggtgtttagtaggagtgagtgtagttgttagttgtaagtttgtagttgtgttttgtgttttatgttggtttttttggtggtagttggagatgagtgttagtattggtgggatagtagtagatgtgggttgagagttggttaggggtgtagaggtggaggggattggtgtggtggggagtttattgtgaagttggaggttgtgtttgtgggtgtattaggagtttaggtagtgagtgattgaatgttttgtggtaggtggtggatgttgttgaaggtgagtgagattttggggttagtttttagtgtttgggagtaatgtttagtttgttggaagatttggggataatgtttaaatttgggggagattgggggtaatgtttggttgtttttttggatatggggaagttttttttgtttatgttttgagggtgtgtggttgatttaagtgtgtttgggtaatgttagagagaaattttttaaatttgagttgttttggggattttgtaggagatagagaggtttgaaattagtgtttgttgtgtgtggggttggggaagttgtagtgggtggttggtgagttgggaataatgtttaaattttggggaatgtaaggtagagttttttttgttttgtgggtttagtgaatgggtgttttggaggaggggattttggggattttgttaatgtgggaattgtgattaatgattaaatttgagattttagaaaaatagattataggtttgggggatgagagaagttgttttatgtaattgggaatatagagaaagaggttttaaataggggttagttagtttgggggattaatttgtgaggaggggtagttaaagaaaattttttatatgaaattgggaattt

SEQ ID NO: 216 - DNA, 1955 bp, Artificial Sequence
  Chemically-Treated DNA
aatgagatttatttaaaattggaaatttggtgtttggttttttaggagaataattaatgattgtgatttgaagtttattagggtattttgagagatttaattaaagatagagtgttggtttgaaattattaaaaggtaatagtaaaagggagagtaaaattttagttttaatgtaatttataaatttattttgttttttttgaaagaggggtgtgggtgggtgtgtttttttgtgagtattttatttaagggggaattttttttagtgtatggtgaagtttttttttggttgttttatttggtagtttttttaggattttggttagtttttaattggttttagtaatgtttagttggagtttttttgggtttttgagtgggagaaaagtgagagtaggtgtttttttagtggtgtgttttgttagggtttggtaggattttgtttttaagttgggaaaagttggttggtgttttttttttttgatgaagttgttttagggttgtttttagaggatgtgtggtaggtaaagagaatgaatttgagtgtttatgaaatgttttgtatggtttttgggagttgggagaaataggtgtttttttttgatgtttgtgggtgatgtttgttgtattttgtttgttgttgtgttttttttgggtattttttgtttttggtgtttttgtttttatttttagtgttagggtggaggtagttttggtttgtaggtaattattgttagtggagtttgttggggagtgggggtgggtgtgttggtggtgggtgggtgggtgtggtggggtgtgggtataaaggggtgtggtgtggggttttggagtttggtttttgtgtagtatgtttgttagtgttttgttgtgttgtttgtggttgttgttgtagttgttgttgttgttgttggtgttgttgggtttgggtggttgttgtttgtgtgtggagttgggtgatggtgtgtagatttgggtttgttttttgtggttttttgtttttgaggttgtgggttttttttagggtattttttttgatggttttttttgggttgtgggtagtgttgtttattagattgagggtggttggtagtagtatggtaagggtgtgtttatttgggatatgtttatttattattttttggtatttttgggagatttttggaatgttagtttgttgttgggtgttttgttgttgttgtagtttgttattggggatgtagttagtgatagttataataatgttttttgtgatatggaggtgttgtgtgagtttggggttatttattattgtttttttattttgtgggtgtgagtgttttttaatggtagtgtgggtgtttttaattgtgaggggttgtgttattattggtgtttgttggagtggttgtgggagttgggtgtgtagtttgtggttattttgtattattgggatttgttttagtgtttgtaggatgtttatggtggttgggttaattgtgttttggttgattattttagggattatgtggagttttgtttttgttattttggtggttaggttaagtattggattattattgataatttttatgtggtggtttggtatggttatgttattgggtgtttggtttttggtatttggggtagtttgtggtttgggtatttggtggtgtataatttttttttggtgagtgtgaggggttaggtggagggttatgtaggggagatagagggtttttataggggttagggggaagtgtgggaattgagttttttttagatgaggttttatttggatatgtgtatgtggttattgggggaaattgagtagttttgattttttttggaaggtgtggaattaggagagaaattttttagtgggtatatgagtgagtgttttttggagtttatttgtggaaaggaagtggtgataggtttttgtagtgaggaaagaaatttttttttttgggtgt

SEQ ID NO: 217 - DNA, 1955 bp, Artificial Sequence
  Chemically-Treated DNA
atatttagagaaaggagtttttttttttattgtggaaatttattattgttttttttttatagatggattttaaggggtatttatttgtgtgtttattaagggattttttttttaattttatgttttttaagggaagttagaattgtttagttttttttggtgattatatatatgtgtttaagtgaagttttgtttgggggagatttagtttttatatttttttttggtttttgtggaggttttttgttttttttgtgtggttttttgtttggttttttgtatttattaggaggaggttgtgtgttattaggtatttgagttgtgggttgttttggatgttgggggttaggtgtttggtggtgtagttgtgttaggttattatgtaggggttgttgatggtgatttagtatttgatttgattgttgaagtggtggaagtagagttttgtgtaatttttgaagtggttggttagggtgtggttggtttagttgttgtaggtgttttgtaggtgttggggtaggttttagtggtatagggtgattatgggttgtatgtttagtttttgtagttgttttagtaggtgttggtagtagtgtagttttttgtggttggggatgtttgtgttgttattggggagtatttgtgtttatgagatggagaagtggtagtgagtgattttgagtttgtgtagtgtttttgtgttgtggaagatgttgttgtagttgttgttggttatgtttttggtggtgggttgtagtggtgatggggtgtttaatggtagattggtgttttgggagttttttgggggtgttagggggtggtgggtgaatgtgttttagatggatgtatttttgttgtgttgttgttagttgtttttggtttggtaggtggtgttgtttatggtttagaggaagttgttggggaaggtgttttggaagaggtttgtggttttgggggtaggaggttgtgagaaatgggtttaggtttgtgtgttgttgtttggttttgtatgtaggtggtggttgtttaggtttagtagtattagtagtagtgatagtgattgtggtggtggttgtgggtggtgtggtggggtgttggtgggtatgttgtgtgggagttaggttttggggttttgtgttgtgtttttttatgtttgtgttttgttgtgtttgtttgtttattgttggtgtgtttatttttgttttttggtgggttttgttggtaataattatttgtgagttgggattgtttttgttttggtattgggggtgggggtaggggtgttgagggtgaggggtgtttgggaggggtgtggtagtgggtaaggtgtggtaggtgttgtttgtggatgttggagaaaggtatttgttttttttagtttttgggagttgtgtaggatgttttgtggatgtttaggtttattttttttgtttgttgtgtgttttttgagagtagttttggagtggttttgttggggagaaaaggtgttgattaattttttttgatttgggggtgggattttgttgggttttagtggagtgtgttgttggggaagtatttgtttttattttttttttatttggaggtttaaagaagttttggttggatattgttggagttaattagggattggttgaaattttagagggattgttaggtgggatagttgagggggaattttgttgtgtgttgaaagggatttttttttaggtgagatgtttgtggggagatgtgtttatttgtgttttttttttgaggaagataaagtagatttatgggttgtgttgggattggggttttgtttttttttttattgttattttttaataattttaaattagtattttatttttgattagattttttagaatattttggtgaattttaaattatagttgttgattgtttttttgaaaaattaaatattaagtttttaattttgagtaaattttatt

SEQ ID NO: 218 - DNA, 2091 bp, Artificial Sequence
  Chemically-Treated DNA
gggttagttttgagttagttataaaggaggttttgtggagtttagaaagtgtaaaaggaaaggttgtttaggggtgggtaggaggggtgttgggttgagggttggagaaatagattaagagatatttgttgtgagggtgtggtgatttaataagtggtttaggtatttttgattgttttaaagtttttgttttttttttttgtttggagagggggttttgaggtggtagttggggttttatttattgtttgttgattaggggagggggaaagtaatagtgtttataaagggtttagtggtaaggaatgaaatagggtgttgtgtggagtaagtttttgggtaggtttgggaaggagaaaatagggttgttggggtggtaggtgaagtttttggaggtggttgggttattggggttagagagtggggaggtggtggtggtatttgagttttaggattttgtgttgttggtggggtttgggggattgggtaggtaggggatgtattgtggtggtaggaggtgtttttgggtattgtttttgggtagtttttgatttgttaggtgtagtgttttggttagagtttagatgtagttgtaggtgaagtgtagtgttttgattttggtgagtttggtgttgttggggaatgagggtagtatgttgtgtagtgtgtttagggttgtgtttaagttgtgtatgtggttgtgtttgtgattgttggttttgatgtgttggtttttgtgtagtgagtgtagtagtgttttggagtggatttgtgtttggttgtggtgttgttgttttttttgtttgttgttttgtgtttttggaattttagatgtttgggagatattgggtgtgtttttgtgggttggtgtgggtggttttgaagtggaggttgtttgttggagtttggtatagttttttttgttggtgaggaagttggataggttattgttgttgttgttggtgtagttgaggttggagatgtaggttttaaggtgggttggtattgttgtgttgtgtaggattgatggatagatagaaaggtgtttagagtgttgtagtttggattgagggtagagttgttagggtgtatttatgtttttaatagtttggggttgttattttgtgttagttgtgggtgtgagagtttggaagggtgtaggggtgtatggagaatttggtttggtttttttgttttgtttgtaggggttatgtgtttggttggttttttgagtgatgttgttggtgattagattagtttgtgtgagtattgagtgtggtatatgattggttttaggattttttaagtatttggtgtaataatgggtgttttttttttttgttatttttgtttttgtggtagtttgggtgaatggagtgaggtggtaggttatttttgtgtagtgtttgggtatttgtataatttatgtttgtgggaggttgttattgttttttttttaatttggagtgtgtttgtaattattgttggttaattggtggtgttgtgtggttttgggagttggtttgggttaagttggttagggtgtttttaggtagtgaaatagaggtggggttggtgggtgattagtggttgaggtatgttttttttggggtgggttgggtgttttttgttggggtgggatggggaggtggggtgtgagtgtgaaagtgtgagttgtttagtgagttgtggaaatttggagggtatttggagtttgggtttgtattttttttttagttgtttagtggttgtgtgattttggatgagtaatttaatttttttgagtattgttttttttatttgtaagatgagataaaagtttattttgtggaggatgattagatataatgtttgtggaatattaaatgtgtagtatttgttgaatagggtgaaaattatttttaaatagattggagagtggttatgttagaggtatagggtgtagggtaaggataagtgttgttgttttgtttaggttgatgaagaaatgggaaagaatttgatttttatttggggagtgtgaagaggagagtggaaaagaggattgggtgattttttaggttgttttgagttttggttttattttttttt

SEQ ID NO: 219 - DNA, 2091 bp, Artificial Sequence
  Chemically-Treated DNA
agggaagggtgagattaagatttaaggtaatttgggaaattatttgatttttttttttatttttttttttgtattttttagatgaaggttagatttttttttgtttttttattagtttgaatggagtagtgatatttatttttgttttgtgttttgtgtttttggtatggttattttttagtttatttgaaaatgatttttattttgtttagtggatgttgtatatttagtgttttataaatattatatttgattattttttatagggtaaatttttgttttattttataggtggggaaagtaatgtttagggaagttaaattatttgtttaaagttatgtgattattaagtagttggagaggggatgtgaatttaaattttaagtattttttaggtttttgtaatttattgggtggtttatatttttgtgtttgtgttttgtttttttgttttattttagtgaggggtgtttagtttgttttaagaggagtgtgttttggttgttaattgtttgttgattttgtttttgttttattgtttggagatgttttggttagtttagtttgagttgatttttggggttgtgtgatgttgttgattggttggtggtaattatgggtatattttgggttgggggaggggtgatggtggttttttgtgagtataaattatgtaaatatttgggtgttgtatggggatgatttgttgttttgttttatttatttgggttgttgtgggggtggaggtggtaagggaggggggtgtttattgttgtgttgggtatttaaggggttttgaggttagttgtgtgttatatttggtgtttatatgagttgatttgattgttggtgatattatttaggagattggttgggtgtgtggtttttgtaggtgaggtgaggaggttaggttaagttttttgtgtgtttttgtatttttttaggtttttgtatttgtaattggtatagagtaataattttaggttgttgggaatgtaagtgtgttttggtggttttgtttttagtttgggttgtagtgttttgagtgtttttttatttgtttgttggttttgtatagtgtaatgatgttagtttgttttgagatttgtatttttgattttgattgtgttagtagtagtggtagtgatttatttggtttttttattgatgaggaagattgtgttagattttaataggtagtttttgttttggggttgtttgtgttggtttgtaggggtgtgtttaatattttttgggtgtttgaggttttaggggtataggatgatgagtaggagaggtggtggtgttgtggttggatgtgggtttgttttgaggtgttgttgtatttgttgtgtaggagttggtgtgttaaggttaatgattgtgagtgtaattgtatgtataatttgaatgtggttttggatgtattgtgtagtgtgttgtttttgttttttgatgatattaagtttattaaaattgagatgttgtgttttgtttataattatatttgggttttggttgagatattgtgtttggtggattaagggttgtttggaggtggtgtttgggagtgttttttgttgttgtagtgtgttttttgtttgtttggttttttaagttttgttagtgatgtggagttttggggtttaggtgttgttgttgtttttttgttttttgattttagtagtttagttgtttttgaagattttatttattgttttggtgattttgtttttttttttttaagtttgtttaaagatttgttttatataatgttttgttttattttttattattaggttttttgtagatattgttatttttttttttttttagttagtaggtaatagatggggttttagttgttgttttgggattttttttttaggtggagggaggaagtgggagttttaaagtagttggggatatttgagttgtttgttaggttgttgtatttttgtggtggatgttttttggtttgtttttttggtttttagtttagtgttttttttgtttgtttttagatggtttttttttttgtattttttgaattttataaaattttttttgtgattggtttagaattgattt

SEQ ID NO: 220 - DNA, 3003 bp, Artificial Sequence
  Chemically-Treated DNA
tgtttgtgttaggagttggtaagtgatgttatttgtgggggtgtaaaagttatttttttaaattttaaatttatatagtataattttttttagagttataaaaattataatttgtgttgtataaggtaggaggtttggttttggtattgtttaagtttttttgatgtggtgagttggggaagggagttggggtgggggttttttgtatgggtattttttgttttatggttttttttttttttaggatggattatgagtttttttttttttggattgagggggaagtttttaataggaatatttgtagggagttgaatgttggtattttaaagttgtttgtattttgttttatttgtaggggtaggggttttatgaatgtgatagggtgagtaatgtatagagttgagggtagtaaatgttaagatttgggggtggggtttgtattgggaatttggatgtgggttttggttggggtggaagaagaggttaggagttttggaaggggggttatattttgttagtaatttattattttgtttgtaatttgtttttaagtttgttgttttttgttttttttaattataataataaaaaaaaagtgtaaagaaatttagtttgttggaggttttgtatttggtgtgtaattttttttgagtgtgagtatattgggtgggaggggtgggggttgaatttggtaggtggtgtttttttttgttgttgttgttgttttgtagatttggggaagagggtgggggatggttggggtgtgggggagggtgggttttgttttgtaattttttttttagtgtgagagtgtggtggtggtagttgaagatttggttgtttagatgatgtggtggtgggggatttgttggtatgtgatttttttttgggtttaaagtatgtatgtgttgatttttgttattttgttttttttttgaagtttttttagagggtgtgttaggttgtttggttttgagtgtggttgagatgttgtggtattgtttttgtgtaattttgtagttttttttgaagtgatatattttatgtaatttggtttggtggtggtggtgtgggttatttatgtagtttagttgtgggaggtgttttggtttttgtggtttgtttgttgttatttgtaggggtattggtggtgtttgttgttaaggggtagagtgagtttttgagtgggtttggagttgtggagttgggtgggggtgggaaggaggtagtgagaaaagaaattggagaaatttggtggtttttttaatgttgttttagagagattaggttggtttttgttgttgttgttgttatttttttttttggggagttgggggtggggggtgaagtgtggtgtattgggtggggtggttatgttaggggatgtgggtgtgtaggtgttgttggggttggggtggtggggtttgtgtggagggtgtgggggtagggattgtgggtgtttttgtagttgttaagtgttattaataggttgtattgttttttgtggttgttgtgtggttttttgggtggggagtggttgggggtggagtgggagtgtgtgtgtgtgagtgtgtgtgtgttgtggtgttgtttttatttgttttttgtttggttttgtttgtttgtttaggttgggttgtttttttgtgtgtttgtgtttttttttttttgttgttgttttttttattttgtgagtttgtgtttgtgatgggagtttgagttattgtttgtttgttggggatggattttgtgggtggaaggagatgttgtagttggagtggttgaagtagttgggattgggatggggtatgtgtgtttggaagttttgatttgtggagtttggtgtggggtggagggttggtttgttagttgggtaatgggagatttttttaaataggggttttttttttatttatggagaaaggggtggttgtttattttttttttttagaaaaaaaaaatatattttttttttgttttttttgtgtttataagttaagttgtttattttggttgtggtgggaattgtggatggtggtgggtgagtggtttttttgttagaggtaagaagtgaggtgggagggggttggggtgtgtttgtttttttgaggtgttgttgggattggagataatttgggggttgttgtgggagtttataaatttttattagttttggggagtgggggtggggggttggtaagggttgggtgatggtgatgaaagggtagtgtgtgggtgatagtgttggtttttttttttttttttgttggtgttttttggttgggttgagggggaggaatttgattttggatggtgagtggagttttgttgaattgttgggggttttgagttttttattttttgtgggaattttggttttttttttttttttagtgttttttttttttttaagggggttgtttgatatttgtttttgtggtgaatgttaagttgtgtttgaattttatttgtttgaatatttgtatgttattttggtgtgtttgagtgtgagtttgggttttggggaggttttggtggtgtttggtttgaggagggtgtgtggggtgtgtgagggtgtatatgtggggggttgatagtttgtaatttggagattgtggttggggttggtgttatttgttagaagtgggtgtgttggagagagaatttaataggtttggatgtattttttttttaattttgtattttttttttttttttatttttgttttgtaagggtttgttttttagtgtttgttgttaatttgtgtttgaggtttttaagtggttttttttagaaaaagattttttgtaattgtaatggttttgtgttgtgatttttataagtgttagtttgatgtttggggttgtagatttgataattgtaattttgtaatattatttaagattttttggtatggtttattagggttaattaatgtggttgggttatttgtaatttaaattgggggataatgttgtttgagggagtgtttttgtttt

SEQ ID NO: 221 - DNA, 3003 bp, Artificial Sequence
  Chemically-Treated DNA
aaaatgaaaatgtttttttaagtgatattattttttagtttaagttgtaaataatttagttatattaattggttttaatgaattatgttagagggttttaagtggtattataaggttgtaattattaagtttgtaattttaaatgttaaattagtatttgtaaaaattgtagtataaaattattatggttatagggggtttttttttaaaaggggttatttagaaattttaggtgtgaattaataataaatgttaaagagtaagtttttgtggggtgggggtggagaagagaaaaaagtgtgaggttaaaagagaagtatgtttagatttgttgagttttttttttgatatgtttatttttaatagataatgttggttttggttgtagtttttaagttgtgggttgttagttttttgtgtgtgtatttttatgtgttttgtatgttttttttaagttaggtgttgttggggtttttttggagtttgggtttgtgtttgggtgtgttggggtggtgtgtaaatatttgggtgagtaaaatttagatgtggtttagtgtttattatgaaaatgggtgttgggtgatttttttggagggaaaggggatattagggggagaaaagaggttaggatttttgtgaggaatgagaggtttgaagtttttggtagtttgatagggttttgtttgttgtttgaggttaggttttttttttttggtttggttaggggatgttggtggagggagaggaagaggttagtgttgttatttgtgtgttgtttttttgttattgttgtttggtttttgttagttttttatttttattttttgaggttaataaaagtttgtaggtttttgtggtggtttttgagttgtttttggttttagtggtattttgggggagtgagtgtgttttggtttttttttgttttgttttttatttttggtagaggagttgtttgtttgttattgtttgtagtttttgttgtagttgagataaataatttagtttgtgaatgtagaaggagtaggagggaaatatattttttttttttaaaaaaaggaagtaaatagttgtttttttttttatgggtggggggagagtttttatttaagaaagttttttattgtttagttgataagttagttttttgttttgtgttgggttttgtgggttggggtttttgggtgtgtgtgttttgttttggttttagttgttttggttgttttggttgtggtgtttttttttatttatagaatttgtttttgatgggtaggtggtgatttgggtttttgttatagatatgagtttgtaaaatggaggaggtggtggtggagggaagagagtgtggatatgtgaaagggtagtttggtttgggtgagtgagtgggattgagtggggagtgggtggaggtggtgttatggtgtgtatatatttgtatatatgtgtttttattttatttttggttgttttttgtttgaggggttgtgtggtggttgtggggaatgatgtaatttgttggtgatgtttggtaattgtaggggtgtttgtggtttttgtttttatgttttttgtgtgggttttgttattttggttttgatggtgtttgtatgtttgtgttttttggtgtggttgttttgtttggtgtgttgtgttttgttttttgtttttaattttttaggaaaaagggtggtggtggtagtggtgggggttgatttggtttttttggggtggtgttaagagggttattgagtttttttagtttttttttttgttattttttttttgtttttgtttagttttgtggttttagatttatttgggagtttgttttgttttttggtggtaagtgttgttagtgtttttgtgggtgatagtgggtgggttataagagttggggtgttttttgtggttgagttgtgtgagtggtttgtgttgttgttgttgggttgagttgtgtgaagtgtgttattttgaaaggggttatggggttgtatggaaatggtgttgtagtgttttggttgtgtttggggttgggtggtttgatatgttttttggggaggttttagggaagggatgggatagtgggggttggtgtatatgtattttgggtttgggggggagttgtgtgttggtaggttttttattattgtattatttgggtggttgggtttttagttgttgttgttgtgtttttgtattgggagagaagttgtaaagtagaatttatttttttttgtgttttgattgttttttatttttttttttgagtttgtgaggtggtggtggtggtagaaggaggtgttgtttgttaagtttaatttttattttttttgtttaatgtgtttatatttgaaggaagttgtatgttaaatgtaaaatttttagtgagttggatttttttgtattttttttttattattatgattaaggaaagtagggggtggtaggtttaaaagtaagttgtaggtgaaatagtaagttgttggtgaaatatagttttttttttgaaatttttgatttttttttttattttggttagggtttgtgtttaagtttttggtgtaggttttatttttgaattttgatatttgttgtttttgattttgtgtgttgtttattttattatgtttataggatttttgtttttataaataaaataaaatataggtagttttaaaatgttagtgtttaattttttatagatgtttttgttaggagttttttttttagtttaaggggaagggaatttgtggtttgttttgagaaaggagagggttgtggggtgaggggtgtttgtgtgggaagtttttgttttagtttttttttttagtttgttgtgttgggaaggtttggatgatgttgggattgagttttttattttgtgtggtatagattatgatttttgtgattttgggaaaggttgtgttgtgtgggtttagggtttggggaggtaatttttgtgtttttataggtgatattgtttgttagtttttgatatgggtg

SEQ ID NO: 222 - DNA, 4313 bp, Artificial Sequence
  Chemically-Treated DNA
ttaattttaaagattttttttaagttttaagtgatagtaaaatttttgatttgatgattaaagttatatgggttttttgttttttttggtgagattttttttattggtattttaagatgttatttgggagattttaaagagttatttttttttttttttttatttagagttgttttaatgggagtagggatggttttagtttttagttattttgggtagtattatttttagttgttggttttttttgttttgttttttttttatggtagttgtgagaggtttaggggaaaattgaggtgtttttgttttattttgttgtttttttaaaaaaatgaaaatgaaatagttgtttattttttggtataaagaaaaaggttttttaaatggttgggggttgttagggttaggggttttttaattttaatttgttatttgggatgtataatatttttgagtaaatgtttggagagtagtgttttgattttggtttagtgttgtttggtaaaattttggaagtttgagggtgtgagtaggaagtttttgtgaagtggtgtgggaggaggggtgttggaggtggagggtaggtttttttattgtttgtattttatttgtggtgtttttgtttttgttttgggatttttttttttgttatttgtagggttgtatttgagtgatttgggttaggggggtgtaaaattttatttgtttatttttgtattaatgtttttatgtaaggtgttttaaaatttaggtggagtggggtaattttgttaaaagttatttttgtagggtgtatttaaaatggaatgttgaggttttggagttgagtgtgtagttagattgaattgggtgtttgggtgttgttgtggtgttttgggtattttttatttttattgtttttgaggttttggtttttgtagtttagatgtttggagttttagggttggtgtttttttgttttgggttttgtatttattttgaaggtgatgggtagtgttttgttgtagtgttagtgtgagggtagtatggagtagaggaagttggggttgttggtgtgtatgagtttgtttgtgtggtttgttagtatgtttattattgagtgtattttgggttgggtgtgttttttgggttttatggttgtttgtgtgtttagtgtgttgttgtttttgtttattttgttgttgttgttgttgtaggggaaggttggggagggaggtgtgaagtggtggttggtgtttgggtttatgggaatatgtataatagtggttgttagggtgttgggtaggtggagatggtgtggttttttttgggggtggttggtgtgggtgtttttttggttgttgttgttgtgagaagtgggaaagtagaagtggtggggtttgggttttagggtgtagggggtggtgtttggttattatttgttagggtttgtttgttgtgaggttttgttggtttgatggttgtttgtagtttgtttggttagttttgtatttttggtgtgtggttttgtgtgtggttgttttttgtggttgttttggttgtttgggttgtggtggggtttgtgtggggttgtgttgttgttgttgttttttgttttgaagtttgtttgtggttgttttgattttgtggttgtagttttagaataaattttttagaattaagtggtggggttgtggttgtttgtgtggggttagtatttttggggtttgtggggtggggttggtggagtgatgtgttgtatagttaattggtggagtttttattgtgggtattttggtggtgtttgtggggaggaatggggtttgttggaggttgtttaatggggaggggtggaaggtgttattttgtggaggaggttttagtgttatagtttagggtttttgagagttttgggagtttggggtaaatgttagaaatttgtttagaatgtttgggttttatggaaggtgtttttgttgtttttttttgggttgtagttttttgatgttggggtgtaatttttttgttttttttttttgttggttgtggttgggtttttttagtttttgttgttttgggtttgtgatttttgtaattttgggttgggggttgtggggttttagggttggtgatgttgtattgggagttgttttaaagaggttatttattttttttgttttgtatattattttgatttaagagtttttattttatatgggattttgtgtgttgtttatgtttggttggtggtttttgttgtttttagttttgtgtggttttggttttagttttggtggtttttgtgttaaattggggataggtggaagggagttttttagggattttaagtagtttggggttaataattttttttttttttgttttttttttaaaataagttttaggattttgtaggttttgtggtgttgttttttgttgtggtggtttgtggttttttgaaaaatatgatgaggtttgtaaaatgtgttttttttttttttttttatgtatgtaattatggttttgtattgtgaaatggtatgtgtgttggtggtaaaagaaaaatagtagtggttgtaaagttaagggtttttgtttttagaggagagaattttttttttttatgtgggtggaaagtggtttttgtgggtttaattttatttttttttgggtttgtgtgttttggttgtgttgtagggattgtggatagttttgttaaggtattgtttgtttgtttggttttgggtttttgtttttatttttagttgtgtggtttaattttttttgggttttattgtaaattattttttttttttttgttttttaagtttgttgagtagatttaggggttggttatagttgggagggtaatgggaaagattaagttataattattttgaattattgttttagatatttttttagattttggggaatgaatgtgtgttgagtttttttgttgttttggagatggggttagatttttgttgtttttggtttttgataggtgtaaaataatgaattttaagttttggaagtaaagaagtttaggatttgatggtggttgtaagattttattatggatttgatttttgtttagtgtgtgttattttgttgttgttaaatgaaattaagttttgtgtgtgttttaggggtgaaggattttggatttattttgattattgggagagttggtttttatttattttgggattttatagtatgtttttaggttgtgttgaaaggaaggatggtaaaggttttttattgaattttttaagagagtttgtgtttggtagttgttgattgtggatttaggtttgtgtgtttttggatgtgttggtatgagtagtagaattagaggaaagtgagtgatttagtttgggtgtttttatttttgggaatgtttttgagaaggtgtagtgtgttgtggttaggtagggttttggttgggggtgggtaatatgtgttgtttttgagtaggttgtgggattatgatttgttgttttaggtggtggtaaattttatttgttgaatggttttggtttgtattgtgttttttgtttgtttttttgtttgatttttttttttttgtttatgatgggtttatagataagtttttagagaatgagggatttttgtgggttttggtatttggtgtagggtttggtatggttttggttttttgtagggtgttggttttttgtgggtattagatttaagggattagggtggtggggggagggggggtgggtgtaggtttttgggtttttagattaaggttgtggggttgtttggtaggtatagtggtgggagttgttgttagttggtgtttgtgttttgttagttgtggaggtgtgggtttggttgggttatagatgtgtgttagttgtggttttgggtgtaggtgtggtgattgtttttgaggagttgttttttttttgttatttatgtggttaggttttagataaattgatggttttgtgttaaattaaggttgttttttttatttttgataagatggatgttttttgtttttgtgtttttaggtatttggggaagatttatagaataggttagtttgtttttaatttttatttgttttttttttattttggattgataaaaattgttgtttgtttgatgggagggagaattttgatttttttatttggggtatgtagatatttttgtttttttttagttggtatggattgttgtttttttttttttttttattagattgatggataaataggttagtttttttttagtggtttttatttaagagtattttaagttgtttatagtagggttaggaagtagaaggttag

SEQ ID NO: 223 - DNA, 4313 bp, Artificial Sequence
  Chemically-Treated DNA
ttgattttttgttttttagttttgttgtggataatttagggtgtttttaggtgggggttattggggagaaattggtttgtttgtttattgatttgatggaagagggagaaaagatgatggtttatgttaattggggaagggtgagggtgtttgtatgttttaggtgggggagttggagtttttttttttattaaatagatgataatttttgttggtttgggatggggaggaagtaggtggaaattgggaataagttagtttgttttgtgggttttttttgggtgtttgaaaatgtgaagatagaaggtgtttattttattagaggtgaggaaggtggttttggtttgatataaagttattggtttgtttgagatttggttgtatggatggtaaggaaagggtagttttttgggggtggttgttgtgtttgtatttggggttgtagttggtgtgtatttgtagtttggttgggtttgtatttttgtggttggtagggtgtgggtgttaattagtggtggtttttgttattgtgtttgttaggtggttttgtgattttggtttggggatttaagggtttgtatttgttttttttttttttgttgttttggttttttggatttggtgtttatggggagttagtgttttatggagagttggagttgtgttgggttttgtgttaggtgttagggtttataagagttttttattttttggaaatttgtttgtgaatttattgtaagtggagagggagaaattaggtggaggaataagtaaagggtatggtgtaaattgaaattatttgataaatggaatttattattatttgaaatagtgggttatggttttgtaatttgtttgagggtagtatgtgttgtttgtttttggttagggttttatttggttatgatgtgttgtgtttttttggagatgtttttggaggtgggagtgtttaggttggattatttgtttttttttagttttgttgtttgtgttagtgtgtttgagggtgtgtgggtttgggtttgtaattgataattgttaggtgtaggtttttttaaaaggtttagtaagggatttttgttgtttttttttttgatatggtttgagggtgtgttgtgaggttttgaggtgggtaggggttagtttttttggtggttggggtgagtttagagttttttgtttttggagtgtatgtggggtttgattttgtttggtaatgatgaaatggtgtgtgttgagtaggggttagatttatgatgagattttgtggttattgttggattttaagtttttttgtttttgaggtttggaatttattgttttgtatttgttgagagttggaggtaatgaaaatttagttttgtttttaaagtggtggggaggtttagtatgtgtttgttttttagagtttagggaggtgtttggggtgataatttggaatgattgtggtttgattttttttgttgtttttttaattgtagttggtttttaggtttgtttgatagatttaggaggtgggagaggaaggggtgatttgtagtgaagtttaggagaggttgggttatgtggttgggagtgggagtggggatttggagttgggtgggtaggtagtgttttggtgaagttgtttgtggtttttgtggtgtagttggagtgtatgggtttaagaagaagtggggttggatttgtagaggttattttttatttgtatggagaaagaaaatttttttttttgaaagtgagggtttttagttttgtagttattgttgttttttttttgttattgatgtgtgtattgttttatgatgtaggattgtggttatatgtgtaaaggaaaaaaagaaaaatgtattttgtaggttttgttgtgttttttaaagagttataggttgttataatgaagaatgatgttgtgaggtttgtaagattttgaaatttgttttgaggggagagtagagaggaaaggggttgttggttttaggttatttagggtttttaggagatttttttttgtttgtttttggtttggtataggggttattgaggttgggattaaagttgtgtagggttgggagtagtaaaggttgttggttgggtgtggatgatgtgtaaaattttgtgtggggtggaggtttttgggttagaataatgtgtgggatgagggaggtgagtaatttttttggggtggtttttagtgtggtgttattggttttgagattttgtggtttttagtttggggttgtagaagttataggtttgaagtagtaagagttggggaagtttggttgtggttagtggggaggaggagtgaaggggttgtgttttagtgttagggagttatgatttgagagagggtggtaagggtgttttttgtgggatttggatgttttaagtaaatttttagtatttgttttgggtttttagagtttttgggggttttgggttgtggtattggggttttttttgtggggtggtgttttttgtttttttttgttgggtggtttttggtaggttttgtttttttttgtgaatgttattgaggtgtttgtgatgggggttttgttgattggttgtgtgatgtgttgttttgttagttttgttttgtgggttttgggggtattaattttgtgtgggtggttgtggttttgttatttgattttggaggatttgttttggggttgtggttgtggagttggggtggttgtgggtgagttttggggtgggaggtggtggtagtggtatagttttgtgtgggttttgttgtggtttaggtagttgggatagttatgaggggtggttgtatgtggggttgtgtgttgaggatgtgggattagttgggtaggttgtgggtggttgttgggttagtgaggttttgtagtgggtgggttttggtgagtagtggttgggtgttgttttttgtgttttgaggtttgggttttgttgtttttgtttttttgttttttgtggtagtggtggttgaggaggtgtttgtgttggttgtttttgggggaagttgtgttgtttttgtttgtttggtgttttgatggttgttgttatgtgtatttttgtagatttaagtattagttgttgttttatatttttttttttggtttttttttgtggtggtggtggtggtaagatgggtgagaatagtggtgtgttgagtgtgtaggtggttgtggggtttggagggtgtgtttggtttgaggtgtgtttgatggtggatgtgttggtggattatgtaggtgagtttgtgtgtattgatagttttaattttttttgttttgtgttgtttttgtattggtgttgtaataagatgttgtttgttgtttttaaggtgagtgtgggatttggggtgggagggtgttggttttggggttttgggtgtttgagttgtgggagttagagttttgggagtagtggggatgggaggtgtttgagatgttgtggtgatatttgggtatttggtttagtttggttgtgtgtttggttttgggattttggtgttttgttttggatgtgttttgtaggaatgatttttaatggggttgttttgttttatttgggttttggggtgttttgtgtagagatgttggtgtggaaatgggtggatggggttttgtgtttttttaatttggattgtttagatatagttttgtgggtaatggagaagaggattttgggataggggtaaggatattgtgggtggggtgtgaatggtgaaagggtttattttttgtttttagtatttttttttttgtgttgttttgtaaaagttttttgtttatatttttgggtttttgaaattttattggatggtgttaggttgggattggggtattgttttttagatgtttgtttggggatattatgtgttttgaatggtgagttgagattgggggatttttaattttggtagtttttagttatttagaggatttttttttttatgttagggagtaggtgattgttttatttttatttttttaagggggtagtgagatgaaatgaaaatgttttggtttttttttaaattttttatagttgttgtgagaaaagggtagggtaggaagggttggtggttgggggtggtgttgtttgaggtggttggaagttgaggttgtttttgtttttattaagatgattttaaatgggaaaaaaaggaagagtggttttttgaggttttttgggtgatattttaaaatattagtgggggaaattttgttgggaggggtgggaggtttgtgtgattttaattgttagattggaggttttattgttatttggagtttaaaaggagtttttgaaattaa

SEQ ID NO: 224 - DNA, 2481 bp, Artificial Sequence
  Chemically-Treated DNA
tttttagttttagttttttttgtagttgggtagtgggagtgtagggagggtagttgaggttattagggattttgtttggttttgtttagtttttgaggaattgggttggggtggaggtgtttgtgttgttaggggtttttttgaagtttgtggttaggttgttgttttttgggaagtttgagttaagattagagattgtggttggttggggttttgggatagtagggtgggtgattgagggtgttgatggtgggtggagtaggggttaggagggggtttatgggtggggttaggtttagggttggggatattttttgtggttttttagggggatttggttgtaggggaggagaggatagggttttgtttttggtgggtgtggagatagttggggtggaggagggtgtgttagggtgtgttttaagagggtttggtggtagaaagtggaatttgaggtagtggggtaaaattggggttgttaagtttgaaggaggggtttgagaagtggttggaaggtgtagggttggggttagagttttttgagaggtgggtgttggggtaggtgtgaataggtgggtagagggttttgtgggagggtttagaagagagggaaatagggttgaagtggtttttgttggatgttattgtggaaagagaaattaaaagtggagttgggggtggggttggtagggggtggggttttttgttgttgttagttttgtttttgagttggtttaaaagattggtgtaggggtgggtgttgaatagagtgagttgtggttgtggtagttgtatggtttttggttttggagtatgtgtgagagttgttttggagtgttttggagttttttgttgttttgtttgtggtgttttgtgttttgttgttaggtgagttgggttttgggtgaggaggtgggagggaggagggaggggagtttagggtagttaggagttgggtgagttttgggggttgtagaatggggttgtggttgtgatgtttttgatttttgttggttttatttaggttgttttttgtgtgtggggtttttgtagtatagtttttttttggttttagtttaaattgtttagattaggtgtggattttagtttggttagtaggtggtgggtgtggggtggtgagttggggttggatggttggagttagaattggttgttttttatgttttttttttggtgttgtttggaggttggattttgtttttattgagtttttatttgttgggaagagttttgtggagtatagagtttattttttagttgtgtttattgaggttgaatggatttgtgtggatttggtgttttgtgtttgttttttagggttgggtttgttgggagtgttgttttttggagttgtttggttggtgtatatttgtttggttttgtagtgttttagtttatttttttgttttttttgtagtgtatttttggatgttatggtttatttttttggttggttttttttgtaggatggtagtatataattaggtggtagttgataatgtagtttttatagtagtagagttttgatggtggttagaatttttttttttttttttttttttgtttgtggtttttgtgtgtttgtggttgtgttttgtggttttggttttggtttttggtgatatgtatttttgtatattttgtttgtatgttgattattggtgtattatgtgtgttagtgtgtttttggatgtttgtggattttattgggggtttttgagtgtgtatggggtgtatgagtggttgtgtgttgagtttgtgggtatttttttggtgtgtgatagttgttagtggaattgtttttttgtttttagtgtgaagatggttttgggatttatgagtatttgtgtgtatttttaggttggttgtttttatttggatggtagttgtgagagttttgattgtttttttgagttgttggagtattatgtggtggtgttgtgttgtatgttgggggttttgttgtgttagtgttgtgtgtggttgttgtaggagttgtgttgttagtgtattgtggttattgtgggttgtgagaatttggtttgtattttttttaattttgttttttgtgattatttgagttttttttttttttagatttgattggtagtgtttgttgtgtatgtagtattaattgggatgttgtgttattttgttattatttgtttggaattatgtgggtattttttttggtttgggttggagggagtggatgggtgtaggggtgaggtgttttttgtttttggttggagatgaggttgtagatttttttttattttttgagggggtttttttttttttggtgttttttttgggtttttttggttgttgtagtagtttaattgtatttggagttaggatttgaatttgtattttttatttttttatgtttatatatatttagtatttttgtataaattaggggttgggggagggtttttggttttatttttttgttgt

SEQ ID NO: 225 - DNA, 2481 bp, Artificial Sequence
  Chemically-Treated DNA
atagtagaaaaataaagttagagatttttttttaatttttggtttgtgtaaagatattgggtatatgtaaatatgaagaggtaggaggtgtgagtttaggttttggttttagatatagttaagttgttataataattagggggatttagagggagtattaggagggggaggatttttttaagaggtgagaaggggtttgtggttttgtttttagttgagggtgggaggtgttttgtttttatatttatttgttttttttaatttaggttggggagggtatttatatggttttaggtaagtaataataaaataatatggtattttagttaatgttgtgtgtatggtgggtgttgttggttaaatttggaaggggaaggagtttaggtagttgtggaggatggggttgagggggatgtgagttaggtttttgtggtttatggtggttatgatgtgttggtggtatagtttttgtagtggttgtatgtggtgttggtgtagtggggtttttagtatgtggtgtggtgttgttatgtagtgttttagtagtttgaagaggtagttgaagtttttgtggttgttatttaggtgaaagtggttggtttgaaagtgtatgtggatgtttgtgggttttgaggttatttttatgttaagggtgaaaaagtagttttgttggtggttgttgtgtattaggaaggtgtttatgggtttggtgtgtagttgtttgtgtgttttgtgtatgtttaggggtttttagtagaatttgtaggtgtttaggagtgtgttggtgtgtgtgatgtgttggtaattggtgtgtgaatggaatgtgtggaagtgtgtgttgttgggggttggggttgggattgtggggtatggttgtgggtgtgtgggggttgtgggtgaggaggaggaagaggaggaaggttttggttgttgttggggttttgttgttgtggagattgtattgttggttgttatttggttgtgtgttattattttatagaaggggttagttggaggggtgggttatagtgtttgggggtgtgttgtgggagagataaagaggtgagttggggtgttgtggggttgggtaggtgtgtgttggttggataattttggagggtggtgtttttggtggatttggttttagggggtgagtatggagtattaagtttgtgtggatttgtttagttttagtggatatagttagaaaatgggttttgtattttgtggagttttttttggtgggtgggggtttggtggaggtggagtttggtttttgggtagtattgagaggggggtgtggagagtagttggttttggttttagttgtttggttttggtttgttgttttgtgtttgttgtttgttggttaggttgggatttgtgtttggtttgggtgatttgggttagggttggagaaaggttgtgttgtgggagttttgtgtgtggggggtggtttgggtggggttggtgagggttaggggtattgtggttgtgattttattttgtagtttttgaggtttgtttgatttttggttgttttggatttttttttttttttttttttgtttttttgtttagggtttggtttatttggtggtggggtgtgggatgttgtgggtgggatggtggggggttttggggtgttttggggtggtttttgtgtatgttttggggttaggagttgtgtagttgttatggttgtagtttgttttgtttggtgtttgtttttgtgttagttttttaaattggtttggaggtggggttggtgatggtgggaggttttgttttttgttggttttgtttttagttttatttttggtttttttttttgtggtggtgtttggtgaggattgttttggttttgttttttttttttttggatttttttgtggggttttttgtttgtttgtttgtatttgttttagtatttgttttttgaggggttttggttttgattttgtgttttttggttattttttggattttttttttggatttggtgattttgattttgttttgttattttgggttttattttttgttgttaggtttttttgggatgtgttttgatatatttttttttgttttagttgtttttatatttgttgggggtagagttttgttttttttttttttgtagttagatttttttaggaggttatagaaggtgtttttaattttgagtttgattttatttgtagatttttttttagtttttgttttatttgttgttgatgtttttagttgtttgttttgttgttttgaagttttggttggttgtggtttttggttttggtttgggttttttgggaagtggtggtttgattataggttttagaggaatttttggtggtgtgggtgtttttattttggtttagttttttggaaattgggtggggttgggtaaggtttttggtggttttgattgttttttttgtgtttttattatttggttgtggaagaaattgaggttgggga

SEQ ID NO: 226 - DNA, 198235 bp, Artificial Sequence
  Chemically-Treated DNA
attattaagaaataagagtttttttttaaggtggttttatttgtaaggtaattttttagtttggtttttgagggttttattagagtagggttttggtgattttattggtttgttaagaaggttttttaaagttttgtgtaatgatgatgaatggtagggtaaaattatgttaatatattataaataattttaggtataattagtattttatattgtattttatttttttttataatattaattagatagataaggaaagtttaatggtaatgtgattttttttaataatataaataaagtgttattatagttaatggtggttaattggagatttattttattttaattatgtaaagtatttttattgtattttttatgtgtatagtgttgtagaatattagttattttttaaaagtattaattttaaaaagagttatggaaggtaaaagtatgaaaattttgataataaaagtttttaatataaaaatatttattgtatatttatttttatttaaaataaaaataattttagtaatttaaaataaaagtaaattttggttgaaaatttaagaaggtataataaataaaattattaaaagaaagtttttttaaaagaaatgtaatttattgttatttttgtaaattttattttggagggaaaaatttaatgaaatgagttatttggagggtttatggtagattttttaaaaggtttaggtgtatggatttatttagtatttatattatagttttatttattaatagttttagaatttttttgattgagtgagtttttttattttttattagtgtttttattttttgtgtttagtttggtatgtagaataattttgttgttgataggatgtttgtttgaagttatttttttggggtagtttagatgaattggtatagtattatttatgttttatttgattttttttgtatttagtgagatgtatattttatgattgtttaaggttatggttgtttaaagatatggaatagaatgatttattgggtaagattaaaggatttgtattattattttttaatttagttttatattgtttaattttataaaatttttttttgtattgtatataataaatatttagaaatagatgtttttattaattagaaggttgttattaaatattttgttagttaaaattgtatatttattgtttaaatatttattagatatatttagtttgaaatttatattattgtattgttaaatggagttgtattttgagttatgttgatgtttttggaatttaaaggttgtattataaattttaaaatgttttttatttgttatataaggttttttgtagaggtattatattgattttaatataggttttttatatttttagttttggttattttgaaaatttttaattttttgatttaaatttgggaatgttttatatttaaaaatttttttttttttttatttttttaataaatgttttttgttttataataatttaaaaaaaaaatttttgaaagatttaaattgaataataataaagatttgattggaatttttataagtttgataatgtagaattgtattttttaaaaagtgtgtaattatatttgtttgggttgtaaaagatattatagaataagattagaatagaattttaattgattttttaatttttttagaatggtttgtattttgagttttttttgtttttttttgatagagtaggtgtatattattaattataagtgataagaaagtttaaaaatagttattgttttaaaagtatagttggaattaattagagtttaagtttatatttataaattatttgttttaggataagtttaattataaatagagattatttgtaattttgtttatttaatagattttggaggtgaaagttagatatgtgttgggattgttttgattatttatatttaattttgattattataattttttttgatttataattattttttaattttttttattgggttagagttatatttttagatgataagtatttattaataaaataaagattatatataaatggaaggttatatttgaatatagagaggtaagtgagttgtggagagaatgttggtgttttgtttgaattaaattgaggtgtttttttaattttgtgattttattttaaattttaagtttgttagagttttttgtttttgttaaatttttggagatgatttgatggttatagattttgttagttgttattttggttttttttgtggagtatttgtgtagtgagggattgggagggttgaggaggtttttagatgtttttttttttttggggttttttttagagtttttgtttttaatttggaaagtgtatatattttatttaattttgattttggttagtgtaaagaggagtatatatagaggattgtttttttatttataaagagtagttaagatgtagatgtgaatttttttttaatataaaatagggatggttttttgttgtttaattgtaaaataattagatataatgaaaaaaaagaagaggagaaaaaaatgattagttgaggtttttatatatatttattgtttttaatatgtttttaataataaggaaaatgtaatattaattatttttagagtaagtgtagttataatattgtatagttttggggttaagaggttgggtatatttattgttattaaaattaggtaataaaattttatagtaaaaggtagttagttagtaattagtttttgtgattttttaatatatatatattttttaaatattttgtgaattttgtttgaataataataaaagataaaataggttttatattaaaaatgtttatgttttttattgttatttttaaagtagtttggaggattttattatgtggagtatattgtaaattgattttattaaaatgattttggtaggatagtagtataggattggatattttatatttattattttgataatgtaaattttttataaaataatattttgtttaaaaattagaattatttaaaggtttgattattttgttttttgaggtttgttggggaggtttggttttatattataggttttttgtttttttggtggagtgtaagtattattgtattttaggaagattttgaaggatagttatgagaaagtttttgtggaaggagggtaggagggttttgggtgggtttgtgttgaaataggttatgtaaagtaattttttaaaggttaaattattatagatttgaatttgttggttatttgttatttggatttttaattgaatgaattttatgggtttaattaaatatgtatgtaattttgaatattatgaattaaatgtggaattgtttagggatgaggaaatttttaagaaataaggttaaagggataatagatataattgttataataaataattttgttgatgtggaaatgtatatgatttggttgaaataaagttttttagtggttagtgatatttaggttttttttaggtagttgagatttagggtttattttatttttttagaatgtttttgaagaattaagagataaaaattttaaatagaaaatgattatttttgtttataaatagtgtataggttataattaaatataattaaaaataaaaaaatgttgagatgtatgtatttttttaaagtagtttttgaaatattaattatagtattaaatattgaatagagtatattttaaagttaatatagataaatggtatataatgtaataatgttatagagttattttattaatgttttaaggttgattttaaattggaagaaaaaaaaattttttagtttatttgttgaagatgttattttttttgttatttttttatagttttttattattgattttttttttaatgttttaggatgtatagataatttttatattttatatttggaattttttttttgttaggtttttaaataaaattaaattatagtgataagataatgttttatatgtaattttatagataggggttaattaatttatgatattttattttaatgttttttttaggatttgtgattttttttaaagttatttaaagttttgttttaaatttataggtgggttaaggttatatagttaatgtgttatgtgttatagttaaaatgggttgtggttattgtttttttttatgtttttagtttttattatgtttttttgataggaagggtttagggtttttgttttttttttttatagtgatatatgttttaagaagggttgtggtttttatgttttatgtgaaaatgggtttatttggagggttttagggtgataggtttagttatatttttttattgtttttttttgatagtggaattttgagttttattagtttttagatatttggagattatattgttttgttgattatttttggaggaggttagtgagggttttggtttagttttaggattaggtttttaagttgggatataggtaggttttgtggattttggttttttaaaagtaggtatttgtggtggtttgatgttttgggtaattttagtttttttgatgtggaagttattgaaatgtttatttttttaagttttagaggattttgttttttatttagatagagttagtattgggagttggggggtgtgtatttaaaatatatgaatatatataattagggtttaaggtattggatgatattgtataaattgttaaaatgttttttttggtataattggtagtttaaaaaaatatttttttatgatttaagggtattttttttattgttgttttttggtgtggaaattttagtgggtattaggtttatttgaagtttttaatttttttttttttattaggtatgtattatgtgagttatatgtaaagagttttttttttaggttagggaggtatggatttttttttataggaattttttttttgttaatattatagtttttagggtaaagaaatgtaagtgaatgaatattttttttttagtttttagtagttagaaagttagtttttttaatgattaggttttttttttatttgtttgttttttagatggtgatttggttaataatatggaaagtgaatttatgtttataggtatagaatatttaggtggagttatatgaagtggtgtttggtaattagtggttggatttttaaagataggagttttgatgggattgttttaaataaataaattttttttttttaataatgtaaaaaataaatgatatttttttttggtagtaaatagttgatttgatgttttgtttgaagattgttaattgttgtgtgtgtgtgtgtttgtttgtgtgtgtgatgtttatatgtgtgttatttttttttaaatagtttgtagttttgttttatggtatattattgataatgtatattatttttattgttttagtgaattttttgtatatttgtttggggtaggtatgttgattttatttgtggtttagataggtatttagggtgatgtaagtttttattagggttaaattgagtagagtttttagagatagttaggagaaattaaatagaggttgtatgttggggttgtatagttttataaaggtattttgtagttgggggagaggagggaagaaaaagaaagagtattagagagagagtagagaatgttattttatagagaaagaggtattttgttagggtagtttgggtatttttagaagggtgagaggggaaaaggtaaatgttttttggaggttatgatttagaaattattgtttttattaatttaaggtatatttattgagattttttttatgtgttagttattttagagatatagtagtgtataaaatagattaaaagtttttattttatgaagtttttattgagtggaatagtatagatagtaattaatataaattattatatggtgtaggagagagtgttaagggttgaggagaaaaatagtagaggtagttagaaaatattagaggttttgtaattttagttagtatgtttatttataaaagtaataaaatttagtaatgatgatgattgttatattttttgattgagtgttgatattttattaaatgtttgatatgtattattttagtttttgtattaaattttttttttttttttttttttttagagataagagttttgttttgttgtttaggttgtagtgtagtggtgtaattatgatttattgtagttttgaattgttggatttaagagtgatttttttgtttttgttttttgagtatttaggattattatgtttggttaatttttaaattttttgtagagatagggttttattatattttttaggttggttttgaatttttgggtttaagtgagttttttgttttagttttttaaagttttgggattaaaggtatgtgtttttttatttagttaattttttgtattaattttatgaagttattttatttgtttttgttttgaagatgaaaaagttgagaattgtagggaataagagattttttaataagtggtagagttaggttttgaatttagatagaaattagtatttttttttttgttgatgttttggtgtggttaatggtagttttatgagagtatttggttagttaagggtttagttagtggaggggttaagggtggttttgattggtgtagtgttaatttttaaggttaaggtttttttggggaaagggagttgttagggggttttttttgggggtggttagattggatgattataattttgtatttatttaaattgtggattttataaggtaggagattaggggtgtgttattggatgtgtaggtttttgagagataaaaagtgttttttttttatttttatttttttattttaagttgggtttgtagtgtgttgtagtaaagtttattttttggatgggtttggattgagtaaattattaattgtttattttttagattttggggagattatgttttatatttgggtttaatgagtatttggataattttttgaatgaatatttgaatatataaattagtaaatgaattttttttatttttgatttatttaggatgaagaagaaaataagaatagttttatattatttttaataattttgatttaaagtatatagttttattataggaaatagtaatatattatgattttggatattgttgttgggaggggttttaatagtgtatagaggggttttttttttttggggtaagggttgtagtagtgggattagggattttttttgttttttttatgttgggtatggttgtggtgtattataggtgtgtagtaaatgtttgtttatttaagttttttgaatataattattggtttttggtttaatgttttatttaaatgtttatgaatttgtttgaaattattttttttatatgtaatagtttttgagaattttgaggtagttttgatgaggatttaaagtattgttagggtaattttttatattattaaatatagatttatataattatttttatgatatataaaatgtgttatattttaaaaaatttatgtttatagtgtttaaaatttttgttattataaataatattatgatatatttttgtatataaatttttgtttatttgtttagttgtttttttgaaataaatttttagaagtgattttagttaattagttattaatattgtttttagatattatgaagggtttgttttgagttatttttatatttttatggattgttttttaattaatgttattttttataaaaggtaggtaagaatttagggtgagggttatattgagagtgattttgttttttaggggatatttggtaatgtttggaagtatttttagtggttatgatttggggtgagggtgttattggtatttagtgggtagaggttgtggatgttgtttaatattttataatgtatagggtagttttttaatgttaatagggttgaggttgagaaattttggtttataagatgttttgtaattatagattatagaagaatagatgatttattttgtgtgttaatagtattggttaaattagtataattagttagtttagattagtgattgttaatttagtgggttttttgtatttttggaggtttttggttaatttttattaggagagggtgtaagggttttttttttttttttaaatatttattgttaaatatttttaaattttagtgttagaaaagtgaggtaatagatgtatataaaatgtgtgtttagtgtttttagtatagagttaaggtataattatgattgtttgttaagatgtatatttttttttatataagtagggattagtggggtaggaaggagttaggatttttttataagttagaattttgttttttttagggagtaatttaagatattatagatatggttgtaaatgttaattagtttttttatttatgtttttttttttgagggatgggtaggttgaaatttttaatagtttagttaaaagatattttaaatttgttagggtattggtaataggttgtttgtaatttggtttgatattgagaaggttagtggttgggttttgaatttttttagtaattaatagagttttgtgtggtaaaatttgaattagattaagtttttgattatttgttttgtttggatttgaagttattttgggaaattggaggatgtagggatatattttagttggtatttttttttagttggtttggtatatagtgttggagagtagaagaaatgttgttttaaatatttttatttttttagagttggaataatttttttttattatttttatttttatataaataatagtgttttttatgaatttaataggttatttttgatatgtattatgtagaataatgttatttttagagtgagatgagttaaattagtagtttttggtttaaagttttagtatagagatgttgttgttattttagggggttgagaagggtatgggatttggaggaggagtgtgggtgaattttggttttgatattttattagtttataatttttagtagataatttagttttgagttttatttattttatttatagttataaaatttattattgtgaagattaatgtaggttatttaaagttatttgtaaattggatatagaaagtgagtttgtggtagaataaatattttgtttttgtttgtttttttgtagatttgttttgtatttatttaatttgttttttttttaagaagttttgttgagtttgttgttttgtagaagtaatttttttttttagttttttgatttgaggatagtttgtaatttttataggaattatgaattaaaatgtatatattttgtgttttggttaaagatgggaagtgataatataatgtttatttatttgtttttttttatatattattagagtgtagggttagagggtaagttatttaattttttggaggttggagttggtttttaaattttgtttttttataattttaaagtgtaaaggagattttgtggttttgggattaaaatgatttgaaagttttttttgtagaaagtttttttgattttttaaatattttgattggggtgatttttgaagtttgtttgaatagtttgttattatttgtttgagtttgaaagttgttttaaataaatatatgtttattttatgtattaaaagtaataaagagggaaaaagaaaatttgggttgttatgtgatttggataaaattttagtttatatatttaggaagttttgtgttttttgtttatgttaggattggtaagggtttatttgattttatggattataggtttatatggaaaggttggtattggttttttttatgaggaggagatgggtagggttttagttttggtggttttgtttatagtggtttttttataaatttttaatttagaggttatagaggatttgagttttatttagggttggtttaaggggataggatggttaaatttttagttgtagttttgttgtaggtttggaattaggttaggtaggtgtggatgggaatagattagggttaagatttttaaatttagtaaaggtgtttttatttttttgggttatggagtatttttatttgggaggtagttattttttaatattttttttttttgtttagaatttttaagaatttttttttttttttttttttgagatggagttattgttatttaggttggagtgtagtggtttttaggtttaagtaatttttttgttttagttttttgtgtaattgggattataggtattttttattatgtttggttaatttttgtatttttagtagagaaagggttttatgttggttaggttggatttaaatttttggttttaagtgatttttttattttggttttttaaagtgttgggattataggtatgagttattatttttggtttattttgagaaattttatgtaaatttaaaatgagaattttttttaaaaaaggttagattgttaagaatggaagagaaggttaattttaagtgttgaaaagaatggtatgtggttggggatatgggtgggggttttaaaataatttttatgtttaggtaaaggtaaatatggagattttttgaatttggtaatgtatattaaaaggtttttaaaaagtttttgttagtaattttatttttagttatttattttggaaaaataataaagtgtatagattatgtataatagtataaatttggaaataaatgtttgaaaatagatgattgatagtgtgtttatatgatggagtgttgtttagtattaaaagttatattttatagttattggtaagaaattgtgtttttaaggttatattgagtaaagtaggataaaatggttagtaaaatatgattttatttttgtaaaaatttaatatatatatgtgtgtgtttataaatagaaaaaaataatataaaggaaaatgtaaagatgttaatagtgattattgttgaaggtagaagtaggtatgaggatatggtatttaagaggttattttgatttttttttttagttgttttttttaatttaatataaatatgtatattattatttatgaaatatattttaatatatattatatagaataatgttatattttaagtgtttatttaatttgaaaaaaatttagattttataatttgatagataaaaatgttgggagatgatgtttagtagtggggagatatgggtttttaggtagtagttatgatttagaattatgtaataggtttttggttaagtgagggtttttttagattttggtttagaagaatttttatgagttttgttttttagattaatgtttgtaataagaggtttaggttttgagtttagtgtgtgtttttagttttttatatattggggaaatttaatatggtttggttggttataagtaaatttgaaatttagttatattttatagtttttgagttgattatgtatgtagatgttatataattgaagggaattttaagggagaaaagttattttgtttttaaagagtttatattttagagagaggtaatgtttttatgtgtatatttgaattaaattaaattaatgggtgttgttattttgtttttgtagattgtagagttttattggtagtaagaagaaagtaaaaagaaaattagattatgttaatgggaaattaaatatagttattgaatgattttgatattttttattttttatgagtttataattttgtttttatggggatttttggggatttttttttttatgataattttagggttaggaagaaaaaaggaaagggagaattattgtaatagaaaattttgggttggaaggaattttaaagtatgtttagattttttgaattggtttaataatgtttaataaagatattagttttttttttaaataggtgaggtgagtgaaattttgataggtaaagtaaattttttatagtgtgtatttataaggaaatttgtggtggataggagtgtgaaggttgggttttatttgttttttgtatgttattggttagaatgttggtaagtagttggtttttttttttatttagggaattttttttttgttttttttaatttgtttttttttattttgatttttttttttgttttaatttggattttagtttaaaataagttttatttgggtttttaagtggtgttgaagaaagttatttaattttgtaggtaggtgttgttggaaatttatggtttttaaatttagtgagttttgatattatttagtaattttttattttttgttagattttttttgttttttttgatgattgtttttaatagttattatttgttttatatattttttttattttttggtagtgaatattgttttttatttttttgagaaaattgggattattgggtaagaattattatagttttttattttggtttatgtataaatgtttatttttgtttgtttttttttgtttttttttatattttattttgattttattattttttattgttttaggaatttttttttgttaattgtttttgtttttaattataattttaattgtattttttttttttgattttaggtatttttaaaatgtttgtgttgatgtgtgttttattttaattattattttttttgtttttgtttttttagaaaagttgttaagttatatttattggtttattttttatttatatttgaatttatttagtttggtttttttttatattgtgtttttgaaattatttttatagagattattaatattttttatgtggttaaatttattgggtgtgaggttgtattttagtaggtgttttgatgttttggatattaagattattgagggttttttgtgattttgttttttttgggttatttttttttttttgaagaattttttttttgttttttttaggggtattttttttttggtttattttgataagtttttgatgttgtttattaggtttttgtttggatatttttttttttttttttgattaattttttttatttttttggttttatatattatttttatgataatgtttttaatatttttatatttagttttatttttttttttaattggtaaatatttattttaattgttttttaagatattttttagggagtttgattaatttgttttaaatttaagttattattattttttttattaagtttttttttttttttgtttttaatttggttatggtattaagtaaatttatagttttagagttttttagatgttttttttttttttatgttttatatttatttaatagtaaattttatggttataggttagatttttttagaaatagattttaagataaagatttgagtgtaagtggtttatttgggagatgatgttaggaattttaaggggagtagggaagggagagaaaaaaaggaaaagatttatgtatgagttattttattaagtaagttattgttattggtaaatagagtttatttttgttagggaaatttgagggttggtgtagattatgtattttttgttaatttattgagggattagggagttggggtatttatatattaatttttgttatttattggttgaaggttgtttttatggaatgttaatattttagtatttttagttggttatgttataggtgaagtattaattaaggaaatagatatagatgttatattttttatagttggaggtgaagttagtgagtattgaagtggtaaaggttaggggataggatagaatagggtagtagatgtattgttaattttattatttgaatatttttttttttttttattttttttttttaggattattgttgtgatttttagtttgatttttttgtttttgtttgagttttgtgttttgtttgtaaattttttttgtgtattgtagttagagtgatttatttagaattaaatttgttgtttttatgtttaagtttaaggtttttaatgttttggttttaatttagtttttttgtttagtttgttatttttaagttaattttggtttatttagagatttagtttaattattttttgtaagtaattttttttaaatttttaggttgagttaaataatttttggttgttttttgtttatagtattatatgaagattatttgtttatatgtttgttttttttatttaattattagtatttggaggtgtaggattatgttttatttatttttggatttttggagtatgtgtttgttatatgttaggaatttagtaaatgtttgtggagttgaaataaattgatttgttttattatatggtagattttttaaatattttaatagataatatttttttaaaaggggagtatttagagattaaataaaggattggtttagataaaatttagtgtttttttttttttttagtagtagtttttagtgttttttttttagggattgatggttagttggtttttaaggatatagagggatttgattggttagtgtttttgttatattggttagtaaatattattatttttatttataggtgtttgattttttaagaaagggagtagtattttttaaatttatttggtttttaatttttttgttaaggagattgttgttatgtttggagtattaggaagataaattttgataagtgttgtttaagagggtgaaaggataatagtagggtattggtaagaggggtagtattggtgtttgtggtgtagggtaggggagatgattagaggttaaaggttgtttttagatatttatgtaaatgtagagattattgggtatgttttgattttagattttattaagagggttggagatttattggtaatattatttgtgattattgtggttatatagaatttatgatatgtaattgttaggtgagagagaatgttaggagaaagagaaaggatatgaaggaggaagtggggtagatagatatttgttttgtagaaagagtgttttatgaagttaagtaagatttttttgatattagagttggtttagagtaagagggggagtaagttgtattggtggttgggagtggtggttggtagagtatatgtaaggaagtgaggatttttttttatttgaataaagtagttggtgaggaagtgattttatttttttttttattattggtttggtaggattttttttatagttatattgtgttgaatgagtttagagggttttgtttgtagagtagtgtggttttggtagttgtatgtttgtttttgttttttgtgatttttttttttgtattttttttttatttttaaaatattgtttttgggtttgggggaaaaggaaagggaaaaaaataatttttgagtatataattgaaggatatatagttgtttgggttggagatggtgaagaggtatgggagtgtgagaagtataaggatttgtttttttttaggttggtgaaggttgttttttaaagttatttttagtgtttgggggttgattttggaggaattttgggtttagggggaggggttggttgaaatatgggttaatgatatttgtgaaatttaatttttatgttatttggatgtaataagaaatttgttggagatatggtaggagatgaaaaatttaaataaaataaaaataaaatttgtttgtttattatagttggtttagggaagttttggtgtgttttgttatgtaaatttagttaagaatgtaaattaggtaggggtttttaggagttggggaggttgaaaaatgagaagtttaaatgggtgttttttttttttggtattatttttatagtttgaaaataatgtgtaaagatggtttatgttatgggttagggtagaggaagtttggttttaattatttgttaatggagattttagttggagttggttattttagagatggattttagaggattttttagtttaattattttttgggttggggtagaagatggtgtttggagggaagtatagaattaagttttttattgttgtattagttatgtaaatattgtagggtatttgtgggtttatgttttttttgtaagaaggtgtggttagtttagtaatttaaaagatgtatttttgaaataggtggagaaatgtatttatagtaaaaagtgttaaaaatatgttaatagttatgttatttggtttattaggttagtgtaataaattataataagagagattaaaggttgtatttatatgattttgaaattttatttttagtgggtttatttatttagtaattaaattatttttgtaaggtgttgagtatttagtttaaagttaaataagatatatgttttgttttatagtaattgtttggtaatatttttagtggtttttatgggtttgataatttttttagtattgaatttaaagtattttgtgttttgtttgtaggtttatttgtttagtagtggttttgttaggagagaataggtttatgtttttgtttttattttaaggtatatttgaagaggttttaaagaaagggtttatatatatataggttttagttatttgttttttagtgttttggttttaaaatgaagtttttttatttttttttttattttttttattttattatttttttttggttagagtttttgagggttttgtttgttgtggtgtttagtttttttttgttttgggtttatgttattttattgttttggggggaagtattaagtataaagtgataaatttaatatttttatgatattgtgttggatatgaaaatatgtttagtaaaaaatttaattattataatttaataataaaaatgtaagtagttaaattttaaaaaaggttaaaggattttggtagatattttattagtgaaggtatataaatggttagtaagtgtatgaagagatgttttattattattagttattagggaaatgtaaattgaaattataaggagagattatatttattagagtggttttaattttaaaaatagataataataagtgttggtaaggatgttgagaaattgaaatttttgtatatgattggtgggaatgtaaattggtgtagttattgtgggaaaatagtttgttgattttttaaagagttaaatagagttattatatgatttagtaatttaatttttagtatatttaaaggaattgaaattgtatgtttatatgaaaatttgtatataaatgtttatattagtattatttataatagttaaaagtggaaatgatttaaatatttattaattgatgaataaataaataaaatgtggtttatttatataatggaattttataatttagttaaaaaaaggagtgaagtattgatatatgtaataatatggatgatttttaaaaatatgaggttaagtgaaggatttaggtataaaggttatttattgtttatgagtttattgatatgtaatgtttaaaataggtaaggttattaagataaaaagtggattagaggtttttaggagatggggagatggggagattagggagttattgttaatgggtatagggtttttttttggagtgatggaaaagttttggaattagttaagggtgatggttgtataattttttgaatatgttaaaaattaatgtgttgattattttaaatggaattttatggtatgtgaattatattttaataaaagagtttaattatgttttttatatgatatgaagagggattaaattatttttatattatatggaattttatagaagtattggtttgtgatggatttttggtttataagtgtaatgaggaatgagatgttgttggttagaaaatgtgtattattgttattttttaaaagaaaaaaaggaagaattgtagtaggaggtggtatggtttgtgttttggatgagaagttaggggttggatgtatgagtagtaattggggtatttttatttgtaaggtgagtagtttattttatttttgggatttttaattttttttatttgaaaattttgttgtagtgaatttttaagaagtttttttttgttttattatttgggtttatttagttagtgattttattttttatttttttttgtgtatttttgaggatgtgatttgggttttgttggtgtgtgttagagttgtgttattgtaattattgtagaggattttttgttttttttttgtgtggtttattttttttatttgttatttttttattgtttttttttttatttggttttagatttttttgttgtgagttaggaggaggttttttttggtatagtattgaagttgtgatttttgatgtgtttttgtgtttttaatttttttgtttttatgagtataatttaagttatttgttttagattttaatttttatatgtttataaagttttttgttttttatgttagttttaattagaattggtgatattagtgtggtttaaagtagggagtaggtgggaagttttgattatatttaatattgaataggattttttattgtttgataggggttggggattttataggtagattggtgtttggaatagatttattaattttttttttttgggatttggagttatatatgtggtttttttttttattttatgttattgtttatatttgtttttgtatgtgagtagaatataattattgtgtgttttatagggattggtgataggtaaatatgttttatttgttggttatgatttgggttaagtgtgttgtggtttttgtatttgttatgtgatttgtgaatatggggtatggtttaggttgtttttttttatttttgttattgtaagagttaatttatgaaaatatgttaaaaatgggaattgaaagtagatgtttgttaagttttgtagtttggtttaattgttgttattaggatattgttgttgggggtagtgaggggagggagttttttatttattaaatgtggagggttagagttaggggttaaatgtttggtttttatttgtttaaattagtaagtgttgattgaggttggtggtgtggggagtataaagaatttgtatgttttaataggaatttgttgaaagtggttttagatttggaggagggtatgtagaagaaaaagagtaaagtagattaggttggaggatgtggtatttttagttagttgggtattgttagtttttagttttgttttgtttggtatttgttttttgggattggttaagaaattagtttgggtattttttttggaagttttatattgtattagttttagggagttttgatgatttattgtaggtttagatatttgttgaggattagatgtattttggatggtgttggttttgttgtttttggtttggggtaggtaagttataaatggttgaaattttatagtttgtttatattttatttaaaagtattttaatgtataatagttttatttagattttagttttttagttttgtagtttaatgggttattttgtgattgttaaagtgattgtgatgattttttgagaagtttatgggagaggttttttatttatattattaatttattgattaggaagagaagaataattatattttttgtgttttgggggataaggggagttgatggatggtggtgaattttttagtgagttttatatgggtatgttaagaaaaatttgtttttattttgtagtttatgatttagtttagtttatttggaaagatttaatatgaataaaattagatgtattttaaggaatattgtttggttttttgataatttttttttttttttattagatagtttttttgtgtttagggaagatagtagatttttttattataaggaaaatgtagtttttgttagtggtagtagttgttagtattaggataggtaaatggtgggttaggttagtttgtggttttggattttggtttattaatatatggataagatatgttggtgtggttttttatttgaatagttgtttatggtgaaggatttttgatagtatgttttttgttgtaagaaggatattgttgtatatagaattagagagagaagtaaaaatagaaatttagagagagaaatgggagatttagagatttagaaagataaagagaaagagaaaaagagaagttgaaagtaattatggatgagttttaagtgagtggaggggttgaaatattttttattagtataatttataggggtatagttgatagttggttgatttgatttaaggatatgtttttatagtgaagttagtgaagttggttttttgggggtaggagtaaggttagaatattatatgtgtttattgtataaggtttgttagtattgttagtagtgggtatttaatatgagaaaagttgtgtttttgggagatttatttttaaggtaattgttattttttgttaaatgtttaggattggttagatatttttgtagtttgtagtggtgagtttgggggattttgtttgtagaagggatgtaagtatgtgttggttgtattgtaaatggaatttgaattgtgttatggggtttttatatattgattattttttaggtaaaaatggtagagttagaatattttaggtgggattggtagttgagtggttagtggttatgtttatgtatgtgtagtattggtagaattttgttgttattgtagaaattttggagtgagttggtttaggttgtatttagggatgtaaatatttattgattgtttgagttgtatatagtattgtgtagagtgttgtaggggagatagtgagtttgattttatgataatgagttttttaaggtaggatattatgtttattatttaaattaggtatttagtaaatgtttttttaatgggatgatttagagatatgtatatttaaggttgtaggaataagtttaagtttgggttggtgaaggttttaagagaaattttaggttaagtaaattgttatttttattgaggaaattttttggttaattttggatttataggtaatatgttttttatagtataattggtgttaattttggatagtttgttttagtttttttttttttttagttttgatttattttttggatatatttgaattgagtaatttaattataggtaaattattttaaaaagtatttatttagtatttatttttggttaggtattaaatttgggatgataagagatatttaattgtggtgttaaagtttattaaggtggtttttataaataattttagatagaagagattgttattagaaaggttatataatttgtttaaagttatttagtttattgtagtaaagttggggtttgaatttaggattatatgattgttaggtatgtatttttttaattatattttgttttttttaaaggaagtagaaaagatatataagatttaattttggtttttttggagtaataaatatgagaggttaaataggaagttttgaggagtgatagggaatgtttaagaaatgtattaagagtgtttaagatgggttggaaggtggatagaaagtgagataggagttgaggttttaggattttaaataaaagtaagaaaattaaggatggtgttttagggtaaggaagtggtatgggagtttggggttattttggtgggttttaaagtaagttggtgtatgttgttaggggtgagttagagtgaatggggttatattaatagaaagaagattttgtgattatggagaaattattagttataggattttttttattatttttgtttttgttgttttgggtattgtgtaaggttggattttatgggaatgtgtgtggtatattttggaagtttttgattgtggtttggttttgttgttagggttgtatgtgttattttaagagtattttaaaatgttgtatgatatagatttaaatttttaaagagaaattttttttatattatttaggaaaagtttttttatttatagggttgttttatagggaattttagaatgtgaaagagaataaaatttttttgagttataaaaataaatttaatttgaggtttaatttagaatattaaaatatgtggttttagagtttttatagtggtaattggattttgatttttttaagtgattagtttaattatttttgttggattaaaagtggttgtgtttgtaatgtgtatgaataagagtggttttatattatggatagagtataagtttttaaagaagagatttagggggatatagggggtttttttggttatttgttttattgtttaagagatttagggggtgggggggtttttttgggttgtttgttttattgttttgttatttgttttttgtatggtttttttttttttggaggtattttttgtgattttttatgattggaaatagtttttttttatttatatttaaaaaatttttataatttaataaaggtagatatttttaaatttttaggaatttatttgttaagtgttttataagaatttagttttgtttattaagtatttaattttttaatgtttgatgtgttattggaaggttagaagtttgtaaggtaagtttgtgattgttgtagttagatttaataagttaaatatttttttttagtattttggtagttgtatgttgagagggaatgtgtttagtgtaatatttttaatatattaaattaaagatgaataaataaaaaagtagaattatagtattttttatgtatagtgattataagtttagttttgtttttagtatataggatgtttaagattttgttttgtggggtagttgaatagtgaggagttggtgggagataaaaaatggttggatatggtttaggtttttaagattttttaaattttttttttttgtttttattataatttagataggatttttgttttattttttaaattttttttttttgttaaaattttttttattttttttttttttattttgttttttgtttttttgttttttttttgttttgtattttattagttgaagtttattttttagttttgatttttataatttgttttttatttgtttgttgtagtttaggatagaaaatttagagtttgaattttttggaagatattaattttttatttttttagatatataaagaaattaagtgttggttgagtgaaataagtgagatttttgtagttgtagttagggtttggttatagttgtgagggattttttagtttgttttttggtagaaggatgttggttgtggatattgatggggaaatggtggttgtttttgagttttttaagaaatggagtgaggtaattagaggtagtgtggttattatttgattgtggaagtttgataggatgttaggtttgtgatttatgttggagttagttagaggtttgttttataagttttttttaatttttgaggagttaaatgttggtattgtggttatgggataattggagagggatttgtgttggataaaggagtagaataaaaatgtttaaattttattttttttttgtgtgtttttatttttgttaaatttttggaatttttatgttttataattttatgtgttttttatttttgtttgaattagaaatattatttaaatgtttttggaggtaattttaatttattgaaatattttgagaaattgtgaaaaaagtattaggattatgtttggtgggttttaagaaatttttgatttttaggtataagtttatggttgatggaatatagatttaaataggtatgttttattaatttggtatattatttgaagaaagtgattttattaagggtaattttaaatgtgaaaaaaataattttattgttattatgtttataatattttttggtgagaaaataagaatttggagtttttaatgtttggtaatggaatatattttttggaggggaggagttttaggagagtttaatttttggttttgaagtttattatgttattttagatttataattggataagttggtttgttttgatgttttggttttattataagttatataatggtaagttgtggggtttgagtgttgatgtatttttttttagtttttttatttgtggtttagggatttatttttttaggttttgagagttttatttgtaataggaagagatgttttatggttttttaaaggtttttggtgatatttaagtgatattatttttagattttgggattttgttttatgtttgtgtattaaaagtagggaggatgaaaagggtttgatatagttggggtattgggagaaataggtgtttgtagttttgttggtttgtatttaaagttgtaatgtgttattatatttattattggtgtaaatagaggtttgaattttagaggggattttattagaagaagttgggatgtgatttgttgtaatatagaagttaggaatgtttttgatattttagatattaaaagaaatataagttaaaatttttatggtattagatattagaattttaggtagggtttgtaaagttttaattatttttgtttaagaatttatttaagagatattttgatagtttaaatggtatgaaaaatatattttaataatattgagatgattttatgaaaaattaagggatgttttttttggatgtgttttattttttagttataaataatatttattatttatggtaatttttgatgataagttaatattttaattaaaggagtttatggtttttatttttattttttgggtaatggaattatatattatttaagattatagtgttattttttttggatgtttttaggagatattttttgtattttttagaatatttttttgaattaaaagtttttatatttaagtttttttttagaatgttttattttttatgtttgatttttttttgtttggaaaatgtagagaaaatttattagttatttttgggttattagattgtgataaatttgttttttaagttttagaagattgttgaattgtgtttttttgtttttttttattttagataatttaaaattggtttggatttgtgatattaattttggtatgtatgaagaatgaggaatgaggattttgttttgtttggaattaaaagagaagaatatttatttttttttttttttttttttttatttttattaagttagtattttttttttttagttagatgatgtatatttttaatattttaggaaaaaagtgttagtgatatgtgagttataataaaagaaaattaaaagaaatgtaattataagggatagggaattgtattatttttaatataaaatgtttagatgaaaatttaatttaaaaaattattagtattatataaatgagaaaagaatataagaaaatatttgttattttaaaaattagtttaatttttaatttttttggtttttggatttttaattttatttttaaaggttaaaaatggttttttggtgttggattaggagtaaattttttaatgatgtaatgagatattgtgaagtggtaatgaatttttttggtttttggtttgttgtttggaatgtagtaggaaaaaaaaaaaaagttgttaaataaaaatagtgaataaataggatgaaataataatttttttattttttttattatagaggtatttattataaataaaaataaatatttatatggtatgttgttgttgagaaagtgtttttatatagattatttagtgtggtttttttaataagttatagataagttattattgttgttattttttttttagagatgattaagaatatgtaatttttttaaggatatttagttaattaattatgaaattagaatttaaatttagaattttgatataaaatattttgtttttttatttaattatgtggtttttttaaatgtagttatgatttttagttaaatgggtttgtttagagttatgaagttataagtgtgtatggagtagtgatgtgtttatgttgatatttttgtttttttgataatgtttatattatgagaaaagaattaagtttatttatgttagtagtttataatttttttggtattagggatgtgttttgtggaggataatttttttatgaatggggtgggggattattttaggatgaaattgttttaatatagattattaggtatttggtttttataaggagtatataatttagattttttgtgggtatagtttataatagggtttgtatttttaggaaaatttaatgttgttattgatttgataggagttggagtttaggtagtgatgtttgttagttgtttattttttgttgtgtggttttgtttttaataggttatagatttatattggttttgggttatatgtataagttgtaattgttggttggtgttagatgatttttgtttgttttgtttttgttttttttttagtttagggagatgttattttgttatttttaatttatgtgaggggaagttggaattatttatgtatttatagggagagtttgaataattatgtagtaatttagttttttttttaaattttttgtttgatgtaattgttaatttttattttaggtttgaaaaataatattgttatgatagtgattggtagatgattaatagtgaagaagagaggagatgttattaataatattgatttttaattttttttttagtttttgtttggaataaatatagtgtttaattatatggttttttatagaaagggtttttttgatatgaggtatttatttatttatttatttatttatttatttatttatttatttattttgagatagtgtttttttttgttagttatttaggttggagtgtagtggtgtgattttggtttattgtagtttttgttttttaggtttaagtaatttttttgttttagtttttttgaatggttgggattataggtatttattgttatgtttggttaatttttgtagtttttttgtagaattggggttttattatgttggttaggttggtttgaaatttttgattttaagtgatttttttgatttagttttttatagtgttgggattataggtgtgagttattgtgtttagtttgatatgaggtttttaggtatagaaagagaagttttttttgtttagatgtaatttttttttattttgtttgggttagtttgaaaatgaaagaaagagagtgatttggtggtaagatggttaaggttttttttttttttagtaatatttagttgaagagtggatattagtgaatgtattttgtttttatttttaatattgtgggtttaggagggttgaaagaaaagtagaaaaattatttttttgtttaatgggtattgtgatggtttttttttttttattgttaatgtatgtttttttttgtttttttttttttttgtgtttgaggttgttattttttattttttttttgtatttttttggttttttttagttttttttggagtgatttttttttttttttgtgaaattattatttttatgtattttttgtgttttatgaatatgttataagttttagaattagattttgtttagtttttttgtgagttgttttagtttgatattttagtagtttttaggtaggaaaaaagaagttgatttaaatatgaatttttataaggttgaagttaagttaatatattttggagattttgtggtagaaaaatgtttagaaatattggattataatataagatttgatgtttaagaatgagttattaggtttgggggtgagaaggggtattaggtttttaatttttattgggttatttttgttatattttttttagtaagataggtaatattttttaaaggttattaagttgtgtttttattaagaaggaaaatgggattttttttattttgagttttttttgtatttttagtaaatgatttttgaagttattttgatttttttttttataatgtaattaggggtattttttgtttttttgttatttttttaattattgaaagaaattttttttttttttgtgtttttttttataattagttttatagattggttaaatttgtttgtttagatttttttttaaaatttttttttttatattgattgtggtgattttaagttatttttttgtttatggttgggttattttttttaatattaatttattttgtaattgattaatatttaatttagtagaaattattgggtatttgtaatatgattggtatgattaaaattttggggtggatttaagagaaaaatgtaattatttttttttttttatgaggttaggagtaagtaatataagtaagaatgttttggtggtagaaggggtggttatgatggtttagagaagggtgagtttatttaggtaaggggggtgataatagatggggggtgataatagatgaggggttgggggtgaggggaggggatagtataggttatagggggaggataaatgtgtgtatagggaatgttaatggtttggtttgattttgtgggttttaaaataaaattttatggaaaagataatttaaatgaaaattggagtttattaattttttgtaggtttagtttaattttttatagtttttagttatgttggtatatgttagtttttgtggtagtttaagataaagtttttaatgtgatgtgagttttttagagattagtattattataaatataaatgtttaaatataagtaagttgaaattaaatgttttttaaatattggttttttgttatatgaaggtttttagtggtgtattgaatttttggataaatgagttagaaaatagagagttaaatgggtttattggttaaattttatggttgggtttttttatgggagggaagaaggaaatttagtagttgttttttatttatttaatttatagtagttggtaggatagttttggaggataattagagaaatgtttttagaattttgagtaggggattgagtagggtatttaagattttgattaaaatagagggtttttatttaaagttaatttgtaaaatatttttttgtttttattgttttgtatgatttttaagagatttattaataattagttataaatagatattaaggagtttgtttatttaattaagagaaaataatgtttgagttttttagaaatatgtatttgatattatattaatgtgttgttttgggagtagaattggagtttgtttttttggggttggtgttttgatgtggttattatttgtttagtagagtttttatttggtaatattttgtttgtttaattttaggtatttgaaattttaaaaatatattttttttaagaaaattttaaaatgaaagagtttttttaaaaattaatttgtaaatattttttttaaagttattttaaaatgtttgagattttaaagaattatatttaagttaagtttggtgagggtaaatagatatgataatgattaaatttattttttaattttttaatatttgtgtataaagttaaataattaatatatatatagagtgttatttttaaatttttttgttattaaaaaataaagggttaattaagtatttttaggaggtaaaataatagtttattatgtgtttgtttttagtgtttattagagttttttttttttttggaagatataatgatttgggttgggtgaaattgtatattatttatgagagtaggatgttgggttgattaggtgataatgttttattatatttttaatttttgtattttttatttatttgataatgggttttttagtggagattataagatgtgagtatatttatataattttagtttagatttttgatggtgtttaatttgtttgtatgaatatttattgtttgtttatttttttttatttgagaaaattatttgatttagtttttgtttttgttttttattttttattttttttagaatgtttatagtttatttatgttagtagtattggagaggaaagagtatatatattagagttagatagatttgtgtttgaattttaattttgtaaattattagatttgttaatgagttgaatgagttattagttttttttttgttttttgtaatgtttaaatttaatttatgttagatgagttatttaatttttttgagtttaaatttatgaatttataaaatagagaaaaataaaaggttgtagttgttgagtggttaggaggatgaaatgatttttgtgaagtgtttggtagtaaaggtattaaaatttagttatgatttttttttattttttttttatttttgtattgaattgttagagatggtaattttttttttttaggtattttttttatttataagtagtttatagaaaatgtatatatgaaaggagttgtgtgaaatttttgaagttagttaagttttttttgtagagtttgtaatttttaattttaggattttattttttaatatttttagttaaggtaagtttttaaagaaaaaatttaaatgaagtttaatatttgtatattattagttaggggtttggaagtagagttttggagttagtagaagtgattttttgaaattgttagggtagagtggttagttaaattttgagatttattaaggtaggattttttatttaatagtaagaatattggattttgtattaagttatgaggtttttatttggaatggtttatttagaattttttatatagatttggttattttaaaaagttagtggtgagtttagaggagggtagttgaaatgggataaattaggtttttagaagataatgatgattttgggaagggtaggtttgaatgtggattttgggatatttatgaagtttttatagtatagaaaggattaagttataattttattgtgaagtttttaggtttatgatttttgaattttttttgaattttaaattttagtttgtgattaaatagatttgtatatttattaggtatattaaatttaatatagtataaagggaattgattatatttttttaaaatttgtttttaagggtttaattagtttttttgatagtttttagtttatattttagtagaaaaattggggtgatttttaattttttttttttttttttttatggatatattattattgttatttttattttatagaagttttttaggatgttttttttttttggttttatagaagttatttttgtttattttattgtatggtttatttagatagtggtaagaagtttttaattgatttttttttattttgttttatttagtttttttttggagtatttttagggtgtttgttagatttataaagtagttgtgttttttttttttatttaaatgttttgagtggtttttgttatttatagggtgagttggttttgatttatgtttttagatttttttttttttatatttattgtttgttttgaattttatgtgattattggtagtattagttgtagttttgtttttttatagattttggtttatatgtatttttaggttgggatgttattttgttttttgtatatttttttatatttagtttaaatattattttttttgtgaagttttttttgattaagtttttatttttttattatgttttttttttattttgtttttttaaggtttattagtgaatttattgttatttgttttttttttttttgggggtattggttatattttttttattttggtttttttaggttttgatagtgtttggtattttgtaaaagttgtgtgtatgtttgtagaatgaatgagtaaatatatggaaattaaaattatttaaataggtttataaagattgtgttatgtttaaggaagatggatttattatatattttaaaagaattttaggattttttgggattggaatggtaatattgtgtggggtaaggagtttagaatgtttagttatgtttttaagttgttatagttttattttatttaagatatttaatatttttgagttttaatttatttatttataagaataagaggatgttataatattaattataaaggttggggtgagaatgatatgggtttatgatgttaaatgtttggtggaggttggtatagggtgggtagaggtggtaaatggtagtgttttttgtttttaattaatagaattgagttgaatatgagattttgagaaaggtttgggatagtagggttatagtatgttttttggtttttagggatagttaatttgaggaggtgataaattttatttgtaaaggtgagaaattgtatagtaagttaatagtattggatgagttatgagataggatgtgattgatgttgggtgggtgtggaatgtgttgtgtattgtgtggggagggtttttagtgggggtgagtttggtgggaaaaggagggttttggagggtttagttgttggggtggaggttataggggtttaggagtgtagggtgggtgtggtaaagagattgttgttgttgtttttaggttgttttgttgttttttgtttttttttgttggtttgggagggaagagtagggttgttggttgagatggatgttagagtgagtaggtgagaagaggttgggaggaattggtaatgtagtgattaggagtaggtggtggagtggggaagagagagggagggttgtttggttagatgttaggtattttgttaattgtaggttttgtagattttgttttgagtttagggttattttgaatttttttttttttttttttagagtgtttgttgtattttttttttttttggggtttttatttatgttttttttggaggttagaggtttatttttttttttttaggatttttttttgtttttttagttagtgtgggttattggtgtgattaaggtgaggggtatttggtgtttttgggatttttgtttttttttttgtttgagggtattttttaagtaagattagagattattttagttttgagtgttttagttaatatttatgaggtttgttgagaagttaaaaaaaaaaaaaaaaaaaggtttggatggtattagatgggttggtaggggaggggggtgtttaaagaggagaagaaagtaagagttaatatagagttttgtttagtaatagtatggaagggagtggtagtttattgttttttaggaaaataaattgtaaataattttttttgtttgtgttaatttagtgtttttaatttataaattattagtaggttttagaatttagattaattgatattttgggttaggtaattttttgttgtggggaggatgggttgttttgtgtattggaggatgtttagtagtttttttggtttttgtttatgatatgttagtggaaatttttgtttagtgtgaaaatttgaaatgtttttaggttgtgttaaatgttttttggaaggtaaagttatttttatggagaattattgttttagattattgttaggtgttatttaaatgtttaatatttgtattggtttttttagttttatttttatttgagtattgtaagaatgttttattttggtgtttattttttttgtttatttgatgtttatgtaaatagaaatagaagttttttttagaagttaaggaatttttttttaagtttagatgttgtgggttgggggtgggggtgtaggaatgtttttaattttgtttagtaattgtaattttatggattttataatggttaaggggattttatatttaaagtttttattttttaattttttgggtagttagggatttaggtagaaatgtttgtttaggaggtgtttttttggtggaggagtaaattttggagaatttgttttttgttttttttttttgtttttttttttatttttttttttaggagttagttggtgagtagttattgtagttatttatgtgaatatgaatttggggttatttttttttaaattttaatagtaagttttggaattaaataagaaagtttttgtataaataaataattaagttaattgtgggtttgataaatattttgtttttttgaggaattaagtatgtatttggggttaggtttttgggttgagttttttgtgtaaaaaattagaaggtaagaaattgaaggaatatggttaaagttttttattttaaaattaaggatattgagttttggagaggtgaattgtttgttagtatggaaaataggattagatataattatggtattttgttttaagtgaagttatttaatgttttttttttatttaaataaggatttgggatatgttgtttaggagggtggttttaaaggggatttttagaggatgtattattaagtatttttgtattttaggaggtggtttattttatggaaattttttatttggggttgtttatagaattatgtatgtggtagttgaaaaggggtatttatgttttgttttgtgatattgtttttagtgaaaattagtgtttgttgtttttagtgttaattttaaattttagttggttttatttttttttatttattataattgtaatgtagtgtattgtgtaaaggttatatttgtgtttatatgttatatgttattaaaatattatgaagagaatattatgtggtttttattagaagattaaaagagaaggggtgagaagtagattttttttttaatttagggttttttagttttttttaaatattgaaataggtttatgtgtattattgtttttgtaggagtttatgtttaggttaagtatgtgttgtttattgatagagaaataaatattgtttagtatttgtttggttttagagtgatgagggagtttttaatttggatttgagaaaatttttatattgtatttaaatattttttttttttttttttttttttttttttttttgaagttaaaattagaataaaaataaatatatatagagtttggtgtagtaggaaaaagaaatttagtttaagatattttataagaaaagttttaagtttatttatatttatttggtttggaattttgggatttatttgattgaggagggttataagttgtattttagaggtttgggaggtattatttggtaggaagatttttttggttttttaagttggaggagtagattgaaaggatgtttggggagtgaggaagtaataggggagtggatgtagaaggtattttgttgtttaatttagtggttttttgaggtgtattaatgagtaatatttatgtattttttttttttgttaaggtagaaataatttggtattttttatttggtggttgagtgatttggttttattagggattttattaattagtatagttttttatagtttggttttgggattggttgttatatgtttttttttatattagttattagttgttttggattttttgagatttttaggtagtttgatagttagtgagtagaaagatttgatttttttttggggtttttttttttagaggttttttatgaagttgtgttggttttgtttaggtagtggatataagtttgttttaattttagaatttaaggtttaagttatttttaataaggtattgtttgaaattatgtgggataaaaagtttttttttttaaaataatttttaatgaagttaggttattattggaatttattatatataatgatatataaaatgttaagagaaatttatagtgttgtttgtttgtttattatttaggtattggtgagttattaatttatgagagatttattagtttataaaagatgttagataagttaatttttaaaaattatgtgagtatagatttatgtttaggttatttattttaaaaaaaggattttttttgggttgtttttttaaagtagtgtaatttatgttaattttttattttattgtttttagtttatgttttagagagttgttgaaggatattggagtttgattagaggtagggttgggtttattgagtgttattaaaattataaaaatataattgaaagagaattgtttttaaatatttatgtattataaaaggggaatttttagaggtttttgatattagtaatttgtttttttattttttttttttttagttttaagatgagatgatgataaaaagattgattagtgagaaaaagtatgaaattttatttataaatgtgtaaattgatatagagtaaatttgtaggaatttttatatttggttttttgatttgttttgaaaagggggaaaaagagagaaaggaagtgtatttttgtttttattaagatattaatattaattttgtttttttaattttatatgaatattattgtgtttggagtttatgttttattttttttgttaggtaaaagtaattttttttaagtaaaagttttgaaatggattttttttagaagtagagataattgggaatttttttaaaattagtataagtatgaatgtttttttttttattttttatttttataaatgtatttagggttaaatgtattggttaattttgatagaatgtaatagagataggagaagtagtttattttagtgagtgagtggatatttattaggtatttattttttataggtttgggatattaggtattgtgggggtgttgtatttaggaaatagaagttaaaatttaattgagtagggaaatgagttaaatagaaatggatataaagatattaaaaatatttataaaaatatagatgaatgtgtagaattagttggagtttttatgagttgagttgaatttgtttattttgtaaagatttttttgtatagtggggattgtttatgtgtatgtattttttagtttttgttggttaatttgaattgtttttagtggggttatttatattgtgtttattttttttggtttttaaatttaatttattttattattttaagagtttttatttttagtattatttatatataataaaatgaatatattatgtgtatagttttatgaatattgataaaggtatatatttttttaatttatttttttattaagatatgtagtatttttatttttttagaaagagtttttggagttattttgtttttaaattatttgtatttgaatatttttgagtggagattattaaagttaaatgtgtgggaagaaagtttaattattaattatttattataaatataggtagtaaaggttttgaagatggtgtgtgagtttgtatagataagtttgtgggattgggttttgttatgaaatgttaaaggggttttttagtgataggtatgtgggttttttttagttgttttgttggtatttagatatgtaattaagattgagtgggttttttttttggttttgttttttaggtattagagtttatatgtttagaaagagggaagttgaggttgaatagttatatttattatatttttataggggtaaatgttttttgattaggagggtttaattatagtgtagagtttttttttttaaaattttgttttaatattgagaggagtttatatgattaggtaaattagagatttttttagtattttttgttttttagattttagaggagttttttagggaatgtttggtttagggtagtatatttaggatgagggaaaaatggttatttttaggtttttttaattattatatttttttttgtttttatttgggtattttgttgttttagtgatttgttaaagggatgggggtggggttgtgagaaaaaagttatattgttttttttggggtgggggtaagggtatttttgttttaggggttttaaattgtttattagtttttttgttggagagggattagaggtggaagatttgttagagtgagtgttaggtagttttagatttttgggtatttattttttataaaaggttgtagtattttttggatatttgaattttatgtttttatggtaaaaataatttaaaatgttttaaaatattatgtaggaaggagtttttaattttttttaaattatttttttaaaatggtattttgaggtgattttgtttttaattttttagtaatgaaaataatgtggttgaaaagttgatagtttttaatttttgaaaaggttatttttttgttttatatttttttgtaagtattaagagtataatggatattttgagttatatgtattgttttttgtttatttgtatttggtgaaattttttttttggattaatttagtaagtagtgttttgggtttttttggtgattgtttttttgttttttgtatatttttttttgtgaaaaaaatttagatttagttagtgaaatgaagttgtagtttttgttattgatgttttttttttgtttagatgatttttttattttgtttgggatagaatttttttttttttgtaatgaatgaagatttttgaggtttagttgaggtttttgtattttaagattttttgaaagtttttttgtttttttttatttgattttttgttggattgatatatttttttatattttagttttagatggtttggtgtttattattagattgtgttattgaaagttaattaagggttttagggttatttataaagtgggattgtaagagaaagtttagttagatggaaatgtattttaaatatttttaagttttagtataggggtttttattaataaaaagttttatttttaaatatattgttgaggatgtagggttttgtttttttatttgatgtattatatattatgttagttgttataggaggtttgagtgttttatgaagttgtttgtttttttttttatttttatgtgtaagttaattattttggtttttagaaatatatttttttttttatgagtaatttaaaagtgatttatttttagttttattagttggtttatgtgatttgtagtgttggttgagtgttatttatagatgtgtaaattaaagtagtttttagaatatagatttttttttttatgtgttgttgatttttttttgttatatagggagggaatgatgttagatatgagtagttagggattgtttgttttgtatttaaatttggaatgtgtttattagaggaaataaaggttattatttagtgatagaaaagaagagataggtaaaaggtttaatatatttattttagtattagtagattattaagaagttttgagaaaattttataaaaattgaagatgatgatgatttatataaataaaaaattgtttaaagttttttttttgagttagtagaaatttagattttatgaaatagagatgatatttatatttattttaattaaaattttattaatatgtttttattgtttaattagaaatatatttttgggatttgttgtggtttgttttgggaatttatatatatgaatatgtttttatttttttaatttgtttttattttattattattaaagaatggtgttaggtttagtttggggatattattggtgtaggtaggtatgtgggtgatatagttggttagtattttagattgtgttttttattttttttttattttttattttttattaaattaaatttgaatttatttgtttgttttgtgaagatttttataatttagttattgttgtttgattttttagtattatttatgtttttggtataattaatttttggttattattagggtagtatttttattgtttttttaaggaagatattagagtttttatttttatgtttttatttttttaaatttttaaattttgttttttttttttttttttttttttttttttttttttttttttattttttttttttttttttttttttttttttaaattgagaaatttttgttttgttatttaggttggagtgtagttgtaattatagtttattgtagttttgaatttttaggattaagtgatttttttgttttaattttttgagtagttgggattataggtatgtgttattatgtttggttagtttttgtagagatggggtttggttatgttgttaaggttggttttgaattttttggtttaagttattggtttattttggttttttaaagtgttgggattataggtgtgagttattatggttggttatttttttttattattgtttgtatttttattttttgggagtatttttatttttattatttaaattttaatttatttttttagtttagtttattttatttgaaaatttttttattttttttatttgattatttaagttgttattaatgtttatattttttaaatttttttaatagtttattatatttgttttttagttttgttttgttatttaatatattattttttatattttttaatattgtttgattgtaagtttttttgggaggggtattatatattttatttttattggttttatagtgtttagttttataatagtagatgaagtaatttttagattgaaataaatattattttaatattgttaaaaaggtgtaataagtaaggttttattaaatttttggttagttgttaaatttgattgtatgttgtttgaaagagaaattttattttttattttagtaggaagttatgtggagaggaataatgtattggatatttagtaaaatgaaaaaaaatatataataatagttatttatatagtattgtgtataagtattgatttaagtatttaataaatatttatttattttaaattttatagtgattttaaaaagtaggtattattatattttttattttatatatgaggagattaaagtattggagggaagttgtttaaagttatatagtggttaagttagatttaaattttggtaatttggtaattagattttttagagtttgtgtttttagtggttgtgttatatttttgttaataggtgtgtgtttttatatggttttttttattgaagtaaagaggagtttattttttgtatggatattatgttatagttatgtgtattaaatttattatgagttaagtttagtgtaaagaaaattgatggtgagatgttattttttagggaagttttagaaagaagtatggtggtggtatgggagttgaataaatagagttttttttgaaatgaatggagtaaaattttttagtttgtttttaggattttgtgatatggtattatttttttatgttttgtagaaataagagatttgaatttttgggtaatttttaggtaggtttgttttagaaaaatattattatatatttaagagaatttttttaaattttatttttttaatataaatttaatataatttaaattatagttgttattagatttgtttataaattttaaatatgatttggtagttttagatatggtatgtttgagaattttagattaggtataagaagaaaattttattttggtggttaaattatggtaggaagtgatgttattgataattatttttgtattagtagttgtttaagtattatgaggtttttagggggaaagattgggaggtagtggttggaaatgaagtttattattaatgtagttaagttttttagttggatttaataaaataaaaagttttgtttagattagtgtttgtagtagaagatgttaaagagttgttttttaaaaatttggttttattgaatttaggttttatatatagtattttttttttttgaatggttgaaaaattattttatgtatttgaaattattggaggagaaatgaatttaagttatggtaagaaagtatagttagatttaaggtgtgaatgttagtgtttaaggtaatggaaattttggtagttttgtagatagatttttaagagagattgtgaaatttttaagttaattaatagaagaatattttttataatagtaaagatttggaattaatttaaatgtttaataatgatagattggattaagaaaatgtgaatgttagatgatgagttagttggtgtagtgtattagtatggtatatgtatatatatgtaattaatttgtatattgtgtatatgtattttaaaatttaaagtataataataaataaataaataaataaaaatagaagaatatttttattaatttaatttaggtttaaaattattattgggtgtttattatgtgttagtttttatgtggtgttttgtaaggttttaaggatattaagatgaataaatataattattgtttaggaggaatttataatttaagggaggaaataggagtttagggttgataattatggagggaagtgttttggtttggatgaattttattgggtgtgattttgttggtttttgtttttttttttgggtttgttgttgttattttttatggttttggttttgtttttattgttttttgattgttttgtttttattttttaggtttttagttgtagatttttttggtttggggagttgtaggtattttttgtgtttatttttttaattatatttttggttaatggttgtttttgtttttatattttgtttagtaggtttatttatatttattaggaattttggagagattttttttattttaaattttttttaggttaaatggttatataattggaaaaggagttgtggagaaattgattttttgggggtgaaggttttgggtttaggtgttttatagttatttgtgtaataaatatttataaagggatgtaaagggtttagatattggtgggagataaaaagagattgagtaagattttgtttttaaggattttaggatttagagaaggtttgtaggggaggggggtggaatttaagtttgaggggatgtttgaataataaataagttatatgataatgttgaaaatagagtttatttttaggttgggtttaattgagttagatagttattgttaaaaattatatgttttaaatgggtagagtttgtttgttggattgttttaaagttgtgttgtttgttttgaagtaagtttattgttattttgttaaataagggttttttatttaatattggttatggttagggttgtagatttataggatataaagtttggtttttagtatgaggattagttgttggttggtttttttggagggggattgtgggtttggggggtatttatggttttatagattgtttagttttatgttttagagagaggtggttggtaggaagaaatgtgatattaggaagtgttaaggagaaagataaggtagtttttagagtggggagaaggatttgttgtggaggaggagaaatttggttaattttggaatgggttttggaagatgagaggatttggattgggggatgtaaggtgaggagttaagttagttttaggattttggatggggtagggatggtgtttttggattttggatagtatgtatattttgattggggaatgaggtatttgtagaagttatattgttattggttgggaggatattttgtagttgattgtgttagtttttattggttaagtttatatgatattatgattagattatggaaaatgtatatatattaatagggaattttggtgaaatatattttttggaaattatttaggagataaatagtataataatgaattggtgttttttagaatagtgttaaataggagtgagtattaatatatttttttaatattgggtagatgttattattgtattgatttggagtatgatagtttattgatgggatatgaggtattatataggttaagtttggttagtaaaatattaatgattgtagtattagaaatgatgtatttttgataagggatattattgttttatataggtttttttattatattggttgattgatgtattttttttttttttttttttttttttgtttttttttttatggagtattgattaggtgttaggtattgggttagatgttgagattatatggtagaatgagatgtaatttttgttttatggttgtatgttttagttagggagattaatagttaataaattttaatgttgtaatatgagaaggtgttggagtagagggatgtgggaaaggtgatgggagtatgaaggaaggtggtttttgttttgaatgggttttaagaggttttttttggtgtataattttataataaatatgttttattgttagggggttggttgttttttatagttatttattttttgttttttttgtttttttttatttatttatttattttttttttttttttatttatttatttatttattatgaatattatttatttatttatttatttttttttttttttttttttatttaatatttattatttatttatttagttttttaggatattttaaatatataatttttttttttaagttagatttttttttttgttataggaaaagtttagttattaaggattattttgttaaagtgaaggttgataaaggagatttagaattttttttttgggtatatttaaaaataaaataggattggggttaggtgtgatggtttatgattattattttagtgttttgggaggttgaggtaggaggattatttgagtttaagagtttgaaattagtttgggtaatatagtaagatttttatttttataaaaaaaattaagaattagttggatgttggttgggtgtggtggtttttgtttgtaattttagtatatggggaggttaaggtgggtggattataaggttaagagattaagattattttggttaatatggtgaaattttgtttttattaaaaatataaaaattagttgggtgtgatggtgtatgtttgtggttttatttatttaggaggttgaggtaggagaattatttaaatttgggaggtagaggttgtagtgagtagagattatattattgtattttagtttgggtgatagagtgagattttgttttaaaaaaaaaaaaaaataaataaaggaattagtaggattgaggtaggaggattatttgagtttgggagtttgtggttgtagtgatttatgattatgttattgtattttaggttggataagagagtggggttttttttttaaataataataataatatgattgttgttatttggttggaatgggtaggtggttttgtttaaaggtagaggggtttattggagaatgtgttaagagtgtttatgtttttttgttttatttattgttaatgtattaaggattattttgttaaagtgaagtttgataaaggaggtttagaattttttttttgggtatatttaaaaataggattggggttaggtgtgatggtttatgggtaggaggattatttgagtttatgagtttgagattagtttgggtaatatagtaagatttttatgtttataaaataattaaaaatgttttaagtttttttggattattagtagttgttatttgttaatattggaattgattgtttaggttaaatgttgaggtggggattgaggttttggaggatgtatatttatagtttttgaggttattttttgttggttgtagttttaatatggattgatgattttgtatggagagttataggaggtttattgttatttatagttgatgtttatagttagatatttatgagatgtttaaatttagaatgttatgtggttagtattttttaatgtttaaagtttttgatttgtttttaattggggggaaatgtggattgttttgtttattggtatgtttggtttttgttgtttaaatttttaaagatttttttattttttgtgaagtataaagtttttttggaatgttagggttttttaggtggtttgtatgttgtaggaagagaaaaggtgatttgagggtgggatttagaaatattgtattttttttattggaatttaaagtggggagttatttttaataattaattagtaataatttaagtttttaggattgaatatgtttagtggttatttgtttttattttggggttttaattgtatttgatgaaagttgtttattggtttaatagtattgaataaataggtaaaatttttagtttttggttgatttttttgaagtatttttagttttgattttgagaatttaatatgggttttttagtattataggtataggtaggtatttgattatttttggtgatatttattttttaattgattttatggagggttttttttgggtggttagaaataataggtttttgttttttaagttaaatgtagatagaatagttttttttttttgtgtttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttgttttttttttttttttttttttttttttttttttttttttttttttttttttttttttttttttttttttttaatggagttttgttttgttatttaggttggagtgtagtggtatgattttggtttattgtaatttttattttttgggtttaagtaatttttttgttttagttatttgagtagttgggattatagtgtgtgtgatattatgtttagttaatttttgtatttttagtagagaagggggttttattatgttggttaggttggttttgattttttgattttatgatttatttgttttggttttttaaagtgttgggattataggtgtgagttattgtgtttagtgtgttttttttaaggggtagatgttggtggttgttattaaagtaattttaatgttatttaaaatttttattttttgagaagaatagagatgattttttaatgtttttttatatattttttaatgttttttttgtaattgtaataagtaaatttatgttattaatagttatattatgattgtaattagtgattagtatgtggaaggaagtttaatttggtgattaatagtatatatatggttttaaatttggtttagttatttattattgtatgattttgtgtaagttgttaaatgtttttgtgttttagttttttttatttataaaatggggttaatgatagtgtatattttattaggtttttgggagtataaaatatgttattatatatgatatgtttaaaatagtgatgggtatatggtaagtgtgagtttttatattaatgaatgaataatttattgaattaagtaatattaagtagataaggtagtatttagaaatttgggtttttaatgggttataataatatagtaatgagtttggaatggtgttttgtgtatagttagtgtttaatgttagtaatttgtaatatggatatttgggttttatttttgtttggaattgttttatatgattttgatttaatttatttaaagtttagttatattatattttgtttttttttttttatttttggtgtttatgtggaaaagatttaattttaggttagagaaagttttttattaatattgtgagatgtaagttatatttggtatatgattagtaaattgggttttattttggagttttttttttattttattatttttttgtaaattttttttgtgtttgttttttatatgtgtttaagattttaaattatggggttatttgtattttttaaaatttttatttagttgtatttttattttgtatataaggaaatataagtataaatgataatgtgtaaagtaggtatgaaattaattaggtttgttatggatggttattgggtttataagttataggttgtatatgggtgattgttaatagttggttggatattgatagagagttatattaattgagtgtttttttttaaaaatttagaattaggtagatgttaatgtttttttaggtatttttagtaaatagatttttttgagtagattagaaaaggaatgatttatttttgaaataatgttagtaaaatatataaatttagtttttatgagatttttttattgttataatgtttttttttattttgaatttaaagtgaatttttaaaatgtttaaaaattatgttttgtttaagtatttataagttatgtgtgatatgtgtttattatttgataatggttagagtttattagtgtaatttttaagtattagtttttgtgttaggttaatggatttaagaaaaaaaataaaaattaatattttaatttttaagatttggttttttaattttttaggaaatgaaaggatttaaatagtttgttgatatattttatagtgtgtttattttgtaattttattagtatggtgtgaatgagtttgatttattgttggagtgagggaggttaggagattttgataaatttagataatatgtaaagaaaatgtttagtaattggtggtttaggagtatttagaaggtttgtaagggtaaagtatttataattatgaaatgagaagggatgttattgataataattaattgattgataatatttagttataatagagtttagttaagtgtatttataaaatagttatatgatgttataggtaaaatgaaattttgaaagaaagttagtttatatatggtaaatatgttttaagttgtaagagataaaaataataaatatggttaggtatatagtttatgtttgtgattttagtatttgggaggttaaagttggaggattttttgagttttgaagtttgagattagtttaggtgatagagtaagattttgtttttataaaaaattaaaagaaaaaaattatttgggagtggtggtataggtttgtagttttatatatttatgaggtttaggtagaaggattgtttgagtttaggggtttgaggttgtagtgagttatgattatattattgtattttagtttgggtgataaagtgagattttatttttaataaatagatatatatataaatatatatataaattagatagaatattaaatatatttgttatatattagagttagattttaattttgatttgtaattgggttaatatttataaggtataggatgattttgatttttatgatttagagtatgttgagtttagtatggttttatgtattaatagtttaaaaatatagtgaatgaatataattttaatgaataatttttaaagatggatagagtattttatttggtaattattttttatatttttttatttatgtatttatttgttgtatagttattatttttttatttgtgagtattattttttatttatttgtttgttgagtaagaataatgtagatattaaatattttgatgttgtttggttttgaagaattggtgagatggatttggtttttttattagaatattattatttttttatttgagtttttggggatttaataattatgttttgagagtaggtattaaaatggtaaatagtgaatttttggttgggtgtggtggtttatgtttgtaattttagtattttgggaggttgaggtgggtggattataaggttaggagattgagattattttagttaatatggtgaaattttgtttttattaaaaatataaaaaattagttaggtgtggtggtgggtgtttgtagttttagttatttgggaggttgaggtaggagaatggtgtgaatttgggaggtggagttggtagtgagttgagattgtgttattgtattttagtttgggtgatagaggaagattgtgttttaaaaataaaaaataaaaaataaaaatagtgaatttttatttaaatgattaattttatttgaaaatgtaaaagtatttaatgagattatgaaggtagaaaagttatgatgtattaatggattttaattttgtatttattttttttttaggttagttttgtttttatttgtattatagtttgtatttttattgattgattttatgtaggatgtttataaatagtaattaaaaattgaaaaaagatattatattgtttaatttgaaataattttttaaaattataaaaagtttagttttaatatagaagttgtgattaatttttttttttgttttattttagaaagaaattggtatataattgtaattaaaaattgaaaaaagatattatattgtttaatttgaaataattttttataattataagaagtttagttttaatatagaagttgtgattaatttttttttttgttttattttagaaagaaattggtatatgtaagatgaagaaaaattttgtttttaatatatattttgttaggtttattgttaaaatatatataagttaaaaatattgattttatttgaatattttgggggttgtttaaatatgtttgtttttttagtgaagttaaaaatgtttttttttggtgtttttgaagagatatttagattaaaataaaaataaaaataaatgatatgtataaaaagttatagttattagatttggagtagaatttggaaagtggatggaggaagtgaattttaagatttgtgtagtagtttttttattttggttgttttaaatagatgtggaaaaataaattgaaagaaaaaagtttatttttttttattttgtataaatgagatataaaaattgattttttatttggagttaagtttaggaatagattaatgtatgtttatgtaatattttttttgttattatagattaaatgttattattatgaattttaataggataagattttttgtttgtattagattttttattatttggtatattttagatatgattgagtttaaaaattttagggggatgaaaattataaagaaatatttattgtagaatattgattataattaaatttgatttgtagtttttttttaagtgagaaaaatataataagaattttagtatagaaagggtttttttatttggataattggaatgaggtttatggttttggaaaatttttgaaaatattaggttaagttttttgtgtttgtgaatttttttggagagaggatatatagttgtaatttaattattaaaggatgtatatatatatttataatattatatgtatatatgattatatatagatatatatatatatgtatatttatttatttaatttttaaaatttttatgaaatgagtatttttttgttttttattttatagataataaataaataaagattatttattttttaggttagtagttgttttatttaatgttaagggatttagttaagattatgaatttaaaatttaatgagaaatataattgaaatttagaatttttagtatgtatggatgggtggatgaatggatgttttaggttttttattgttgtttttttttttttttttgtttttttttttttgatgtatgtggatggtttttttgttaatttataatttagtttaatgttaaatattaatttatatttgttttttttgagatttaagtaaaaaatggtatatttattttttgttataaagagtataaagaggttgggtatggtggtttatgtttgtaattttagtattttgggaggttgaggtgggtgtattatttgaggttaggagtttgagattagtttggttaatatggtgaaattttgtttttattaaaaatattaaaattagttgggtgtagtggtaggtatttgtaattttagttatttggggggttgaggtaggagaattgtttgaatttaggaggtggaagttgtagggagttgagattatgttattgtattttagtatgggggataagagtgagattttgttttaaaaaaaaaaaaaaaaaaaagtattaagaagttttatggtttttttttaatttttttgttattttttttaaaatattaaattttgtggaattttattaagaattatatagtatatttttaaaaatatatgtttgttgtttttatttaagatgttatattgatttataaatttaggttgaggggtatttgttttgatattgtttgaagtttattatattttgttaaaagttattttttttaaatattattgttatttgtaagttttttataagtatttttttagttattttttaaagtttggataaagtttattttttggaattttgggtaattaaattattagtatttatgaaaaaatattggaaaagaaggtttagttttaaatattgaataatttttttgttgatttttaaaagatataggtaaatttaaagattgttttatttgttaattgattaaaaaaattatgaaatataatttaagttagatgtgggagtggtattagttaaatgttatagttgaattagttaattatttgttgtattgtttagagatttttatatatattatttttaaaagttatatttaaaatatttagtaattagtatagtgtgtatttaggttaattagattaggttttagttagttgtaagtagttagtatagttgggtaatttaggtgaattttagttttgttagtttatgtaaggtttttattggtgttaaatttgttttattaatggatttaagaaggaatttaaagtgtgaaaatttaggttttaggaagtgaaggggtggtttggattaattagttggtaaatgatagagaggagatttaaagttagattttttaatttttgtttttttttttttttattatataggtgtttaaaaatatttttagggagataaagttgtttggagttttatgttatattagatagtaaagttattgggattatttaggagataatttatttagatatttttttaagagtattaggagtttgagagatgggtattttttgatttttagttttttatggggtttatatttttttgaatagttttattgtaattttttttgttgtttgtgatatgggaggtatttatattggagatgtgatttgttatgatggaaggatatatgatttgggatgatgggaaggtgggtgaaaattgtggatggaatttttaagtaaagggaaatttaaaaaatgattttagtttgaatttttatagtgtggtttggttgtttgtttttttagatgagttgttttgtttgttttggttaggatttggtatggtttattgaaagaatttttttttattagtatggggagtaatggtaggatggaaatgagtgttttgagaatgtttgagataaaattattggtagattatttaatattttttataatgatgagatttaatttaataaattggtttgttttttattttttggttagttttttttgatattagagatttagtgggtttgaggagggtagtttaggaggttaatgtgggtggttaggtatttggggattagggttttaaaattttttttttgttggtttttaatagggtgtttgtttgtttagattgtgttaggtatagagttagtatttgtttagggattgtttgttgattgaatgagtgagtgaatgagtgaaagaaaggatgaataaattaaatagtgaataagttagtgaataaaagagtgagtgggtggtagtagtgggtaaatgggtaagggtagtaatagtttttttttttttttttttataattgatatatagtaattatatatatttatagagtatatgtgatattttgatatatgtatataatatttaataaattagagtgtttaggatatttattattttatttattatttttttgtgttgggaatatttaaaatttttttttttagttattttgaaatatataataaattgttaattatagttaatttattgtgttattaaatataataatttatttttttatttaattgtatgtttgtatttattaattagtttttttttattattttttaattttttttgaagaatttgatgtttttttttttttttttttttttttttgagatagggttttatttttattttttgggttggagtgtagtggtataattatagttttttgtagttttgattttttgggtttaggtgatttttttattttagttttttgagtagttgggattataggtgtatatttttatgtttatgtaatttttttatttttagtagagatgggtttttattatgttgattaggttggttttaaatttttgggtttaagtaatttatttgtttttataggggtgagttattgtattttgttaatattttttaaaagtaaaaaataaattaaaaaaaaagtttttagtggattgttgagttttttttgataggaggtattaaatgtgttttttttgaggataggggaagagtttattatttagttatatttttgtatattttataaaatttatttttattaaggatgtttttttataaaatgaggagtagtataaagaatatttaagaaattaggtttgatttagggtttttgatgttggggtaggttttttgtgtgttaatattttaggggattttgttgtagttttttgaatattggttgtgagttttttaattttagttgagttttagtattttttttatattatttattttttttgtttgtttttggtgtgtttagataattggaatttttgttgatattttaaatgggttggttatttttttagtgtggaggtatttagtataaggtgtgatagattagtatttgttgatgagtaataaagttattttggtaaattggattttttttttgaaatgttttggtttttatatttttaatgatgggttaagaaatagtttttaagaagaaggggtggagatagggggtaggattttgtttgaagtttttaagttgattttgtttgtagttatttaatttattagggagggttggatttgtttttttgtggtggattttttgtatttttagaaagtgtaggggtggagaattaatttagttttttttttttttataagagttttgttaggttagtttgtatgaggagggtatgtgtatatttttaaaaggattggtgtagttatttttttaagtttatagttttagtgtgagtttagggtttagatttggggtttttggtgttttaggtgtgagttaagttttttgagtaagaggttttatgataaattagttggagtttgggggttatgaaagtattggttatggtagaaattattagtttgttattgtttatgttgttttgtttaaaaatgatattgtgtaagggattttgttaatttttaattttgggagattatttattatttggttgtggtttgttgttgaataggaaagtattttgagatgttaagagattaaaaggtttgtaattgttgtttagaaatgaaaatggttttaaattataattagagatggaagtgtgttttaggggagggtggggtgttgtgtaattgagttttttatgtgtaaggtggatataaatggtttatggatgtgggtgaaggtttttagagtaaagaatgtttatttttattagattaaaatatagtttgggaaaataattatttgtttgagattttgggaaagtaaaattttttggtttttttgttaggaagaatgattgtaaaataagggttgagaattttttaaataagattttagaattttatttaaatagttgtagtttatttttgaggagttttagatttatttgggtttgatggatgttgtaatattaagtttgaggtttttttagtttggtgttaagagtgggttttaggggataaatagagaatagttgtttttttaattggagtagaaaataaaatttttttttttttttatttttaatttttttgttttgttgtgaaattgttattgtgtttttgaggagtgattaaaattttagttatgattaatttaaagggtaggtttttaggtagggaagggaaaggggtttaaggtaaaaaaaaaaaaaaaaagttagttgaagtgagtttatggaggatttggggattataaaagttatgggatttgagttaattaaaattaatggaaaagtattaatatgtaatttaaaaaataataataaaataaagtagtaaggatatttttggtttgttttttgtttttatttttgagtttgtttgggaattttggagtagattttttgaagtatagtatgagtgtttaatggttgttttaatttatttttttgttttttatatataaagattttgtaatggagagtgggaatgaatggtttatttatttttgaatattttttgtgagttgggaatgtgtttagtaaggttgttggagtggagggaaaagaaaaggtgtttgagttttttagatatgggtagaaaaggagagaatttgagataggttgagagaaagttgttttggttggtagtattgttagatttttagatatattgtatattttagtttttgaaaaggttattttgagtttttttagggtttttggggtttttattttattttaaatatttggaattgtttgtgtttgttataatatataagagtttttttttatgtttttttttggtgttatttgtaaaggtgaggaaaggtaatgatattaaaggagttttaattttatgggtttggtttttagaaagttttatgttgtggtgtggaaggtaggtaaggaggtgaaggtttttaattttatttaggggagggagtatattttagtaaaggatttagtttttatttagtttgaattttatttgtggtttttggatggatatttatattgattaagttaagagattttgattaagtttttttatttttatttttatggtggggatgataatagtatttaatttgttggtgagagtttttatgatgatgaaatgagttgttaggtattatagtgtttagaatgtagtatagtatatagtagtttaatagatgtttgattttattgttgttgtaagtgtttttattttttgattgattatttatttagttttttttttttttatttaatgagatttttgtagtattgtgatgaatgttttatagttattttttttatgaaagattttagagttttaagttataaaagtatatggttatttatgtaatttattaattaagtattatgttttatttgattaggaaatttttattttttggtattattttttttttttttttattttttttttttttttttttttttaaatttattatatatgtttagttgatattttattaatttttgatggtttatggaaaatgtgttttagttataggaatattgatgttttatagttaagttgtttttttgaattagatattagttttttagttaaatggggaagagtagggaagggagatattaaaattttttgttaaagtagaagttttgggtgttgttaggaagttttgttttttagtaaaaattgtagtaggaattttttttttttttttgtgaaatggaaaataaatggtttgttttgattttttggttttatgggggttgttgagtagtattgttttttttggagagagaaggtggaggtagaagttgtttgtttattttattttagattgtttattttattttaggtttaatttttatggtgttttttatttttttaggttgattatggtaatgtgaatgttttgttgttagttagttgagtattgtttttggtgagaattttgttttggagaagtagggggaattgaagttgtattgtaggatagggggtttttagttaatgtttttagattttttattagtgatggggtttttaaattattagtgatggggttttttattattaaggttttttagttttttagtttttgggttttttagggtttttatggtagttgtttttatgggtagatatatttttttttttattatagttatagtaaaaataataagtagtaaatttattaagggttttgtgggtttttatagattaatatttttataatgtttagtggaaatgtgttagtgtatagatgttttgatttattgtgatttaaggggttttttatgtttttaaaaataaatattaatgtggagaagatgttttgttttattatgtatttttatggtttatgatggaggttttaaatgtaaagtttttaggataagtaagtgtaatatgtaagatagattagttatttttatttttgttattagaaatgaaaaagtgttttttttttgtttggttgtaggttattaatttggaggatgttagttttagagtttattttagtttgatttgtaaatgaaaggtggaatttagttaaaattatttttgtgtggttgttggttttggtatgttttgtatattttttttttttatgttgaggtgggatagttattgaaattattagaaagagtaattaggaggtgtaaaataagttttggaaggtagtaaagttttgtgagtaatatagaattttttttttttagttttgtgattgggatttttatttgtagagaggattttaagtattggttgttagaattatttagggtgtttgggaaaaatgtagatgtttggatttgttagtgagtttggatttttgtgtttttttttagtttttttaaaataatattttagaattattgttttttagtatagtagagagaatgaagttatggggagggttaatttgaaatagagttgtggattttttttaaggtttattattattaagttttttttgtagaatgttagatatgtgtttaattttattattattttattaaatttatatgataatttgtaagtatgatttgatgtttttgttttgtggatgaagaaatagaagttaagagatattttagtgaattttggatttggaaatttatggttaggaagtagtttgtttgatgggaagggtagatgtatgtaggttttatagaaggagttttgtttttttttttgagttttttttggttttttatgtttaagtgtagggttagagatggggtaggtatattgtttttttgttggggatttttaggtatttgttggggggtatttttttattttattatttttggttagtttttgattttttttttttttttggttttaattttttttttttattttgttttgtttttttttttttttttttttttttttttagagagtagttagttttaattttgtaaatatagtgaaattatttggagagtattgggttttatttttagggagtgtggtagaattgatttggggtgtggtttggatattagaatttttaaatattttaggttgattttagtggatagttaaggttggaagttgttttttatttagagttgttagttatagtttgtataattaggagatttatttggatatgtttaggttgaagagggtttggttattagtttatggtttgaaatagagttttgtgaagaaggattaggtggttttagtgttagtttagttatatttgtattgagaaaatatagagttattattagttgattgtatggagtgaggattttaatatttgatggataaaatgtgtttttggttggtttttgtagagaagggattgtggaaaaatatatgttgtttttttgagattgggggatgtttatagggtgggtgataggaagaagagagagtagttattatagttattttgtatattaaatagtttgaaataaggggtggttgtgtaaattttatttttttgttataaattagattataaaataggttttattggtttattttgtaaattaattttgtagttttattatatatataaatatgtatattatatgtaggataaaaaaattttgtatagagttttgttttgtattaatttttttaaggaaattttatagatggtaaataaaattttatgtttttatttggggtatttgtttgaagataagagtaatttattgtaaaaggatttttgttgtaagatagattgtagtttattaggggagagtaggatggaaatagaggttttttgaaatatttgaagggttttgtaaattgttgaagttatggtattgtttggagtatttagtattgagttgggtatgtttaggttattgatgaatttttgttaatgtataaatgagtagatgtatgttatattgatggtggggtttagatttattttttgttatggataaggaagtgttggggaaggaaaataaatataaaattttttatttgaagtaagattagttggtagatgagtgtgtagaaggggtaatagtaatttatggagggtaagttattagagagggtaggaaatgatttttttggatattttttttttggttgtgggttagtagtgagggagagaaagaagagggtaggtgtttgtttttttattgttttaggagaggaaaatgttttttatttttatttaggagttggtgttgtggtttatattatagtaggttttatggaagttgagttattatggtgaagagggtgaggtggggtatagagttgtttgggatataggatttgttttttttatgggtatgggatagttgttttttatgagagatagttgtagatggggtttttgtgtttggttattagtttagttgtgtttgtgggtattttagagggttaaagtagtttttagatgagagaaaatttaaagataataagaagtaaattaattttgaaaaaggtgattgaagataagggttggtaatggtattattttatgtgtggaaggagtttagaagaaaggaaatatgttattgttttttgtatggggtgggggtggggggtttaaatagatgtttgagaattgtatatggatatttgtaattatatagtttttatagtaaatatttgtttggagagaatttttttgttttttttttttttttattttttgtgtatattaaatagtgtaatttatgttagtaagaataattatatattttttttattatttttttttgagtgtattttaaggtagtattttattatgttgtggaaggagtttgtatggggttttgtttttaaatatattatttttaggattatagtggtatagatgtatgatagagtagaagagaaaaaggttttgtaaagaaatagaatggttttaattttgaagtgtttgattataatttaattgagtatttgtaggagatagagttattaattagagtagggatttattggttgttggttgagaggttaatgttggttttggttatggataaggagttttgattaattatttaagaagattttgggaatgtatgtgtgggtttagtttgatattgatttatttttttaattttttgtatttagattttgtgtttattaagttgtttttgtagtatatttggttttttaggaaaatttttttgtagagagagtatgggttggttaggtaagtatgaatattaatttgaaatatttttattatagatgaatatattggtatttttgtttgaatatttatatagttggtttttaatgggtgttagtttttaagagatggatttggtttttgagggatgaatagattagatttttaagtatgttaggaggaagtttatagagttttgttttgtattaatttttttagggaaattttgtagattgtaaataaaattttatatttttatttggggtatttgtttgaagataagtgtaatttattgtaaaaggatttttgttgtaatatagattgtagtttattaggggagagtaggatggaagtagaggttttttgaaatatttgaaggtttttgtaaattgttgaagttttttgattatgatgaatttagtaagtaatgttatttttgaaggtgttttgagggttatatttttagtttttttttgatgatatttgagtaagttgttgaaagttttttttggttattttttgaatttttatttttttttttgaatgtagattgtagatttagaaatgattttgagttttttagggtttggatgtttgaatgtgattaatgtggttttagaagtagtgggtattttggttttattttttagtgatattgttaattttatagttgataattatttttgatttgttaaattttttggttttgtttaattttgatttaattagattgaaagttaggtaagaaaggttaattagagggagttatgagagatgtttgtttttatagaatataggttttggttgggaagatataatatatatatgaaatggttaaatatatttagtgttataaatgaaaatatagtttatattgattaagaagtgagtaggttagaattgggtggtattaattttaaaaggatttttgaaggaagtatttttatggaaaagtagtgttgtgataaaaggataggtttttaggttaattttttgggttttaatgtttgattatttgtgattttataaagtatggttaaggttaggtgagtggggtaggaataaagtgtttgatatatagagatgttaaaaaaagtgtttttataaatatttttgtaagggaaaggatgagaagagataagaagaagaaaatttgaagtgttttttttagggttagttgttttttatatggtattttatttgatttttatagttatattgtaagatgtttattattttttgtattttataaagaagaaattaaaggttaaggttaagtaatttatttaaagttattttgttgatttgtggtagagtttaggtagtaatttttattttgtgttaggtattattttaaatgttttatttgtattaattattttggttttataattttatgaggtaggtattatttttaattttatttattaaggaggaaattgaggtatagagaggttaagtaatttgtttaaagttaatatagttagtaagtaatagagttaggatttgaatttaggtaatttgggttttgagtttggaatgttaattattttattatttttttttattatatatgttatattgtttttttttgaagaatatttatgaatagataaaattgttaaaatagtttggagttttaggatgaatattttaaatattataaattttttatttgtaggggagtggttgtttgatatggtttttgttgattatttagtaatttatttaagatagtgatgtgtatagattattttggttttagttaatatatagtattatataaatattgatttaattggagagtttgaataataaattattattagtttaagtgttaaaatagtatttgtttttttttgtgtttgagtatgttatttatttatattttgtttatttttgtggagtttaaattgttttatgtatattttattattgttgtatttatatggatttattgtttttattatatatatgtgattaatgtattatataatgtttaatatttattataggaattttagtttttaattagttttttaatttatgggtattattgattgtttttaatttataattagtggaagtttgttaataataaaaattatagtattttattgtttattttttagtttaatttattttgtatatgatatgattatttttgtttttgagtatgaattatatattattttttggtttttttttataattttatttatggttgattttgaattagaataggtttgtgattttattttttaaagtttaatatatgtattttttttttgtttatgttgatatttgtattggtatatgtgaatttttaaatttggtttttatttttttagtttttataggtaaaaaataaatttggatgatgtaatagttagtaaagaattttaaataaaggtttttttgattagttggaggatatatggaaatttttaattgtggtgtatataaattgtaaatttaagtttatatattgttaggagttaatagaatttaagatttagtagtattttttagtattagatttataaagagaaatgaagaaagaattgttatttgatgtttttgttttgataaataaaaatagttaattgtttagtttatagttggggtattttgtttttttttgttttttttttatgtgaatatttatttttattattgaaaatagaaattttaattttaagtatttttttgtttttgtaaaaaggatattatattaatagttttttttaagaataggaagttattgttttattttatataagtttttatagtttttattttgttttggtgtgttatttgttagtgtgattttaggaaggtgagataggtatggttagatatgagagatttttaaaagttatagtgttaataatggtgttataaggggagtgtttagtaatagagttatttattttaggaatgtttttgtattttggtaattttgatatgataaggttttaataaggttaattaagtaatttgtagttaatatttttatttaagagaggttagatgtttggggatttatagttgtatagatgtattgtgtgtttttttattttttttttatgtatatgttgttttttttatttagataagtgggtatttttatttttatgattttttttttaggattttgtgtagttattattttttttaaaaagttttttttaaaattaagttggatgtttgttttgtgggtatagttttttatatttattttatttattttaatgggttgaaaatattaggaaaaattttagataaagattatgttttagtaaatagttgaataaagaataggtgaagggtgttagaaaagtaagaaatggagatagaggtttggaatggtttttttagtattgttgttgttatttttatatggttattttgggggtatatgtggagttgtggaaatttttaaaattaaaattaggttaggtttagaattagtttgattaatatagattatgttatttgaatgtttttaaatgtagattttgtttttttatttttttttgttttttattttattaaaataaatagtggtatggtatttttatttgaattaggtttagttttgaaagttggagtagtttttagatggtatgttttatttggtttttgtttatagggttggtgtttagattatggaaatattagtagaattgaatgtatttgggtagtttttataaattttgtaagtatatgattaaagttaagataaatgggaaatatagaataattaataataatggtgagtggaaaatgttagtaagttataataatttaaagtatgttttttatttttttttaagtagttatttgttttatttataaagatattgtttgaaaaatgaatttattagttttatatttgaggtagaatgatatatggaaatagtatagtttttggtgttagatttgagttttagtgttagttttgaaatttatttgttggttgtatggttttagtaagttttttaagatggtagggtttttgtttttttattaatttttataattttggaggtttagagaaaatataagtataagtgtttagtatattataggggtttaataagggatgattagtgttattattattatttttaatattattgaagaaatagtaaaataattagtttggaaattatgaatgattttaaattgaattggagtttaattatataggtgatagaaataaagattggaataagtaaattagaatataaattggaaaatatttaataaatgtaagaaagtaaatttttgaataatttaattatatttattttattataatattatgtatatattaataaattttaatttgtattaatttgtaataatattaattttaatttataatatttataatttttaaattatatattagttgaatagtatattatatatttttttagaaaatgttatgaatatatatgtatttgtatatgtatttaattttttttttattaataaaataatattatttatatagatttttattttttttttttataataaattttagatattttaaaatgtgagtttatatgtatttattattttttttaatagtagtattttattttatattagtttattaatttagttagtattttatatagatatttttttttttttttaagttttttttttttttttgttgtaaaattaaaatatataatgttgtaatagatatttttatatataggtagaaaaaatttgtagaagtgaaattattaagataaaggttatgtaaatttagtatttttaaaattaaggttaaagtgttttttaaaaattttataagaatttatttttttattaatagtatataaaaaaaaaaaaaaaagaaaaagaaaaataatttaggtttttttatatttgttttttttaattttttttgtttaggtttgttttagggtagaaggtataatttagttatattaataattgatttaaagggttattatttagtatttagttataatttatgatagttttttgtagttattttttgttgttgtttagtttgaaattataaataatgttggaggttaaaaagtttttgtttgttttaggttaggtatattaagtttttttagttgaaggttttttaattatgtaggaagagtttttttatttttaaaagaaaaaagtaaaagtaaattaaattaattatagataaattgagttaagttattttgtatgtattgaatgtttttttgtgttaggtttagtattagggggttttttatatattatttattttaggttttatgtatttttgaggaagttttttagattgttgaattatatttgggaaaatgagaattggtgttttattttttatttattgtatttaatgaagtgttgtttttaattagtaaaaataggttattttattattagttagaaatttttattaatagttgtttttgagataattgatgttttttgtgtgattttgaggtttggtgagatatttaagtgttttttaagttattagaagagataaatatgtgtttagtatagttgtggtgttaagtatattttgttgtatttgaattttataaaaatttgttgtggaaaagtggtttattgggtatttttagattaaatagaatgttgaattaattagaatatgttatttttttagttgtttgggggtttattgtatttaagataaattgggatttattatattatttagttttgattttggtattataaattttttttttattttatttttattgttatattgagtgaaagaatagaggtttttttttttaggataaaaaaatgtgaaaaagggtaattttttattattttttttaaaaagaattttatgtaagattgttgaatttattttaaataataatttttaaattaataattattattttgagatgagagtaaataaaaaattggattggaatgtagagtttgataaaatgattttatgttatgggatattttttgtgatttgtgaatataaatgatagtttattttttatttaaaatattttttttaaggttaggtttttgaaatttaatttatattttttttttaaattaataaggttagattttaagtataaaggaatgttttatgaagtattagaagttggatattaatagtattgtgagatataagttaatatttaaagtttattttttatttttagatggtagggatataattgttatttagtttatgttttttgtaagggaagaagggattttttttttttgagggttaagtttttggagattgtttttaattttagaaattatgggtttgttttagtaagtgaaagttttattttattttatttattttttaaaattttattttaagttttgggatatatgtgtattatgtataggtttgtgatataggtaaatgtgtgttatggtggtttgttgtatttattaattattatttaggtattaagttttatatgtattagttatttgttttgatgttttttttttttttgtttatttttaataggttttagtgtgttgtttttttttttgtgtttatgtgtttttattgtttagtttttatttataagtgagaatatgtagtgtttggttttttgtttttgtgttagtttgttgaggatgatggtttttagttttatttatgtttttgtaaaggatatgattttatttttttttatggttgtatagtattttatgatgtatatgtattatattttttttatttagtttattattgaggggtatttgggttggttttatgtttttgtgattgtgaatagtattgtaataaatatatatgtgtatgtatttttataatagaatgatttatatttttttgggtatatatttagtaatgggattgatggtttaaatggtatttttggttttagatttttgaggaattgttatattattttttataatggtttaattaatttatatttttattaatagtgtaaaagtatttttatttttttatagttttgttagtatttgttgttttttgaagtttttattttatttatttttattttagtaattataataatttggttttttaaggatagatttatttttaattgaattttatttttgaggtagaaaaaattttgtgagattttagtatatttaaaaatagttaatttgtatttagtagtgttattaatttatttatatgaaaaaatattttgtgtgtatgaaatatattatattttaagtagttgaggtgggtttttggtgaaattatttattgtaggtatttatgtataagtagttgtttattgaagaagttaagttagttttggagtttaggataagttttaaaggtttttgatgtgttaagtggagattttgaaatttgtgttagagagtaggttttaggttggtgtatttgtaaattattggaaaaagtagtgtatttgaatttttttaggatagattgttgtatgtgattaattaatttttgattaattagaaataattaagtgttgaggttgaaatatgaaattaaaaaagaaaattggtttagtttttattttttttgtattattaaaaaataatttataaatatgtttgttatatttaaattatttatagtttgagtgttttttttttttatttgataaattatttattgaattattatgtgtagggtgtttatttagggtttgggagtattgttgggattatgataggtatggtttttgtttttatggattttaaagaataaataagtatagtattgattgtatagaaatatttagagaattaaagtagggtgataggagagggaatgattgggtgttttaggggagttttttaaaggaagtgatatttaagttgagatttgaaaggtaagaaggagttagttttgggaaagttaggggtagtataatgtaggtagaagttataagtagtggaagattttaaggagggagtaatttgatgtgtttggaggattaggaagttagtttgagtggtttataagtaatgggggagtgtgtagttggtgagagttgaggtttgagaattagtgtgaaggtagtgtaagattttggaaattagattgagagtttggatattattttaggatgatgggaagtatttggggtgataagataagttaaaaagtatggtttatatattttttttataaagattttaaattagagagatggttaataagatggtaggtgttttgaggtgtatgtttattttttggtgttttttatttaaagagttagatttttgaaagtattgatggtagttggttttttggaatgatattattaggggatattatggttatagtatttgttattgtattagttttaatttggttaagatttatattattaagatttttttttttatttttgttttagtatttagatttaatatagttttttatttttttttagaaatgtttttttgtttatttttgtatttttaatatatagaagggttttgtttttaagtattgatagattttatatttttgtgtaattaattttggttaaaaatatttttaatatttttgaaattttgaatgtgttttattaaggaaataagggtaattaattttatagttatatttgttttatgtatgaagagaaaaatttttaaataatattttgtgatgaaatgttatatttaattattaaagatttatttttagtaaagttaattgttgagtttttagttaaatgaaaggttatgtgttatttgagaagtatatgttattgtggttattaaattgttaatttggggtaaggtattttatggaagatgtttgttatgaaaggagagtgtattgtagtgattattgttatttagaaatgaggattaatttataaaaatgataaggagaatatgaatttaataattatattttaaatgatgttttaaatatgtttattaaagtgatatttgtgtgtgtttgtgtgtgagtgtgtgtgttaagaatttttaatatgagatttgtttattttttatttttgttgaagggtaattttttatttttttttttttttaggttttgataattattattgtgtttttggtttttgtgaatttggttattgtagatgtttatataagtggaattatgtagtatttgtttttttgtgattggtttattttattgagtatgatgtttttaagaattatttatgtagttgtatatgaaaatatttttaaggtggagtagtatgtatgtgtgtgtgtgtgtgtgtgtgtgtgtgtatatatatatatatatataaatatatatatatatatatatatatatatatatatatatatatatatatatattttttgtatttatgtatttgtgaaatgatattttttgatatatattattagtggataaaaatgtgttttgaggttttagtatggtggtttatatattaaatatatggttttaaaatgatattattatatttagtatggtattgaaaagattgatgtagatttatttttttattagtatgattttaagtaagatatattatatttttaaattttggttttttatttgtaaaaaataaaaataattatatttattttttatagggttgttgtgatgattaaatgagataaattatataatatagtatatgatatagttattgatatttaatatatatgagttttttttttttttagttttttgtttttatagtaatttaaatttttggtaagttaatagtttttattttttgatatagttattagtattatttaattttatataaattataaataggttggaatttttgtttatttgtttgatgttgaagtagaaaagtgtttgttagatagtaggtgtttaataaatagttattgaatgaaatgaatgaatgggaagttatattggaatgaggttgaatgtgaaggttagttaaatattttagtagaattattggatatgtttttaatggaagagatatatttttaaatttttttttttttttttttttgagatggagttttattttattgtttaggttggagtgtagtggtatgattttggtttattgtaatttttgttttataggatttaagtaatttttttgttttagtttttttagtagttgggattataggtgtgtgttattatgtttagttaatttttgtatttttagtagagatgggattttattatgttggttaggttgtaataatatagtgattattatagtatattttatattgtagtatagagattgaggttggtatattttatatatgattatgaatatttaattattatgtttatgaattataaaaaaattagtagataatttataagtgtagttatgttataaaataattaagtataaaaattatttaataaagatagtagtggttttattaaattttgtgatattttaattataaataaagtattaatgggaaaagtttgattttaagggtttttggattagtagtaggttagtgatatttaggagagtaggaattatggtgtataaggtttgttttggatttagttttaggatttgagagttggtttggggaagttttggtaatttgtaaggttatttttatagaagagttagtggtggtaggtattgtttttttagtttttttagtttatttttttatgatagtgtagtgatatattattttagaattatgattttagaattatgtagttatatggagggggtatatttaatattatagtggatggaaattgattagagtgattttagaatattaagaaaatattatagtggggatggaaattttttttgtttataaagttggggattgggagttaattttgttattaataagttgtgtagttttgggtaagttattgaattttggtttagtaggttttggttttattatttgttatttattaatataggttgtttttatttttatttttttattttagaagttttatgtttggattgtggtggttttggttggtatttttttttatgttttgttgttttggaaaagttatatgtgtagaaattatagatggtagtaggggagataataaggaagaaaaagttatttttttatttttttttaaagtattatgtttataattgtttatatttggtatattttaatagtaattatttgtaaggtttaaaaattttgaattatgaaagtgaaagaaggagttttatttttaaaaggaaaattaaagatttggagaggattatttgggatttttttattatatttagataatggtaggtattattgttttatgtagtagtatgtttttatgaatagattaatatatatttttaggttgtaaaatagtgttttaggatataatatgttgatttagatataaaataaaatattgtttgtattgtaggtttttaatgaaaagtttaaaaatatatttatttaataaatttttatttttatagggtttgtttaaaaaagtttgttttaaaaaaaatttaagtatgggtggttttatatttagaagtggtataagaattttttgttagatgatgtgttttaatttttgttatggaaaatgtggttattataattatagtttagagaaaataaaaggtttttaaaattttatgtaggaggggaataagagtttgttagtatttaataaaattataatttaattagtttttaggtatagtggaattagtagttaaattatagtattggataattttttattttattttgtggttatttgttgaagtgttttatttttttttggagatttaagttttttgggaataaatgttaagttatttgtatttttgtaatttttattagatttggtatatggtttgttttttgtgtttaatgaattataaagaattttttaggaaaaattatttgagaaatattttagagtaagaggaaattaatgtataatttgttaaaaattatttttttaggttgaaagatattttaaatatatattttaaaaggtttatttatggaaaaagtttagttgtgtaggttttgaaatgagatttagttaagaaaagtattaatattaattaagtattgataaagaaggaggggggagtttagttaggtaatttagttatttggttattaaaattttttttttgatggaaagaaattattagagattgagtgatttatattgaaggaggagttataatgtaattgtttttttttatgtatggttttttttttggttttgaaataaaagggttaaaggtaaatgagtttattgaaaattaatgagagttgaatgttgtatgttgttaatatgtttatttaatttaggtattaagaaagaattgtgtggttttttattatatgggataaaatataaaagtttttatatataatttttgtttgttaattaaaaataattaaataaaaattttaaaaatttttttaaataaaagttttttaggaaggttgggtgtagaaggatttgaagttttttgtatatggaaatattatagttatgagttttttttagtttggattttttgtattttttagattttttaattttatagtgtaatttattttttttttaattatgaatatgtattaattagaaattttaatattttagtatttgaattttatttttttaattgtattttattattagaagtagttaaaaaaaggttttttttaaatttattttttttatgttttgattttttgtaatagaaataggatgatgataaatataggtgagagaaaataatgtttttttgaaataggtaagaaagttatggtttgttgatatgtggttgttaaatatatatgggtggaaattgatttgaagggtttgggtttgtgtaaagatgttgtatgatttttagagtttaatttggttaagtgttttttgttattttttagttgtgtgattattgataaattgtttattttttttgagttgttgttttttggtttgaaaatggagtaaatgtttgtatttgttataggtgtttagggtttagatagtgtaagttataagtttatagtagtattgtgtttgttatgtggtgagaatttattatatggtggttatttttggtgttattttttgtagtaatttgttttgtttgaattgtgtagaatgtaattaaatgttaaattttttttgtatttttagtgataattttttggtgatagttattttagaggatggtgtttgtgaggtgttagttatttttatagttgatttttttatgtttatgtttgtttaattaggggaatggttatagtaggaatagaaaagggaagggagagaggaaaggagggagggaaaaagggagagaaaggaggaagaaaggaagaaggaagtgagggaggaggaagtttttataagatgatgtaatatttaattttttatttttattttttgttaattgttattaaatattttgaatttaaatgaaaagtatgttagttagatattgaggggtgaatttgttttttgtgagagagtatagttttgttggtaaatgggagtggagagtagaaaagaaatataaaataaatagagattttagttaaattgatttgttttttttagtttggtgtgggattttttttattgaaaatttttgttttttaatattgtattataaggtggattttatttgagttttttaggttatttggttttttttttgtaagaaagtagtttatttgtttttataataaagtagagtggtttttggttgaggaaggagagaattatgagttgaaggaagatggttttgtatgattatgttatgtttttgtatatgtaaagatgtagagatatatatatatagatatatatatatatatatatatagagatatatatagatatatataaatatatatagatatatattgatatagagatatatatatagatatatattgatatagagatatatatagatatagagatatatatagatatatattgatatagatatagagatatatatatagatatagagatatatatagatatatattgatatagatatatatagatatttattgatatatagatatatatagatatagagatatatatagatatatattgatatatagatatagagatatatatagatatatattgatagagatatatatagatatatattgatatatagatatatatagatatagatatatattgatatatagatatatatagatatagatatatattgatatatagatatatagatatagagatatatatatagatatatattgatatatagatatagagatatatatatagatatatatagatatatatagatataaagatataatagatatagatatatatattgatatatagagatatatatatatagatatatatagatatagggatatatatagatatatattgatatagagatatatagatatagagatatagatatatattgatatagagatatatagatatatagatatatatagatatatatagatatagagatatatataaagatatatagtgatatatagatatagagatatatatatagatatatatagatatatatagatatagagatatatattgatatagagatatatatagatatatattgatatatagatatagagatatttatagatatatatagatatatatagatatatattgatatatagatatagatatataaaagatatatatattatataatatatgtatatatagagatatataaatgtatatatataatatatatatagatttatgtataggtatagatatagagatgtagatatatatattatatatattatatagatatatatatagatatgtataatatatagatatatataatatatatattatataatatatgtatatagaaatatatagataaatgtatatatataatatatatagatatatgtatagatatagagatatatatatatattatataatatgtatatataagatatataggtatatagatatagagatatatataatatatatagatatgtatagatatatataatatatatagttataaatatataaatattatataatataggtatatatatagagatatatgtagataaatgtatatagataatatatatagagatatatgtatatatagatatagagatatatataatatatagatatatgtatagatttatatatatagatattatataatatatatatagatatagatataatatagatatatatataatatatgtatagatatatatatagagatatatatatatatgtagatatatgtatatagatatatatataggtatagatatgtagatatattatatatgtatagatatatagatattggtatagaaatatatggagatgatatagatataaatatatagatgtatatgtatatattatagtgaggtttattttatttttgtgttgtgagtggtataattttttatttttttttttaattaagaaattttgatatttttaattattatatatggggtaaatatggtagtatggattaaaattgtaataaataaaataatgtgtatatatgtatatatatatatgtatatatatatatatgaaggatatttttaagtaagttagttttttatgaattttttaaggtttagtttgtaattttagttttagatgtatatttttgattgtttttaatatgtttttgttttgtttgtttgggtttatttgtttttgttttgtaggaagtttttatagatatgatagggtgatttaattttgtataaattttgttttttttagtttttagaatgaagatagatattattattggtatttttagagttagatttatatagttttttatattaaatagagtgaagtagaatttatattttattggaatttttatttttaggtatttgtaggtttttttttatgatataggaaattaaatatgaggtattattgtagatagtaataaatgggtttttaaaatgtttttagtggttggtagaataataattgatttatattttaaaaggggtaatatatttgattttttatattttgtaaaggaaaggaagattttagatatttttttgttaggtgtttaaatttatttaggataatagattgttaaagttatttttgaagggattggtaaaagtttttttttatatttttgtgtataagatagttaagagttaaaaatgatagagttggtagtgggttatgggatgggaaaataaattaagttttattttttgttttgtttttttttagagttagggttttgttttattatttaggttggagtgtaatggtgtaatatagtttaatatgggtgggagaaaatttattaatttttgggaaaaagtgatttttttattttagttttttaaatagttgggatatgtttggttaattttttaatatttttatagagatggggttttgttaggttgtttaggttggttttgaatttttgggtttaagtgatttttttattttagttttttaaagtgttgagatataggtatgagttattgtgtttgggttaaattgagttttgaatgaaggggtttatttttatggagttaatgaatttgttgtatttttagttttagtaggtatgggatgtttgaaataagttaggtataatttgtattaaatgggtaatgtgtaggtagtattatggagtagaagttaagtgataggttggggggtttatggttttgatgatttttgtttttgttgttatgttgatagttagtttattgatgtatatatagagattatttttaattgtaggttgaattgtttttattaagttatttgtattttgagtatataataaattattgtgagaaaagttaaattttttttatttaattttgatatttaagattttttgtaagatggttaaaatgttttaagatttaaatttttgaaagttttttaaaagatgttagttaatttatttttataattttttttttttttattgtttttaatagaaagtattttgggggaattttttttggttaatatataagtaaattaaggagatgattttttatgattttatggaattagtgatttttaaataaatttttttaaaaaggaaataaatgtgtttttatagtagaaggatttatgtatatgtatgtttgttgtggtattatttataatagtgatgatttggaattaatttaaatgtttattaataatagattggataaagaaattgtggtatatatatattatggaatattatgtagttttaaaaaaggatgagtttatgttttttgtaggaatatgaatgaaattggaaattattatttttagtaaattattataagaatagaaaatttaatattatatgtttttatttgtaagtaggagttgaataatgagaataatatgaatttagggaggagaatattatatattggggtttgttagggggtgggggtttaggggagggatagtattaggagaaatatttaatgtatgtgatagggtgatgagtgtagtaaattattatggtatgtgtatatttatgtaagaagtttgtatgttttgtatatgtattttagaaattaaagtataataataataataaattttataatgaaaaaaaggaaataaatgtatttttttggttgggtatagtgttttatgtttgtaattttagtatttggagaggttgaagtaggtggattatttgaggttaggagtttttgattagtttggtgaatatggtgaaattttgtttttattaaaaatataaaaattagttaggtatggtggtgtatgtttgtaattttaggtatttgggtgtttgaggtaggagaattatttgaatttaggaggtggaggttgtagtgagatgagattgggttattgtattttagtttgggtgatagagtaagatttagttttaaaaaaaataaaatatttttatatttatataatatttgttagaatattggtagtataattttatgataattattttattaagatttagaagatttggtttgatttagaataattgaggttatttatttaatttgtttgtatttttgttaatttatttttaaaatggtgaggtttggataagatggtttgtaagataatttttagttttaatattttgtgattatatatttatgtagattttatttgtaaaagatatgttgttagatgttatagagataaatatgtaaagatatgatttgtattttgttttgtttatagtattattgtttggttgtatttttaaatttttattataggttattttgattaggtattaaatttttatttttttttaattttttttgatgtttagaggtttttagataaatggggattagtattatatgtataggttttgtttaaatatttttatatttatttttattttgtgtgttttgtgtagttatggtttttttggtatttaatattattaggggttttttaaataaggattatgttggtttgttttgttgtgttttgggaattttataatatagtttaatttttgtttttggagtggatttttttttttttttttttttttaagaataagtgttttggtttatagtttgtagtttggggattggtgatttgtttgaaaatttgtgtatgttggatttgttagtatttaggttggggaaaataggttgtttttgagtagaatagttttgttaattaattatgttttaggaaagtgggtggtttgtatgtgaggtttattttgttaggattaagttttttatgaaaatgtttgagtgtgaattaaaagaaagaaaatagtttattttttgtatttattgtgggagggttagataaggttttatttaaaaaaattttttttttttgaagtttgaaagtaagattttgggtttaaagagaatttttttgttaagatttattagaggttatgattaggagatggagtttttaatttggatgttaatgatatgtgtaaaataagagaaaattttagggaggttttttatttatttagaaattagaaattaattatttatatatttttaaaaagagttttttgaggtgatattatatatgattgtgattgtattagtaaagtaattagtaagttgagtatatgtatatttttagaagttaagttagatataagatataagtttttattagtaagatgtgattaatgggataatgttaagtttattgttatagggttgggtatatattttggttattatttgttagttggggtaagttaggtaatttttttaagtttttaaatatatttatatatatgtatatgtatatatatatatatatatatatatataatggggttaattatatttttaatttatagaattgttttgagaattgagatattaaaagtaaattaagtgtttttatgttgtaaatataatagaaatgtaaagtattgttataatagatatatttgtatttttttaaataatgtatatattattttatttaaaattatttgatttttattttagtttttatgttttttgttattttaggagtgagtttttaattaatttagtttatatgtattttttatttaaagtttttttatatttttaaagtttttgtatgagtgatagaaaaatataagtttaaaatatttagagaaatagtattatagaaataggatagatagataattgagaaggtatttgttttttatttagtatagggttagtattatttttggtatttattttgtttatatatgaattgattaatatataagattatttattggagtattatttgtaatattaaaagattggaaataaataggtgtttattattaggggttggttaattattttatgggtagtaaatagttatataatgatatttaatgaattttttattttgaaattgtttttatattgattttgggtttggttttatgatttgtttttgttaatggaatattaattaatgggatttaagtagaagtttaataaaatttttatagtggggttaatttttttttgtttttgtgggatttagttgttatatgaagtagttggggttggtttatttaaggtatatattttaattgaggttagatttttttaataatttgttagtgaggttattttagattatttagttttaaataattatatttatatgaataaatttaggtaaaagtagtagtaaaaaatttttggtagattttaggttaaatagtttatttatagaattatgattaataaaagggttgttgttttaaattattatgttatggagtaatttgttatgtagttaattgataattggtatattttgatatttttaaaatgatgtaatattaggaagtattatattatttaggaagaaaggaaaagtatgtattttatgtattgatatggtatattttaagatgtattatgataagattttatatggtaaaattttaagatatattgttaaattaatagggtaaatagtaagttgttttttgtgtaagaaagggaaaattttaaaatgtgtatatgttattttgtatggatgggtgttggatatatatttaagaaattaatagataatggttttttattttgatggaagagtgagtagtgaattgggtggatggggatggaggtgttagtgagattttttaataaatatttttttaaattgttttagtataggaattatgtgattaatatttatgtaaataagtattttgaaaaagggaaaaataaggttaatataagatagaaatgataaagtttgaaaaagttgaattttaaattgatgattataattttgttatgtaattattttttattaataatagtttttttttgaattggaataattgtttttttgtaatatatatgattatttgtatatttggttgttttttttgttagattgtaagtgttttaaaagtagggattatattttatgtatttttgtttttttagtaagtggtaagtattttgttgggtatagaagaaagttttgtttaataattgtttgttgagttaaaaaaataaataaaaatatttggattttattaatagtgtttgttgttaatgttgatgagtttaataaaatttttaatagtttagtttttatttgtatatattttttatatattattttttaggaaaatggtgagtattttttatgatttgggtttatgaatgtattttgaattattggggagagtatatataaaagttaaatttgaatattatgaaaagaaaaatgtaaaataattttttttatttaaaaaaataataatatttgattagagggggtttagaaaaagaaaagaagaaggattttttattattttttataagtaatatatttgattattgtggttggaataagtagttttgtttttattttttgtttgtaaagtaaattaagttatttgaataagtggattatggggatatagaggtagaaaatttttggttttatttttaggtttttagagaatttgatatttaagttatggtggagaggttttttgttatgagtttagtatttttaagaaagaggagattataggttttttttgtagtttattttaagagtttgatagtttttattggaaatttttattttttttgaatttgtatttttttgttgtgttttaggttttttttttttttgagagtttttgtttttatgtttgatttttgtgaaagtgtaggtatttaaggaggaggtttgggttttttttatggtggtgtttatattttttttagggggatgtgtttggtaagtgtgtatgtagtattattttagttttgtgtattttggattgtattaataaatagtattatatagtttggggattatgtttagatttatatgtagatgataagtattgtggttaatatttaagtgttagataattaaaggtttttttaaggataaatataagtaagagtggaagtaaaggaagtgtatatgtttgttttaagaaagatagggtatgtagttttttttttaggattttttattatttttgttttttttttttatattaaatgatgttaattttttaatttttttaggttttattttttaatgtttttattagttttattgttttttgtgaggttgaatttttttaattaagggtagtgggagatgttttatatttggagtttttgtgaggtagtaaagatggagagttgagattgattatttagaatttaggtgtgtttttgttatatagaataataagtattgttgatgtttttagtaagtgttaggtgttgggttagatgttgttggagatataaaaggtggagatattatttttgttatttaatgagagtgatattgattggataggatttaaagaaggggattttggtgtgggtgggaagagtatagtgggagggttggggtaggggtatggttttgggattagagtaggtggaggtagtggggtggggaggaggaaaagaaggaaggaagaggttggttagaggaagtttaaaagtggatttttggatatatagtaaaaaggggaggatgatttaaagatggtttttagatgtgggggtttggggagaagggaagtttttatagttgttgatagaggttgatagatgtagagagggtttgtggtgagttggttgaatttggggtaaataagaggagattttatgttttattttagatgaggaaataggattaggaatatagttttatgattgaagttgtgatagaaaagtttttttaaaggagtatagtggaggagagaattggagaagaggtatggagattgttaagtgttttaggtgtaggtggtaggagggagtttaggatgttggtagagtgagttttggtttgtgaattttagggttgatgggtattggtttatttaatttatttgtgtatagatttataaaattgtatttggttgtggttgttagtaagtgttatataaatgttttataagtgtttgttgaaggaagttgaaatgtagttgttagaagagtgagagggaaattagtgatagagttttgtaagtttaagaaaaagaatttaaagatggttaagagttaatattgtatagggaattatagtatttttggaagattaagggtaattttgattgttttagattgtttgggagtattagagtttgattgttttagattgtttgggagtattagagtttgattgttttagattgtttgggagtattagaggtttgggtgggggtaggagttagtttatttggaatttttgtttttagtgtattgagtttgtatggattattagggttgatattgttttatttaatatgggggtgggggaagtttttgtgatatataatggttttaatttaaattttgtgttgtttttattttagttgtgtaatttggaaattttaaataaaaagtttgaaaggaaagttggattatttaagtttatatagattttattaatgttatatggttattttatttttgattttggaagaaggagaaattggtatgggaatatatttttttaaaaaaaatattatttaaaaatatgaaagtttatttaatatttaaggaaaggtatttaattagagggatatttaataagaagaattgaggatttaagtaaatagtttttatttgtttttggttttattatttggtgattattttttttttttttttgatagattttagttaattaattttgttttatttgtgtaagttgagaggttatttgttatggaatatatttttatattaaataaagtgaatattttttatttttgtgttttttatatgatttttaaaatataaagtatttatttttattttaaatagatttaagaaatgttgattttgatgaataggtataaataaggtaattttttgtttatgaaaattgttaatgatttatttatagaaagatatgttttgtgttatattgtattttttatttttgtttatttggttttttgatgttggtgaattaatttatttatatgtttttgtttatttttttggttgttattagttgaagtgaagaaaagatattttataaggggatatggtatatttgtgttaaaataggtattatataaatttagagaaaggagttaaaaggaaatattaggtagagggaatagtgtggataaaggtaaagttgagaagagggtaagtgttttgtgttgggggatggtgtatttgggggttggggggagtggggtatagtgtattgggttgaggatttatagttaggaaaattggaaataaaggggaaggagattttgtgaagggttttaattattgggttaaggaaagttgtattgtttttaataattgggtattagtggaagtttagagttaggaatataattgttatagaggtgttttggattgaataatattgtggttgtaggtagttttgggttgggggttgggaggtataagtttttaggaatttattgtagtagtgtgggttttgttatgttgttttgaataaagtgttatggggatggatataaatatgaagtgaaaattttagagattatttgatttttatgtgttattgttttgattgttggattatagtgatgtttggggttttttggaattagtgttagtttagagttagttattagtagtttttaaaaggtttgattaattttttttttttagtgtatagttattttggtaaaaggttataggtttttttggggaaggttgggagaaaaagtaatagtattaatttttgatagtgtggtagggttttttgttaaggagatttggttttttttttatttaagggtttttgggttggtaaattggtgtaagtgtgtgaattgattgaggggttgtgattttttgtttttagggtgtaagttgggtttttgttttttttatttagaatttttttatttatatagattaagtaagggtttagtagatgtttgtttatgttatttttaggaatgttatgaggatagggttggaagtgggggaaatgaagtgttagtttgtgtatggatataaagaaagtgagatgatggaattgaagatgattaagatgtggggagttaggattagtggtttttattggtaggtggttttttaattggtaatgttagggagaagtgtataaatttttaatttaatatattgtatttaatatattgttagtggtggagggagaggtagagtttggtttgaaatggtgggggattttttaaggtggtatggatatataggatggaaatgggagatgtgttaggtttggagatatgggttttggaataatttgtattaaaattggaaggattagagagagtaggtgagatttttgagatagaggaaatagagtgaggaagttaagatttaggttggggtaaatgtttgaatttatttgagtgggggaagatagagaagttggtatgttggatagagatgattggttattaagatagaaggaagaattaggttgtttaataggattaagagggtttagtgtttaaagagagatttttttaattgttataggaaagtaaaatgttatggttttagatatttgttgaaattggtgtatgatttttttaaagatagtgtttttttaaaaatttgggaaaagaagagtttttggtgtggtggagggtggtagtagggatagttgggagtgaagttgtgtagttaggaagaaattatttagtttgaggaagttaaagatatggggaggagatatagtgtagattaaaggagtagttaagttaaaggtaatttttttttaggattttggggttttaagtaaatttgtgggtagtgaatatgttggaagtgtttggattgtttaggtggagaataggtagtataagggatgaaaagtaaatgtttagatggtgattagtggaggttttgggggtggaagattttagggtttatttttgtggttattattttagtgagggggttagtgtggattttaggtttaaggaagaataatattttattttttataaaatagtgtatgaaagattagttttgagtttttataattttattattggttttaaattttaattttatattatattttttaagtatattttgttaaaatttttttaatttataatattttaattagtaatgagtttttatttatatgtttatgagtatatatattaatttaaaaatttgtattgtttttgtatgaatgaaatataaagaaattgaatttttaatgaatgaaagatgttggatgaaaagataatattttatttgagttttagtttagttatatgtttgagaatgagtttatttagtttataagttttttgttttttttttagtttttttttttttattgttatttataggttttttaaagatttttttatttatttttgtaggattttgttaaataatgttggttgtttgtagtttagttttattttggagatgtggttttttttggtagttttggtgatttatattttggattttatttattattttattgttttgtgatttatttttgatttttttagtttttttttttattttattttatttaagtttaaatagtaagttttatgtttaaattttgttttgtttttgttttttgttttgaatttgtttatttgtttttttgtagtttttatttttttttatttttttttttttatttttttttttttttttttttttttttttgagatagagttttattttgttatttaggttggagtgtagtggtgtgattttggtttattgtaattattattttttgggttttagtgatttttttgagtagttgggattataggtgggtattattatatttagttaatttttgtatttttagtagagatgggattttattatgttggttaggttggttttaaatttttgattttaagtgatttgtttgttttagttttttaaggtgttgggattttaggtgtgatttattgtgtttggttatatttatttttatttttttaaagattgtagaaatttgttatttgagagaggttggttttgtttttttttgatttaaatttttttttggttttttaagtttatgaaaatttttatgtgatatttttttatttgtagttttaagttatttatatatttttaagtttttatttttaaatttttattgatttttttttgtaggtgtattgttattttggtaatttaatattgtttgtattttattttggtgtatgggtggggggttttggttttgatttagttttttagatatatatagtgaaataaataggtatttgatgatagtatgtgttgttgttgtgtagtttttttgtttttgaatagtaaatattattggatttggtattgttttattgtggttgtaagttgtgttttattatagttaatgttagtgtagaggagttatgttatgtaaaggttttttgtggtagtattagtttgaagttttttagttatgaaaattagggaatatgttattgatgattgttttggttttggtataggttttattaaaatgtaattaggttttgttagaaatgtagttatgtgattttttttttttttgagggaggatggtgtttatgaatgtaatggtagtatatgatatttttagttgtttttaattatgtggttttaaaaatattttatttaggttaggtgtggtggtttatgtttgtaattttagtattttgggaggttgaggtaggtggattataaggttaggagtttgagattattttggttaatatggtgaaattttgtttttattaaaaatataaaaattagttgggtgtggtggtgggtgtttgtagttttagttatttgggaggttgaggtgagatagaattgtttgaatttaggaggtagaggttgtagtgagttaagagtatgttattgtattttagtttgggtgatagagtgagattttgttttaaataaataaataaataataataataaaaaaaatataaaaaaattttatttagtagttttgaaaattttaagttttttttaaagaagggaggtaaggaaggaaattatgatgtatttaatagttatgtgaagtagatagttttattttagagattagaaaattaagggtagagagtgagtattataataggtggttataagttatagtgggaatttagggagtttaggttaggattttaagtttttttaaataaaagttgttattttggttgggtgtggtggtttataattgtaattttagtattttgggagatttaggtgggtggattatgaggttaggagtttgagagtagtttggttaatatggtgaaattttgtttttattaaaaatataaaaaattagttagttatagtggtatatgtttgtagttttagttatttaggaggttgaggtaggagaattatttgaatttagaaggtggaggttgtagtgagttgagattatattgttgtattttagtttgggtaatggagtgagattttgttttaaaaaataaaaaaaaagttgttatttttatataaaggatgaaaaagtaggaaagagattgtaggaaaggaatgtgagagaggaaaaatataaagaaattttaaatttgtgaatatattttttttttaatttatgtgttgtttatgattaggattaagtgttgaagttagaggtgatttaaatttttaggagtagaggaggatagaggtaggtaggtaggttgatttttgttggttttttgtgttatttttgtttttataattttttttatataggttggttttagattttttaataaaaatgtatgttaaaattgtaaaaataataaaatatgtaaattttttttatttgtagttaattgttattatgtaggtattttttttggtaaatatttaaatgttattagtattatgtgtttaatattattttagttaatatgatttgtgttaaaattgtttgaatttagtgattgttggattttattattattaatgtaggtttttatattatattttttattgttgatgaatttataagaaagattttatattttaagaattagtatttttttagaaaaggaagaaaaaaagtagtttttagtaaaagataaattatagagtaattgggtttagatgagttgtatatattaaattatatatatatatatatataaatatatatatatatatatatatatatatatattatgaaaatgatgttgaggtattgtttaatttataaatgtgagtaagtttataatttaggagttaaaatgagaattttatttatgattttttttggtattgagaatgtattgaagaatgatgaaattatattttagattattttatttgtttttttgatagttttgtggattattattatatagaggttttttgtttggtgagattttgattatttgatatttttttttagagtgggttggttagagtttttttgatggtagaatttatagggtttattttaatgtataaggaagttttaggtttttagggatttttaggttttaaaaaatagtgttagataaagaaattaagagggggttgggagaagtattttgttaaatagaaagtttatttatagaaaatttagggatgaatagagttaagatgggttgatgattttgaagttgtagttaaaatgatgaggttaggtgggtttgttggttaagaaatgtaattttaagagtgggttatggttgtgatgtttaagtttttttgtgataaagttaagaaatatgggagaaatggaagggagaggggtagaatagataaggaagatgggaagtaagaaggataggaagtgttagtagatattagtagtagggatgagtgtagaaagtgttagataatttatgaattggaggaggatatttagtgaggagggaaaagggattggattgtgttattatttttgtaggggaggtgagataaatgtttggtgtagtttggaagatggtttggaaggtttaatttttttatttgtttgatttttgatattatgatatatatagttatttttaaagtgtttaaaatataaattatatttatgggaatttgaagttaggttttattttgatatttatttatttgtgtatttttaaggttgatttaaatgttgaaaagttatttgtgatgtgttgtattatttgagtttttgataaaaattataaagaagtaaattaaattaggagggaaatttttagttgttatattaattaaaaattgttgggtaataaaaaaaaaaattatgttaaaaataaaattatattttgggttttaaggtttatttttttttttttttatttatttatttatttatttatttatttttgagatatatgtttattttgttatttaggttggagtggagtggtatgattttggtttattgtaatttttgttttttggttttaagtgttttttatgttttagttttttaagtagttgggattataggtatgtgttattatgtttagttaatttttgtatttttagtaaatggggttttattatgttggttaggttggttttaaatttttgattttaagtgatttatttgtttttgttttttaaaatgttgggattatagatgtgagttagtgtgtttggttttttaaggtttatttttataaataatatttttttagaatttaattttagaaagtgataattattttttaatgaatttttttttatatatattattgtgatggttatattattgttttatatttgttttgatgttttggattttaaatggataaggtattttatttttttttgtaatttagaggtattgttttttggtaagatatagaaagatttgttggtagaaatatgaattattatgttatttagaaagtaatttggaaatgtttattttaatttaaaaatttattttttttttaattaagttattttatgttttgtaagtatagaaatgtttattatagtattatttgttatagttatatttaataatttatgttatagttaattaaggaatagtatgtagttatgaaaaaataaaagagggattttagtaatttattattgttaaatgagaaaaagaaagatgtataaagggatatatgatatgatttgatttgtataaaaaataattataatatatatttgtgattataaaatatttggtaagattgtagaagtataaagtatggaaggatatagataaggttgatgttattggtaatttagaagagaggaattagagtggaaggagggaagggaatgagaggaaaaaagtaaataagtgaaaaatgaaagtaagtgtttatgataagaattgtatgggtgtttttattttatttatgggaaattatgtgtgtggaggtgatataaatatatggtggtgagatggtttttaaaatattaatggtttttattttagggtggtgagattttttttaataaggtgaaatgtttttaaaaataatttttattttattttttttataggtattattggaaatatgtataattatatgaattatttatataattagaaaaaatttattgagagagaaatatgaaaagttttatgttaggtaatgtatgtttttagaggaggtgtaagtagggagatgaggttgtaaagttaatttagaatttgattaggagggttttaagtgttaggtaaagataggagtttattaatatattaataatagggttgtggttttgtttgtttgtttgtttttggtggtgggttatgagtgattttttttttttttgtttgtttttttttattttttggatttttttgtaaaaattttattttgtttttgtaattagaataaaaatattatgtaaaaaataatatagtggaagtggaagtggataattattaaagtgttgatttttagtaaaagaaatgaaaatttatttatgaattagtaatgttaaggtgagttagtaaggattttagataaagaagaaatagtgaatattgaaaggaatataggaggttttaaatgttttttaaaaaaaaaaaaaaaaagaatgagtgaaattttgtttaggaagaattgttaaggtttagtggttttttgtaaagtttatattgatgtttgtaaaaatatatttaattaaatgttaaagttggttgataggatttaaaaattatagagaattgtaattgttttagagattggtttatttttattattaagtttttaagtatagttatattttggaatttatattaaggaaaggtataatattaagggaaaaggtaatagaagtgatagaaattatagaagtggaagatattgtgttaagatgatgtaaagagtttttttttgtataggagagatgtgtattattgaaagtattgttttaaagaaatattgggattttgtatattaaaaaaagattttaatgtgattttggtttgatttgttttgtagtgtagttaatataataaatttatgatttatgttaggataaattaatttaaaagtttttatttaattgtggtttttttttttttaatagttggtatattttgagaattgttttttgttagatatatttagggggaggatggtggtattatgttgaagaaggtggtagtaggaggtttttaaaagaattttttagttttaagattttttgatttgagatgagatgttatgttaattattagattttatgtttttttttttttagatgttttaattgaggtagtttagtaaataaattgtgtttatgttttttagtatttttgaagtagatgtaatataattgaaggtaaataattttagtaatgtaatttatgtattgttatttaaatattatgttattatgaaattgaaatgtttattaaataattaaagtttaagataaagaaattgaaaggtattttgtaaggtaaagtattagttagtatttttaataaaataatttattgagagttattttggagtggtttgttagaaaaagttaatgtgatttggtttttaattattaaaaggattgttttgttgttatttttaatggttaggaaaaaaatgaggagaaattgggtttgtttttatagagtagtagggtttttttaatagagttttaggataggttggttagaaggtaagtaatgttttttttttaatgatttttaatagtttatttatattttttaaaagtattaaattttgttttgataatttggtaagtgttgattgttaaatgataggttttttttttatgatgttgtgaaataagagtgattattttttgagtttagttttagtttttttattaattggttatgtgtttgtgggtaaatggttttattagtgttgagttttagtttttttaagtaaaatgttaaggttagataaagtgatttttagaaattttttgatttttggtaatttatgattttttataattaattttaggttttgtttattatgttttaggtttaatataaaattagatgttgagtgtttattttaagtaaaatggtaaataataggttagttttatgggttttttgtattatgaagatgtgaaatttttaagaaaatgttatagagttgagtttagaaaaatagaagaatggaaaaaaggaaggaagggagggatagagggaaggatagaaagataggttttagaatatgtagaaattgtttttaaggttagttagtatttttttttttttttgtattggtggtgtgtttttttttgtttttttttttgtttttataatttttatttttataatttttagtatggtttttttattaatttaattttttttttttttttaaatgtggtttaagtttatgttttttttgtttgatattagtaagttttgattttttgttttttttgagtttttttttggtgtgttatttaattaatatgaaattagtagtaagtttattggtaggaatagtttaggaaaaatgtttattagattttttaaaatttttaatgtttttttttattggggtatagtagagaggtagagagaagggaaaagtttttttttttttttttttttttttttttgtttttttttttttttttttaatttaatgtttattgaatattttttttatgtaaagtattgtttaaagtttttttatatattattttattttatttttttataatttttttggaaatttagagttttggttaattaaattttgattttttttgtgtttttttattattatttatttatttttttttatttattttatttatttattttattttttatttatttttattttttagttatttttattttttatttattttattttttatttatttttattttttatttttttttattttttatttatttttattttttatttatttttttttatttatttttattttttatttatttttatttatttatttttttttatttatttttatttattttgttttttgggattgtgtttggttgttttttttattttggttttttttttaattaattgttaattttgaattttatttttggtttttttttttttttttgtttttatattttttttgaatatttaagtttttttttaattggtttttttgtaattaggtttttattttaaagtatgagttggttgatattattgtatttatttaatattttatgtgattttattttttatataatataatttgagttttattatttgatattaaaggatttttaatttttttaaattaatattattaaattttattttttgaatatattaggttttttttgattttttaaatatggtttgtaattttatttttgtaggtttttgtttgtgttgtttttattatgtggaatagtttttttttattttagttttagagaaaaattttattttttaaatttagtttaagtgttattttatttttttaagttaaaagtgattgtttttttttttgaattttttaaattttagtggtttatggttttaaagttgtttttaggttataaagttttggagggtagggattttttttatttttttttgtattttaatattatgtattaattatagtagaattttttttttttttttttttttttgagatggatttttgttttgttgtttagggtagaatatagtggtataattttagtttattgtaatttttgtttttttggtttaagtaatttttttgttttagtttttttatgtagtattttttaagtgtaagtagaaatgaagttgttaattttgataattaatttattagttattattgttttttaagtgtgtttttgaatttaaaatttataagtattgatgagggtttattatgtataaagtattttggtaggagatgtaagggtaagtgagtttaggaataatgatgtttataatgagttattttaaagatttattttattttattatgttaggttattaaatatattattattatgaatatataatttagtttggggattattaattttttagaagttttttttttttattgaatatattagtggtaaaatttgtatgttttaaaatgtatttaagaaaagtaggtttagaattttagaaattggggtttttatttttttttagaagatagagtggttgataaagaagaatgaaggtatttgttatttagtagtattaatttttaaatttataatttagtttaattttagttataatgtgtatttggagttatggaagtagttgaaaaaataagaatgtttggaaaaattaaaaattttattatttgtaaagttgggtttgtggatgaaaatttttgtaagggatgataattttttgtttgaaagattggtattaagagtagttgtgtaaatagttttgatgagtttaaggtgatttagaatataagttgattgtttgttttagtatgttagggaaagttttaatttatatttgttgtttttgtataattattattattgtttttttttattttgaaaattgttttagtttgtatgaaaaattttataattattgtattagtgttattgttagatattagtagtttttttatataatattggtggtttgtataggtttattagggagtagagaaatggggtagaatttaggttttttgatattaaatttaggttttatttaaaagaatatattttttttaggttttttgttattaatttatttataggaaaatattttggaaaatggtaaagatatataagttatggtttttgtaagttagtatttataattttggggagatgaagtatatatatatttaataattaaagaggattagatgaatttattatatggtgttaatgatatggtttaaatgataattttaaaaggagttagaaaaggtgaaaaattttttaagagttttagattttagggaaggtttttggtaggtgatggattttgaaagatgtttttaaggagaaaaaaaaaaaggtgtttttttttgaaaaaataaaggtagaaaaataaataaattggtatagtaataagttatttaaataatttaataagtattattattttgtatttaagaagagaaaaatataatagtaagttaagataaatataaatggtatatgtggtttttttaaaatgttttagtgatttaaggtttaataagtattggattttggtgttttgataatttggtaagtgttgttagatgtttttttttgtgatgttgtgagataaaagtgattattttttgaggttagttttattttttttattaattggttatgtgtttgtgggtaagtggttttattagtgttgaggtttagtttttttaagtaaaatgttagggttggataatggatttttaaatgttttttgatttttggtaatttatgattttttataattaattttaggtttgtttagtatgttttaggtttaatataaaattagatgtgagtgtttatttttagtaaaatggtaaataataggttaattatatgggtttttttttattataaggatgtgaaatttttaagaaaatattatagagttaagtttgggggaaaaaaagggaaaaaaggaaggaaaagggggatagaggaagggagagaaatagaggttttagaaataaagataaaattgaagttagagtttttatgtaaggttgattatatagtgtttaaggaagttttagatttttgtaaatgtttttgaagttttgggaatagtggtgagattttaatgtttatgtagggatatgattttggttttgtatgaggtagtggggttagaattgagttttttttttaaattttaaagttttaaaaagttattttaattatgaaaaggtggattaaagtattttgtttattgttttagagataaagagtagaatatttttttgtatttttagtttaggatatttttgggaaattagaattttaagtatgaattatttttagttgtaagattggaatttatattatttgtgtatttgagtaggggaattttatgataataaattaatataaatatagttttaggattattgaaagtttttagatttttagaaaagataaatatatgtttattatgtagaaatgattttataatttaggatttataagatttttatagaaaagaggttgggtatggtagtatatgtttgtaattttagtatttttggaggttgaggtaggtagattatttgaggttaggagtttaaaattagtttggttaataaggttaaattttattttaatataaaaattagttaggtatattggtatatgtttgtagttttagttattagggagattgaggtaggagtaatatttgaatttgggaggtagaggttttagtgagttgagattgtattattgtattttagtttgggtaattaagtgagattttattttaaaaaaaaaaaaaaagaaaaagaaaaaagaaagaaagaaagaaaaaagaaataaagaaaaggaaaaatatttgaggttgaattgttagtattattttttaatatatatataaataaattgttatgagggatagtgataaagggaaaaaaaaaattttaaattttaagaattggaaagatataattttaaatggagtataaaataagattgtttaaaaatattatagtgataaagattaaaagttataaggagaaaattaggattatatgaaaaaaagagaataagtagatttgaaaaaataaagtagaatttttagtaattatttaatggaaaggttagatagtagagtaatataaaataggttattagtgaattggaagatagttttgagaaaattaaattaaaatgtaatataggatttttaagtaaaaatggagaattgaatatattgtatttaatatggtttttatttgaaatgttattgtaatgagggaagatgattttttaaaagatataaaattattaggataataggagaggagattttaaatattttttgatttttggtaatttatgatttttttataattaattttaggattgtttagtatgttgtaggtttaataagtaataagattttagaaataatagtaataagattttagaagatggaaagtagatggagaagtagtgatagaattaatagataaaggaagttgaatttttagtgaggagtaggaaagttaggaataattagtggattttttaaaggtttaggaatagatagtattggtgatttttggaattgtgtggaagggagatgagttattaaaataagaagaatagggtagggtgtggtggtttatgtttgtaattttagtattttgggaggttaatgtgggtggattatgaggttaggagattgagattattttggttaataggtgaaattttgtttttattaaaaatagaaaaagttagttgggtgtggtggtgggtatttgtagttttagttatttgggaggttgaggtaggagtatggtgtgaatttgggaggtggagtttgtagtgagttaagatggtgttattgtattttagtttgggtgatagagtaagattttgttttaaaaaaaaaaaataaataaagaagaatgtgagggaaattgtttaagaattagttagatttttggattttttttttgaatttattttgttaggtagtagtttttattataattgttaatattggaggtttgaattttgggagaggattttggaattgggagatgttatatattaaataaaaggaaatatgtatgttgaaggttgaattttttagttttattttttattttagtttttagtttgggataggtagggtggtattttgtagttaggagtttggaagagtgttttttggagaatttgattattttttggtttttttattaggagattttaggagttgttagtattaggagttttttaatttatgatagaaatattttattttatagtgatgtttagagttgataagttttttatgtatttttagagtttttaatatatttgttatttatttttaaatatggttagataattaggattgtttgatatgtaaggaaagtttttataggaaagatagagtttaaaataaatagattgaaaaagataatatggaggagatagagattaggagaggtaaagataatttttgaaaagaaaaaaaaatgtagaaaattaagagaatgatatatattttgaaaatagaatagaatgtttaaaaaattatttatagatgaaaagaggaaatttaagatggtaatagaaatgaatttaatagatgggttggaaattgaagttaaagaaattgtataaaaagagtgaaaaaagataaagagatggaaaataggtgagaaaatatgaaaaaattataaaattgtttaggaagtttaatttttaaataatagaagttttggaaagaaagagtagtttatagagagaatatagttttgatagattgaaagattataatgattattgagtataataggtgaaaatagatttataattagaatagttattgtgaaatttagaatatagggggataggaaaaattagaggttttaggggaaaagaaaaataaggtaaggtatagaatattaagaattagaatagtggtagttttttgatagtaatattgggagattgtgtgtaataaagtaatatttttaaatttttggggaaaattgttttttaatttggatttttttgtataagatagataagttattatgtgatataatagaatgaagataattttagatatgtgaagtgtgaatgtgttttttagggatttattttttataggttattgtaagttgggagttatagaaatgagagagtgtaaagggagttttatgagaattaatataggattataatagagggatgatggtattgaagtgagatattttaggatgatgattggtttagttataggattagttatttagatagggttagtagattaagagtaaggtatatgaaggttgttattattgtattaggttttaattttgatagttgttggaggttgtgtttttttaaataatggggtaaaataagagagagaatttaatatagaagaaaaggtaaagggaagttttagaataatagtgaagataaattttaggatgttagttatttagtaggttgagagagaagtttagttagaaggaaaatgtaggtttttagtagagatattattaagaaaagaaggagaattgatagattattaatgtgattagttttgtggaaaaaggtattgtgagtttatggaagatagaggaaaagtttgtattaggtataaagattaattaaggatatgaaaaaaagatagatattaattttattgttaaaggtttagttgttaatgttatttattttgataaaatagtgaaaatattaggggttgatttatttttaaattgtaatataattatattgggagaaagaggggagaggaagttgtggatatgattatattagataggtaaatttttatttattataatataaggttaagatatatataaaattgatgaaataaaagataatagtatatatattatttagaaatgtagagatatatatatgttagaagaaaaagttaaaatatataaagttatattttttgagaatagggattggggtaagtaaagtggtattgaattggtttttatagaaattaaggaattagtatataagtaaatatgtataaggatgtttatggttataatgtttgtggtgatgaagtaggattatttttttgaatgttttatgggtgggaattggagtgtatgggtgttggaatttgttagttattttggtattggtaggggtgaattttatttatgaagatatgttgtattttattttttatggaggtggagtatgtaggtgagtagatgtaggagttaggtgagtgttttttgggtgttggaaggagtgaattttatattagttttatagtagtgtttggagtagtgtttgtaatttttgaagtttaagaggataggttatagtatttttttagttttgttatttatggatgttttaagtgttaatagtttagtgggggtggttagtgtgatatagtattttatatttgtattgtggtatttaagtttttgtttggtgtttaggagaaatgaggttgtataaataaattgaagatggtaaatatagaggattttattgttaatgaaagtggtttttagtaggaaggggagttgaaaaggggatggggatggaaggtaatttttttttgaagtttagttatttttggttaaatttttgtttgaagttatattgttaaattgtttttttgaatttaagttatttttttttaatgtttaattgtagtttttaatatttagttgttttttttttttttgttagtggagttagggattttttatgggtttaggatgggaggtagggtaggttatgggtggttttggaaaaggtaatatttgagtgggaaaatagggatgtaaattttttttttggattatggtattaggttttttagtttgagggtggggtttttattgggatttatttttttttgtttagaatttttttgttttttgtttttattagtgatataaaattgaaaataatttgaatgtttattaatagggagaaggttgaataaattataatatagttataatatggaattttatttagttatttttaaaaatgaattaaatttgtatttatttatttggagattattttttatgtattattaagagagaaaaataagttgtgaaaaaatatatgttgtatgattggattttttttgtaaataatagtaataaaatatttttatttaagatatatatgaatatatatgtgtatgtgtttataggagtttggagaaatatgtagaagaatgtatattaagtgttaatattggttattttggagggataggaataaaaaaggtagggagatgttaaagaaaaaaatagaatataaaaaagagagatatgagaaatttgaaaaatatatttagagatatgaaaaagagaataataaggtttaatatatatataaaagaggatttagatagataaatagaggattgaggagagaaaatatttagagattaggataaaattttttagaattggtgaatgttaggaatttttagttttgaattttaagtaggattgtggtgaaattgtagattattaaagataaaaataaaaaaaaattttaaagtaatatgagagagagagagagaattttttaaataaatgatagtttgaagtagattatattttattaattatataaattaaaaggtaatgaaataatatatttaaatgttgagggaagatatttatgtaaaattttatatttagaaaaattattatttaagattaagagtgaattaaagatatttttagttagagattgagatgttttaatatttttaaatttttaatgaaatagttatttaaggatgtattttagtaagaaggaatttgaattgggattataggtgtatgttatgtttggttaattttttgtatttttggtagagatgtggttttattgtattgtttaggttagttttaaaatttttggatttaagtaatttgtttgttttagttttttaaagtgttgggattataggtgttagttattatgtttagtttttaaatataatttttaatgtttgagggtaataattgttaaaataataggataaaatgtatatattataaattagtggaaaatagtgtaagaaaaagttaagtaatttaatgtgaggtagaataagaagaaaaaataagtaaagaagtagtatggtatatagaaaatatttaggtttttagtgaattttaaatatatgagtaattataataaatataaatgattttaatttgttagaagatagaaaattttagattggattttttaaaattttagttttttataagaaagaagtttaaaatataaggattaatataaaggaagagaaagtaatattatagggaaatgtttataagaatttggtatagttattagataaattagtttgggttgttatattaaaatgttatagattaggtgttttaaatagtagaagtttattttttatagttttggaggttggtaagtttaaaattaaggtgttggttgattttatttttggtgaggtttttttttttggtttatagatggttgtttttttgttgtgtttttatatggtttttttttaggtgtatatatagaaagaaaaatttttttttttttttttttaaaagattattaatgttattgtgagggttttgttgttttgatttaatgatatgggaagagaatattttatttaataagtatggaatatatagtagagaatgtaattttaattattttttaaaggttttatttttaaatattattatattagaggttggagtttttgtgtatgaattttggtgggatataaatatttagtttatataagtaatataaatattaggtggtttttttaggtttttgtttaagtgttaattaatttaagagttgtttatgattatatgatatagaatagtataattttatattttttagtataattttatttattttattttgttttatttttttttatagtattatattatttgataaattatatattttgtttgtttattatttgtgatttttaaataaaatataagattttttagatttaagagagtagggatttttttatttgtttattattgtatttttagtgtttaggatattttttaaaaataataaatgtttaataaatgtttattttaattgaattagtgaatgaataaatgaatggatttgataaaatagattttatagttaaaagtaatttttttttttttttgagatagaattttgttttgttgtttagttggagtgtagtggtatgatttttgtttattgtaatttttgttttttgggtttaagtaatttttgtgttttagttttttgagtagttgggattataggtatgtgttattaggtttaattggttttttgtatttttagtggagataaggttttgttatgttggtgaggatggtttttaatttttgattttgagtgatttgtttgtttttgttttttaaagtgttgggattataggtatgagttattatgtttggtttatagttaaaagtattttgagggataaagaggattatttgttaatatgaagatatatttattagaatttttttgtatgttttatgatgtagtgttaaatatttatagtaaaaattgaattaattataagaaagtaataatttaaaattatagtgggagattttatttatttatttatttatattttattttttatgtttttattgaatttaatatattaaaaatagaagaaaattattttatatgtatttaatttattattttaaaaattgaggtatttaatgaaaatgttaaaaatatgtaagaaaatagaatataggaaagtggtatttaggtggtgtgattgtgtgtttttgtatttagaatgaagttttttgttattaattgatatatttgagtatttgtttttttgaattttatattgaaatataatttttaatgttgaaggaggaggtgattggattatgggtttggattttttatgaatggtttagtattatttttttggtgttttttttgtgatagtgagtttttatgatatttagttgttttaaagtgtttggtattttttttgtttttttttttttattttttttttggttatgtgatgtgtttgtatttattttattttttgttatgagtaaaagttttttgtggtttttttagaagttgagtagattttggtattatgattgtatagtttgtagaattgtaagttaattaaattttttttgtttataaattatttagtttttggtgtttttttatggtaatgtaagaattttttggtttatttttgtttagttaaaatgttatatttatgaggattttttttatttttttgtaaggatgggtgttttggatatgttgttttatttattatatttgtgattttttaatatatatgatttgttagaagtatatagtgggagatttttagtatatatttttatgaaattgatagtttaagttttttttttaaaaaagggaaaagatttaatattgaaataaggtattatataagttttagttaatgatatgggaagagaattttttatttaataaatagagaatgtatatgaaatgtttataaaaattgaataggttttaggttatagaataaataataaattttaaagaattgttattatatagattatattttttaattaaaatataataaaaaaattgagatagataaaattataatttttaaatttaagtatattttgaaattttagaagtatattgttaaattattaatatgaaattaaaatgaaagtaaaatatatttaggattgaataattgaagttttaaattttagttgaagaaaatgtttagtattgaatttaatattagtaaataagaaaaattttaagaaagttagagaaagggtaataatgtaaatttaaaaataatagaagaaaattttttttttatatatggttaaagtagtaggaaggtaataataaagataataaattaatagaattaaaatagaaataatagagaatagaaataaaatagaggttgattttttaaaaagattaataaaataggtaaatatttgataagattgagtaaggaaaaagaaagagtataaataaatattattaggtataaaatgggttataattaaatagagtaaagattttaaagtatgagaatttttttttgtattttaaagtaataaatttaaaaatagataaaatggaaaattttttagaaaaatatgttattaaagttgatatataaaaatatggaaaaagaataaagaattttgaatgtatttttatgagtttagtttaaatttatattgtagaaaaatattaagataatataaaaaaaggtaagtattggttaattttagttaaagtattaatgtaaaaaatttgaaaaaaaaaattagtaaaaattttagtagtatagtgtgtgtataaatatatagtatttttttaatatatatatttgagattatatttattaaaatattatgtttattatataataaatatatggaatgtgtgtgagatgatttagtaggttttattttagaagtttaagtaagagttaatattagaaaattttaatgtaattttttatattggtaaattaggaaggaaaaattatataattattttaatagatgtagaaaaattatttaataaatttaatttttatttataatttaaaaataaaataaaatatttagttaatagaaatagaaggaagttttttttaagaatttataagaaattttaggaatattttttttaaaattagtaattagataaatatgtttttttttttattattttatttattattgtatgagatattttgttgatgtaataaagtaagaaaaaggagtaagaaaattagaattagaaatgaagggggaatatgtggtattatttgtaaatgataagattgtttatatagataatttatgagaaattatgaataattataagaaataagagggtttggtagggatgttggagataagattaatatataaatatttatggtattagtaataattaattagaaaatgtaatttttataagatgttattagtaatagagattttatatttgtgaggtatttaggaataaatttaaagaaagaggtgtaaggtttatatggaaaaaaaaattataaaattttattgaaatttataagatttaaataaatagagatatattttatgtttaggagtgagaagattttataattttaatattaaattttttaaaattaatatataaattgaatgaaatttatataaaaattttagaaaggttttttttatggatatttgtaattggttttaaaattgtggtttaaaagtagttaagataattttgaaaaagaataatatggggatttgttttattagatattaagatatatataatatatttaattatgttataaaattaagatattatagtattggtgtaaatatagataattagattaatgtaatagagagagttttatatatgtgggaatttggtatgtgatagagatagtattataaattatggggaaaataaaaattaaattaataggtggtttgtagataattgttatttatatggagaaaaaaaatagattattaatttatattatatttaaaaatgaattttaagagaattatagttaattttaaaatatttaggaaaaaatgttttttagatattatttttatggttttaagtgagggattgataaaaaaaaatataaattataaagtaaaaaagaagaagaaggaaagaagataaaattgagaaatttgatgttaaatattttgtgatgaaggatgttaaaaaataatgtttaaaggtaataaatagttttggagagagaaaatttttgtaagtatttataatatttagtgaatatttagtattttataaggaaaaaataatttattataaaaaagtgagtaaagtttagagttaggtaatataaagagaaagaaaaaaattttaaatgatgaaaaattgtaggaaaaattaatattaaatatataattttataagtaattagagaaatataaattaagataattaaatatttttttaatatattagattagtaaattttaaaagtttaataatgttaagagtgggagaagatgtagaataataagaattgtatatattgttgttgaaagtaaattgagagtaatttggtaatgtttattaatttttatgatgtttgtattttaagatttagtaattttattttttttgtatttttgaaaagtttaataaatttatatggaaataagtttagagaaggttataatagaattgtttataaaatgataatttggaaatattagttagggagtggatatattatgatatatttatagaaagaaattggtttatgtttgagtttttttaggttgttataatataaatattatagattgggtgatttatgtaatatttattttttagttttgaaggatggaattttagattaaggagttagtagatgtggtggtgtggatttattttttggtttatagaggatttttttattgtgtttttatatagtgaaggggtaagagagttttgtggggttttttttagaagggtattaaatttatttatgagggttttatttttgtgatttaattatttttaaaattttgttttttaatagtattgtatttgggattaggattttagtatatgaattttgtagggaaagaaatatttagtttataataatataatagttaaaggaattagttttatatatattaattaggataaattttagaaatataattttaagtgataaagtaagttttagaaagatggattattgataatattattatttgttttttaaatttgtaaaatgatattagttattgtttatgatagtggtttttaatttttttggtattggtttaatagaagatagtttttttatagatgggggtgggggatggttttaggatgatttaagtatattatatttattattagatttttataaggagtgagtaattaagattttttgggtgtatagtttataatagggttgtgtttttatgagaatttaatgttgtggttgatttgataggaggtggggtttaggtggttatgttggtttttttgtagtttattttttgtggtgttgttaggtttttaataggttatggatttgtattggtttatggtttgggggttggggatttttggtttatgatatataattatatagtaaaatgtaataggtatgtaatagtgtaatttttaaagagtgtttattgttgggaaagttgtggaagaatgttgttagtttggggttataaaagaggtttaaattataatattttttgttaaaaaatatttttaaaatgtggttaatgttaatatttattaaatttgagttggggtatttgattgtttgttatattattttttgtaaattttgtattttaaatattaaatagtttataatttttaaagttattgtttaaaagggtatatatgatttttttttgtatatttttttaatatttttttttttttttaaaatttaattttattttattttaagtattgggatatatttgtaggatgtgtaggttagttatataggtaaatgtgtgttatggtggtttgttgtatttattaatttattatttaggtattaagttttgtatgtattagttatttattttgatgttttttttttttttgttttttttaataggttttagtgtgtgttgtttttttttttgtattaatgtgtttttattgtttagtttttatttataagtgagaatatgtagtatttggttttttgtttttgtgttagtttgttgaggataatggtttttagttttatttatgtttttgtaaaggatatgattttatttttttttatggttgtgtagtattttatggtgtatatgtattatattttttttatttagtttattattgattatttttttaatattttaatttaggtatatagttgtgttggtagtttgggatttgaggaatagtttttgttttaatattattatgttgagtgattttgagtaaattagtgaatttttttgggttttatttgtgtgtttatttgtaaaatggggatatttatagtagttatgatttagaggtagtggttaagtgtatgggttttggaatttgatttggatttgatttttagttttgttatttattagttgtgagattttagttaatttatttaaattttttaagatgtattatttttatttaaaaatgtaaatagagatagtatttagtttatagattttttatgagaataaaataaaaggaataatgaaaattttttagtagattattattaataaaataaaattataaaattaagagaagatatttgttgtgtatataatggataagggagtggtgttaagtatatattatatattttaataagttaataaagaaataatgaattaatagaaaaatgggttaaggaaagaaagagataatttatggaggaaattttgattatttggtatgtaaatgaaaatatgtttaattttattggtaattaggaaattgtaattgaaatttgaaataattattagattggtaaaggaaaaaaatttttaaatatgattttaataagtattgaagagaatattgagtattaggaatttttagattttgttgttgagaaggggtttgtattttggagagtaatttggtaatatttagggaagatgatgtgttaatttattattttgttattggttatatatttaagagaaattattaggtatggtgtgtaaagaatatattaaaaagttagatatatttgtagtatttttttaaaggatattttaaaattagaaataatttttatgttttttatttgataattataatatagtatggaaaatgtatagaggtttatgttttgtaatggataaattttataaatataatgtagaatataaattttatgatattttttatataaagtttaaatatatttaaaaatatatatatatagtttaaggatatatatatgtgaaagataaaattatgtatggttataatgagtattgagtattatatttaaattgatgattgtgatgtttagggaaggaaaaagtgggtggaaatggggaaagtttattttttttttataaaaaagaataaggatatgataaaatagtggtgaatgtatatttatatataattttattttttgtattttttgtttgtttgagattttttataataaaaaaatattgtgtgatgtttaatgtttattattattatgtatggttttattttttatatgtgtgtatttttaaattatatatatatatttttaaatgtatttaaattttatataaaggatattatggagtttgtgttttatatttataagatgatatgatttggttgtgtttttatttaaattttattttgaattgtagtttttataatttttatgtattatgggaggtatttggtgggaggtaattgaattatggaggtgggttttttttaagtttttgtatattgaataagttttataagatttgatggttttataaatgggagtttttttgtatatggtttttttgtttgtttttatgtaagatgtgtttttgttttttttttattttttatagattgtgaggtttttttagttatgtggaattgtgagtttattaaaattttttttttataaattatttagttttgggtatttttttatagtagtatgaaaatagattaatatataatttgttaataaatatttgtttttaggagttttttaaagtaggtaggagagtgttaatatgattatttgatagataatagaggtgtgggataaaaagttgatagagtgggtttgtggtttattgttttataatgttaatgttttatttttgatattatgatgtttattttatttatttagtaatttatttaatatagggaattggaatttgatgtaatttagggtaggtgggtgaagaagataatttttttttttttggaataaattatagtttgaggaatataatgatagaatttgataaaaagggaagaaattagattgttttagttatttgatggttttttaatgaatttgtaatttatttatggagggtttgattatttattgtgtatttgttgaagaggaggaaggggttggaggaagtgagattgatggtttttgttttagtatgattttgtttttttagtattttatttaaattaagaatagggtattgtgttgtgtttaggggtattagttttgagattttgtttgggataggttttttttttgttttgggttttttttgtttaaaattgaggagtagattattattttgaggttagtgaaattttagattttttattttgttttttaggatttttttttttttttttttttaaaatttgaaatgggagtttttgtatttattatttgtatgtggttttgaggtgtatttttggttatattatagttatgtttttttgtttttgggaaatatataaaatgtttagtaatagtttttggtggtggttggtttttataaatgttgttggttggtttttattttatttttatattatgattttttttttagtttggggattgtggtatggaggttgagagaggtttattttaaggaagaagtaagatatatgtattattttatttaaggagtaaataggtgggggggaggtgggtgtggttttgattaattattttttttgaagttgtattatatgtatattttaggttggaaataagaaagaattttttggttgtaggaattgttaaataatagggtggatgattaagggaggttttggaatttttttttgagatttttaaaaatgtgatataagattgtatgtttgagatgattttttgtagttttggttagagatagatggattaggtgttttaatgggtttgattttttttttaaggtatatgattttgttttttgtttttttttatttttagtaatatttttagtgttttttttatatgtttatttttttggtgaagtttatttattgttattttttaggttagtttttatttaatttttagtttttttatatttttttttgttattttatggaaagttggttaaaggttagagttgtttaattttttatatatagtttggtggtagtatttgatatttagataaaatatggtaaggattttaatattagtatattgaagtttaaatattaaatttggatggaaatagagaattagttgttgttaataatttattgtaaatgaaaatatgattttggtaattgattttaaatagttttttttaaaagaatttttggttgtattttattaagaatatagagttttaaaagtgtttattttagggttggattttttttttttttttttttttttggtttaaattttaaatggttaagattttagtttgaataaataatgtgggtggtgatttttttgtgaggtttagtagaggatgtaattatttttttatttggtttaatattaaattatgtgaaattagtttgattattttatataatttttattttgtaatggagggtaatataatatgtattttttttttgttttttagggagaaagaaatgaatttttttaattgggagtgtttaattatgtataaagtttgttgattttataggtggttgttagatgattttgttaaggtttgtgaatggtattttaggaatgtagtgatgtgggtagaaattgagtgagtttatgttattgaatgttttaaatgggattgaattagtagttgtttagaaagattttagtgaaaatagaatttttggataattagtaatttaattttatttaagtattttgaggtttttaaaagtgattgttataaattagaaatttaggaaaaattttataggtatggggtttataataatggggtgaagtaattttgtttgttggttattgttatagttggttggaaatgtatgtatttgtaatgttttgtttttgttttagaggtaatgttttttgatttttttgttattgatattaaaagaaaatgatgaagtaattttatttataaatatatggtggggtttgaaggagtgtgtagagtttatgtttatttatagttttgatataatgtagtttttatatgtgtatgtagtaattatatttatttgttagtaaatgttttgaaatgtgttttttttatgtagagggttgggtttttttttttgggtttagggagtggaagggtattagtaagatgagtgtatggattgtgtgtttttttttgtttttatttggagtatttttatttgtttattgtgaaaggattaggaaatgttgggagatgggttggtatgtgttttttggtaatgagagagtagagtttttggagagttgtgggatggttaattgtgggagttttgttattttgggtaggggagaggtgggggtttgtgaaataggtgggtttggtgttttttataatatttaaattatttgattgggggtttaatattatgtttttttagtagtttttttattaaatatatattttatttatttaaatattatgtttttggttggtaaaattttataggattatattttaaaataaaattttgttgtatttatgttggtatttttattgttatgagtataaagaaagggaggttggaatttagttaataattttgatattttgttggaagtaaaatggaaggggttttttttgagtattttttagattaatttaaaagttttgaatttttttttaaattaattatttaggttttgagtgtataatgtttgtttgtatttaatttgagttaatttaatagatatttggaaaatataaataatggataaggtaattttggtgatataaaaattaggttaggtgtagtgatttatatttgtaattatagttttttgggaggttaagatgagtggattatttgaggttaggagtttgagattagtttggttaatatggtgaaattttgtttttataaaaataaaaaattagttgggtatggtaatgtatgtttgtaattttagttatttgggaggttaaggtaggagaattgtttgaatttgagaggtggaggttgtagtgagttgagattgtgttattgtattttagtttgggagatagagagagattttgttttaaaaaaaaaaaaaaattagaattttttattaggttatattaattttaattgggaggatttgggtagtttttatgtatggaatttttttagggttgggggttgaatttttaaaggggtttaataggttaaagggaaatgggaatttattaaaattttagtttatatttgtatgtattgtggagaagagagagatgtaattgttattgagttttgttattttatggttagggttttataattttattttgattttttgtttgtttgttttaagatagggttttgttgtgttttttaggttggagtgtagtggtataaatttggtttattataattttttttttttgggtttaagtaatttttttattttagatttttaagtagttgggattatagatgtgttattatgtttggttaatttttgtattttttggtagagatggggttttgttattttgtttaggttggttttgaatttttgggtttaagtgatttatttattttggttttttaaagtgttgggattattgttgtgagttattgtatttagtttattttgtttttatagtttatttgatatttgagggtttttttatagaagtttttttttaagatttatagtatttaatattatattgtgaagtgaataattagtaaaaaagaaaaggaattttttttgtttttttattttgataaaggaagtttttttttaaatgtttaaaaattttttataaatatgattatttttatagttataggggaaatatgtttttagataaaggaatttggatataaagtaatattttaaattatttttatttttttggatattataatttataaaattttatgaaggaaattagtttgattttttatgaagttttttattgggaaattattgtgtgttatagttatggaagtaatatttttgtgtattttttaattttttgtttttgttggaggtttttattatttttaaattattatagtaatttagttattttttgtttgtagtatgtgttgtattttgtttggttagaggtaaagatgaatatatgatttgtttttgttatttgagtatataatttgtttttgttatattataagtttttggaaattagagattgatgtatttatttttatattttttagtgttattaatagggttggtgtttattgaaagaatgaataaatgagttagtaaataaatattatgaaaatatttatagtatgggttggaaaatatttttagtgaaaaattagatagtaaatattttaagttatatggtttttattataattatttaattttgatgttgtagtgtgaaagtagatatagataatatatagtaaatgggtatagttatgttttaataaaattttatttataaaagtatgtggtgagtaagatttggtttataggttatagttttttaatttttggtttttggtggttatttttgttgtaaattttagtatattttttatgtttttatatagtgtttgttatttttaataatgagataaagtgtagaaaatataaatgttaaagggttgttttggaattttatagtaataaatttatttaaaaattaattataaagtatatatggaaattagttgatttattaagtatattttatggttatttattttgtatattgtatttttttaaagtgaaaaatttttattttaagaaataagggtagtagttttgttatttatgttattatgattgagataatttgatatgataagattttagagttattgagtgaaaggtttggtgttaggttatgttgaatttgatatttttttgggaaaggggaagaaatgtttttttattttgttgtttagtagattatttggtttttaattttattgttaaaattttttttgaggttattaatgtagaagatattttttttttttgataattttttggaaaatatttagttagaaagagtataatagaattttataagtttagtaaatatatagaaaagttaagagtaattatgagaatttgatgaaaataagatgttttggtttgttattttggtttgatttgagagtgttttatttgttattatttttgttttgttattaggttattttttgtaaaaaatataattttgaaaaggagttggatttgaattgtggttgatattaataggatgtaaagttttaggttaattgtttggtttggaataaatttaattagttttttttaaggtatgaggaaatatataataaataatgtattaatgagtattttggttgatattttgtgagatgggtgattttaaggtgtagatttttaaattgtgttagttatttataggttgtgatgaaatagttttatagattttttttaagaaggaaaaaaaaatgaaatttgagtttttttattatgttaagtttttttttaatattagattaagtaatgggatgaattttgtgttttaagaatatgagaaaatagaggtttggaaatggaaggtgttatgaggtagttaaaagatttgagattatatttattatatttaatttatgtgatatgaggtagattatttgattttaatgttatttgatgttttaatttttaatgtagggttgggaagtatatattattgaggagaaattagggaatatatgatatagagtttaatttattttaataaattttgagattttattgtgtgttagtgttggagagtgtaaaatggttgttagggattttgagtatagtgtaggtgagtattttatggggagagtattatatattgttttatttgtaatattttagtgtttaattattttgagttttttttttttgtttattgaatttttttttttgttagtttattataattttttattattagtttttttttattaaaatatttttttttatttttgttataaaataaggagggtatttttattgttttttagaatagggttgtagtaaataattttatgtatgtgaagtggtatgatttatattagtttaattgatattagataaaattttaaattgttgaaaatgtatgtggtaatgtatataggaattttattgtaatttgggtttggggtaagatgtataaaaataaagataagagtttgaaagagggattaggtggagaagataatgaaagggaatggagaggtgttggaatattgtgaaatgttttaaaaagttgtttatagtaatttaggataaatttttatattttagttatggttgtttttaagtaatatggattgggtaaggtatgttttttaaggtgaaaattattgaatatgaagtgtaaatttattagtatttgtattatttataatagtaaagatatagaaataattttaatgtttattagtgatagattggataaagaaaatttggtatatatatattatggaatgaatatttattatatagttataaaaaagaattagattatgttttttgtaggaatatggatggagttggaggttattattttaagtaaattaatattaggaatagaaaattaaatattgtatgtttttatttattagtgggagttaattgatgagaatatatggatatatataggggaataatatatattaggatttattagaggatgaagggtgggaggagggagaggattaggaaaaataattaatgagtattgggtttaaaatttgggtgataaaataatttgtataataaagttttatgatataagtttatttgtgtaataaatttgtatatgtattgttgaatttaaaataaaagttaaatttaaaaataaaaattaatattaaaaaatttattagtattttattgtgaagtttgtgtagggaggaggggtaatgttttagggtgagggttgaaattttttgtttataatttttttttgtttttattttgggaaattgagtatgggaatttatggagaatatttgatttttattttttttaaaatagttttttaggttgtgtttatagaatataaattaatggtttaagagaaaaaatatgaataagttaagggattaatatgataaatttttaatttaatttaatattgagatagatgtttttaatgttttttgaggttttatgagaatattatttgttttttttttttggtttttaattttattattattgaaaatttttatttgaaatataaaatattggaagagttatttttaagatttttagaagttttgtggttgggtgtagtggtttatgtttgtaattttagtattttgggagattatagtaggtggattatttgaggttaggagtttgagattagtttgtttaatatagtgagattttgtttttattaaaaatataaaaattaggtttggtatagtggtttatgtttgtaattttagtattttgtgaggttgaggtgggtagattgtgaggttaggaatttaagattggtttggttaagatggtgaaattttgtttttattaaaaatataaaaattagttgggtgtggtggtaggtatttgtaattttagttatttgggaggttgaggtaggagaattatttgaatttgggaggtggaggttgtagtgagttgagattgtgttattgtattttagtttgggtgatagagtaagattttgttttaaaaataataataataataataaatataaaaattagttaggtatggtgatgggtgtttgtaatttttgttatttaggaggttgaggtaggagaattatttgaatttaggaggtggaggttatagtgagttaagattgtattgttgtattttagtttgggtgatagagtaagattgtttttaaaaaaaaagatttttagaagttttgtttggtagagtaaatggattttttttattagtatgtttagaataatttaggtaaaatgttgttgtaattaattgttttaaagttaatttttttggtgtgttattttagtattgagaaataggattagatgagtttattttatttgttttaggtagtattttgggtagagtaaatagaaaattttaaggaaagaaagaaatttttagagtttgttttgggtttttgtggattttttttttaagtgttataagattggttttagattatagatgtaatttttggatgttagatttattagatagatgtttttttttaaagttgttgttttttttttaatttgtttatagtgtgtttttattttagtttgtattttttttaagtttttattgttaattgtatgttttaaaggttttttgtttttatatataaaaggttatttttttattatgtgttttgttttttataaggaatgtatttattttttgggtgatttgttaatttattattggtgtgtttgttttttgggttatttttgagaaatgtgttaaatgttttatatatatattattaattttttaagttgtgtggtgttagaaagagttttttttttagaaataaattatttaggttatatgattggtattagttttttaaattaattgagtattaattgatggatttttataatgtggttagggttatttatttaaatttgtgttttttggttttgagtttgtagatggtttttatataagttagattaaggaattttatttttatattaattaagtagatttttagtgttaatatattttaattaatagattttaaagatttatttatttttttttattgtagatttttttagaatatgatttagattaaaagtaggatagtatttgttgttattttttatatataaaagtatagggagataagggagttttttggtagggatggaataattttgtgttttgatggtggtggtggttataggaatttagatatggggtgagatatatatatatatataaattagtgtatataaattatggtgaaatttgtttaaggtttaatattaatgttagttttttggtattgataatgtgatgttatatatatgatattatttattattgttatgtaagatgttattatttaagaagtaggatgaagagtatatgggttttttttgtattatttttgtaattttttataagtttataattattgtaaaataaaattttttaaagttttatgagaaagttattgtttataaggtagtagtttgtttaatttagtttgattgaatttgaagttttaaattgttttttttttttatttatagtatttttaagtattttttataatttttttttaagaaatggagtttattgattttttaatttgtgaaaggtattttttgttaatatgagagttttagagagtgggtggggtgggattaataggtttttgaaaagtttatattgggtttattagtattttgtattataatgagtattttaataaaatagtattttttagttgttttgtggatgtttttaatgatttagaggtttaaagaggtattaggttatagttttaagtggtaaatatatatatgaggttatttagtgggagaggagtttgtttgtttttttttttgtttttaagtttttttttaggattttttagggttggttttttattttataggttttaagttaaagaaataggttttgtgaaatttatatttaaattagttttttttttgtattagtttgtgtttatgttgttggtaaagatatatttaagattgtgtaatttataaagaaaattataaattataattatggtggaaggtgaaagatatggtggtaaataagagaaaataatagaatttgtgtaggtaaatttttttttataaaattattaggttttatgagatttatttattattataatagtataggaaagatttgtttttatgatttaattatattttatttgtttttttttatgatatgtgggaattgtgggagttatgatttaagatgaaatttgggtggggatatagttaaattatattattattttttttagttatattttatgttatttattttgttgtttgttatgtttttattttttggttttatttattgtttatgtggtattatgagaattgtgtttttttgtttatattgtgtttttagtatttaggatagtgtgttatttgttgattgaaagattgaagaaatgaatgaaatatttttaaagttatggtttatttttagataatggtgattgttaaatatgtagattattattaaatagttttaattaatgattatttaggttagtttatgtaggtaatgattatttttatgtttggttatgagaataaataagataaatttgagtgatgtttttaatattagtagttgagtttaagtgttatggggaattttaatgaaaagttatgatttttattgaattttttgattgggttagaaagagattagtaggtaggtagatagatggggagataggaatgaatatatatttaagtatatatatatatgtatatttttttatttttgaagatgtaataggattttttttttttttttgagatgaagttttattttgttgtttaggttggagtgtaatgatgtaattttggtttattgtaattttttttttttaagtttaagtaatttttttgtttaagttttttgagtagttgggattataggtgtttgttattatttttagttaattttgtatttttagtagagatggggttttgttatgttgattaggttggttttgaatttttgattttaggtgatttgtttattttgattttttaaagtgttggtattataagtgtgagttattgtgtttggttataataggattttggtattttttttatttttgtaagttaatttgtaaagaatggaaattttttattaggggaagaattagaaaaatattagggagataggttttttgggtataggtaggtagagtattagggagaaggagttttttgttgtggttggtggagagtgttttgaatggtgttattatttttattgtttggatttataaggttatgagaggttaggagtgagggatgttttgttattaagttattattttagtgttaagttggtttttttattatgttatattaatgtttaaaagaggagaggttttagataatttattatgtttaagatgttgtaagaaaatttagagggttatgtttatagatatagtgaaatatatttttttaattattaattttatatgtatttgttttagtaaggaaaaaaaaatttttttaaaagatttttttaaaattatgggaataagaaataaagaggttaatgattttataattttaaaagtatatatggtgttaagtagtttaaaagttagttttttgatattagagttagtatgtgttgattgatttttttttattttatgttttttttaaaagaaaataggttggattgttttagtaaataataaaaggttagagaaatgttatttataatatgagtaaaataattgtttaatttgttaaaatgtttttaaaggtttaataggtagaaaaatttagtggtgaaataatttatggatttgattggtgagaaaaggttttttttagtaaaatttgttattaggtttttggtttattttttattaatgagaaataaaaataaattatgttgttaggttttgttaatattgagatgttatgttttttatagtaaagtaaggttgtttattatatagtttttagattttttgttttagattatattttgattttaaggttaagtgtagaaatggtggttaaataattatgtatttaaaaatgaagtttaaagagtttattttgtaaaatttttttttgaatgaaattttttattggtttagtttttatgtttattttatttgtagaatttttttgtggtgaattggatgttaatattattataagagttttatagagagatagagaataagtatatttgagagagaaattaggattttgtattttggggatattgttttaattgaatttgtattagtaatttggtgggatattgttttttttaaggtatttttgttattagttatgtagataatgttattattaatggtttattgttagttttgttgtagaggtgggattttatttatttttgttttttataggattttgtgaggttagtgtttagtatatttattgggttgagttaatgtttttatattgtattttatttttggtttaaaattatagagtagtattttatagagtattttttatgaaatattggttttgtaagatgttatttgggtgtaatataattttgattttatgaagaaataagttttagaaatgttttttattatgattatattttttaattttagaattattatgtatatgggtatattaaagaattagagaagttttgtaggaaagaaatttggtgaagttagtattttttaaatgttttttagaaatttttttttaattaatatttatttttatttttagtaattagtgttttggagagggtattttggggaatattattttaaaatagtttttaatttatgtttaattatatttaatgtgttattaagtttaattggttttttttttattatataagattgtgattagttttgtttatttaatattttattgttaattttttagttttaatttaatgttttatagtattatagtattatagaaggatagatttggaagtgttttagaaataattataaagtaaaggttaattggttaagtgtggtggtttatatttgtaattttagtattttgggaggttgaggtgggtggattatttgaggttaggaatttaagattagtttggttaatatggtgaaatttagtttttattaaaaatgttaaaaaaattagttgggtatggtggtgtgtgattgtagttttagttatttgggaggttgaggtaggagaattgtttgaatttaggaggtggaagttgtagtgagttgagattgtattattgtattttagtttgggtgatagagtaagattttgttttaaaaaaaaaaaaaaaaaaaaaaaggtaagttttgaatttaatagaggagttaattaagatttttagggtgaagggatatgtttaagatgttataatatgatatgtttgatttattaaaaaaaatggtagttttaggtattattttttttttttttgtttatttggtgaataggaattagaggagtaggtttttagtgtggaaggaaagggaagttagtgttgtggagtatttattgaatgttgtattgtatatttgtatatatatttttttattttaatttagtaagaattttgtagggtgggtattttatagattaggaagtttaagattatatagtaagtaagtagttgtgttaggatttgagttaagaatagtttgattttaaaatatatatttttgttagtgtattatatttttttttgataaggaggtttttaataaaagtatattgaattatatagtaaattaggaattgtatatttgaagttggtggttgtaattattattgttattgtaaaggagaatatatagtgagtttttggttttttattaaaatagtttattatttgtgaatgtaggaaagagtgaatttttattatttatgaaaaatgaattaagttaatgaagttataaatattaattgagagtattattgaatatataaataatatatttgtaaatttttataggattatttaatgttagggtttgttggttttttttgttaagttatttttgatggttggttattttttatgaaatttataatgggtataagtttagttaatatgatgatgatgatgatggtttatttttattgtatatataaaagtatatattatttaaagttgttggagttttaatggagaatggaaattttttttagggatagataattgataaattttaggagtatttttttttatatttatttttttatatttgtattttttgaggtatttggaatattgttaagtgatttttttttttatttattagggatttgttgttttttgaagaatttttgaaataaatatgtggtttataagtttaagtaaaatattttaaaaataataataaattaataaatagtaaataataatggttataaatttatgaataattaaatttaataaaatattgatatgtaaggatttttattgtttattataattattaatatgtaatttagtttatggatattatggagttttaatattggtgggtggggatatttttaattttagtatttaaaagttgtaggggagagagaaatggtttttttttattgttttgggttttttggttgggttatgaattgatgtaagataaattaatagaaagaaattttatatttaataatgtaggtgtatatgggagttttataaaatatgagatttgaagaagggttatatggttgaaatttatttagtattttgagttatggaatggaataggggtttggggtttttgggggtggtggggatataagttgtgtgttgatgaggggaggttttgtatggtgggttaagtgtgttttattatgtagagaaagttttttaggtattagaaattatattggaatagtttttggaaaaggagatgatagtttggggtggtatgttttgagtttttataaagttaattatgattgtgtaattttaagaaaaagagtgattatttagtattttgggaggttgaggtaggtggattattaggttaggagattgagattattttggttaatatggtgaaattttgtttttattaaaaaatataaaaaaattagttaggtgtggtggtgggtgtttgtagttttagttattgaggaggttgaggtaggagaatggtgtgaatttgggaggtggagtttgtagtgagttgagattttgttattgtattttagtttgggtgatagagtaagattttgttttaaaaaaaaaaagaaagaaagaaaagaaaaagagtgattgatattaaggaaggtttttttttttttttttttttgatgtagttttttttttgttgtttaggttggagtgtaatggtgtgattttgttttattataaattttattttttgggtttaagtgatttttttgttttagttttttaagtagttgggattataagtatttgttattatgtttagttaatttttgtatttttagtagagatggggttttattatgttggttaggttggttttaaatttttaattttaggtgatttatttatgttgattttttaaagtgttgggattataggtgtgagttattgtgtttagtttaaagaaggtattttatatttgattgttaagatatttttatttaattttaagtattgaattttagtattaaagtatgtaaagaagttataaggatagaattatgtttttattaattttttagtttttaaatataagtaattttaatatttttaatattttaaaaaagatattaatgagatttttatttataaagattattagatatagtgaagtaaatatttataaggaaataaaatttgttaaaattttaatatttgtgttatattttattgatagaaaatttgtttttgaaagttaattttgagttttatttttttattttttttgagttttatttttttattttttgtatatgtttttatattttagtgggagagtttttattaaaaaatagtattttatttttttttatatttattgatatggtttggttgtgtttttatttaaattttattttgagttgtaatttttataatttttatatgttgtgggaggaatttggtgggaggtaattgaattatggtggtaggtttttttgtattgtttttatgataatgaatgagttttataagatgtgatggttttaaaaatgggagttttttgtataagttttttttgtttgttattatttatgtaagatgtgatttgattttttttttttgtttgttatgtgagatgtgttttttattatttattgtgattgtgaggtttttttagttatgtggaattgtatgtttaataaattttttttttttgtaaattgtttagtttaaggtatatttttattaatagtgtgaaaatagattaatatattttgtaaatttgatggggttagttttgtattggttgtatataggagtaattttgtatagagaaatagattaagtttggaattagaatagagtaggtagtaagtagaaagtagaaggaagagtaagtaaaataaataggtttttaatatttgttattttttgatttttaaaaagtgaatgtatagataatagatattaattttgtatataaaaatatattttaatgttaattagaattattttttagatgtatatagtttgtgtttgtttatgtatggtgtagttgttatttatgtagtgtttattatatagttggtattgttttaagtagttaatttataaatgtatttaaagtttatagtagttttatgaggaaaatgttgtaatatgtggtatttagtagatgagtagaaggagttttagaaaagtttgggtaggaaaggatagagtagaggtttgaatttaggtagattatttttagtttatattgtttatatttgatattatattgattgtttatgaagtttgttgtatttattttgttgatatgtttggaaaagaaatatattttaagtagttaataattaattattttttatataagaatatattgtaatatttagaaaagggttaaaatattttgtaattttattattatattatattgttggggtagtttaattattgtagagattttatgaaagaggtttttgagttttattttaaaatattagtgattagggtaaaatttttttttaaatttaagttgtttatagtataaatttgggaaggaaattatttgagatggttgttggagatttttattagaataatttgattattttttttatagtttatatatgaatagttgaattatttaattgtaggagttaaaagatttgtttgtgtttagaaaaatgagatttttatttgggattttttagtatattagaaagatgatttttagtaaattgtgggtaagaaggaaataatatatatatttgtggttatgagagttaattagaaaaaaaaaaaagaaagaaagaaagaaagaaattttttggatttgtatagttttaaaaattgttgaatgttgttttttttttttttttattttattaagtattttttttttattgaggaggatttattttttatttgttttttttatgtttttgaaatatatataaagttagtgtttattttttatttattgaaattttgtttaagttattttttttttggtttttatttttagaagttataatttgttttgaaaatattagtatgagagaaggtttttttttatgtattataaatttttaattatttagaatgtttgttttagaggtaaagagatgtttggtggtttttttgttttgtaataatggttgtgtaaataatatgattggataaaattaaaaatgtgtttagatagagttttttttttttgtttaggtaaggtggtttatgtttataattttaatattttaggaggttgaggtgggtggattatttgaggttaggagtttaagattagtttgggtggtatagggaaattttgtttttgttaaaaaaaaaaaaaaaaaaaaaaaaaagttgggtgtggtggtgtatttttgtgattttagttatttgggaggttgaggtgggaggattgtttgaattagggaggtagaggttgtaggagttgaaattatgttattgtatttaagtttgggtaatagagtaagattttgttttaaaaaaaaaaaatggaattttttttttttttgatgagtgttttttattattggggttataattattaatattagttttttatagtttaatgttatttgaaatatttatatgtttgtgttataaattaatatatgtatttaaaatatgggttatagaaaagatattatatgtagtggtttagaattttgagttgtattgtttttgttttttatatggggtattagattttaattaaaatgaagattatatttttaagtagattgttagaaggtattatattggaagtttatgggtagtgtattttgtttaatgagggtagaaagatagtgatatatgaggttttttaaaggtgatatggaatgtaggtagagatgaaatgtagaggagaaagaatgtaaagttgtaaaatatgggttttatttgtatttggatttggtttttggattgtagagtttattgttgtgtgtatagatttggtaagtgtatggttgttagtttgattttgatgaagggtatttagaagaattaaaggatgaaagataatggaaaggagttaatattatgatttttattttattgatggtatggttgaggtttaaaagagttaagtgatatagagttagagtagtataaagttagtatttgttattttttttagttttataatttataatttttttgtggtatatgtttttggttattaataaaatgggatgatagtgtggatagttttatttaaattattatttttgataaataaattaaatttagggatgttgttggtttagagttgtttttttttttttggggattggtttatgttttaggggtttaaaagtattattatttttatttatttttataatgaaattttgagggatatgattgtttatatttttaattggaaagttgtatttgatttatttaaatgtttagatttttaaaaagtaaagtggtttagagtggaattttaaagttgagagtatggatttagggagatgttgtttattagttaggataagagatgtggtttgaaagagttggattttttttttttattttgtaattgatttgttgattaaatttgggttatttattttttaattttagtttgttttgaattttttttgtgtaaaaaaatatgggaagataatatttaaatgttttttagggatgttgtgaagaggattttattgatgttttaaattatatggttttaggaaggtgttatatattattattattaaaattatttgtggttggttgtagttttttttttttgttatatatataaatattttttattaaaaaaaaaaaagtaagaaattaattttttttttatttgaagggattttataaaattttttattaaagtattaatattttgaaaattgaatttaatttaatgtggtaagggtatgattgataattaattttaattttaatttttttttttttaaggagagaaagaattttatttgatggttaattaattaaatatagttgatgggatatatttagttaataatattttattttagatttagtttagttagagaagattagaaaaatggtgttattgtgtattggttgaatgtttaagttttattagttatattattttaagttggtaaaatatatatgggaagataatattatggaaaaaaattattattatttgagattgagttttgttttgttatttaggtttaagtatagtggtgtgattttagtttattgtaatttttattttttaggtttaagtgatttttttgttatagttttttaagtaattgggattataggtgtgtattattatatttagttaatttttgtgtttttagtatagatggggttttattatgttggttaggttggttttgaatttttgattttgagtgatttgtttgttttgattttttaaagtgttgggattataggtgtgagttattatgtttggttaattttatggtaataaattaagatagtgaaagtgtgatttatttaagggttatatatataaaggtgatagatttgtatgtatttatttaaatttatgtttaatatagtatatgttgggtaagaatttgtgagttagtttagtttataaatggtttagattaggggtatgtggtaaggggtatggggttttatttatagtttagggttataaaatagggtgatttaatttttttattttatataaagtttgttttttttttttgtatattttttatattaggttttaattaattaatttaattatttatagagtaagtagagttattaatagtatgttttattttattaaaattagatatatggttattaaataaggttgatttaggataattattttatttagaatgtttttattagtttatgttaaatgggaaaaatgagggaaagtaatgagttttttgaaagttaaatttatttaaaatttttaaaattgtgtaatttattttaaggttatgtttttattattttgttttttatgttaaatgtttttattttattagtgagagtaaataatagttgatttattaatattttattttggtaaaataaaaagttagtatttttgtattggtttttaaaaaaaagaaatgaaaagtattgaaatttaaagtttggttagtattattttagaatggtttatttgttgttaaaaatttatagagagatttatgtggttattgtgttatgtgattaaatatttataagatataaagttttattttaatatgtaatgttaaaggatattaagaaaaatgaatagatagttttttaatttagagtaagtaaagtatgttgttatttaaaattaaataaatgtagattttaaagtattaaataaatagaaattatgttgttattttttaaatggtataaagtattttaattaaaatttagagggtatgtaaaggtataataatttaggagatagagttatgataatattgtttattggtttttaatttttagattttattaatagaagttgtagataaatatttattttttgtttgaggataaatgatagaggatttaattatttagggaattgaaaagaatatggatggtattaagtttggttttagttgatagaggtttagaggtagaagatgggagttgaaagagtgaatgtttttattttttaaatgagtaattaagtgatgttttttaaggttaatagaatgagaaatgaggtttttaagaatttgtttgagaaataagtaatgttttttaagtggagggatggagtatggagagggaagaggtttgagagaagatatagatgaggttgaattagggagagaaattttattgattataaaaggaaggtaataaattgagaaagagtagtgttatgggttgaattatgtttttttaaaagatatgtttaagtttttagtatttgtaaatgtgatttaatttggaaatatggtttttgtaaatgtaattaagttaagaggaggttgttagggtgggttttaatttaataggattgtgtttttataggtagaggaaaatgttatgtgaggagggatatatagggatatagagggtaagttaaggattgatggtatttttaggagttggaagaggtggggggtggatttttttgagtttttagaataagtgtggttatgttggtattttgattatagatttttagtttttagaattatgagataataaatttttattgttttaagttatttagtttatggtattttgttatagtagttttagaaaattagtataaatggtattattatatattatttaaagatatgaaggtagttatttaaagaatttttaataaagttgggagggtttaaaggtgttttttttggaaagtgggattaaggaaggataggatttaggtagggttgttattttttattaaaagttttttgtgttatttggttttttaattatatagatgttattttgattattttttaaaaagtataaaatatttatgtgatgttattagaataaaatttggttagttttttttatagtggatgataaattttgaggattgatagttattttttttatttgttttttggtgttgttttttggttttttagatttttatatatggtttttggttttagggggagtagagttgagttgggagggtattggtttggattttaaagtagtttaaatgttttggtatgttttgtttatatgtttattatttttattttaaaattaaatataaattatttttggattttttatgggtttgtgttattgatgatggtgattttttttattgatttggatgattaagaattgattaaagggaaaatagagaatagtggtgagtttgttattggttttttttgtagataaaaatgtaaaataatgtttgataaagattttagtaattatgttatatatgattagaaaattttataatagagttttattataaatatttgtttattatattttattgaatttataaaaagatattttaagtgttttttatggtttagatggaggatttttgtattgtggtgtaggttgtgatttttttggttgttagaagttttatgttttttgtttattttaagaagaatgtttatattgagttttgtagtttgtaatgtggtaaaatgttgttgttattttttatatgaatagggttattgatgattgtgggggtttagtgtaaaggtattagtttttattatagaaagaaagtgggtagtgtgtaagtgttttaagtatggttttgagagaaaagtagaatgtaaaaggtaaatgtagtttgtatgtatgtagggttttgttgaggtttatttgtatttggttttttatggtagttggggagtattttgttgttggttggtattgaagtagtgttaggtgggtgaaagttgaatgaaatgtttaatagttattatatggatgaatatgtaggaagtagaataaaggagtagtattttattagtagtagaattttgatggtagttattgtttaaggggaaattgtttgtttttatttttattttggtttttagtttttttgggtaatattttttagttattttagtggttattttatttatttatgtggttattagatgtttagatttagttaggtgtttttttattttatattgtagggggtaaggttattttggaatggatttttaaaggtaggtgggaattatgttaatgagaaagtaagttataatttaaatatttgttgtatgtgggaatttatattgaatagaaagaataaaatgattttatttttattttgtgaatttttttttttagatttttatatagaagagagtgtggatttatttaaggttgattatatttaattgtatatatttgttttttaattgttttagttattattttttatagttggttttttttttgtttttgtttttaaaatattattttttaatatattgtgaggaagattaaatttttagatttagatgttttagaaatttgatttattagttgtgttttgaatatgtttggttattttttatttgttttttttttttttggttatatgaatattgttgtaaataaattttgtagtttgagttatgatatttattagaaaagtttaataatattgtagtttttattataatgtataagtatgaaatatttaattttttttattttatatatatatatatatgtatgtatatgtatatgtatatatatagtaatgtattatttgaaaatggaggtatagttttttagtaatataattaaaaatatggtaatattttttggatttttaagttttggatttattatgtaaattgtttgaggtttatgattgaaggttttaagattttattttattaaaaaagattttagtagttattagtttatagaattttttttgatagtagggtatttttgtaaggagttgttttgtttatgagttaggtatgttttggttagtaggggtggatgatagtatagatagtaaagggttaattaggttagaatagtgttttaatttttaggaataaatataatttaattttttaagggttaggtttgttattaatgaggttttgtgttatgaaataaatttatgagagaaaggtgatatttagttaattgattttaaaaatggaaaaaaaaaagtggtttatgtttttttttatttttttggtagataatgggggtagatgaagtgggagaaataagaggaataataatttttttaaaaagaagaaataaaatgaaaaagaaaaataaatatgagttggattaggaaaaaaaatagggtaaaataagtagaaatgatttttagataagaatagtattatataaaatagtatttataatatgttaaagttattttgtagtataaattatttttttataaagaattaaaagaagaagaataaatataaaaattaattaaggtttagggaagggttttatttttttttgaggggttgttttttatttaaatattggttgatttatgtaggtattgttaggttgttttagagagggtattttttatttttgtttgattttgtttatagagtgatttttttattttagtttgtaaggaaaggttaagtaggaggagtagaatgttattttatttagaaaagaatttaatttattttagggttttaggtttagtgtttttttttggtgaattagttttttaagagttgataattagttgtttggttgtgagtgatatgaaatattgtttttttttttttggaggaagaaattattagtatttttttaattgtttttattgggaataaggtagatggaagaagattagtatgatgtttgatttatagggagtatgaattagatatttattgaaggagtaaggagtaagaaatagatttttgatttaaagtgataaaatattaaagttaattgtttattttattagttgtaagagagttatgtagggtagtttttttttttataagataatttagtgtggagttgttgaatgaataggaaaaagggagagttttgaaatttatatagaaataaaaatggttttaggggataaattatatttatattatattatttatgttatttaaggaatgtggttatatattttttgaaaaataaaatgttttattttgttttaaaaaattgaatttgtataatattgggtttgtttaaagagtaaagtatatatattaatttttttttttgttgttattttttttttttttttttttattttgagatagaattttgttttggagtgtagtggtatgattttaggttattgtaatttttattttttaggtttaagtaatttttttgttttagttttttaagtagttgggattagaggtttttgttattatgtttagttaatgtttgtatttttagtagagataatgtttttttatgttggttaggttggttttgaatttttgattttaagtgatttgtttgttttggttttttaaagtgttgggattataggtatgagttattgtgtttagttaatttttttatatttttagtataggtggggttttattatgttgtttaggttggttttgaatttttggttttaagtgatttatttgttttggttttttatagtgttgggattataggtgtgagttattgtgtttagttatatatattaattttttttggagtaaaggtataagtatatttattgtataagtatagaatttaggaaaattattagaagagttttgatgtaaagagtatttgttatttattagtagttggtagtgtggttgattatttttttgaaatgtgtaaatgtgtgtggtaaaagtaaagaattggaggtagggaatttatattaggtttataattttattttttgtttagagtaagtgttgggttgttgattaaattaggtttttttggatttttggagtagtttttttgtatttttaggaaggaggtggataagtggttattttggtttgtttgtttatttggtttgtttgtggttggttagtttattatttagtttatggttaggttggaggattgggtatttttgttttgattagttagatattttattatgatataggttatttattgtagattagagggatttaataggaaagttttatggggtaagtaaatattattattatttaaagtaaaattttaggttaggggttagtggtgtttttattataggaaaaagggaaagtatattagaatttgatagaggaataagtattaaattgttgtttttaaataaagaatttatattaataaggaatataaaaatgttatttaggatttttgtttttagatgtttaatataaaggagagattgttgtgttagggaataaagtgatttaatatttataaagttagaatttttttattgtatattttgtttttaaaatattaaggaatatagtaagattttaagttggagtaaagaagttatttttggaaataagagaggagataattgaagatttttatagaggggttgaaattttttttggaaaattgtgtttattagggaattttagtttagggggtagtgagggtggatggtgagttgatttatttttagatatgtggaataggtattgggtgtgtggggggtgtagtgtagaatgaaggttgggagttgttaaagttatagaatattttagtagtatattatgggaatttaggaattttaaatgttttttaaaaattaatgttttgggtttagagttttaggtagtttagtgtaattttatttttattgggattgttgttagaaagaaataagtagtgttttttgattatagatttttaaaatttgttttgttatatgtaggtgtgtgagattttaaggagatttatttaattaagatgggggtgagggagtaggagggttgatgagtggttttttttttttgaatggttattatattggattgtattatagaataaaaatttaaaagttttaattagaaagataatttaagggtgttaatttgttttttttgtttttagtttattatttttattttttattggaagtagttatattattgtattattatttttttttttattggattgagtatttttagagggtaatgtaataggattgaggtgatggggttgggaaattaggttttttggatttaattttggttttattgtataatgggattaatgttaagttatttttttttaatttagtatttttatttatataattggaataatggggtttattttttggattgttgtaaattttttttttagatggagttttatttttattatttaggttggagtgtaatagtgtaattttagtttattgtaatttttgttttttgggtttaagtgaattttatttttgtatttttagtagagattgggttttattatgttggttaggttggttatgaatgtttgattttaggtgatttatttgttttggttttttaatgtgttgggattataggtgtgagttattatgtttagtttgttgtgaattttaaatggaatagtatagtaaaatgtttagtatgtagatggttttgtttttgaatttgtggattgtattttatttgtttttatatttttttttatatttgtttatagtagggttttatattaaaattttttaaagaataataaaatgttttattttttttagtttattttttttttgataatatgttttttgtttgtgttttaaattttttttttggtattggattggatgttttagattagttgtgattaatattttatatattttttgtaaaattggatattagtatttaagtattattttaattaatggttagagagtggtaaaattaaatatgagatgatttattttaatgttttattgtgttttttatttttggaattttaaggggtttttgttaaaagtgagtgtataaaggaaatataaataggtaaaggagaggagaagggagtagtagagatagataaaagttaggaaattatagtttgattttttgtattgtttttaaattattggtgtttttgaatagtttgtatgatattaaatatttttaagaagttataatttatgataataaaaattgtagtaaatattaatagaaattgatattgtagaaatttttaaggggattatttattaaagaaatatatgatttggaataatttttttttgtgtaattaatgggaatgaagagatagttaagagatttgtggtttttttagttaatatgatattttaaattttttattttttttaatttttttggttaaagatatttatagggtatttatgtggggagtatgttgttttaagtttttttgggatgaggtttttgtggtaaggggttgtagggggtttaaaggaaagaatatggatttttattggtgatttatggaaagaaattaagtgttaagatttggagaggtgttagggtttttaagggattgggagaatagttgtgtggtaagtggagaagtatttgtggtattttaggtggttttagttagaattttaggtttttttgttgttaattaaaataaatagtgaagtaattaaagtgagtatttgagttttattagtagagtattatgttaaggttttgttggtagtagagtttgggaaggggaagggttataatggtaaggggaaagtaaaagaaagagaagaaagggtttttgtttttgtgtaattattattaaatttggagaaaataatataataaaaatagttattagtaatttaatataggatgattttttatattgtggtatgtgatttttatagttatttgtaattttgggatatagatattattaatttattaaatattttatttaagattaaagaaatagagatgaaattagggtagttaggttagtttgattttatagttggtttttttagtgattatattttattatttttttttttgaaataattttatatatttatgtatgtatatagaagaggattttataatttaggtgtggggaaggttagttttaattatgatttaaattttagaggttataaaagaaaaaaaattgataaatttgattttatgaaaataaaaattttttgtatggggaaaaaatattattaataaatgataaattagggatttatttggaatatagattatagataaaggatatatttttttaatatataggaaatgtttataaattaatatgaaaagagttaatgaatattaaattagttaataaagaaaattaagatagtttataaatatattaaaagatgtataatgatttataataagaaaaaagttggttaaaaatattagaagggtgaatattaaaatattttattatataggtaagggtgaggttaagaaggaaggggtaattttataaattattaatgagaaaataaatgagtatatttgttatgagggataatttggtattatttattaaaattataaatgtatttgttttttggttgtaaattttaattttaggattttattttgtagattaatttgtatgtgtgtaaaatgatgtttgtaggaagttaatttttgtggtattgattgtattagaaaatgtttgagaataatttaaatatttaaaaaggagattgattaaataaattatggtatatttttataatgggttattatgtagatatagaagagaagaggaagtttttaatatattgatatggaataagttttaaggtatattgttaattaaataaagtaaattaaaaattttaagtagaataggttattataaatataaaagaaaattatatagtgtttatatatatatttgtaaatatttttggaaagatatatagggtatgggtgataggagttgtttttggggagaagtgggaggtaaagtgaggagggaggtttttgttattgtatatattttgtattttttgaattttataatatgtgtttttattgtttatttaaaaaataaattgtatatataatttattatatattaaatatatagatgataaatttggaattaatttggaatataaattttttttttttttttttttttttttttttttttatatatatatatatatataaaaatatatatatttatattatatataaattaaaattaggagttatataaaggtagaagtagtttttggtttataaggttgtgtgattttgggtaagttgttttattatttaagtaaggttttagtttttttatttataaaatggggattggaatttttttttttttttaaagtttggagaagtaaaggaaggaatatatgtaaagtttttaggttagtgtttggtatatagtaaatttatgtaagtgtttgttaaataagtttatttggttggttaaggaagatatttttgaaaagtgtttttaaagttagattagaaagtttagtaggagttaggtaaggaggagagaagtaggggaaatagagagtgttttttagaaggagtggtttgtgtaaaggttaggaggtgaggagatgtttgtattgagggaagtttgggtgattggtatagagtttgggagggtaggggatagtatgatgtaaggttgaggaagtgagagtgtggattagttatgatagtttttttgggggtgtttagtaatttatggagtatttatataggggtattttgtgtttgggtaggtttttttagaaaaatttttttggtaagagttaggaggataggttggagagaggtaaaaattgggtggtagagaggttagttggagattgttgtagtaatttaaggaggaaatgatgaggttgtgaattaaggtagtggtagtaggtaggggatggagtggggaagatataaaggaggtgtagttagttgggttgtttgatttagatggtggttagaggtgggatagaagaaagaattgaggataattattagagttttgattttattagtttggaggattgtgatgtaatttattgagataagaagattaagtaaaggaagtggtggagggagtaagatgatgggttaagttttaaatttgttgaggttgaaatattttataggtgatttgtagttagttatatgtgtttgaattttagatgaaggatttgtagtaaatatatatttttgagaggtattagttaagtttttaatattgaaagttttggattgtggttaagggagttgttattaatggtttttttggtttataaaggagattttggagaaggtatgttatttgtaatgtaggtaaatttttgttttttttttttttttttttgtttttttttttttttttttttttttttttttttttttttttttttttgttttttttttttgtttttttttttttttttttaaaaatataataaaagtttttataagaggtttttttatatgttttatgtgaagtaatttatttttgattagttttagttaattagtggtgatgtttttattttttttaatatttttgtattttttttgtatttttttttatgtatggtggaagttattagaaagttgttattgttgtgtatgtgtgtttgtatattattgtgagtagtttgaagattttatttttttaataggggagtaatttatagtttattaatgaaaaagagagggagggaatattaagtgtatgttttatgagtgttgtttagatgttttttagaaagagtattttgtggtttttttttgtgtttattgtttttagtaaaattaatttttagttaaggatgatttattatatggttttattaagagattttagaattgatttttaaaagggtatatatttttttattataaaaaaagtgtgtttaggtaagatttttggaataatttagttaggtgaggtttggggttaagatttaaggatgttagttttgtaatttatttatttatttatttgttaatatgtttttaattttgttttagttttagttttttttatttataaaattgagatgaattgttggattatttttaaatttttttttggttttaaaattttgtgagtttagttttgagtaagggtttatattggttttatgatagtgtggaatattttaataatttaaaattgttattatatatttaaagtaattttattttggaggtttgttgattttatgattgggtaatagaaatattatttataaattttgtggtaatgataaatatatttattttaaaggtaaatttttattattataatttagtagatggttagtttttaaattttatatttgttagataagttttttttttatggtttgaaggaaatataggtagggatttataggggagggaaaatagtatttaatttatgaaagtattaaatattatatattattattattatttggtttttttttttttttttattttttttttaaatatagagtttttttttgttgtttaggttggagtgtagtggtgttattatagtttattgtagttttaaatttttgggtttaaatggtttttttgagttagttttttaagtagttaggattataggtgtatatatattattatgattggtaattttttaaaaaattttatagagatggggttttattatgttgtttaggttggttttaaatttttgggtttaattaattttattatattggttttttaaaatgttgagattataggtgtgatttattatgttttggtttattggtttttagttatgtaaagtatggatttatagttttaaaatatgatatggaaagtttggtgtgttaagaaatgggtaatttatttttttatttgtagagatttatgagatttttgtgggatttattaagaaatatggataaggaaatttaataaataatagatttttatttttttttgttgagggatgtgggattatttagatgaatttagttattatattaaagaaatagttattaaaatttgttataagggatttttatttaaattttaatttatagaaaaatattaaggagaaagtggttatttttatttaaaagaattttgtttttttattatgttagttatttggtgagttttttataatttgtgtgtttttggtaaaaagtaatatatattagagtttaattgatttaaaatattgtattttaaaagatattatgtaatgtgtttttataaattaaaatttgatttgattagtttgaaatgtattattttgaaaaataatgttagttgaaattggattttagtaatatgtttttggtaattatatgaaggagaatgttaggtattttttaatatttgtagtatatttattgttaataatatattaatatagaaattagttatttaatttattagaaattaggtataattttttagtgttttgagggggtagaaaggaaaatgtataaataggtttttatttttgaaatgtatatatatatatttaattataaaaatttatttttttttttttaaagtgtttattatatttaatattatttaaaataagtgaaagggtaaattaaattataagttgggattattattttatttattatttttataagtatgaaaaaagttgatgagtatttatattgttagtagaattgttaattgttaatgtttatggagggtaatttgataaaattaattgaaatgataaatgtatttatttttagttgtaataattttatttttaggattttttttttagagatatataaaataatgtgatatagagttatttattgaattattgtttattttgggaaaaattggaaatagtttaaatgtttattagttaggaagtagttaataagttattatatagtagtataatgtagttttaataaagaaagaagaagtttttaatttattgataggtagtatattttaaaatgtatttaaaaggtatatgtagaatagtatatatgtttgttattttttgtataaaaagagggaaagtatttatatatatatgtatttatgtatatatttatttatatatatatgtgtatatataaatataaatatatgtatatataagattttgataatatagattttgtggaaaggaaattttttttttagaatagaagtttggggataataggaggaggaggaaagaaattattgtatattttttgggatttttttaattttgaattatgataatatgttatttatttagaaataagttaataaatttgattaataaattgtttattgataagtagtaaatatatatttatatgtattattatttaataagaatttgaagaattttttttttttgagatagtttggttttgttgtttaggttggagtatggtggtgtgattttagtttattttgatttttgttttttaagagtttaagtaatttttgtgttttagttttttgagtagttggaattataggtatgtggttattatatttggttaatttttgtgttttttagtagagatggggttttattatgttggttagaatggttttgaatttttggttttaagtgatttatttattttggttttttgaagtgttgagattataagtatgagttattgtgtttggttaaagaattatatttttaaaatattaaaatagttaggttaagattgtttttttttaaagtaaaagagatatatagttaaagatatgaagaataaaaattaggtatttttttttttttttagttttttggaatttttataaaataataaattaaatttaatagtttggaggaaaattaattaaagggatataaattattattaattttttttttagatgaatgataaagagatatgtgttttaattaatattgagtaatattgtgtaaagagtagtttgtagtggaaatgaatagatggtaaataagtaaaagaggtattggagagtaagaaagaaaatttgatttgatgttgaaaattttaagtaattgaaagaaattatattttaatgaaaatagttttaaaaggatggatgaatttgttgatttaattttagtttttaggtatatttagttttgttgtttttaatatttagtttttataaggttaatattattttaatttttattttattttttgtatttgtaaataaagttatatattaattaattaattatttttttataatagaaagattttttatttttaggtaatgaatggtttagttattttaaattaagttagtattttagtttaataaaaggttttggatattattttggggtttaatgtaataagagttgatttggaggtttatgttttaataattatttttttttttttttttgaaatagagatttatgataggaggtagagaagggggtaagattttagggttgatgaatttttggtatgaattattgtgtaggtatgtaagaagtttttttttttgttttttttttgtttaaaggtaaattggagttaaagttatggggaagtatagtattatttttttttgtttttaagtttattttgtttttaggttttttttggtggaaataagagtgttataagtaattaagttttattagttgaatttttagtaaagaattagtgattgattttatatgtgggagattttaatttagttgatagatgttatttttttttgtttttgttgatttaggttggggagatagtatattttagataggatgtttttttaagagttgtgatgtaattttggaaaaaatatttgtttaagattttaagttaggatttggtttttgttaatttagagtgatagggattagtggttaagatattggttattataggaggtatgttgaatttatatatatttaataatagtagatatttaatatttttgtgttttttattgtttaatttatatagagtattttaaattgtatattttgtagtgtataatggttggataaaaaataaaaaattttgggtaaatatttgagataatttttgttttttatgtaaaaaaaatagaaatgttttttgtttgtttgatttttgaattttaaataattatttaaagaaaaaagggagataattggttaattaggttatttttagttatattaataataatatttaaggttgagaattataagtataaatgatttgtgtaatttgaatgtttagatttagattgatattttaatttatgtgtttagagaggaatatagagatatagattataaatatatatatagtaggttgttgtatatattttatataaaataggtagtttttattaaattatttgaggtattaggatttaaatttaatttttttttttatttgagatagtagatttttttggtttgaggatatttttaaatataaaagttaattattttattttattgtttataaatttaatttttatttttgaggttgtttttgttgtagattttttggtagtttatttatattatagtttgtttataatttagtttaaaattatagtaaagatagagattgaaaaaaaaaaaaaagttttttaattttttaggaagatttgataatgtagtaggatttttataatgatatagataattaagtttattttttatgaaataagagtttttaagtggtaaattttatagataaaatgtagaaagtataaagtagatttatgagtggggttaatgttagggttggaatgtttttttttggttaggttttttagtaaaattaattaattaatatatatggaaaatgtattatataaattttttagattagagttggggttttgttttgtgttagttgatgaagaatttttaaggttgttttggattgaattttagtgtagagatatgtaatatgttattaattttttttttttttattggtttttttgaaagagagttttttataagtagtttaaggaaaaagtatattaataatgataatttatatttattagttggggtggtgaaggttaaaggtaaattaaagtaaattgataatgataaagaatttaaaagtttatgttttaaaaaaaaatatttaaatttgttttttgattgttaggttggttgattagttgtataatttttggtagttttttgaattttttggattttattttttgtgtttatgaaatgagagagttgaatttagtgattttgaggttttttttagttttaattggttatggtttatgattaaaggttgtggttatatttttgattatttattttttataaagttttatgtttgattttttttttttaaggttttgtttatattgtgttgtttgaattttataggtgatggtggtaaatgaaggtggtatgatatttttttgttgtttggtttttataagtattttagattaaattaatattaaagagggaaatagataaatgaaataagattattaagatgatattttttataaaggaataaaaatatatattttttaaaaaggaggggaaaattatttttggaaattttttggatatttttttttaagaagggatttagggagttatttttatattgtatttttttaatttttatttttgaagttttaaatttttttgttttttattttttttgagattaggaaggagggagagatattttttttttttattttttgagttggttaaatttggatgatttttatatgtttttatggtaattttttatgttatgttaatatttgggatttgttggtaaattttaattaggtttatttattatgggagttaagtttttataaagatattttttttttttttttttttttttttgagatggagttttgttttgttatttaggttggaatgtagtggtgtaattttggtttattgtaattttttttttttgggtttaagtgatttttttgtgttttagttttttgagtagtggggattataggtgtttgttattatgtttgggtaatttttgtatttttagtagagatagggttttattatgttggttaggttggttttaaatttttgattttaagtgatttgtttattttggatttttaaagtgttgggattataggtatgagttattatatgtagttgattttataatgatattttaaataatattttttttatattggatatgtataaagattaattggtgaattttttttatttttgtttttgaagtaaatggaattgtagggtaataagttttttttttatttgttgtggaggatttagtaaaattttgggtgtggagtttgtagggatttttgtttttaaatttatttttttttaaatgaagaagtttttaagtatttggttgaatttaagtatttggtgatttgatgggtaaatataaataaaagtttaatttttaaaattaaaaattttgaatttagttatgtatatgttgtagagtatagtgttgttattatatttgggttttatatttatgggtttaaatatttattgattaatatatttaaggatagaaatagattttgtttttatagttttgtgtgtggtttttgtagaagtatttatttgattattatggtatatatatttatttttttgttttaatatttttttatataaaaaaaaattaaggttaggtgtagtggtttatgtttgtaatttttgtattttgggaggttgaggtaggaggattgtttgaggttgtagggagttagttatgttattgtattattttagtttgggtgatagagttagattttgttttaaaaaaaaaaaaaagggaaataatttttgattaaggtttatgtaatttgaagattagtgagttattggagattatgttaaataaggttagattttatgaaaatatatttagtaataataatgttttttatttttgttttatttttatttaataatagtaagttaaagtggtttttttttttttgttttttttgggattattaaattaaattttttagtggttaaaggatggaagagaatttggaatgggtgtttttattttggtgttaaatattatatagttgtgattttttttttgagtatattttgagagtgttttgagtgttatgaataatgagttttatattgttgaaaaataaaaataaaaaggatttgtttaagtagttttatatgtaaattaatagagtagttattgtttgtaatttttagtttagggtttatttaattatttttttattgtttggaaggttaggtatgggggattttagttataggaaaggtatttgttatggttaatttttgtaggttaagtaaattttggtgtagattgtagtagattttattggggtgtttatgtggtggagggggttatttaggaaaggaaggttttttggtaaaataattttagtgtgaggtttaatttattaattttttttaattattttgtaagaatttgttatttattgtaggaaaaggaattaaaatgagttgggagtgtgtgtatggtgggaagggagtgatggttgaaatttgttttaggtgatagttaatatttgttattgtaaagggtttagggtataaaggatattatggggtgtttttattttattttttattagagggaggtttttgatggatggtttaggtggttttggggtagaaagatagatttttgggtgagtttaagtttgagatagatagaggttagtttggtatttttgtagtttatttttgggggttgagtttttgttaagtgatatagaaattttagttttttttttattatttttatgaatggtagatttttttaaaatttaggttgggttattttatttttttgatttaaattgtttgttggttttttattatatgtaaataaaatttaaaatgtttgaaaaagtatttggaaatttatgggggttgttttggtagttataggataattgggagttattagtggtatttaaggggtggggttagataggttggataatttgtagtatatgggatggtttagtataagttataaatattttatgttttttaggattttttagttttttttggaagggttgaaaagtttatgttattttatttgttaatataagggttttttttatgatttttataaatgttggattttaatagggaatgatgtattttgttttgtttagaattttattaatatgtatttattattttagaaatattatattattaaagttaatattgattatgttatttgagtggttaatataatatatttgtagttatttggatttatagttgttatgtttgtagtgattttataagtgggtgtaaaatatatgattatattattatgttttttagtgtagttatgaaatattttttagtttatgatatatttttttttttttgtattttttttttattatagttaaggtattgtatggatggtttgtaatgatgtgggtagataggttatattttttataaattttattattgaagagtgaaaagggtgttattaaatatttattataagaagtgaggttttgggtttggttagggttgtttttttttattttattttttgttatttttttttttttttattgtaatattttttttttttttgttggtatgtttagtttttgttttggattttttatttgttttttgtttgggagattttttttttagagatttatagggtttttttgttatttttttttttttgtttttgatttttttttttttttttatagaatttattagagtttaatattatattttttatttaataattttttgattgtttttagtattagaattaagttttatgagagtgaggattttgtttattttgttttttagtattaagaatagtgtttgagatataaaaggtattttttggttgggtgtggtggtttatgtttgtaattttaatgttttgggagattaaggaaggaaaattatttaaggttaggtatttgagattagtttggtgagattttgtttttatataaaaaaaaaattgttaatgagttagtgtagggttttatgattgtaattttagtgttttgggaggttgaggtaggaggattatttgtttgggtgatagagggagattatgtttttttttttttttttttttaaggtatttattaattttagtagatgattaaaggaagaaatatatatataaaagtttggttttattaatgggtttagtttttttaggaattaggaaattttatttttttatttttataattattgttgtaaaatggtttttttttttattgattaggttttttatgtttattttttgttaggtaaagagtagtaaaagagaaaatggttaatgaaaaggagggggaaatattttttaaaaataattatatttttaggataggttttgtgtgagatatattttaatgtggggatatgttatagtttttagtggtttttgtttatttttttaatttattgtatagaaatattttatggaggttaatatttgattttagaagttagtgttttttaatttaatttttgtaattttatatttaataaatgatgtttaaaaataaaagtagttattttaagattattaaatattggttggtgatggtaaaattgtgtttttttttatttttttttttatttttgttttttattaggttattgttttttttatttttttaaaatgaattttatttagaaattattaggaagaaatattatttaaattaaaattttagtagttatttttgtagattttgataaatttattttaaaagttatttggaagtttaaaaggttaaatatagtttagatatatttgaggaaaagaaaatgaggtgaaggttatattttataggatattgataaagatttttttagattaaatttaggttgggttttttggagtttttttttttattagattttgattttgggtttttttttttgttttatagaatttagtttaagtaagaattttattagttttagtgaaaattttttatttttggtatttgtttttatttttaatttttgatattttattattttggtttgtttttagtaagaattttgttgagttggtttagtaagaatatttttgtttttgatgtttttttttttatttattgattttattttgttgtttgattataaatttttttttgtttttgtagaagttggattttagtttaatttttttttttattatagtaagattttgttgtagtagtttttttatttattataatgtttttttttttgaataaagttttttttgttatttttaataaatgttataaatatttttttttaataatattaagatttatagagttataagtaagatagtgtggtattggtataagtgtaggaaatagattagtggaaaagaatagatagatttataaatagatttatatatatatagatatttaagttttgaaaaatttaatattatagtgtattagaaaaaaagatgtttttttttagtaaatgtggttgagttgattggatatttatgtgggaaaaaaaggaaatatgttttttttaaatttatagtatttatataatttaattttaggtgtattatgtagatataaatataaaagataaatgatataatttttagaagttaatataagagaaaatttttatgattttgggataggtaatattgttaaataagatataataagtgttaattatgaaggaaaagagtgataaatgaggttatattaaaattaagaaattttttttattaaaagattttgttttgagattaaaaagataagttataaaatggaagaatatatttgtaatatataaaattaatgaaggatgtatagttagaagttgtaaagaatttttataaatttataagaaatagaaaatagttgaaaaatggataagagatttgtataggtatgttttaaaagaaaataagtatatgaaaagattattagtaataagtaattagggaaatgtaaattaaatttataatgtgatatttttgtgaatatgttagaatggttaaaattaaagagattgatagttttaagtttggagagtatataaaataataggaatttttatatatggtattatatttataataattttattatttggtgtgtttttaatagaaatatatgtataaggtattaaagaataggtataataatgtttatagtagtattatatattataataaaaataataggatgaataaatatagtgggtgaatttttataataaaatataataaggaaaatgaataaattttagttttatgaaattttataaatgtaattatgagtaaatgaagtttaaaatataaattatatatattataattttatttatatgaagttaaataataagtataattaatttatattatttagggtgatatatttaggtggtaaatgtgtaaggaaagtaaggaattggttattataaaatttaatataatttttatttttggtggaagatatagggttatgattgttaggggatatggttttatgggggttggtaatgttttgttttttttatttgtatgatggttataaagtgtttattttaaaatagtttaatgggatatatatttatattttatttatattttggtatatttattatatttttaaataaaagattttttaaatgaaggaaaattataaattaaaaagatagaagagtatttatgttaaattgtatgagattataggttttggagtgagatatatttgtgatttaattttatttttgttattgattaattgtatgattttgaatgagttatttaaatttttaaagttttagtttttgtatttattaaatgaaggtgataatatttattttttagggttgtaaaatgaattaagattttatatataaagtatttagtagaatatttggtatattgtaagttttaagaaatggtagtattgtaaattgtatatttgataatggattaatgtttagaatatgtaaagaatgtttataatttaataataataaaataatttgattttaaaaaattaataaagaatttgaatagatatttttttaaaaataagataaatgaatggttaatttgtatataagaaagatgtttaatattattaattattaggaagatttaaattaaaattataataagttaattattttatatttatgaagagggttattttgaaaaattagaaaataagaaatattggttaggaattagagtagttggaatttttgtatattgttggtagaaatgtaaaatggtgtagtttttatggaaaatagtatgatggttttttaaaaaattaaaaatagaattataataggatttagaaatgttatttttggaagtggaattttaaaagaattgaaagtaggtatttaaatagatatgtgtatatattgtttatagtagtattatttatattagtttaaaaggggaagtagtttaagtatttattaataaatgaatggagaaataatatgtagtagatttatttaatggaatattatttagtttttaaaatgaaggaagttgtgatataggttaaaatatggatgaattttgaagatattatgtttagtgtaataagttagttataagtgtgagtttatttatgtgaggtatttagagtagttaagtttatagaggtaggtagtagtatggtggttgttaaggttgtaggtgtgggggaataggtattattgttgaatagattttgagtttttgtttgagaagaaaaaaataatttggtgataaatggtggtgatggatgtatgatattgtgaagaaattttatgttattaagttgtatattgaaaaatggttaatatgataaattttatgttatatatattttattataatttaaaaaaattattaaaaaatattaataataggttaagtgtgatggtttatatttgtaattttagtattttgggaggttgagataggtggattaattgagtttaggagtttgagattagtttgggtaatatagtgagatttttgtttttataaaaaaatataaaaattagttgggtatggtggtatgtgtttgtagttttagttatttgtagggttgaggtaggaggagtttttgagtttagaaggttaaggttgtagtgagttatgtttatgttattgtattttattttgagtgataaattgagattttgttttagaaagaaagaaagaaagaaagaaagaaagaaagaaagaaagaaagaaagaaagaaagaaagaaagaaagaaaaagagagaggaaagaaagagaaaaagaaaagaaatagtagtaattgttattgtaagatatttttatatattagagaagttaattttaattttaatatgttaagaatagagagaagttaatatgtttattttaggttgatggtttgtttatttgtgttgttgttggtagttgggtttgttatttttaaagtagtttatttaatattttattaataattttagtaagttattttattttttaatataaatatgtataaggattttttttggttaagattaaattaatattagtttatagtaggagttaatattattatatttattaagtattttatttgtaatttgattgtagtttatagttttttgttggttaaagtgagtttaatgttgattaggtaaattaaaaattatagttaattaaaagggtataaatgttatttgatttaataagttattttaattaggtttgttattataagtttttgatatatgtaattaagaaagttaagttataggttattttttgatgatgtttaagttgtagttttgattatttttaaattgtgattttaatttagagttgtaattagtagttattttttttatggattaaaagattagaattttttttggaagtttattagaaatgtttttaagttttaaaatatttgtttgaagtattttatagtggttttgaaaatgatttgtttaaatatttagtttaatttatggtttaagaaataaagaaagttgattttatttatttgtttttttttttttttaaatggtagtttgatttgtaaagtatggtaatggaatgaaaattttatttttaaggttagttttaataagtatttaatattttaaatgttattatatattttatttatttaaaatattaaaaagttattaatatgatttttttaaaatttattaatgatttttgtgaaaggtattgaatttttgtaattagataaagtaagattatgtatgttaaaatataggttttggtttatagaaaatgtttaataaatagtagtaaatatatatagatatatatattataatagtataagttgaatgtgtagggtttatgtaagttaaatttattattttattttagttgaatagattttagaatatttagtgattttattttattttgtaaattattgatttgtattaatttaaaaatttttttgaaatttaatttttaggtatttggtttttgtttttgggatttttattgttttagagaatttagttttaatgggtttttttttgagaaattttttattggttttgagaagtatttttattgaatgttttatttaattttattttgtaattaatgaaatttttaagatttatttttttttttttgaaaaatttttagttattttttttttgttttttgggtaattaggagtagtaaattatttttattaagaattaaaggtagtaagtatggtaataaaaatattaaatgttaaaataaatgttattttttgagttttgaaatgtttattttttagaattaaaaatattttatgttatttttatgggtttttggttgttagtttttaaatggatttatgttttgattttagtaaaatttaattaaaagtttttagggtttttaattttttttgataaaaatatttaattttttttagtttgggaggtattgtttttttttgtttgtgaaattttattagtttggtaataaaataaattattaatttagttgtttattatttttagtttaaagatgtttgtgtggttagttgagtataaatgtattgtatttgtgttttttttttttaaagttttaaataaataattattgaataaaattagttaggaatgattttttgtttatgggaattgtattttaatttagaattatatgtagaagagtgtagggttttgaggtttgttattttattaaataattttttttatgtggtgaaaaattggttaaattatttttttagtgattttggaatttttagtttaattttattttttttaagttattagggtttttttggtaatggatgaaattatgaagtttggtttagaggaagtaaagatatatttaaatgtgagatttaattgttttttgaggattttttttgttttttagttttaggtagattaagagtatttttaaaataaatttggtgtttgttttttattttaatggaaaatttgattggagattttatagtgatagtaaagaatttttatttttttggataattaaaatttggtttttgttattttaattgtagtaggttagtatatagggtattagtgtgtttttgagtgtgttgatgaatggatatggtgttggtagttttggtttgggggtatttttgaggagttttaaaaaatattaatttttgggtttttttttttagtttagatatttttattaaattggtttgagatgtggtttgggtggtaggatttataatattttttggatgatgttaatggaagttttttgaggtagaagaaggtagataggattgattgggagtgtattattaattatttttgtttttttattaagaagtttaagaatattttaaaataggggtgtagtggttgaggagaaaagagaggaagttatgtatatttttgtaggtttttatgtaaggatttaagtgtgtgtgttaagtatagtttttaaataggggattttagaagttttatttttaagatttgaattgtattaaaggtagagagattttttttggggttatttgaaataaggtagattttgtttggtatgtatgtgttagatttagtttttgtagtgtttatgtggtaatgtttaagtagtttttagtatttgatagggtattttaaataattttattagtttgaaattttaaatttaaaaaaagttatttttaaatgtatgatttaagagtataaaattttagagtagagaatattgttaggttagtaggtgaagtattttatttttaaatggtaagggggaattttgagtaaatatttggttgtaatgtattttaggggtggggggtttggatggagaggaattattggtttttatttaaaattttttttttgttgggtttaggttaggtttatatagttttggttatagattgtgagaattttggaaggttttaggggttggtttttattatgttttattttagtaagggtagatgttaggaaaaaaatggaaagggggagttaggtatggaaggttttagatttgttgtaggtaaaaggttgtagagtatttttagggagtagagattttataattaggttttttattttgttgttttttagggttgtttatagttggtttatttgtagttgtattatttaagagatagagataggtttatatgtagtagttggagagaaggggttggaataaggattttttttaaatggaaaaataaagattattgggggaattttttgtttatttagtagtttgtgtgtatttagtttttttggtagggaatgagggtttgttgttttttgttgaagattattgttttggagatgggatgggtgggaagaaaaatgttagtaggggttttgtttttgttattttttttttttggttgatttttggaattttttttttggttgatttttgaaattgagttttgggaatggaaggggattttgtgatgtttttaatatttttttaagaatgtatgtttttagttggagttgtagttaggtaaggagttagttgtaaattgtattttttttataattttgtgataggggaatatatgtaaatatgagatgggttattgttggggaggtattggatgggggatgtgtttaggaggtttttgttagttatggattgaatatatgttagttatgtggtatggtttttatataaaaatagaattttgagtttggttttataaataggtttattttttatttttgagtgtgtagtgggagagggtgtattgtttttatgtagggtaaatttgtttgtatggggttgggggttttgtattttagtatgggtttggaaagtattagaagtgtattttatttaatttgatttagtaagtatgtttttgtggtttatggtttgtgttggtaatttaaatttgatagtatataaattatgtgatggtgatggaggggtaggtatagtaatgtttagttttttatttttaggtagtggtattttttttgttttttttgtaatagtagtttgggaggtttttaatgtttttattttttttgggtatatttgaattatgttttgtttttatatatataaaagggttatttgaggagttttggttatatggtagttgtttggaaataggttgtttgatgtattgataattataagaaatttggaagagtaaaatttgttttatagttggtatgttatttgtatattaaaatgagagtataatgtaaaagaaatgttttaatattttttttattaggtttaaatttgttgtgattatttaggaatttattttatttaattaaatatgaattgagtattttttatatagttgggggtaggggtgtttaaatagatatgaataattatgatataaaatttattgtatatatatatagaaaatggatgtagatataaaatgaataaatatgaaatgaatgtagataaaggataggttaatttttattgaaggggaggtaggagggtttaataaaggagttgaatgtagttgggatgtaagattagggtaggagtaggggtgaggattgggagtagaaagtaaggaggatagagaattttaatgggaggtagattggaaagtgggttggtgttagttttgaaggttagttgtatattaaattttgtagtttggtatataatgatttttgagttaatttttagggttggtattttgaaggttattgaaggggaggtaggaggatttggtttgtggtagtttttaggtgagaggtaagaagtaaggagagaaggtagagatggtataggatggtgggaagggagtttttggtgtttaatttttgttaggtagggttttattttgttattttatgatttttatatgatgattgtatggagtagatgttattatttttattgtagatttgggttttttgggtttttttttaaaataagatttatttaaaagatattttttataatatgggtttgaattataggttttttgaggttattatggaaggatattggtatttatttaatagtaaaattgttttaaaatattttttgtagatatttgtttttttttagtgttttgttttttgtggtagttgtttttttttttttgttttttatttttttttttattattttttttttggatttttttttttataagagttttaggttattattttttatttagagtgattttttgtttttttgatttgtttattagttgttttagttagtaagatgaagggttttttttaggaattaatttttttagaaagtattagaattttgtatgttttttattttatattttggttgggttatattttaataaggaaattgaagtttggagaaattaagtgttttttaaggtgtttaatagagatgttttaggaagataaatggtattgatgaagaggatggatgggttgggaataggtgttgaaagagaaggatattaatttatgatattttggaaaatataaaattttagggatatagaagagaagagaagttgttagggttaagggttagggggtggtgggtagtttgagtataaatttttattatgaaatatgtttggggggtgattgatttgttttgtatattgattagagtagtggttatttttttgtttatttattaaaatttataaagttatataaaaatgatgaattttattgtaggtaaatttaagaataatttttgaaatgataggaagattggttaggaggttatagtatatgtaagaaggaatgagaggttgaattagagtagtagtagtagtaggataaaaaaataataaaataattttaaaaatttaaaaattagagatttagggaagagagatttttagaagtaggatttagatatgtggggagtatgagtgaagaatttagatatgtagatttttagggttggaaagaattttaagagatgatttaggaaagttttattttatagatgagaaaattaagttgaaaatgatttaagagtttggggttttgtttgggtggatagtgatattattaagtagatagaatagatatagatgagtaggtgagaggaggaagttgatgagtttattttggatattttgattttggaatatttatgttattaagatttttttttttagtttttaggaatttgaaaataaaattgttgggttttggtattgagtgtaatatttttttataaatattgttttattatagttataatgaaaaagaattttgaatatagatttttatatgaagatgatatattagttttttttgagttgtttttgttttgtgatttttttttagtattataaagagggaatgatattgatttagtaaagattttaggtatattatttattaatatatttgttatgaatattattatatttttatgtgtttatataataaagtttttttttttttattaaaaataatataaattaagttttgaaaagtagttgttttttatttttattgatgttaggttataatttattgttgttttgtttttgttttagaatatttagtaagtaattaagggaagatgggtattgatttgttattagttagtaggtatagtttagtgaaagtttttatgttgtatatagggttgaaattaaggagttttttgtttatattttagagtaatttggaaaatgatttggtttagtagttaaggggagaaaagaagtagagtttttaatattattatagttattgggatatgtaattaattttaagaattagaaatttaagttgtaaattattaagaaagtataatgtttttggtagtaaagtttaattatagaagaataatataaatataaagttaatagtatttataataattgtttattgtttttttaagagttgagtaaagtgaatgtaaagatggtgagtttaaggaagaatttagaatgttggtatatttaggtagggattttgttttgtttgttgataaatttatatgtgtagtatagtgtttggtatataataggtttttaatatgtaattgttgaatgaatgaatgaatgaagttaggagagaagtgaataagtaaagtaagagatagtaaagttattatattttatttatttatttagtaaatgttattgagtttttattaatgtgaggtttttttttaaggtatggtggtggatatatataagtttaaaataataatttagaaaatagttttgggttttaatatgtttataatttggaagaggaagaaggaaaagtatagtaaatatttgtatattaaagtaatattaaagagtatgtgataaggtttggaaaaatggtataaaaaaaaagaaaaaggttgaaaaggtggtaaagatttagaaattagtggggttatttttaatagggatattgttattttgaaggtgagattagatttgggttttaagggatggagaattttgatgggaatagaatattttgggatgtaaaaatagtaggaaaaagatttttagaatagagaaggtagggtgggtttagagtatagtaattttgttaaggagtagtagggaatgatgaagaaaatgttatataggttgtagtgaaagatggagagaggaatttgaatagttggataaaggaaaatgaagatttatttaggaaaagaggagttttaaaataaaaaaaagggtggtttatgtttataattttagtttttgaggaggttaaggtaggtggattatttgaggttaggagtttaagattagtttggttaatatggtgaaattttgtttttattaaaaatataaaaattagttaggtatggtggtgtatgtttgtaattttagttatttgaaaggttgaggtaggagaattatttgagtttgggaggtggaggttgtagtgagttaagatggttttattgtattttagttgggtgatagagtgagattttattttaagaagaaaaataattagggaagaattttaattaaattattataaagtataagataaattggagtgtggagaaattggagtaggtgaatgaatttttttagggaagagttaagaaggtggtggtagtaagattagtgagggaggaatggagggtagtgaaggatgttgggtttaaaaatttgagtagaagttggaagaatgtattttaggttttgagtttgggtgattggaatagtgatgagagtaggaagagaaattgttgagtttaaggaaggttttggagggatgatgatgagtttagttttggattaaatattttgattatgtgtttaatttgaattgttaataggaagtttagatagaaagggttattaggaaatagtatataagtagaattggaatttgtagaaatatttatttgagaattagttgtatatagatgatatggaagttgtggggatgaaaaaggttttgtataagagaattaggaaaaaaaaagtgagataatgagttaagatagatagtattaaaggaattttttaattatttgtttaatgtaaaaatggaaatgaggtgaggtttgtttttttagaatatgttttttatagtaaaagagaatttatttttaaaattggtttttattttgagttaaagaaaatattttaatattttatttatagtaaggattattatagtaattttgtgtgataaagtttaggataaatgttatggtaggaattttatttgaatgagatagtaggatggaaggaaggaaataggagtttttgttttggagagattattttttatgggtttagtttaggttttatttagtaggaaaaaaatttgtaaggtttaaataagtatttttatttggtagaaggtaatggaaaagaataatttaatttatttaatttgtagttgttatagatataaaaataagagaagatatgaatattgtgtgggttgaatgttttttttttatttttatttttattttatttggtttttttttttaggttattattaatatattttaaaagtttttgagatggtgataaagtggtttattatttgtgaattttttttttatagaagagtgataggttttaagaataaatttttttattttagtatggaataaaagtttgattttaatatttggtatttatagttgttttttatgaatagaaagaatatagttaatttaattggttttttgaaggtatgttattttttttttgtggtttaatttatgttgtagattgaaaagtgtaaaaaagtaaaaaatggataaggtttttataagagttatttagtagatgttgatttttttttaatattaaatgtttgaggtgtatatgattggtttttatttttttgtatttgttgaaagaatttttaaattgttttttaaatgaattattattttgattggggatattgaagtttatggttatttttaaaaattatattttgtaaaaagttattattttttttattaaagatttataatatagtgttgatgggaatgtgatttagttggatagttatttttagatatgtttgatgttttttaataggttattatttgtattagaaattaatatttattaagtgttaataggtttatagttttgttttgaattatttagaggaagttaaatataagagtttgtaatttaaattaaagtgtattattttaatttgtaaaagatttgggaatatatgaaagagtataaagataaagtaaatagttttgagttatttagtttagttggaattatttttgttatattattaattgaggttttggagtatttatgagtattttttttttttttttttttaataaagtgggaaaaaatgttgaaagaattttttagatgtattttttttttgtgttggaaagataattttattgaaataggaatggaatttagtttatgttttttttttttatttttagaattttaaataaagaaatgaatgtttataaggtggtttggggaaatagttagaagatttttatgggaagtaagttaaattgagagtttaagaagattagaaattattttatattagtgttgggtttataggagagttaggtgataggagaaagggttagtgatgtggatagattatgatagtgatagtgaagagagtttaggtaagatttaatgaatgatttaatagattaattggagtggttttagtggataggtttgtatgtttttaatgatatagaaatttataaaatagtttattggtttttagaaaaatattggaaggatttattataaatttttagttttagttaattttagtgtaaaaaaaaaaaaaaaaaaaaattatgtttaattttttaaaagatttatatgtgtagggttattattttagatattagtttgtttgggattattttggtttattttattgttttagaataatgattaataataagtgttttagtttggatgagatatgttatgattattttagatatgaaagaatggtaatttaataggttaatgaatattaagataaaatatttttagaaaggtttttttttttaattgtggttttagattttatatagtgtatttatatgtattatgttagttgggatttgtattttggtaatagaaagggggggtttgtgtatagaaggaaatgggtttatgttggtattatttaggtgtttagtaaatggatagtaaataaattgttgttgaagaaaggtaatgaaagaattttttttattaatgttttgaatgaatggttttttagttatgatatattgtattgaggaatggtttaatagttttttttgattttgggagtgaaataagtatgggggtaaagagtattaggaagatttttattgtaggaaattttgtgaagaaagtgttgaagaaagtgtttttttattatgtattagggaaggagtttaggagttttttgttaattgtagtaggtatgggtttagagatagaagatttttgtggtttgggtattttttttgttgttgtaggtgatgagtaataatagtgatggtttttatgttataatttggtggttgttggatttttattttggttggagggtgtgtttttataggggaagtttataagagttaagttgggttttgagttttatgtaatgtgtaagatgtgtattaagatgattttatttttggttggatttagttttgggataatatttttattttgtagagtttagttaggtttttagtggttttaagatagtatataagtagttgggatgggaaaataaggtttagtaatatgaaattaaaatatttttttagtttgattgtattgtttaggatgaaattttttttaattttattgaatattttaaattaaaatatatttaaattttgaatattagtagtatttgtattttttttttttggggttgtgaagggagggtggagtgttgtaatagaataataatttttagtataggaaaatttttaatatgtaggttgttatttgtttgatttattttttttttaattaagttaagtaattattaatagttttttatgagatattttttattgagattaaaggaatgattagtaagaaatagtgtatgtgttgtggtagtgtgagtgtgggtttttaaatgggtatatttttagaagatgggatagtaggttttgaggaggtagttttgtggaagagattggggtgtttagaggattttggatatttggaatatttatatatggtgtttgttttggggttggggggagataagtatatatagaaatattataattagttttttttagtaaatatattaaaataaaggaaaatgggattaaagtatagttagtaatgtgaaaagttttattttaaaatttaaagtaagattttaaaatagaatatgttttaatagagtatgtaaatttatggaaatatttttttatttggtttttgattttttataggtattttttatgtaatagtttagttttaaattttttttaggaagtagttggttattagagatttttatttttgtgttttttttttttttttttttttgtaaatttagtattttttttttatgtgatgtattatgtttggagttggtagagtaaaagtttgttatttttaaaatatgaagagaataatttagtgttttattttgtgattatagagaatgtaattaatattttggttgttttggtatgtagattaaattttttgttatagtgttttgtagtgttgttgtttagggtagttttgttaatttttttattttaatagaaatgatgttagattttttggtgttaagtaaagtataatgaggtggaagaggtggttggaatttttagtgagggaatgtgtttttgggatgattttttataaaatataaagttattttaagatttaatagtttttgtatttttgtatttatgaaatttaattaaaataaattttttaaaaagaaaaagtaggttgggtagggtggtttatatttgtaatttttgtattttgggaggttgaggttggtagattatttgtggttaggaatttaagattagtttgattaatatggtgaaattttgtttttattaaaaatataaaaaattagttgggtgtggtggtatatatttgtagttttagttatttaggaggttgaggtaggagaattatttgaatttgggaggttgaggttgtagtgagttaagattatattattgtattttagtttgggtgatagagtgagaatttgttttaaaagaaaagaaaaaaaaaagtagttaaatttttatgttatttatttatggtttaaaagttttttaatttatagaaggtataagatagggaaaatttttttaaattgagaatatgtagtgatttattaaattatatgagtaatgttggagaattattatttgtgtaatattagattttgaagataggagataagaaataattataatttggttgagtttggtggtttatatttgtaattttagaattttgggaggttaaggtgggtggattatgaggttaagattagtttggttaagatggtgaaatttttatttttattgaaaatattaaaaaaaaaaaaaaaaattagttaggtatggtggtgagtgtttatagttttagttatttaggaggttggggtagagaattgtttgaatttgggaggtagaggttgtagtgagttgagattgtgttattgtattttagtttgggagatagagtgagattttattttaaaaaaagataataatagtaataattattattattattataatttatagaaagtgtagggataaggagaatagagagaattaagaaagataagtaggtataaatgtttttagatattatattataatatgtatgtattggttatagttgtaaagaaattttagatttaatttgtgtttgttaagggttaagtgaatggtttaggttaatgattttatttgttatagattttagtgtttttagtatattagatagtagaaagagtagtagtgagaagtaaaatttttatattattattgatagtttattaatataatttttgttgattttttggtttttgaaatttatagaattataaaatgttagtgagggattttgtaatttaatttttttatttgtagatgaagaaatgaaagtttagaagagtatatgatatgtttaaatagtaagtgtttggtgggttagaagaatataatttaaggtttgttgttttaaatgtttttaataattatatagtttttatttatatttattttttttttttgattaattttttttttttttttagaattgtatttttttaattttttttttaagttatttttaatgttgggtgattatttgggttggattttttgtttttttggtttagggtatttgttttgtttttttattttttaaggattaaatttagttttaggattttttgataggtgggatttattaattttgttttatgttgttaggaattttttttaatagtagttgatttttaatagaagaaaatgttttttggttgtgattatatgtttgttttattttgattttgtttttttttaatgggttttaaaatttagtaagttttatttttatattgaatatttattataggttttgattattgtgttttattagttagttgtagagtatgtttgtgtgtatttatatatatatgtatatagaaatatttttaagtgggttgtgttttattatttttggtatagaaataaaagtaaatatttttatgtataaattttagtgtatttttaatagatattagaatagaagttgaaagttttatttttaatttttttaatttagttgtaatggtttagtttggtaagagttagaaattattgaagtttttttttttgagataaggttttattttgttatttaggttggagtggagtggtataattatggtttattgtagttttaattttttattttagttttaagggatttttttattttagttttttaagtagttgaaattataggtatatgttattatgattggtttaattgttttgtgttttgtagaggtagggttttgttaagttgtttaagttagttttgaatatttgggtttaagtgattttttagttttggttttttatagtgtggggattataggtatgagttattatgtttatttagaaattattgaagttttatttttggtttaatttttagggtaggttggtaatagtgattttttatattttagtatgtttatttgtaaaagtatggtgaggttttttttgtttagtttagtagattgataatgggagttataagaatatgaatatgaatgaattttaaaaagggttatataattgtagtttattgaagaaaaaaggaaaggtttttttatttttttatatagtaatatttaattatgggaataaaaaggtgattatattgtgtaataaatggttagtagtttagattagtgttgtttaatagaaatataatgggaattggttttgtatggtggtttatgtttgtaattttagtattttgggaggttgaggtgggtggattatgagtttaggagattgagattattttggttaatatggtgaaattttgtttttattaaaaatataaaaaatttagttggggatggtggtgggtgtttgtagttttagttgtttgggaggttgaggtaggagaatggtatgaattttggaggtggaggttgtagtgagttaagattatgttattgtattttagtttgggtgatatagtgaaattttgttttaaaaaaaaaagaaagaaagaaatataatgggaattatatatgtaattttaaatttttagtggttatgtttagtatattttattaaattaatatatttaaaatattattattttaatataaaatttttataaaaattattgataaaatattttgtatttatttatttatattatatttttgaaatttagtaaatttggtgtgtattttatattttaattgtattttaatttagattggttatattatgtgagtttggtagttatagttatggtattggagagggtaggagtagattttagatataatgttatggtgttatattttggtggtatagagtagtttttttttagtgtttagtatagtgttttttagtgattaaatgtttaattaagatgtgtaggatgagtaaatgtttggatatatattgtgattgtagaaaatttgtagaataagaggaagaataaaggattttttgaaaaagtattagtttgtgttgatttttttttgtttttaaaatatagaagttttggtttgtagattgttaaagggaaagttgttgtttataatgaaattttaggtgtggtattggttgatggggtgagttatttttttgtaagttatttttaatttgtttttttgtggatttgtttggttttttaagtggttgtttttaaaagtttaggaatattgttgaaaatagatgagtatgtgtttttgggatttgtatttttgtgaaattatttgtattttattaggtaaatttgtataaaattggagttaagagagtttggttgggtttttaggttggtattttttttttgtgttgttatggttattagtatttattattatttattagggtggttgagtaagatagatttttaattagaattggtagataaatggaattttttttttatgttgatatgaaaattagtgttttttggggtaaatgagtgaaggaattttgagttgtaatttggttgttgtattttttgttatgataagagtttattttatatgattttgatttatggtttgaaaatatagtttagttgtggttgtaatgatttagaatggtatatatatttgaatgttaaggagtttagattttggtttatgggttatttgggaaattaaatttattattttttattttagaaagttaagggttttgatttttaaagtaaggtttatttttaagggttttttttttttttagttagttatgttgatggtaagttttaggtaaggtgtaaatagttatttttaaatgtatatatttatttttttttttgggataaaggataaaagttaaattatagtgatgtttaatttatttatggttaagggaataaggtaaattatataatagagaaggataaaggtggaaggaaaaatatatagaaaataatgtaatgttattttatattttgttatttttattttaattatttatttttttttaggattattttttagagaaattttatttttattataaaattagttttttatgttagggaaaaggttgtggagttgttattattgttattgttatttttattaaggttattttagatggtatgtttatgtgagataaatggttttttaaataggtttttttgtattttgttattatttaggtttgttttgagttattatttttggggttttgaaagtagtagttttttggaaggtttaaaagttgggtggtagtagagtaatagaattaagggttttaagtattttaaaattgtttgggtttaaattttagtttagttatttaaatagttgtaatgggtttttttttgtaagttttagtgtttttatttgtaagataaggataaaaatattattattttttagtattgttgtaagaaagaaatatatgaatagtgatagaatgtttagaaagagttgggtaaagtataggttatgtgaatttttgttttattattgttgtgagtatagttggggtgttattttaatatttgtttgtattgtttgttatgtgtatttagttgtttgtgtatttatttatttagttaatattattgagtatttattatgtgtttgttttgtgttaagtattgagtgtttagtgatgattaattgtgtataattttgttgattttattttagaatatttttttaggtagttttattttgggagtttttattgtttatgttttggggtagttgtttagtatttttatttgggtatttgattttatttttttatttggtttttttgttgtttttagtgttattaatatattgttattagtagtatttttattaataaaaaaatttagttatgttatttagtattttgttagaaattttttattggtattttattgtaggaaaggtttaattaaattttttagtggggtatatagagttttggagagtgagtttttattatttttttgttttatttttttttattttatttttaattgttttttttttggttattttggtttttttgttatttttaagtttggtaggttttttaattattttgtttatttgtatatggtatttttttatattttttagagagtaagattttttgttttttttttttttttttttttttttttttgaataaatttttatgtattttttaagtttaggttaaatggtattttttttgtgaaattatttttaatttttttaggaaaaaatttattggattgtaatagatttgtttgtgtgtttgtttttttaggagattgttttttttaaggttagagattatgtttagaaatttagtaggtataaagaatgtggaataaataaatgattatgttttattgtatagtggttttaaaatgaagttaggaggtagagttgaggttgtaaagtagttttttataaaaattattttatgtattttgtagtgggggaggtggtttttttaaatatgtgtataatttaatttatgtatagatagaataatttagatgtagtaagatagtaaaaattttttttagaaattatatttttgtttatttgagttaagtttttattaattttttattttagaaagggaggtaggagatgaaaaagaatgaaagaagttagtaaatgtttttgaaggtttttttgtttatttaatatatatatatttatagagaaggtgttatttggtttgggtttgaaggatatgtaagagtttgtttaaaaaaaaagagaaaaaaataaaaaagaaagagattttgtgttttttttttttttttttttgtgtgtgtgtgtgtgtgtgtgtgtgtattttattttgatattgttgggattttttttttttattatagtttggattgaattattttatataagtaaattttttagatgattgaagtttaaatttttaaaaaattttaattatttggaatggagatatttttgtaatttattatttattttttttgaattttttgattttttttatagaaaataattttgttttgatgatttagtggtattattaggaattattaagattgttttgtgttatgatttagtgagaattttaggagttgtagagatttttgtgattgtttgttttatgtagaagagttttagagatttttgagttggttttaagagtatttttgtttttttttttgttgttagattttaaaataattttttgaataatttataggtttttattattttttttgttaggttaattttaatttaatatatttgttgtttttattggttgggtggggagtggaaatgataattaattttttgagaaaatggatttttaaaaaagtaaatggtatggaatattatttagttttaaaaaggaatgaaattttgatgtatgttatgatatgggtgaattttgaaaatatgttagataaaataagttagatataaaaggataaatattgtttgattttatttatgggaagaattaaatttttttttgaagagttaaatttatagagatagaaaatagaatagtggttatttaggattggggagaaaaagaaatagggagttatagtttaatgggtagagtttttatttggaatgatgaataagttttggaaatagatgttagtaatggtttatataataatggtttatgtaataaagtaaatgtgttgaaagttattgaattatatatttaaaattggtggaaaatgtaaattttatgtatattttaatttatatatatattatatatatatatatgtatgtatatttatatagatatatttttatatgaattggttgagaaggttggttgagtttttatgagtaatgggtatgaattttagtatatgtattttatgatatttttttgtatagaaggggttgaaatgattttttagtttttagttgtgatttatattgttattaagaaataatgatttttgaaggtgttaatgtattttgtaattataaagattttttatttataaattatagtattggtgataaataggtattttgagttttttggagaatattatgaataattttaaagagaattgagttttagaaggggtggggttttgttttttttatatgggaaattagtgtgtttgtttatggtatagaatttaaatttatttttttttttttttgagattaaattttagaattaagaggttatatgtaaagttgttaaaagaataaaaatattgattatttgaatttattaggattttaaggatatgtaaaaattatataatgtagttttttaaatattataatgttgggttatgttttataaatgaaatattttaggtaatattggatgaatatttttaaagtagtttggtttataaaagagaggaggttaggtgtggtggtttatgtttgtaattttagtattttgggagggaggttgaggtaggtggattatttgaggttaggagtttgagattagtttggttaatatgatgaaaattagtttttattaaaaaaaatataaaaaaatgagttaggtgtgttggtaggtgtttgtaattttagttatttgggaggttgaggttgtagtgagttgggattgtattattgtattttagtttgggtaataagagtaaaatttttttttaaaaaaaaaaaaaagagagagaaagagagaaagagagagaggaaatagttggtggtttgtttagtttaattaatatagagtttggggtttggggagtttgatggtgaattttgttttgtttaatgaaaggttattattgtttttttgtttgaataataatttttttttttttttggtttttttatgaaatattatgaagttttattttaaaaagttataatatgttgtgtttagggaagatgttgaattgaaattttttaatatgtgttttattaaataaattatttaaaatattatttttgtttttttgaagagtgatttattttgtatatgaatttagagtgagttaaatatttaatttatatatgttttataatataagagatatataaataaatgagaaagtaggggggaaaaagaggtttagtaaggatgtagtaagagttttttattttgttagaattttgtgtttaagttttttttaagaaagtagttttttggtttatgttgaaatttttttagttttgtaaataatataagggtattttgtttaaatgttattatggaaatattgtgttgttttgggttaaatgtatttaaattaaattgagggggatggaaataatttttttttgatatgttttggttgttgaaggtgggtttgtttttaagtagaataaaatgtatagttgaatataaaaatagatatatttttattttgtaaatttgagtgatatgttattttatttttggattttagaagaaaaaaaatattaaggttatgtttaaaataaaaagagtgaagggaaaaggattatattagaggtaaaattgtagattttttttatttttttattaaggtattaggtaggttataatttgatagtgagattatttttttggaattaggaaggtattgtgggtttgtttttttaatgtatattttgatttttgtaagagtttttgaattaggtgtttggttttggtaggaattagtgattagtatttattttttaaaggttatttaaatagattttaggagttaaaagggagatagaaaaaaaaagttgttttatttattttttaattatgagagaatttaaaattatatgttgtaggaaagattttattttttagttattaaaataaagatgattaattggttttttaaagaatttaaaaggttatatgtataaagttgtttttttgtaatatgtttttgtttaaatttttgttttaaaaatttaagttttagaggatatgaatattatttggattgtttaaataaaggatgttggttttgttttttattaggtaaagttaattgattttgtagaatttttgtttttgtatttataaatttattttttgtttttagggagaggttattgaggttaaataattttttatttttaaaagtgttaaatttagggtttggtatatattggggtttaataaatatttatttttttttttttttttgatttttggtgattgaggttaatgattaatgttgttataaatggaaatggggaaatgagaaggatgagtaggtaaggaaaagattgtgttaaatattttagttaaaaatagtaaaagtttttttaagtttatattgtttatggtaatttattttaaattgatgtaagggttatattatattaatatatttattatttttaaggtataatattgtttttaattattaatgaagaaaaatttattaaattttttttgtgtaaatttgtagtattgtttgaaaaattttaaagattaaggaagaagttaatattgttttattagtatttttgtattgtattgttttgtttttattattttgtggtttttatgttatattgttaatttttaagttgtttatttttttgatttttttataatgtgggatttataagagatgggagagtttttaatttgttatgttttttgttatagttttagtttttagaataatgattggtttagagtaggttttttatagtaaataaatatttataaatatttgttgattgaatgaatttgtagtaatatgttttttattattgtggaaattttattgatgaaggttttattatttttaatatttaaaaaatatgtattaaatatttttggttatttaaaaagaggagtttagtgttatttttttaattttatttagttattaaaggagatagtgttttagttaatgttttatgagtaaatttaaagattttgaaggatttttttatatttattagtgtttgtttttttaatttttttgttttatattttttttaaattttttaaatttttaagtttaggggtatatgtataggtttgttatataggtaaatttgttggatgttgttatatagattattttatttatttatgtattaagtttagtatttattagttattttttttgatggtttaatgtggtatttttttgggaaaagaaaaaagaaagatggaagagtaatatttataggattatatttatgggtatttttgattaaagttaattataatttttgaaaataataaataaggattttgaggaatttaaagaaataaaggtagtaaatagtatgttaatataatattgttgttagttaggtgttaataagtaaaaatagttatatatgtttatttaattttaattggtttttgttgaaaggggttgttttatagggtttttaagtgttagagattttgtatgttaattttattattgtttttttagtttatgtttaagtttgtttggtttataagtgtatttttatagggttttgagttgatggtaggtattaaatggaagtagttagatttttttttgttgtaagtatgagaaatgttgtaaaggttgaattgaagaagggaaagtaattagaaataaaagattgtattttaatttttttgaatatttttgatatagaaagtagtagagtatattagtttttaaaatgtaatatattttagtttttattaagtaattttgtgtttttatgaatatatatttagagaagtagtataggataaagaaatatttatgggatttttaatttagggaatgaatattagttttttttgtgtttattggtttgtatatatttttgttgggtgaatttttttttttatatgggtataaataaataattaatagtgtgtgtggggaggaaagtagggagaagttggaatataatatttgttttgtttagggttgttgtgaagattaaatgggttaatagatatggaatttttttttagaaattttaaaattttatgtaaaggtaagaaattattgttattttttttatttggaaaaaaattttatgaaaattgttttttataattgaattttttttttaaatatatttttattaattgatagttaataaagatttattatatggtgaattttaataaaaatagtttttaattagataattttttaaaagtgaaataagaaaaaatatatatttgtataaggttaggtgaggtgatttatgtttgtaattttagtattttgggaggtggaggtaggaggattgtttgaagttaggagtttgtgattagtttgggtaataaagtgagattttgttgtaaaaaaagataagatagatattatttaggtgtggtggtatgtatttgtagttttagttatttaggagattgaggtgggaggattatttgagttttggagtttgaggtagtagtgaattgatatggtgttattgtattttagtttgggtaatagagtaagattttatttttaaaaataaataaataaataaataaataaaaaatataaaaaagtatttatatataattagaataatgattatattttttttaagttgtatagaaagattagtaaagttgaggaagaattgagttatgttttaaagtatttagttaattattattttttttaaaaaatttttttattttagttttaattattgtgtaaagttagtaattttttgttgtttttattattatttttttaggttaggtatttgattttttgtttgtttgttgaaagagttttttatttggttattgattttttttttgttttattaatggtttggagtggagttagggtgatgtatttgaaataaatttttttagggtgggttatttttagtattatttttttgatttatttatttgtattttttattttagttaggttgaattttttagtttttgtagtttattatgtggttgtttgtttttggtttttgtttttgaagttttgtttggggttatatttggttttttttatttattttattatattgatttttgtttattttttaggttttagttttttttttgggaagatttttttgattttaataaatgttattattattgttgtatttttttttatagttttaaatatgtttttttgtagttgatgttgaatggtttttatttttttagattaagtttgtttaatttatggtaggttttgaatatagtttaatatatatttgtaaatttttttaaaatattatgaggtttttttgtgttttttttttttttttagtttattagttattatttgtgttagtgtattttatgtgtggtttaagataatttttttttttttaatgtggtttagggaagttaaaagattggatagtattgttttagattattagttatgttgttttggtttttattttttatttttttagggtttggtttaatatttttttaaaagtatggtataaatgaataattgattttttgttttgtttgttttaattatgtgattgagtgtaaaaaaataattatttatttaaaaatatagagatgtaagtgaattttttgttataataatgagtttattttttattaatattttgttgtgttaaataggtagagaggttttaaaaaagagttaagtattttaatttatattaaatttttttatattttttatattttaaaagtattggtttagttatgggtgatgttttttaagtattttgtataaaaggtatttttaaattttaatgatatgtatttttattggttaatttttaattgagttaaatattaaatgtttatattaattagataaagtatttttagttattgatttgtagtgatagtttgtgttatttttatatataggttaagtatgaaatagaaaattaataattttttaattgtatttttaaagtattatttatgggaaagaaaattatatttaaaggaaatttgtgtaatggttgttatttttttttttgagttataagttgttataaagtaggagagtttatttttttatagatatggataagtttaagaattttattgttattggatgtatttattaagaaggaatttggtagtagtataggggatagatattttggagaataggttaattatttgggtgttttttataatttgaagtttttgaatttatttatagataagttgtttgaagagggtttggtaatgggaatataatgtatagatggttattgaagaaataagagggaggaagggaggttggaagagagaagagaatttgtttgtggttttatttatggggataaatttataagttgatatatttatttttttaaaaagtttttggagaagtatggttaagttttattataagtaaataaattaaaattttttttaaatagatgataattgatgagtaataatgttttgagtttgttttatgttaatggatgagggtttttaaaatataaattttattagttgttaaaattatagataggttgtgatgttggtttgaattagaatagagaatttagttaaaagttgttaggttaatggttttatgtaagatattttaggtggtttttttgttgagtagtgtttttagaaatggaattttaggttttgttgtttttgggaatgttgtattgtattgatttttatttttaattggttgtttatttttatgggagaagaatgaggggattatttatttttgtgatttttgtgttgtagttttttttatatttgagttataatattgattagagttaaaatttattttgtttttattgtgagaattttgggttagttttgttttttataatgatggggtgatgaataattttagtttttaaaatttttttagtttgggttaggtttgagatgtgaaataaaaggaatgagagtaattaggtatatgtatatatattgtgtgtttataatttttgtataaatagatagaatgtgataattagtaggttggtatttatattagtattaaggattaataaatgttaaatgtttaatatagagtaaaatttagatttttttttaggaataaatgatatatttttttaatttaatgaaaaggatgaaattaaaatatttaataggtatttttttttttttatttttattaaatattaatgaatttgtaggatgggatattttagatatatatatatatatatataaatatatattataataaaagaagtaggagaaaattagttgtttaggatgaattgtttagaatgttttaatataattattttatttatttatttaataaatagttattgtgtgtgtttattatttattatgtttggtgttaggttgaatttaatagaagaaatattttattaataaggaagttttaatgagaaaggatattttgattttgtaagatttagagttatatatagaggatattattaggatatttggaataatattaatttgatttaagttgaagtatttattaagttggtaaattggtagtgggaagttaagttttgaatagtaaagttgtaggttaattattttaatttaatttatgtaagtttatagattatttttgggaaaaggtggggtgtaaataatagttgtaaattaagatagtattagtagtagtatttaggattatttagggtaatgaaagaaggtaaaagagaaatttatatgatttgaggggaaagatatattatggtttaattttaattttttttttgagatttagatttttatgtttaaggtttattgggtatttttatttggatattttattggaatgtttaaaatgaaatttattatatgtatgttataaagtagtaattgttgttattttttttttttttttggaagatagtattattttttgaggtagttaggatggtatttgagttttgatttttttttttttttattttttatatttgatttgttgttagttttttgattttatatgtgtagtgtgtttatatttgttttgttttttttgttttaggtgttttagattttatatttggttttttttgtttaggtttagttattgttaattttttttttatgtatatattttgttttgtttgagaatttttgtaatatttttttaatatttttggtatagttaaatgtagttattttttagtaattttaggggattggttttaggaatttttagtggatattaaaatttgaagatgtttaagtttttgatattaaatgagtagtatttgtatatgtatatttttttatatattttattttatttatttgtttgtttatttatttattttttgagatagagttttgttttgttttttaggttggagtgtagtgatatgattttggtttattgtaatttttgttttttgggtttaagtaatttttttgttttagttttttgagtagttgggattataggtgtttattattatatttggttaatttttttatttttagtagagaaagggttttattatgttggttaggttggatttgaatttttgattttaagtgatttatttattttgagtttttatagtgttgggattataggtttaagttattgtgtttgttttattttatatatttttgatttaaagttggttgaatttatggatgtggaatttaaagatagggagggttgtttatataagttttataatttagtatgtagtggtaagtttttaaaattatggatttattttaggagagttttttatgttttagttaaattagattttttataattttttaaatatattttttgtatttatgtttgttttgatgtttttagtttttattatttgaaagattttttttttgtattgtttgtttgttttttaaaatttgttttaatattatttttggtatgaaattttttagatattattgtagttgggttgggtttttttgtttattatatattgtttaggattatagtgatttgtatttttgttttggttttttattgattggtaagttttttgaaggtaaaagttattttagatatttttttgtttaattaaaatatttagtatagagttttgtatggtgtagggttttaataaatgttttttttaatgaaataagttagtgtgtatgtttttttaaataattagattttaaaatttttttttatgattattattattttggtttttgggaatttagggttaagttttgtggataattgtttattttttttaattaggatttttttaaattattttttttttatattattattttaatgtttagtaagtggttttgtttttttgtttttataattttgttataaaatattttaaaatttttttgtgtgtttttagtgtgtgtgtttttaaagatgttggtaggaatttataaaggatatggttaggagatagttttgaaattttatatttagaaatgttaatgttgttattttttatggatttgtttttttttttttaagaagataaattaatatttaaagttgatgatataatttgtatttaattttatttttattttaattgtaaattagatattaatatatttgagatatagtattgaattaagaagattaagtttatgtgttttatgtttttttagaaaattttaatgtagttgagaggaatatttggttgtaatttaattttagagttaatatagagatatagtatttattatgttgtaaagtagaaaaaatattattttggttatttgttaaggagagttggaaaaagttaagaagagatagtttgtaatattgattttttgtttggtgttttaagtattaaaattggtaaatttattatattttgttgtagtttaattgtttttttgatagttaaaaataaggaaatatggtaattggatttgttataagaaaagatgtattggttttaatggagaaaattttttttgaaaaattaaagttttatttgatatagtgggtttttgggttgtttttgggagatatgataatgagtagagtggagttagttattagtttttgatttattatatggaagttttagagagttgattattaattaaaaatggaatatgtttttatttttgaagttgtgaaggtaaaataagaagtagaatggaaatataaatttttttattgatgtatgtggtttaaatgtgatgtttaagggtaggtgttttttatagttaatttgtttatggaatgtggttgattgttttagaaaattatttaagttatttttagtatattgttataaatggttatattagtatgttagggagatttttttttttatatgtttaaaagggtgtttggggaagtagtttttattttaagttattttagtttagttagttaaatatttattgaagttttaggtataattttattataattttgtattagaggaattaaagtaagtataaattttgttagtagatattattttttttttgtataggttaaagtttataattattagaggaaaaggatagtgtttggttatagaattttgatttgtttagttgtttgtagtaagtttggggtgagggttatttttttattttgattagattttttatttttgtttttttttgttagtatttaagtgtattatggttttttttaggtaaattttatttattattaattggaagttaataaggagttatatttgagaggttttttattggtggaatgataaggtaggtaggggatggttataggggtggtggtatttatgagaaagttttatggtttggaagagagaggaataattatttaatttttatttatattgaaggatagatgggtgtattttttgtttggtaaatggagggtagagaaatagtgttatagtatatatagaattgggtatatataagaataataagtgataatttataaaaatatgtttttaagtgaaaatagttttgttggtattttgaaagttttatagtttttatttaaatgaatagattataagtttaaaaaagtttgaaggtaaatgttagtgttataatggattgtgaatttttgtaattagtattgtagaagtgttttgataaatagaatagtaatataattttaaattaaaataaaatagaagttttttttttttttgtttaaaggaagagtttttgttttggtttaaaatttatttgtattttttggtatataagagttatttaagaaagatagttttttaaattattttgttttagttagtttaattggagttttgattgttttttatttaaaaagaattaatgaaatgttttagaaattgtagattggtgtttattaagtttttttagtatgtataaatagtgtttagtgggttaatatttaataagggaattttttttgttttttagtttttttaagtatatgtttatgttatatagtattttttaaagtatttatattttggttttgtttaaattaggtttaatgtatatatgaatagttatatggttagaaataatgtttttagattaaggttgaagtatatgtaaaataatttatagttatttgttttttttttttaagtttttgagtttaggattatgtttattaggttgtatgataattatgagtttattaagatgtttgtaatattagtttgtgagtttatttagggtagaagtaaagttttttttgttgtgtttttaatttaatttaaggtaggatttatgtaagattggtaattatatttgtggaataattgttagtttttggatgatttttattattaattttgtttagatattaaatattaaggttgattaagttaaattaagagggatgaaagagaaaatttatagtggagtaaatttattgagtggttttttatatgtggttgatagaaaggatgattagattgataagttattgttatatttgaataaggtgatattagattattttaaaaaggttgaatagaatttttgaattttaaatataatatatttttgggggaaaaagaaaatgttttatttgtatattataaagatagtgttgttttttagtataaatgtatttttgttgagatattgttttgttaaattattgttaagatataatgagtgattttagaaaagggtgtggaggtatgttgggtgggaagaattattgttaatatgtagtatttatatatttgtttatgagtgggtgtattatttttttaaatagtgtaataggattgggaatagagataagaaaaaataataagaattttgtttgttttttttttatttttaatttatggttttttgttatttggtatgttgtgtggtttgatgatatttaagtaatttgaaatgtattagtttaattaaagattgttaaaaagggtaatttatttttattagaaagtatagttgaaagtaatagaatgtgtaaaagaaagttatgtttttaatggatgttaaatagtaataaaatagaaaagagaatttagttaattataaaattttatgaatgtttagaaataattatattatagtatatgattgaaaattttatgagaaatagtgtgtttttttttattatataaattattgaaaggggttatgtgatttttgtaggtagaaagatgtatttttttaaggaaagtttattatgaaatatattatttaagattagattatttttaagttatttttaattttattgttttgttgttaaaattggttataagtagttaatttttagatattagaaaaatgatgtttttttatgtaatttgtatattggtatgagaatggtattgttttttagttaattaaatgttttgttggatgtggattgttttgagaaaggaaaaattgtttgttgattaatgaaaaggtagttgaattttattgggtgtggagaagtttttgtttttttaaattattaatattaaaaaattaaaaaataagttggattattattttgttaatagaataaagttaattttttataattttttgtttgaattattttatttttttagtggtttttattttatttttttttaagatatgaagttgaatgttgttatagtttttagtttagagggttattttttattatttgtttaaaatttaattttttgtttgtaagagtttttttgttttaaagaagttgtaaggttattaaagttatttatagaatttaaattgtgttatgaggggataaaataataattaatagagttattaaaagagttaatttttttgtttttaattgaagaaaagttattttattttttaatgggattagtgatgttaatataaattatataattattatgaaaaatatttatgagaagattgggtttatagttgatttatttgtttgttattttttttttatttaatttatgtttttttaaagttagattataatagtggatatttgggaaatatttggtattttaagtaatattatagatttttaaggttattggaaggggataatgtagaatttattttaggtagtaattttttttaaaagatgttattaggaattaaggatggtagttagtattgttaattttaatgtgtatataaattatatattttgatttagtagttttggggtgggagttgagttttagtatttttataaagttttgggggatgtatgtgttattgtttataagttatattgagtagtaaggtatttatattttttagaattgttttttttttattgttttttttgttttgtttttttttggatgttatataatgttttatttagatttaggaataaatttatattttattttatagttaattatttttttagtttttatttaatttgtagttttttgggataatttattagaggttgattattttaaggatttgatttatttatgttatggaatataaaagttaaatagatttttttagttttataaggttttaattttttatgagtagtagtaaagaaaaagaaatgatttgtagtttaaagtttggagtatttagtgtagtatttaggagatgggttaatttatggagttttggggatagtgtagattattgttatatgttaagaaaatatgttagtttttttttgaagttttattattaagattattttatattataaaatataatatattattagagatgtaattttaattggtgtaaatgtgaagaaaatttgtttgtatgttaaatgtttaaaatgatttttagattaataatgtatatttgaaatgataggtaaattatttattatttttaaatattattatttttattttaaagtgttttatgagtgtattttttggtatatatatatattttttttttaaatttttttgtttttttatatagttattatttatgtattgttttgaaagttattatatattttattattaattatttgtgtttttatatgatttatttttattagaagtagttttgttaaaaaatttttattatgttttatggtatgttattgtggtttggtattataaaatgtagtttttatatttattaattttagatatttgttgattataaagataggtttattatgaaaattttgttttataaaaagaaaaaagtgagtttttatttaaaaagaaattttagttatatgagagggtaatatattgaaatttagtaataaatattaaggttgtattttaatttttgttataaatatgtgtttttgttttttatatttttattaatttatttgatagatagatattagttattattttggatttattttaagtagaaagaaaatttgtaagtgtgaattttttataaaaatgtgaaatagtaaaattattaaattagttttattttggtttaaaaggattttttgggaatttggaagttttaatttttttagttatagtgattaaaaattaaattatttatttaattaaatatttaataaaaatattttttttattttttagtaaatttttttagaattattaaagatttgataatgtgagattttaataaataaataatttaagaagaggatttaaattttagaaatttaaattggggtattttagttaattttatttttaaatattaaatagtggtattaatattttgttaattttggttaaataagattagatgtttatattaattatttattttttttggttttttttttatttggttttttagtatgagtatattttgtaaaatgtaataaaaatatgtggtgtgttttttgatatttaatttatttgtagtaatttttaggttttttgtttttgttaggttttataaaataatgatattagttatttttttaagaggttataaaaggaagtattgaattgtattttgttttttaaagataattttttagattaaaataaaaagtgtaaaaaaaaaaaaaattttatataagaattatttttttataaatttattattttagatatgagatatagatttttattataatttttgatttttaggaattaaattttttttaataaagaattttagaaaagtataattgtatggtataatgatgaaagttttatttagtatagtatgagaaaaagattattttataaatgttttttaaagttataggtattaattattttaattaaagtaagggtaagataatttatagttaagaattaatttttttatattttatatagatatttagatgtaaattttttttagttgattataaaattaggtttattttgagtggtgaaaaataaaagattttaatattttagtaaattggtaaattatatataaattatagaatataaagaatgtagttgatgtaaattttgttattgataaggtagtaaagttatagtttgatattttttaggatattttattatgtttattgggaatatggtatatattggagattttagtttaaggattttggaatgttaatttagttttttataaatataattaagttttttagggaaaaagatttatattggttttttttttttggaaaattttattgattgatgatgtttttggttttttgtggagtttatttttttaattgggttgttttttaattttagtgtataatgggtttgttttaggggagtttgtttgggatgtagattgttaagatttaatttggtatttggtttataagtagtttttgaaatttttttttggttttaataagttgtttaagttaggaaatggtggttttggggatttttggatttttagtttgagaaatattgaaggggtattatttattattatattttattggattataaatgttagatttttggatttttatgattagtaagtaagttaaagatttttagatggtaggtgttattggttaggttgggagtgaatgttttgtttagaggaggaggtagggatgttgggaagtaataattttgattttattttgttggttttatagttttttattgttttaggagtttatttgtattttaatttttgtattttggatttgtggttttagtttagatttatattattaagtgtatttatttagtttttgttattttggatttaggtgtgtaggtgttggtttaggtatttagttatttatagggtgatgttgtttattaggggtgatattttttggttgatgttttttatatatatgattttattgaatttaaagaaggttataatttttttttagtttattttgtttttgaagagtttttttattattgtggtaaagtgtttttgtgtggtgaagggtgttaggtgtagttggttggatattttggtgaagttgtggtggtagtggtgggagaagttgttgttggtttggtggagggttaggtggattataggtggtattgggttgagtgtaggttttgtggtggtgttgggggtagttggggtttgtagtggtgaggttttggtgattgggttttgggatgtggttggatggggtgtgtgtttgggttgggaggagaagatgtttggtgtgggggtggtttttgggggtgtggtgtttatattttttgtattttatttgtagtttttttgtgatagtttataatggatgtattttattattattttttggttattgtattttgtttttttagtgtgtgttattttttttagaggaaaagtaatgggggttaatggtattttttgttttagtttttattttatggtttttagagaaagaagaggagttataatttagttattttattggatgtgttttgtatttttggatgagggggtgtttttaattatgtggaatatttgattttggtgttttttttttggtatgagatgtaggaaatttttattttaattttttttggatttttattttatgaggtatgttattattagtaagtattgttaatattagtttattttttttgtgatgttgaaaggttaaagaaaaaataaattaataagtaaaaaattaggtgtgtttttttgtatatattgagtgaaagtagggtatatatattataagtaatatggttaaaaagaatgtattaagttgtttggaaattaaatttatttgaatgtattttaagtaaaaaattttaaaggtttttattgaaagttatattaaattaattttttgtgtagagaatttatttgtattttttaagtatagtatgattttttgttaagttttttttttgtaaaattaaaataaatgtataaggtaatgattttattaatttttagtattttttagttatagttgatttgaaattttttaatgaattaggagttgtggggagagggagtaaaaattaggaggatttttagattgatttttagatttttgttttatagaaatgttaatttgtaggaattttaattggagattttaagagtttgagaaaaaaaaaaggtagtggtggtggtagatgaattataatttttagtttggtatttgtagaagttttgtgatgtttttttttttttggtaatttatatgtgtgtatatatgtgtgggtataggtatgaatttttatttatgggattgttttatgtttttttaggagagagataggggagaggggatgatgaaggagttggggatggaggtaggaatttttttttgattaaattttgaatagtaaatgtattttttgaaaagttgttggataaatgaaggtaggatgtgtttggtttgttggtgttgagtgttagaagtttgtgttgtgtgtggtgtggtgaggggtggggagaaggaggtggtgggggagggttttattttttttttttttttttaaaaaggatgattgttatgaagtttttttttttggatttttttttttgttgtattttattggtgtattttgtttttgggttgtgtatttttttttttttttttggttttgtgtggtggtgttggttatggttgttttttggagtttttgttgtgtagtttgttttgagtgttgatggttgttggtagggagggtttggagttttggtatttttgttggtagtggtggtggtggtagtgtggtggggttatggagagtggtgggtgggagtgtggtgggtgggtgggtaggtggtgtggaggggtgggtgtgggaggaagggggtgggagtggggttgtggtgtttgtttttttattttattttttgtatagtttgattggttttttgtgtgtaatgttatatggtttatttaaaaaaagaagaaagaaagagtttttttttgagttatttgattgttttttttgttttgttttttggtttgggttaaaggtgttgtggtaggtttgggagtggtgtgttttgttgggggtatatggtgtgtggggttgtggttggggagggtgtgtttgggttggttatttgtttgttttgttgtgtttgtggggtttggttagtgggtggtgtgggtggtataggttttttgtgtggttgtggtgtggtgggtgtgtgtggggttttttgtttaggtttgtggtaggttgtgtgtggatttggtggttgttggggtttgtgatggggtgggggtttttggggaattgtatgtggttgggttgggtggatgatggagtgtggaggggggtggttggtgggagggtgtgttatgaaaataagggttggaaaagtgttgggaattgtttggattttttttggttgtgtgagtgtgtgtggagtgtgtgtgtgtgtgtgtgtgtgtgtgtgtgttttgtttggattttttttagttgtgtatgtgggagtgtgtgtgttgtttggattttttttagttgtgtatgagagtgtgtatatgtgtttatatatatatatgttgtgttattggtgtttggttgttgggggaagatttaggttaatgttgttttttattgtttttagtagtgggattttagtgttgttttgttgtgaagataggtgattttgtatgttttaagtaatgtttagggatgttttgagtgtggtgtttatttttaagtagttttttaggtgtttgtgtattatatatgtatgtgtatttttgtttgtgtttatttgaatatttagtttgtggtttaggttatgtagaatttagtgttttagggaaggggtttattaagggttttatgatagtttaagttaatgttttttttttgtttttaatattttttatattggtttagtgttatatgatgaggatttttatatagtaatttttaggtttattgttttaatgttggggtgggtgggtttttaaaggtttttatttttgttttgtagttaattttagttggttgtatttttttaaatgaggtatatagatatatatatatatatttatatttgtagatgtgtgtatgtgtaagtagatagtt

SEQ ID NO: 227 - DNA, 198235 bp, Artificial Sequence
  Chemically-Treated DNA
aattgtttgtttgtgtgtatatatgtttgtgagtgtgaatgtgtatgtgtgtatttatgtattttatttgagaaagtgtggttaattaggattggttatgaggtaaaggtggagatttttaggagtttatttattttagtgttaggatggtgggtttgaaagttattatatggaagtttttattgtgtagtattaaattagtgtaaaaggtgttagggatagagggaaaatattgatttaaattgttgtaaagtttttgataaattttttttttggagtgttgagttttgtatggtttgggttatggattaggtgtttaggtggatatgggtggggatgtgtgtgtgtgtgtagtgtgtggatatttaggaagttatttgaaagtaaatattatgtttggggtgtttttagatattgtttaaaatgtgtagagttatttgtttttatagtagggtagtgttgaggttttattgttgggggtggtggggggtggtattggtttgggtttttttttggtggttgagtgttggtaatataatgtgtgtgtgtgtaggtgtgtgtatatatttttatatatggttagaaagggtttaggtgatatatatatttttatatatatggttagaaaaggtttaggtgagatatatatatatatatatatatatatatatattttatatatatttatatggttagaaagggtttaggtggtttttggtgtttttttagtttttgtttttatggtgtatttttttgttagttgtttttttttgtattttgttgtttgtttggtttggttgtgtgtggttttttgggagtttttattttgttgtggattttagtgattattaagtttgtatgtggtttgttgtaggtttgagtagaaggttttgtgtatatttattgtgttgtggttgtgtgggaggtttgtgttgtttgtgttatttattggttgggttttgtgggtgtagtggagtgggtgggtggttggtttggatgtgttttttttggttgtggttttgtgtgttatgtgtttttggtgggatgtgttatttttgggtttgttgtggtgtttttaatttgggttagggagtggggtggagggggtggttgggtggtttagaggagggtttttttttttttttttttttgaatgaattgtgtgatgttatgtataggaaattggttgggttgtgtagagaatgaagtaagaggataggtattatagttttgtttttgtttttttttttttgtgtttgtttttttgtgttgtttgtttgtttgtttgttgtgtttttgtttgttgttttttgtggttttgttgtgttgttgttgttgttgttgttagtgaaggtgttggggttttgggttttttttgttggtggttgttagtgtttggagtgggttgtgtggtgggagttttgggaggtggttgtagttagtgttgttgtgtaggattaggaggaggagaaagggtgtgtagtttggaggtggggtgtgttggtggggtgtagtggaagagggggtttaggggggagaattttgtagtagttattttttttaggaaaagagggaaaaaataaaatttttttttattatttttttttttttattttttgttgtattatatatagtgtgggtttttagtgtttggtattggtgggttaggtgtgttttgtttttatttatttagtagttttttggaaaatgtatttgttgtttggagtttaattagaagaggatttttgtttttgtttttggtttttttattgtttttttttttttgttttttttttggggaggtgtgaagtggttttgtggatagagatttatgtttgtgtttgtgtgtgtgtgtgtgtgtgtaaattgttgagaaggggaaaatattataggatttttgtgaatattggattgaaaattgtaatttatttgttgttgttgttgtttttttttttttttgagtttttgagatttttggttgggatttttgtggattgatatttttgtgaagtagaagtttgggaattgatttggaaatttttttaatttttattttttttttttgtgatttttgatttattgggaagttttaaattagttataattggagagtgttgaagattgatgggattgttgttttatgtatttgttttggttttataaaaaggaaatttgatagaggattatgttgtatttaaaaaatataagtaagttttttgtataggaaattggtttaatgtaatttttaatggaaatttttgagattttttatttaaagtgtatttgagtaaatttaatttttaggtagtttaatatattttttttagttgtgttatttgtagtgtgtatgttttgtttttatttagtgtgtatagggaaatgtatttgattttttatttattagtttgttttttttttaattttttagtattatagaggaagtagattgatattaataatatttattaataataatgtgttttatgaaataaagatttgaaaggaattggaataaaaattttttgtattttatgttaagggggaaatattagaattaagtgttttgtgtgattgaagatatttttttgtttaagaatgtaaagtatatttaataaaatagttggattataattttttttttttttttgggggttgtggggtgggagttggggtgagaggtgttgttggtttttgttgttttttttttgggaaggatggtgtatgttgggagaatagggtatgataattgggagatagtgatgaagtatatttattataagttgttgtagaggggttatgagtgggatgtgggagatgtgggtgttgtgtttttgggggttgtttttgtattgggtattttttttttttagtttgggtatatgttttatttagttgtattttgggatttggttgttaggattttgttgttgtagattttggttgtttttggtgttgttgtggggtttgtgtttagtttggtgttatttgtggtttatttgattttttgttaggttggtgatgattttttttgttgttattgttgtgattttgttgagatgtttagttagttgtatttgatgttttttattgtgtggggatgttttgttatggtggtggaggagttttttagggatggggtgaattgggggaggattgtggttttttttgagtttggtggggttatgtgtgtggagagtgttaattgggagatgttgtttttggtggataatattgttttgtggatgattgagtatttgaattggtatttgtatatttggatttaggataatggaggttgggtaggtgtatttggtgatgtgagtttgggttgaggttataggtttgagatgtgggggttggagtgtgggtgggtttttggggtaatgggaggttgtggagttggtgaaataaaattagagttgttgttttttggtgtttttatttttttttttggataaagtgtttatttttaatttgattgataatgtttgttatttaaaagtttttaatttgtttgttagttgtggagatttaaagatttagtgtttgtaatttagtaggatgtggtggtaaatggtatttttttagtgttttttaagttgaaggtttaggagtttttaggattattgttttttggtttgagtagtttgttggaattggagggaggttttagggattgtttatgaattagatattaggttgggttttgatagtttgtattttaaataagtttttttgaaataagtttgttgtatattaaaattggagaataatttgattagaagaatagattttatagaagattaagggtattattaattggtaaaattttttaaaagaggaaaattaatgtaagtttttttttttgaaaaatttagttgtgtttgtaaagagttaagttgatattttaaagtttttggattggaatttttagtgtgtgttatgtttttagtgggtgtgatgaggtgttttgaggagtattaggttatggttttgttattttgttagtgatagaatttgtattggttgtattttttgtattttataatttgtgtatggtttattagtttgttagaatgttagaattttttgttttttattatttagagtggatttaattttgtggttggttgaaaaaaatttgtatttaggtatttatgtaaagtgtagaagaattgatttttagttgtggattattttatttttattttagttgaagtgattgatatttgtggttttgaagaatatttgtgagatgattttttttttgtattgtgttagatagagtttttattattatattatataattgtatttttttgagattttttgttggagggggtttagtttttaagagttaaggattgtaatggagatttatattttatatttaaaatgatgaatttatgaaaaagtaatttttgtgtgaagttttttttttttttatattttttgttttaatttgaagagttatttttgaaaaataggatgtaatttagtgtttttttttatagttttttgggagaatgattaatgttattattttataggatttaataggagtaaaaagtttagaaattattgtaagtggattagatgttaagaagtatattatatgtttttattatattttataaagtgtgtttatattaggaggttaaatagagaaaaggttaagaaaagtagatgattgatgtgaatatttgattttatttgattaaagttgataaaatattgatgttattgtttggtgtttaaaagtaagattaattaaaatgttttaatttaaatttttaaaatttaaattttttttttgaattgtttgtttgttgagattttatattattagatttttagtaattttggaagaatttgttaaagggtgaaaagaatatttttgttaaatatttggttaagtaggtggtttgatttttaattattataattaaaggggttgggatttttagatttttaaaggatttttttaaattaaagtaaaattgatttaatagttttattattttatatttttgtgaaaaatttatatttataaattttttttttatttgaaataaatttaaggtggtaattggtatttgtttattaaataagttaataaaaatgtgggaaatagagatatatgtttatgatagaaattaagatataattttgatatttgttgttgaattttagtgtgttatttttttatgtaattgaagtttttttttaagtaaaggtttatttttttttttttgtgaaatagagtttttatagtagatttatttttgtggttaataggtatttgaggttgataaatgtagaggttatattttatgatgttaaattataatgatatattatagaatatgataaaaattttttgataaaattgtttttagtaaaaataaattatgtagaagtatagatggttgatggtaaaatatgtaatagtttttagaataatgtatagatggtgattatataggaaaataaaggaatttagagaaaaaatatatatatatattaggaaatgtatttataggatattttggaataaaagtggtagtgtttgagaatgatgaatgatttgtttattattttaaatgtgtattattaatttaaaagttattttaggtatttggtatatagatagattttttttatatttatattaattggggttatatttttaataatatgttgtattttatagtgtaaggtagttttaatggtaaagttttagaagagagttagtatatttttttggtatgtgataataatttgtattgtttttagggttttgtggattagtttattttttgaatattatattgaatattttaggttttagattgtaagttatttttttttttttgttgttgtttgtagaaaattggaattttgtgaggttgaggaaatttgtttgatttttgtgttttataatatggataaattaggtttttggaatgattagtttttgatagattgttttagaagattataaattaaataaagattaaagaagtaattggttgtagagtggagtgtggatttatttttaggtttgaataaggtattgtgtggtatttagagagaggtaggatagaggaagtagtgagagagaagtaattttagaaaatgtggatattttgttgtttagtgtggtttatagatagtagtatatgtattttttggagttttgtagagatgttaaagtttagtttttattttagagttattgagttagaatatgtggtttgtgtgtatgttaaagttagtgatgttggttattatttttggtttttggtggtattttttaggaagagttgttatttgggatggattttgtattgtttttttttagtggttttaaagatttatagtgttatttggaatattgagtattttttaggtgtttattattgtgatttgattttaggaagatataaattggatgaaggagagatagtaagtaggtagattaattataagtttagtttttttatgaatattttttgtagtagttatatagtttatattggtattattggttttattaaaaagtaagatagtttttttttaattaaaggtaagagaattagtttttttaatagttttgttagttattattttatttttttataatatagtttaaattttgtaaatgattttagtgattttgtagtttttttaagataaagggatttttgtaggtaagggattgagttttgggtaggtgatggagagtgattttttaaattgggaattgtgatgatatttagttttatgttttaggagagagtgagataggagttattagaagaatgagatgatttagataagagattgtaggagattggttttattttgttgataagatggtaatttgatttattttttggttttttggtgttggtggtttaggaagataggaatttttttatatttggtagagtttagttgtttttttattagttagtaagtagtttttttttttttaaggtagtttatatttagtaaaatatttgattaattggaaagtaatattatttttatgttagtgtataaattatatgaaagagtattatttttttagtgtttgaggattggttgtttatggttaattttggtagtaagatgataggattaaaaatagtttgaagatgatttagttttaaataatatattttatgatgaattttttttgggaaagtgtatttttttgtttataagaattatatgattttttttaataatttatgtagtagagaaaaatatattattttttatagagtttttagttatgtgttgtggtgtgattgtttttggatatttataaaattttatagttaattgaatttttttttttgttttgttgttatttaatgtttattgaaaatatggtttttttttgtgtattttgttatttttagttgtattttttaataagaatggattgttttttttagtaatttttgattgaattggtatattttagattatttaaatgttattaggttatatagtatattaggtaatagaaagttataaattaaaaataaaaaaaaggtaagtaaaatttttgttgtttttttttatttttgtttttagttttattgtgttatttggagggatgatatgtttatttatgagtgagtgtgtgggtgttgtatgttaatagtggttttttttatttaatatatttttgtatttttttttaaggttatttattgtgttttagtagtagtttagtaaagtagtattttagtagaagtgtatttgtgttagaaaataatattgtttttgtagtgtataagtagaatgtttttttttttttttagagatatattgtatttgagatttaaaggttttgtttaatttttttaaggtaatttaatattattttatttaggtataatagtaatttgttaatttggttattttttttgttaattatatgtaggagattatttagtgaatttattttattgtgaatttttttttttattttttttggtttggtttaattaattttaatgtttgatgtttaagtaggattaatgatgaaaattatttaaggattgatagttattttatagatgtgattgttagttttatatgagttttgttttgggttaggttggaggtatggtaaggagagttttgtttttgttttggataaatttataggttagtgttgtaggtattttaataaatttgtagttattatatagtttgataagtatgattttagatttagagatttagaggaaaaaagtaaataattataagttattttgtatgtattttagttttggtttaagaatgttatttttgattatatggttgtttatgtgtgtattaggtttaatttaaatagggttaaaatgtagatattttaaaaaatattgtgtaatgtagatatatgtttaagagaattgaaaggtagggggagtttttttgttaaatattaatttattaagtattatttatgtatattaagaagatttaataaatattagtttataatttttaaagtattttattaattttttttaagtaaaagataattaaggttttgattagattgattggaatagggtaatttgaagaattattttttttaaataatttttgtatgttaaaaaatataagtaggttttgaattagagtgggggttttttttttgagtaggggaaaaaaaagtttttgttttgttttggtttgaggttatattattgttttatttattaagatatttttatgatgttagttatagaaatttatagtttattgtaatattggtatttgtttttggatttttttgggtttgtggtttgtttgtttaaatggagattgtaaaatttttaaaatgttaataaagttgtttttatttaaaaatatatttttatagattgttatttgttgtttttatatatgtttaattttgtatatgttatagtattatttttttgttttttatttgttagataaaagatatatttatttgttttttagtgtgaataaggattgaatgattattttttttttttttaagttatgggatttttttataggtgttattatttttgtgattattttttatttgttttattattttattggtgagggattttttaggtgtagttttttgttaatttttaattagtgatgggtaggatttatttgaagaaaattgtaatgtgtttagatattagtaaaagggagtagaagtggggagtttaattaaagtgagaggataatttttattttaaatttgttgtaggtagttgggtaggttaaaattttgtgattagatattattttttttttttagtgattataaattttaatttgtgtagagaaaagatagtatttgttggtaaaatttgtatttattttgatttttttagtgtaagattatagtggggttatatttgagattttaataaatgtttgattaattaaattaaaatagtttagggtaaggattatttttttaaatgtttttttaaatatgtgagaaagggaatttttttgatatattggtatggttatttgtagtaatatattgagagtgatttgggtgattttttggggtgattaattatattttatgagtaggttaattgtggaagatatttgtttttgagtattgtgtttgggttatatgtgttaatggggaaatttgtgtttttattttgttttttgttttgtttttataattttagggatagaagtgtattttatttttagttaataattagttttttggggtttttatgtaatgagttagaaattgatgattgattttattttgtttattattatgttttttaaaaataatttgagaatttattgtgttaagtgaagttttaattttttaggggaggttttttttattgagattaatatatttttttttgtgatagatttagttattatatttttttatttttaattgttgaaaagatagttaagttgtaatagagtatggtgagtttattaattttaatatttgaagtattaaataaaggattagtgttgtaggttgtttttttttgattttttttagttttttttagtagataattaggatgatattttttttgttttataatatgatgaatgttatatttttatattaattttgaaattgaattgtagttaaatattttttttagttgtattagaattttttaaaagaatatgagatatataaatttagtttttttagtttaatgttatattttagatatattgatatttgatttataattaaaataggaataaaattaagtataaattatattattagttttaaatattgatttatttttttgaaaaaaaaaaagtgagtttataaaggatggtagtattggtatttttggatgtaaaattttagggttattttttagttatattttttatggatttttgttagtatttttaaaaatatatatattgaagatatatagagaggttttgaggtattttataataaaattataagaatagggagataaagttatttattaaatattaaagtgatagtataagaagaaaatgatttgaagaagttttaattgagggaaatgagtaattgtttataaaatttaattttgggtttttaggaattggggtagtgatggttatggagaggggttttagaatttggttatttaggaaaatatgtatattaatttgttttattgaaaaaaatatttattgaggttttatattatgtaaagttttatgttaggtgttttagttaagtgaaaaaatgtttaagataatttttgtttttaaggaatttattaattagtaggagattaagataaggatataaattattgtaattttggataatgtgtagtagatagagaggtttaatttagttatagtggtatttgaagagttttatgttggagataatgttgagataagttttagagaataggtaggtgatatggggagagggttttttaggtagtggaaattggaggtgttaaagtaggtatgaatgtgggaggtgtgtttggggaattgtggagagtttgatttgattggggtatggagaatttttttgagataaatttatagttttgagaatttattattgtatattaagttgtgaaatttgtatagatagttttttttatttttgggttttatatttatggatttaattaattttggattaaaaatatatggggtagggtaggtatagtggtttaggtttgtaattttagtattgtgggagtttaaggtgggtggattatttgaagttaggagtttaagtttagtttggttaatatggtgaaattttttttttattaaaaatagaaaaattagttaggtgtggtggtgggtgtttgtaattttagttatttgggaggttgaggtaggagaattgtttgaatttaggaggtggaggttgtagtgagttgagattgtgttattgtattttagtttaggggatagagtgagattttgttttaaaaaataaataaataaataaataaataaataaaataaagtatataggaggatgtgtatatgtaagtattatttatttaatattagggatttgagtatttttagattttggtatttattgggggtttttagagttaattttttgaggttattgaaggatggttgtgtttaattgtattagggatgttgaaaggatgttgtaaaggtttttagataaggtaggatgtgtgtgtgggaggaagattgatagtgattgagtttggatgggggagattaggtatgaggtttgaagtatttggaatagaaaggataggatagatgtgggtatattgtatgtgtagaattaaaggattgatagtaggttgaatgtgaggaatgagggagggaaagaattaggatttaagtgttattttggttgttttaaaaaatgatattgttttttagagggaaaggaaagataataatagttattgttttgtggtgtatatgtgatgaattttattttggatattttagtaggatatttaagtggaaatgtttagtaagttttagatataaggatttggattttaagagaaaaattgaggttgaattataatatgtttttttttttgaattatgtaggttttttttttgtttttttttattgttttaagtggttttaaatgttattgttgatgttgttttagtttgtgattgttgtttgtattttatttttttttaaaggtaatttgtagatttgtatggattgggttaaggtggttaatttgtagttttgttgtttaaagtttggttttttattattagtttgttaatttaatgagtattttaatttgagttaaattagtattgttttaaatattttaatagtattttttatgtgtgattttaggttttataaaattaaggtgtttttttttattgagatttttttattaataaaatattttttttattaaatttaatttggtattaagtatagtaggtaataggtatatataatgattgtttattgaatgaatgaataaaatgattatgttagggtattttgagtaatttattttaagtagttaatttttttttattttttttattatagtgtgtgtttgtgtgtgtgtgtgtgtgtgtttgaaatgttttattttataggtttattaatatttaatagaaatgaaagaagaaaaatatttattaagtgttttgattttattttttttattgaattgaaaaagtatattatttatttttgaagagaaatttagattttgttttatattaaatatttgatatttattggtttttaatgttaatatagatattagtttgttggttgttatattttatttgtttatatgaaggttgtagatatatagtgtatgtatatatgtttagttgtttttattttttttgttttatattttaagtttaatttagattgaaaaggttttgaaggttgagattatttattattttattattatagaaagtagggttggtttaaggtttttatagtgggagtaaggtggattttaattttgattagtgttgtagtttaaatataaaaagaattgtagtataaaagttataaggataaatgatttttttgttttttttttataaaaataagtagttaattgaaggtggaagttagtatagtgtggtatttttagaggtgatagaatttaagattttatttttaaagatattgtttaataagaagattatttgggatgttttatataaaattattggtttggtagtttttggttgagttttttattttggtttaagttagtattatagtttatttgtggttttaataattgatggaatttgtattttgagaatttttatttgttagtatgaagtaaatttaaagtattgttgtttattagttgttatttgtttgagaaagattttgatttgtttatttgtagtgaagtttgattatatttttttaggggttttttaaaaagatgaatgtgttagtttgtagatttgtttttatgaatgaaattataagtaaattttttttttttttttagttttttttttttttttttgtttttttagtggttatttgtgtattatgtttttattgttaggttttttttaagtagtttatttatgagtgaatttagaaattttaaattataaaggatatttagataattggtttgttttttaaagtatttgttttttgtgttgttgttagatttttttttaatgaatatatttagtgatagtgggatttttgagtttgtttgtatttgtgagaaaatgagtttttttgttttgtaatagtttgtggtttagggaaaaaaatgatagttattgtataagttttttttgaatgtagtttttttttttataaatgatattttgagaatatagttaaggggttattagttttttattttatgtttggtttgtgtgtgagaataatataagttgttattgtaaattagtagttaaaaatgttttgtttggttaatgtgaatatttaatatttggtttaattaaaaattaattgatgaaagtatatgttattggaatttgaaaatattttttgtatggaatatttaaagggtattatttatgattaaattagtgtttttaaaatatggagaatatggggaaatttaatatgagttgggatatttgatttttttttaaaatttttttatttgtttggtataatagggtattgataaagagtgggtttattgttatggtaaaggatttatttgtatttttgtgtttttaagtgggtaattgtttttttgtatttagttatatgattaaagtagatagaataagagattagttatttatttatattatatttttaaaaaaatattgagttaggttttggggaagtgggaagtgagagttagagtggtgtggttgatagtttagggtagtgttatttaattttttggtttttttgggttatattggaagaagaagaattgttttgggttatatgtaaaatatgttaatatgaatgatagttgatgagttaaaaaaaaaaaaaaagtataaaaaaattttataatattttaagaaagtttataaatgtgtgttgggttgtatttaaagtttgttatggattggataagtttggtttgggggagtgaagattatttaatattagttgtaggagagtatgtttaaagttatgagaagagatgtagtaatagtggtggtatttattggagttaaggaagtttttttaggaaggggattgaagtttgaaggatgagtaggaattaatgtagtgaagtgggtgggaggaattaagtgtggttttaggtagaattttaggaataaaggttagaggtaagtggttatatggtggattgtaggagttgaggagtttagtttggttggagtggagagtgtaagtgggtgggttagaaagatgatgttagaggtggtttattttggaagagtttgttttagatatgttattttgattttattttagattgttaatgagatgggggagaaattagtgattagatagaaggtttttttagtaaatgggtaagagattaagtgtttgatttagaggaatggtagtgggaatggtaagaaattgttagttttgtataatgattaggattagagtggagagattttttggaagaggtaatgattgattgaatgttttagaatatggtttagtttttttttagttttgttggtttttttgtataatttggaaagaatgtggttattgttttggttatatataaatgtttttttgtgttttttgtttgtttgtttatttgtttgtttttggagataaggttttgttttgttgtttaggttggagtgtagtggtattatattggtttattgttgttttgaattttggggtttaagtgatttttttattttagttttttgagtagttgggattataggtgtatgttattatatttagataatgtttgttttatttttttttgtgataggattttattttgttgtttaggttggttataaatttttggttttaagtaatttttttgtttttgttttttaaagtattgggattataggtatgggttattttatttgattttatataaatatatatttttttttattttatttttaaaaaattgtttggttaaaaattatttttgttagaatttattgtgtgataaatttttattaattattagttaataaaagtatatttgaggaaagaatttaattatgaaaggtagtttttatagaatttttttttgggtgaaaaaaatgatagtggttttttgtttttatgtaggattttaaagtttttaaaaaaaaattttatatttgttggtttatttgatttttataataattttaagtaaggtagatattgtattttaatttttttttatttttttttttatatatattgttagttatttgtttatgtttatgtaaagaagaaagtttgtttaataaaggtgtgtatgagttaataagtataggaagagttgatatttattttttgggttgggaattttgtagatatttttttattttgtgttgtttttttggatatgtgtttataaagatataagattgtttagtagagattgaaatatattgtattttgaaaattagtatattttattgttttttgtgttaaaaatgtttagggaaattggaatgtagttttttgtttttggttatttttttttttttgatttagtttttgtagtgttttttatgtttgtagtagagggggatttagttgtttttatttggtgtttattattagtttaagattttgtgaggatgtgtttatgagttaggtgggtttggatatgagttgaagggatagtagtaggattgatgtgtgaggtttttaatatttgaaggttttgtaaaatagttttttttaataggggttaattggaattagatgaatatgtgtgattgtttttgtttgttgatatttgattagtaatggtgttatgttagtatgttgtttgttgtttttatttttttgaattttttagagtttttatttattatttttaaaggttgtaattagttttaattggaagtgtttgtaagtgtagttttgtaaatgttgtttttttattttttttttttttttttttaagaaaatgttgtattggattattaggaaaaataattaatgggtattaggtttgatatgtgggtggatgaaataatttgtataataatatttaataagtttatttatgtgataaatttgtatatgtgtttttgaatttaaaagtttaaaaaatttaaaaaggatgtgaaataaaaaaattaaaagaataaatattaataaatatgaagaagttttttagagtttttaaatttgtttatagagtattgattgagatattattttttttagtaattaaataaaattaaaaaaataatattgggtttttttttttaggtgattaaaaatatttggtatatgttttttgaatgttgaaaatggtggagtttttattagtagggtttttgtagtagtaaagggtatgttattgtaagtttatttaattaataaatatttataaatatttgtttattgtaaagagtttattttgggttaattattgttttaggggttggagttataatagaaaatatgataggttaagaatttttttattttttgtgaattttatattgtgaggaagttagaaaagtaaataatttaaaaattaataatataatataagggttataaagtaatgaaaatagggtaatgtagtgtaagggtgttgatgggataatattaattttttttttggtttttgagattttttaagtagtattataagtttatatagaggagatttaatgggtttttttttattaatagttgaaaatagtgttgtattttaaaaataataaatgtattagtataatatagtttttatattagtttaaaatgagttattatgaataatatgaatttaaagagatttttattatttttggttaaaatgtttagtgtaattttttttttatttatttattttttttatttttttatttttatttatgataatattggttattggttttagttattgaaagttaggaggaaggaaggaaatgaatatttattgaattttaatatgtgttagattttggatttaatatttttagggataggagattatttaattttaataatttttttttgagggtaggaagtggatttatagatgtggaaatagaggttttgtaaagttaattgattttgtttggtaagaggtaaaattagtattttttatttaggtaatttaagtgatgtttatgttttttggaatttaaatttttaaaataaaaatttaaatagaaatatattataaaagaataattttatgtatgtgattttttgggttttttaggaagttagttagttatttttattttaataattagaaggtgaaattttttttataatatgtaattttaagtttttttatagttaaaaaataaatgaaataattttttttttttgttttttttttgatttttagagtttgtttaaatagtttttgaaaaataagtattaattattggtttttattaagattagatatttgatttagaagtttttataggggttagagtgtgtgttggaaaaataaatttatagtgtttttttggttttagagaaatgattttattgttaaattgtaatttgtttaatattttaataaaaaggtggggaaagtttgtggttttatttttggtatgatttttttttttttattttttttattttaggtatgattttagtgtttttttttttttagagtttagaggtggaatgatatgttatttaggtttataagatgaggatgtatttgtttttatatttagttgtatattttattttatttaaaaataaatttatttttagtaattagggtgtattaagggagagttatttttattttttttagtttaatttggatatatttggtttagaatagtatagtgtttttataataatatttgaataggatgtttttgtgttatttgtagggttaagggagttttagtatgggttaggaaattatttttttaaaagaaatttaaatgtgaaattttgataagataggaaatttttattgtatttttattaaattttttttttttttttatttttttatttatttatatattttttgtgttatgaaatatatataggttgaatatttaatttattttgaatttatgtgtagaataagttattttttagaaggataaaaataatgttttaagtggtttgtttaataaagtatatattaaaaaattttaatttaatattttttttgggtataatatgttatgattttttagagtagagttttgtggtattttataaggaagttaaaaaggaagggaaattattatttgggtagagggataatagtgattttttattaagtaagatagagtttattattaggttttttaaattttaggttttgtgttagttgaattgaataagttattaattatttttttttttttttttttttttttttttttttttttttttttttgagaaggagttttgtttttgttgtttaggttggagtgtagtggtgtagttttggtttattgtaattttagttttttgagtagttgggattataggtgtttgttagtatgtttagtttatttttttgtattttttttagtagagattggtttttattatgttggttaggttggttttgaatttttgattttagatgatttatttgttttggttttttttttaaagtgttgggattataggtgtgagttattatatttggtttttttttttttatagattagattattttaaaaatatttgtttaatattatttaaaatattttatttataagatataatttaatattgtaatatttaaaagattgtattatgtagtttttatatatttttaagattttaatgaatttagataattagtatttttgtttttttaatagttttatatgtgattttttagttttagagtttgattttaggagaagggaagagtagatttggattttgtgttgtggataggtgtattggttttttgtgtgaaaaggataaagttttgttttttttggagtttagttttttttgggattatttataatgttttttaagaagtttggagtgtttgtttgttgttagtattgtaatttgtgagtaaaagatttttatgattgtaaaatatattagtgtttttggagattattgttttttgatgatggtgtgaattataattaggaattaggaagttattttagttttttttgtgtagagggatgttatgaagtatatatgttaaagtttatatttattgtttataagagtttagttaatttttttaattagtttatgtaaaaatatatttgtataaatatgtatatgtatgtatgtatgtggtgtgtgtgtgagttaagatatatataaaatttatgttttttattaattttaaatgtatagtttagtggtttttagtatatttattttgttatataaattattattatgtaagttattattgatatttgtttttagaatttgtttattattttaaatggaaattttatttattaaattataattttttgtttttttttttttttagttttaggtagttattattttattttttgtttttataaatttgattttttgaggaagaatttgattttttttataagtggaattagataatatttgtttttttgtgtttagtttgttttatttaatatatttttagagtttatttatgttatggtatgtattagaattttatttttttttaaggttgaataatattttatattatttgtttttttaaaagtttatttttttaaaaaattggttgttatttttattttttatttagttaatagaaatagtaaatatattaaattagaattgatttgatagaggaggtaatggaggtttgtaaattatttaaagaattattttagagtttgatagtaaggaagaagataaaaatgtttttaaaattagtttaggagtttttgaggtttttttgtgtggggtaggtagttataaagatttttatggtttttggagtttttgttggattgtagtataggataattttagtgatttttaatgatgttattgagttattaagatagagttattttttgtaggaagagttaaagagtttagggaaagtgagtagtaagttatagaaatatttttattttaaatggttaaaattttttaaaagtttaggttttagttatttgaaaaatttatttgtgtgaaatgatttagtttagattgtagtgaaagagaggaattttagtaatattaaagtaaaatatatatatatatatatatatatatatagagagagagagagaaggagtataagattttttttttttttgtttttttttttttttttttgaataaatttttatatattttttaagtttaggttaaatggtattttttttgtgaatgtgtgtgtgttaaataggtagagagatttttaggggtgtttgttgattttttttatttttttttattttttatttttttttttagagtagagaattagtaggaatttgatttaagtggatggggatgtaatttttagggggagtttttgttgttttattgtatttaaattattttgtttgtgtataaattaagttgtatatatatttagaagagttattttttttattgtaggatgtatagagtggtttttgtgaggagttgttttgtagttttaattttgttttttgattttattttgaaattattgtataataaaatgtggttatttgtttgttttatattttttgtgtttattgggtttttggatatgatttttggttttgggggggatagttttttggggaaatagatatataaatagatttattatagtttagtgagtttttttttgggaaagttaaggatggttttatagagaaggtgttgtttggtttgggtttgaaggatatataagagtttgtttaaaaaaaaaaagaaaaagaaaaaaaaaaagtaagagattttgttttttggagaatgtgaaagggtattatatgtaaataagtagagtaattgaagggtttgttaagtttgggaatggtaaaaaggttagagtgattagaagagaggtagttggggatggaatggaaggggatgaagtgggaagatagtggaggtttgttttttaaggttttatgtgttttattaaggagtttgattagattttttttgtagtggaatgttagtaaaaggtttttagtaggatattaagtgatatggttggatttttttgttgatgaaaatattgttggtagtagtgtgttggtggtattgagggtagtaaggaggttagatgggaaggtggggttaggtgtttaagtgaaggtgttgggtagttgttttaaggtatgggtagtaggaatttttaggatgggattatttgaaaaggtgttttaaggtagaattaataagattgtgtatagttgattattgttgaatatttagtgtttagtgtaaggtaagtatataatagatgtttagtaatattgattaaatgaatgaatgtataggtagttgggtatatatgataagtagtataagtaagtgttaaagtgatattttagttatatttataatagtgataaagtagaggtttatatggtttgtattttgtttaattttttttaaatgttttattattatttgtgtattttttttttataatagtattgggaggtggtggtgtttttatttttgttttgtagatgagaatattgaggtttgtagagggggatttattatagttgtttgggtggttgggttggaatttgaatttaggtggttttggagtatttggagtttttaattttgttgttttgttgttgtttagtttttgagttttttaggaagttgttgtttttaaggttttagaagtgatgatttggggtaaatttaagtggtggtaggatgtagagaagtttgtttaggaaattatttattttatgtagatatgttatttgagatgattttagtagaaataataatggtaatgataatagttttgtagttttttttttggtataagaaattagttttgtaatgaaaatggaatttttttggggaatagttttagaaagagataggtagttgagataaaaataataaaatataaaatagtattgtattgttttttgtgtatttttttttttatttttgtttttttttgttgtgtaatttattttgtttttttggttatgggtaggttgggtattattgtgatttgatttttgttttttgttttaaagaaagggatgagtgtgtgtatttagaggtagttatttgtattttgtttggagtttgttattaatatagttagttaaaaggaggagaggtttttgagggtaaattttgttttaggagttgaagtttttggttttttggaatgaagggtggtgagtttggttttttagatggtttatgggttagaatttgagttttttggtatttaggtgtgtgtgttgttttggattattataattatgattgagttgtgtttttaagttataggttagagttgtgtaaaataaatttttgttataataaaggatgtggtagttagattgtagtttggagtttttttatttatttattttagaggatattgatttttatgttagtatagggaagagattttatttgtttgttgattttaattgggggtttgttttgtttgattattttggtaaatggtgataaatattggtggttatagtagtatagagagagagtgttggtttggaaatttagttaagtttttttggttttaattttatgtaaatttgtttaatagaatgtaaatgattttataggaatatggattttagggatatgtgtttatttgtttttagtagtgtttttgggtttttagaagtagttatttgagaggttaggtaagtttatagagaggtaggttaaaggtggtttgtgaaggaatggtttattttattagttgatgttatgtttggaattttattatgagtagtggttttttttttggtagtttgtgagttaagatttttgtgttttgggaataggaaaaggttaatatagattaatgtttttttaaaaagttttttatttttttttttattttatagattttttgtgattatagtatatatttaaatatttatttattttatatattttgattgggtatttagttattaaaaggtattgtgttaggtattgagaaaaggttgttttgtgttattaaggtgtgatattataatattgtgtttaaaatttatttttgttttttttagtgttgtggttgtggttattaggtttatgtaatgtggttaatttgaattgagatgtgattggagtgtaaaatatatattaggtttattggattttaaagatgtagtatgaataaatgaatgtaaaatattttattaataatttttataagaattttgtgttgaagtgatagtattttggatgtattagtttaataaaatatattaaatgtgattattaaaaatttaaaattatatatgtggtttttattatattttttttttttttttttttttgagatagagttttgttgtgttgtttaggttggagtgtagtggtgtgattttggtttattgtaatttttgtttttagggtttatgttatttttttgttttagttttttaagtagttgggattataggtgtttgttattatttttagttaaattttttgtatttttagtagagatagggttttattgtgttaattaagatggttttaattttttgaatttgtggtttgtttgttttggttttttaaagtgttgggattataggtgtgagttattgtgtggggttggtttttattatatttttattggatagtattggtttagattgttaattatttattgtataatgtggttatttttttatttttatagttggatattattatataggaggatagaaagatttttttttttttttttaatgagttatagttgtgtagttttttttaaagtttatttatatttatgtttttgtggtttttattgttagtttgttgagttgggtagggaaggttttattatatttttataggtgagtatattgaagtgtaagaggttattgttgttagtttgttttaagagttaagttaagaataaaattttagtagtttttgggtggatgtggtggtttatgtttgtaatttttgtattgtgggagattgaggttggaggattatttgagtttaggtgtttaagattagtttgagtaatttagtaaaattttgtttttataaaatataaaataattaagttaattatggtggtgtgtgtttgtagttttagttgtttgggaggttgagatgggaggattttttgaggttgagatgggaggttgaggttgtagtgagttatgattgtgttattttattttagtttggatgatagagtgagattttgttttaaaaaaaaggattttagtagtttttaatttttgttaggttggattattatagttgggttgggaaggttggaaatagaatttttgatttttattttagtgtttattaaaaatatattaaaatttatgtatggaaatatttatttttatttttgtattaaagatgatagaatatagtttatttagaagtatttttgtgtgtatgtgtatgtaaatatatataaatatgttttgtagttggttaataaaatatagtaattaaagtttatagtggatatttagtgtaaaggtaagatttgttgaattttgaggtttattggggaagggtagggttagggtgagataagtatgtggttataattagggggtgtttttttttgttgggagttaattattgttagggaaaatttttggtagtgtggagtaaggttggtggattttatttgttagaaaattttgagattgggtttagtttttgagggatggaaggataaggtaggtattttggattaaagaggtaagggatttaatttaggtagttatttagtattggggatggtttaggaaaaaggttggggaggtgtagttttaaggaagaagagagaattgattaagaagaggaggtggatatgggtgagagttgtgtagttgttgaggatatttagggtaatgggttttgggttgtatttttttgatttgttaggtatttgttgtttgggtatgttatatatttttttgagtttttatttttttatttgtaaatggggaagttgagttatagggttttttattaatattttgtgattttatgagttttgaaggttagagaattagtaagaattgtattaataagttattaatgatggtataaaggttttgttttttattgttgttttttttgttgtttgatgtgttgggggtattgaggtttatggtaaatgagattattggtttggattatttatttggtttttgatagatataagttgggtttaggatttttttgtaattatagttaatatatatatattgtagtataatatttaaaaatatttatatttatttgttttttttggttttttttgttttttttgtttttatattttttatgaattataataataataataattattattattattatttttttttgagatggagttttgttttgttttttaggttggaatgtagtggtataattttggtttattgtaatttttgttttttaggtttaagtagttttttgttttagttttttgagtagttgggattataggtatttgttattatgtttggttaatttttttttttttttttggtatttttagtagagatgggggttttattgttttggttaggttggttttgattttgtgatttatttattttggttttttaaagttttgggattataggtgtaagttattgaatttagttaaattataattattttttattttttatttttagagtttagtgttatatagatagtaattttttaatattgtttatatgatttagtaaattattgtatgtttttggtttagaaggattttttttgttttatattttttatgaattaaaaagtttttggattatggatgaatgatataagaatttaattatttttttttttttttttttttgaggtggatttttattttgttgtttaggttggagtgtagtggtgtgattttggtttattgtaattttagttttttgggtttaagtgatttttttgttttagttttttgagtagttggaattataggtgtgtgttattatatttagttaattttttgtatttttagtagagatagggttttattatgttggttaggttagttttgaatttttgattgtaaatgatttattggttttggttttttaaagtgtagggattataggtgtgagttattttgtttagtttattttttttttttaaagaatttattttaattgggttttgtaaatgtagggatataaaagttattggattttgagatagttttgtattttgtagagaattattttaggagtatatttttttattgagggttttagttattttttttgttttattatattttgtttagtattgagaagtttggtattgtttttgttggaatgaaaagattggtagagttgttttggataatagtattgtaaaatattgtggtagaaggtttggtttatatattaaggtagttaaagtattaattgtattttttgtgattataaaataaggtgttgaattattttttttatgttttaagaatgataggtttttgttttgttagttttaagtatagtgtattatatggaaaggagatgttagatttgtaaaaaaaaaaagagaaaaaaagtataggagtgaagatttttggtagttagttgttttttaaaaaagatttaaagttgaattgttgtatgagaggtatttataaaagattaggagttgggtgaggaagtgtttttataaatttatatattttgttaaaatatgttttattttggaattttattttagattttgaaatgggattttttatgttgttggttatattttgattttatttttttttgttttggtgtatttattggagaaaattggttatgatatttttatatgtatttgtttttttttagttttagaataagtattatatgtgagtattttagatatttaaggttttttggatattttagttttttttataaagttgtttttttagagtttgttgttttgttttttaggaatgtatttatttgaaaatttatatttatattattataatatatatattgttttttgttggttgtttttttaattttagtggaagatattttatagagaattgttggtgattgtttaatttggttgggaggaaaatagattaagtaggtgataatttgtatattggggatttttttatgttgaaaattgttattttgttgtagtattttattttttttttatagttttaaaaaagagaagtatgagtgttgttgatgtttagggtttgaatatgttttggtttaagatgtttagtggaattagagagaattttattttgggtagtgtagttaggttggaggagtattttggttttatattattaaattttgtttttttattttagttgtttgtgtgttattttggggttattgagaatttggttgggttttgtggggtgggagtgttgttttggggttgagtttagttaggggtgaggttgttttggtgtatattttgtatgttgtatgaagtttagagtttagtttggtttttgtgaattttttttgtggggatatattttttaattaaagtgagggtttagtggttattaggttgtgatatgagagttgttgttattattatttattatttgtagtagtaggaagggtgtttagattatagaaattttttgtttttgggtttgtgtttattgtagttggtagagagtttttgagttttttttttaatgtgtggtgggagagtgttttttttagtattttttttatagggttttttgtagtgggagtttttttgatgttttttatttttatatttattttatttttagaattaaggagaattgttaagttattttttagtatgatgtgttatggttgaagaattatttatttaagatattggtgaagagggtttttttattgtttttttttaatgatggtttatttgttgtttatttgttgagtatttgggtggtgttaatatgaatttatttttttttgtgtgtaagttttttttttttattattagagtgtagattttagttagtatggtatgtgtgagtgtgttgtataaagtttggaattataattagaaaggaaagtttttttaaaggtattttgttttgatatttattaatttattagattgttatttttttatatttaagatgattataatatgttttatttaagttgagatatttgttattaattattattttgggataatagggtaggttaggatggttttaggtaagttgatgtttagagtaataattttgtatatatgaattttttgaaggattgggtatgatttttttttttttttttttttgtattggggttggttggggttaggagtttgtgatgaatttttttagtatttttttgaaaattagtgaattattttgtaggtttttgtgttgttagaaatatgtaaatttatttattaaaattattttagttgatttattaagttatttgttaggttttatttggattttttttattgttattattatgatttgtttatattattggtttttttttttattatttagtttttttgtgagtttagtattgatataaagtggtttttagtttttttggatttttaatttaatttgttttttatgggaattttttaattgtttttttaaattattttgtagatatttatttttttgtttaggattttaagaataggaaagagagatataagttagattttatttttgttttagtaagattatttttttaatataagaaaggaatatatttaaaaaatttttttagtatttttttttgttttattgagaaaaaaaaaaaaagaaatatttatgagtattttagggttttggttgatagtgtgataaaaatagttttaattaaattaagtaatttaaggttatttgttttatttttgtatttttttatgtgtttttgagttttttatagattgggatggtatattttggtttaaattgtaaatttttgtatttaattttttttgaatgatttaggatggggttgtggatttgttgatatttgatgagtattggtttttagtgtaaatgatgatttgttgaagggtattaggtatatttgaaggtagttgtttaattaggttatgtttttattaatattgtattgtgaatttttggtaagaagagtgataattttttgtaaaatgtagtttttaaaaataattgtgaattttagtgtttttagttaaaataataatttatttggggaataatttagagatttttttgataaatatagagaaatggaagttaattatatgtgttttaagtatttgatattggaagaaaattagtatttattaagtaatttttgtgaaaattttatttattttttgtttttttgtattttttaatttgtagtataaattaggttataggaaaaggatggtgtatttttaaagagttagttgggttggttgtgttttttttatttgtggaaaatagttgtgggtgttgggtgttgaagttaggtttttgttttatgttaaggtaggaaggtttgtttttgagatttattatttttttgtggaggaggagtttatagatggtgagttgttttattattattttggaggtttttgaaatatgttgataatgatttgggaaagagggttgagtgggatgagggtgggagtaggaaagaaatatttggtttatatagtgtttatatttttttttgtttttgtatttgtggtaattgtagattaaatgaattaggttatttttttttattgttttttattaaatagaagtatttatttaagttttgtagattttttttttgttgagtgaagtttgaattgagtttatgaaaggtgatttttttaaagtaagggtttttgtttttttttttttattttgttattttatttaagtgaaatttttgttatggtatttattttgagttttgttatataggattattgtgatggtttttattatgaatggagtgttaaggtgttttttttagtttgagataaaaattagttttaggaatgaatttttttttgttgtgaaaaatatgttttaagggaataaattttgttttatttttatttttatattgagtaaatggttgggaagtttttttaatattgtttgttttgatttattgttttatttttttttttttgatttttttgtgtgggattttttttatttttatagtttttgtattgtttgtatgtagttgatttttaaatgggtatttttgtaaattttagttttgtttatatattattttttgatgattttttttatttggattttttgttggtagtttaaattaaatatataattaaaatatttaatttaagattaaatttattgttatttttttaaaattttttttggatttaatagtttttttttttgtttttattattattttgattatttaggtttaaaatttagggtgtatttttttagtttttgtttaggtttttgagtttagtattttttattgttttttattttttttttattggttttgttgttattatttttttaatttttttttaggggaatttatttatttgttttagtttttttgtattttagtttattttatattttgtgatgatttaattaaaatttttttttgattgtttttttttttgaggtggagttttgttttgttatttagttggagtatagtgggattattttggtttattgtaatttttgttttttaggtttaagtgatttttttgttttagttttttaagtagttaggattataggtatgtattattatgtttggttaatttttgtatttttagtagaggtggggttttattatgttggttaggttggttttgaatttttgattttaagtgatttatttgttttggtttttttgagggttggggttataggtatgagttatttttttttttattttaaggtttttttttttttaggtaagtttttatttttttttatttagttgtttaaatttttttttttattttttattgtaatttatgtgatattttttttattattttttgttattttttagtaagattgttatgttttgaatttgttttgttttttttgttttggggattttttttttgttgtttttatattttagagtattttgtttttattagaattttttattttttaaggtttagatttgattttatttttaggatgatagtatttttgttgggagtgattttgttgatttttaaatttttattatttttttagtttttttttttttttttgtgttatttttttaggttttgttatatgttttttgatattattttgatatataaatgtttgttatattttttttttttttttttttaggttataaatatgttgaggtttggggttgttttttaagttgttattttaggtttgtgtatatttattattatgttttaaaaaaaggttttatattagtaagagtttagtaatatttgttgaatggatgaatgaagtatggtggttttgttattttttattttatttgtttattttttttttagttttatttatttatttatttaataattatatattgagagtttattatgtgttaggtattgtgttatgtatgtaggtttattagtaagtaaaataagatttttgtttaaatgtgttagtattttagatttttttttagatttattatttttgtatttattttatttagtttttaaagaaatagtagatagttattgtaaatattattagttttatatttatgttgtttttttgtgattaaattttgttgttaagaatattatgtttttttggtagtttgtaatttgagtttttgatttttaaaattggttgtatattttaatggttgtgatggtgttgaaaattttattttttttttttttttgattgttgaattaaattattttttaagttgttttgaaatatggataaaagattttttgattttagttttatgtgtagtatggaaatttttattaggttgtgtttattgattaatagtaagttaatgtttatttttttttggttgtttgttaaatattttaaaatgaaaataaaatagtagtgaattatagtttagtattagtaagaatggaaaataattgttttttaaagtttgatttgtattgtttttaataaggaaggaaaagttttgttatataaatatatgaaaatatggtagtgtttgtggtaagtatgttaatggataatgtgtttaaaatttttgttgggttagtgttattttttttttgtgatgttgaaggaaagttataaaataaaaataatttagaagaagttaatgtgttatttttatgtagggatttgtatttaaagtttttttttattgtagttgtaatgaaatagtatttgtggaaagatattgtatttaatgttaaaatttaataattttgtttttaaatttttaaaaattaaaaaaagaaattttggtgatataaatgttttaaaattaaaatgtttaaaatgaatttattaattttttttttttgtttgtttatttatgtttgttttgtttgtttaatgatattattgtttatttagatagagttttaaatttttaaattatttttaatttggtttttttatttgtgagatagagtttttttggattattttttaagattttttttagttttgaaagtttgtatatttgagttttttatttatattttttatatatttgaattttgtttttaaaagttttttttttttagatttttggtttttaggtttttaaaattattttattatttttttattttgttgttgttgttgttttaatttaattttttatttttttttgtatatgttgtaattttttagttagtttttttgttattttaaaaattatttttaagtttatttatagtaaaatttattatttttgtgtagttttgtgggttttgataaatgaatagagaggtaattattattttaattagtatatagaataggttagttattttttaaatatattttatgatgagagtttgtatttaaattgtttgttattttttaatttttagttttggtaatttttttttttttttatatttttagagttttgtattttttaaaatgttatagattggtattttttttttttagtatttgtttttagtttatttattttttttgttaatgttatttatttttttaaaatatttttgttgagtattttgagaaatatttagtttttttaagttttagtttttttgttagaatgtgatttagttagagtataaaataaggagtatatagaattttaatattttttaaggaggttggtttttgaggaggattttttattttgttaattggggtaattgatgggtagattagagaagtaggaagttattttgagtaagaaatggtggtttagagtttttgtgagaaaagggatttaagaagggggtagtagagagagaagtgagagatggagaaaagagaataattgttataagaagtaaaatgttggagagggatagatgtttatagaagatgttttgggatagttttgttgttgaatgagtgttagtatttttttatagtggttttgggagatttgtagtttagatttgtgttgtaggaggtgttttttgaatgggttttattttgaggagggatttaggagatttagatttgtaatggggataatgatatttgttttatgtaattattatgtggggattatggggtagtaagataggattttgtttggtagagattgggtattaaggattttttttttattattttgtgttatttttgttttttttttttattttttgttttttatttggaaattgttgtaaattaaatttttttattttttttttaatgatttttagaatgttagttttgaaggttggtttagaggttattgtatattaagttatagagtttggtgtatagttgatttttagggttggtattagtttattttttagtttattttttattaaagttttttgttttttttattttttgtttttaatttttgtttttatttttgttttaattttatgttttagttatgtttaatttttttgttgaatttttttgttttttttttaatgaaaattaatttattttttgtttatatttattttatgtttatttattttgtgtttatatttattttttgtgtatatatataataggttttgtattataattatttatgtttgtttggatatttttgtttttaattgtgtaaaaggtgtttaatttatatttggttaaatgaaatgaatttttaaataattatagtaagtttgaatttagtgaaggaagtgttaaggtattttttttatattatgtttttattttaatgtataagtagtatgttagttatggggtaggttttatttttttagattttttgtggttgttaatgtattaggtagtttgtttttaaatagttgttatatggttaaagttttttaagtgatttttttatgtgtataagagtaggatatagtttagatatatttaggagaagtaagggtattgaaaattttttaggttgttgttgtagaaaggatagggagaatgttattatttggaggtgggaaattggatgttgttatatttgtttttttattattattatatagtttgtgtgttgttaaatttaagttgttaatataagttatggattataaagatatgtttgttaaattaagttgagtgagatgtatttttagtattttttaaatttatgttgagatgtagaatttttagttttatgtagatagatttgttttgtatggaaatggtgtatttttttttgttatatatttagagatgagagatgagtttgtttgtgaaattaaatttaggattttgtttttgtgtaagaattgtattatatggttgatatatgtttagtttatggttggtagaagttttttgaatatattttttatttagtatttttttggtagtgatttattttatatttgtatatgtttttttgttataagattgtggggagggtgtagtttgtagttgattttttatttagttatagttttaattaagggtgtgtatttttggggagatgttgggagtattataaggtttttttttgtttttagaatttagttttagaggttagttagaaagagaattttagaggttagttagagagagaaggtagtaaggatagagtttttattgatatttttttttttatttattttatttttagggtaatggtttttagtagggaataatgggtttttattttttgttaggggagttgagtatatataaattgttggatgggtgagaagtttttttagtgatttttatttttttgtttagaaagaatttttattttagttttttttttttagttgttgtgtgtgagtttgtttttgttttttgggtggtgtagttgtaggtgagttagttgtgggtggttttgaaggatagtgaggtagggagtttggttgtgaggtttttgttttttggggatgttttgtagttttttgtttgtagtaagtttgaaattttttatgtttgattttttttttttattttttttttggtgtttgtttttgttggagtggagtatggtgggagttagtttttggagttttttaggatttttatagtttgtagttagagttgtgtaggtttgatttgggtttagtgggaggaggattttgaataaaaattagtggtttttttttgtttaaattttttatttttggaatatattgtaattaaatatttatttaaggtttttttttgttatttaaaaataagatgttttatttattagtttggtggtgttttttgttttgaaattttatgtttttgagttatatatttgaaggtagttttttttggatttaaaattttaaattaatgaagttgtttaaagtattttgttgagtgttgggagttgtttaagtattgttatataagtattgtagaggttgggtttggtgtatatatgttaggtaaagtttgttttgttttaaataattttaggaagagtttttttatttttggtgtaatttagattttaggaataggatttttggggttttttgtttggggattgtgtttagtatatatatttgggtttttgtatgaaagtttgtaaaagtatatgtgatttttttttttttttttttaattattgtatttttattttggggtatttttagattttttagtggggaggtagaggtggttgatgatgtgtttttagttagttttgtttatttttttttattttaaagggtttttattaatattatttaggaagtgttataaattttgttatttaggttatattttagattaatttaataaaaatatttgggttggagaggggaatttaggaattagtattttttaaagttttttagaagtgtttttaggttaaggttgttagtattatatttatttgttagtgtgtttagggatatattggtattttgtgtgttgatttgttgtagttagagtgataaaagttggattttgattgtttagaaaagtaagggttttttgttgttgttgtggagtttttagttagattttttattggaataggaaataaatgttaagtttattttaaaagtgtttttgatttatttaaaattaggaagtaggaagaatttttggggagtagttgagttttatatttgaatgtgtttttgttttttttgaattaaattttatggttttatttattattaaagaggttttggtgatttaggagggatagaattgaattgaaaattttgggattgttggaaaagtgatttaattagttttttattatatagggaaagttatttggtgagataatagattttgaggttttgtatttttttgtgtgtggttttgggttgggatatggtttttatgagtagaagattatttttggttgattttgtttagtgattatttgtttaaaattttaaaaagaagaagtgtagatatagtatatttgtatttagttagttatgtaaatatttttaggttaagaataataaataattaaattagtggtttgttttattattaaattggtagagttttataggtaggaaaagatggtattttttaggttggagaaggttaagtatttttgttaaggaagattaaaaattttaaaagtttttggttgaattttattgaaattagaatgtgaatttatttgagagttagtaattaaagatttgtagaggtgatatggaatgtttttaattttgagagatgggtgttttagaatttggaaaatgatatttgttttgatatttggtatttttgttgttatatttattgtttttagtttttagtggaagtagtttgttgtttttaattatttaaaaggtaagaaaaaaataattagaaattttttaaaagaggggaaataggttttgaaagttttattaattgtaaaatgaaattaaatggagtatttaatagaagtattttttagaattaatggagaattttttagaaagaagtttattaaagttggattttttaaagtagtggaaattttaggaataaaagttaaatgtttgggaattgagttttagaagaatttttgaattggtatagattagtaatttataaaatggaatggaattattgaatgttttaaaatttgtttagttaaaatgggataataaatttagtttatatggattttgtatatttaatttgtgttattatgatatatatatttatatatatttattgttatttattaagtattttttgtgaattagggtttatattttgatatatatgattttattttgtttaattataaagatttagtgttttttatagaagttattagtagattttgggagggttgtgttgatgattttttggtgttttgagtaagtaaaatgtgtaatggtatttgagatattgaatgtttgttaaagttgattttgaaaataagatttttattttattgttgtgttttataaattaaattgttatttaggagggaaaaaagataaataaatgaagttaattttttttattttttaaattatgggttaaattgggtatttggatagattgtttttaaggttattataggatattttaggtaagtattttgaaatttgaaagtatttttgataaatttttagggaaaattttgattttttggtttatgagagaaataattgttagttataattttggattggaattgtagtttgaagataattagaattgtagtttaaatattattaaagagtgatttgtagtttagtttttttaattatatgtgttaagaatttgtgataatagatttaattgaaatgatttattgagttaggtaatatttatgtttttttaattaattataatttttaatttatttgattagtattaagtttattttagttgataaaaggttatgggttatagttaaattgtaaatagaatatttagtaaatgtgatagtattagtttttattatggattaatattagtttggttttgattagaagaaatttttgtgtgtatttatgttgaaagatgaaataatttattgaaattgttaatgaagtattggataagttattttaaaaataataaatttgattattagtaataatataaataaataaattgttagtttaaggtggatatgttggtttttttttgtttttaatatgttaaaattaaaattaatttttttggtgtgtggagatgttttataataatagttgttattatttttttttttttttttttttttttttttttttttttttttttttttttttttttttttttttttttttttttttttttttttttttttttttttttttttttttttgagataaggttttaatttgttatttagagtgaagtgtagtggtatgaatatggtttattgtagttttaattttttgggtttaagaattttttttgttttagttttgtaagtagttgagattataggtatgtgttattatgtttaattaatttttgtatttttttgtagagataggggttttattgtgttatttaggttggttttaaatttttgagtttaattgatttatttgttttagttttttaaagtgttgggattataggtgtgagttattatgtttggtttattgttagtattttttaataatttttttaaattgtggtaaaatgtatgtaatataaaatttattatgttaattgttttttagtgtatagtttagtggtatgaagtttttttataatgttatgtatttattattattatttattattagattatttttttttttttagatagaaatttaggatttgtttaatagtaatgtttgtttttttatgtttgtagttttggtaattattatattattgtttgtttttatgaatttgattattttaggtattttgtataagtggatttatatttgtgattggtttgttatattaagtatgatgtttttaaggtttatttatgttttggtttgtgttatagttttttttattttgaaggttgaatgatattttattgaatggatttattatatattgtttttttgtttatttattgatggatatttgagttgtttttttttttggattaatgtgaataatgttgttatgaatggtatgtatatatatttgtttgagtgtttgtttttaatttttttgaaattttatttttagaagtggtatttttggattttattgtaattttatttttaattttttgaggaattattatattgttttttatagaagttgtattattttatatttttattagtagtgtataagggttttagttgttttaatttttgattgatattttttattttttggttttttaagatggttttttttatgagtgtgaagtggttaatttattgtggttttgatttggatttttttagtgattaatgatgttgagtattttttttatgtgtggattggttatttatttattttgtttttagagaaatgtttgtttaagttttttgttgattttttaaaattaggttgttttgttgttattgagttgtaggtgttttttatatattttggatgttaatttgttattagatatataatttgtaatgttattattttttgaggtttatagtatgttagatgttttattaggtgttttatatataggattttaatttattttataattttgagaaatagatattattatttttatttaatagatatggaaattgaggttttgaaagtttaaataatttatttaaggttatataattagttagtggtaggggtaggattggattataggtatgttttattttaaagtttatgattttatgtagtttggtatggatatttttttatttttttgatttatgatttttttttatttaaaaaattttttatttagaagtataataaatatattaaaatgtaaataaaatataaatgtatattttattgggttattttaaagtaaatattttgtagttattatgtaggtaaaagaaatagggtattgttagtttttataaggttatgttttttgataattatagttttgtattttttattaaaggtagaaattatgttaagttttatggtagttaattttttattttttttatatatttattatttaagtatgttattttaaatgatataaattagttgtgtttgttatttaattttatgtagatgaaattgtagtgtatgtagtttgtgttttgggttttatttgtttatagttatgtttgtgagattttatgaagttaaagtttgtttattttttttgttgtattttattgtgaaagtttatttattgtatttatttattttgttgtttttgttatgatatataatgttgttgtgaatattattgtatttgttttttggtgttttgtgtatatatttttattgggaatatattaaatagtgaaattgttgtagatgtaatgttatgtatgagagtttttgttgttttgtatattttttaaatttagaattgttagtttttttaattttagttattttggtatgtttataggagtattatattgtgggtttaatttgtatttttttgattatttattattaataatttttttatatgtttatttttttttagaatgtgtttatgtaagttttttgtttattttttaattgttttttattttttatgaatttgtaggagttttttgtagtttttggttatgtattttttattaattttgtgtgttgtaaatatatttttttattttgtgatttgtttttttagttttaaaatagaattttttgatgaaaagaattttttaattttgatgtaattttatttattattttttttttttatggttggtatttgttgtgttttgtttgataatgttgtttattttaaagttatgaagatttttttttatgttaatttttaaaagttgtattatttgttttttatatttatatttatataatgtatttggaattgagttatatgaatgttgtgaatttgggaggggtgtgtttttttttttttttatatggatatttaattaatttagttatatttattgggggaagatatttttttttttaatgtgttgtagtgttaggttttttaaaatttaggtgtttgtatatgtgtgggtttgtttatgagtttgtttatttttttttattggtttgttttttatatttgtgttaatgttatattgttttatttatagttttataagttttggtattgttaaggaaaaatatttgtaatatttgttaaaaatggtagagaagattttatttaaggaggggaatattgtgataggtagagggattgttgtaatgaggttttgttgtggtgaggagagagattgggttggagtttaatttttataaggataagaggggatttatagttaagtagtagggtggggttagtggatggaagaggaaatattagagataggggtatttttgttagattaatttaatagaatttttgttgaaggtaggttagggtgataagatattaagagttaggggtgaggatagatattaagggtggagaatttttattaaaattagtaggatttttgtttaaattggattttataagatagaaaaggaagtttaaggttagggtttagtggaagagaaggttttggggagtttgatttgagtttgatttaggagagtttttgttaatattttgtagaatatgatttttattttatttttttttttttaagtgtatttggattgtatttggttttttgggtttttaggtgatttttagagtaagtttattaagatttataaaaatagttattgagattttgatttgaatagtatttttttttgataatttttgagtaaaatttattttaaggaagtaggaggggtagtggtttgatgaaaagtaaaaatgaagaaaagaataaggaaagatatagttttgttattattagttagtgtttagtgattttaaaatagttgtttttgtttttgagtattatttgttgggtatggagttgtagaagttgggttgagggatattggtttttagaattaaatattggtttttatagagtgtttttgtatagtgagttgggaggatgggtaggggttattgaggattgtggtgtgtttttatgttagagtgtattttatatagagtttgttttgaaaatatagttatttttaaaaagtgttttttttttttttttattggttatttttttttttattattttttatttagtaaagggtgggtatgagaaatttggttagtggaagagaaagttattttgtaatagtggttataggggtgggagagtaaaattttttggtttttggggaagttaagtttattggtaggattagatttttgtatgtgtgtttttttttttagttatttattaaggttaataaatattttaaaaaaaaaaaaaaaaaaggatatgatttttttttgttatttaggtaagtgatttttttgttttagttttttaaggtattgggattatagttatgagattttgtattggtttattaataattttttttttatatagagatagggttttgttaggttggttttaaatgtttaattttgagtgattttttttttttggttttttaaagtattgggattatagatatgagttgttatatttggttaagaagtgttttttatgttttaggtattgtttttggtgttggggaataagatagataaaatttttatttttatagagtttaattttagtattagagatagttgagaaattattaaatagaagatgtaatgttgagttttgataaattttataggaagaaaaaggagagttagggatagaggaagggaagtgatgaaggagttttgtggatttttgagagaagagttttttagatagggggtaggtggagggtttaggataaaggttgggtatgttaataggggagaaagaggtattgtagtgggagggagggaaagtggtgggaaatgagatggaggaaagtagttttggttagatttaaaattttattttttatgatagatatttagtaatattttttttattttttaatgatgaaatttgtagaaaatataatttatttatttatattattataaattatttatataatgttttaattgtaatagaaaggaagtataaaaggggagaaatgtattatgaattaagaagtattttatgattatattggaagatataatggtgtggttatatgttttgtatttatttgtaggattattgtaaatgtggtagttataaatttagatggttgtagatgtgttatattggttatttaaatgatataattggtgttgattttagtgatgtgatatttttgaaatggtgaatatgtgttagtaaagttttaaataaaataaagtatattattttttattgaaatttagtatttatgaaaattatggaggaaatttttgtgttgataggtaaaatggtgtaggttttttagtttttttaggggagattggaaagttttgggggatatagaatatttgtggtttgtgttagattattttatgtattgtaggttgtttagtttgtttggttttattttttaaatgttattaatgatttttaattgttttgtgattattagaatagtttttatggatttttagatgtttttttaagtattttgggttttgtttgtatgtaatgagaagttagtagatagtttggattagggaagtgaagtgatttaatttaggttttaaagagatttgttatttataaaaataatgaaggggaggttgaggtttttgtgttatttagtaaggatttggtttttaagagtgagttgtagaggtattaggttgatttttgtttgttttaagtttagatttatttagaagtttgtttttttattttagagttatttagattatttattagaggtttttttttaatgaggagtagggtgggggtattttatggtgttttttgtgttttaaattttttataataataggtgttggttgttatttgaagtaggttttaattattattttttttttattatatatatatttttagtttattttgatttttttttttgtaataaataatagatttttgtaaagtggttagaagaaattagtaagttaagttttatattagggttattttgttaggagattttttttttttaggtaattttttttattatgtgggtattttagtgggatttgttgtagtttgtgttagggtttgtttggtttgtaagggttggttatggtagatgttttttttgtaattggaattttttatgtttggttttttagatagtagagagataattggataaattttaaattggaaattataaataataattattttgttagtttatatatgaaattatttaagtaagttttttttatttttattttttgataatatgaagtttattatttgtgatatttggggtatttttaaaatgtgtttaagaaaagggttatggttgtgtagtatttagtattagaatggaaatatttattttaagtttttttttattttttggttattgagaggtttggtttagtggttttggggaggataggaaggggagagttattttaatttgttgttgttgagtgaaggtggggtaggagtgaaaggtattgttgttgttgagtgtgtttttatgaaatttaattttatttaatatgatttttagtaatttattggtttttaagttatataaattttgattgaaaattattttttttttttttttttttgagatagggtttgattttgttatttaggttggagtggtgtagtggtgtgattggttttttgtagttttaagtaatttttttgttttagttttttaaagtatagggattatagatatgagttattgtatttggttttgatttttttttatataaaaggatattagagtaaaagagtgaatatgtatattatagtggttaaataaatatttttgtaggggttatatataaaattgtgaaggtagaatttatttttgtttttagatgtgttggttaataggtgtttgggtttgtgaatgtaggatttaaatgtaatagtagtattatattttatagtgtgtgtatagttggatttagaatttttggttttaaaaattaagtttttatttatatttatttattaggttattgaatatttggatttaattaaatgtttgaaagtttttttatttgggggaaggtgggtttggaggtagaaatttttgtagattttatatttggggttttattaggttttttgtggtaggtggaaggaaagtttgttgttttgtagttttgtttgttttaaaaataagggtgggaagggtttattaattgatttttgtgtatatttagtgtaggaaaagtgttatttagagtattattataaaattggttgtatatggtggtttatgtttgtaattttagtattttgggagtttaagatgggtagattatttgaagttaggagtttgagattagtttggttaatatggtgaaattttgtttttattaaaaatataaaaattatttgggtatggtagtgggtatttgtaatttttattatttgggaggttgaggtataggagaattatttgaatttaagaggaggaggttgtagtgagttaagattgtattattatattttagtttgggtgatagagtaagattttattttaaaaaaaaaaaaaaaaaaaaaaagagtatttttataaaagtttgatttttatggtagatggatttaattaaggtttattagtaagttttagatattagtatagtataggaaattattgtagaggtatgtaggagttatttagatttggttaatttagaggatagagagaaaaaatattttttttttttttttaattttaagggagatggaaaataagaagatttagagttttaagaatgaggattgaggaagtataatgtaaaaatggttttttgggtttttttttggaaaaaaatgtttagagagtttttaaaagtggttttttttttttttttgaggaatatgtgtttttatttttttgtgaagaatattattttagtagttttattttatttgtttatttttttttttaatattaatttgatttgagatgtttgtaaagattaagtaataaaaagatgttatgttatttttatttgttattattatttgtgaagtttagataatgtagtatagatagagttttaagagggaggagttaggtgtgaggttttgtgaggggtgggtggttaggggtgtagttatagtttttgattataaattatgattggttagaattgggaggaattttaaagttgttaggtttaatttttttattttatagatatgaaaaatgaggtttaaagagtttaagagattgttaagggttgtatagttaattggttgatttagtaattgaaggatagatttgagtatttttttttaaagtataggtttttaagttttttattattgttagtttattttggtttgtttttaatttttattattttagttggtaagtgtaaattgttattgttaatgtgttttttttttgaattgtttgtgaaggatttttttttaaaggagttggtagaagggaggaaagttggtggtatattatatatttttatgttgagatttaatttagaatggttttgggagttttttgttggttgatataaggtaaagttttagttttgatttgaaaagtttgtatgatgtattttttatgtgtattggttgattggttttgttggaagatttaattaagagaaagtattttgattttggtgttagttttatttatgagtttattttatattttttatattttgtttataaaatttgttatttaaaaatttttgttttatagaaaatggatttgattatttgtattattatgaaaattttgttgtattattaaatttttttaaaaggttaaaaagttttttttttttttttaatttttgtttttgttgtgattttagattgggttgtaaataagttataatgtgaatggattattaagagatttataatagaagtagttttagaaatagaaattgaatttataggtagtgagataggataattagtttttatatttaaaaatatttttagattagaggagtttgttgttttagatagagaagggaattgagtttgaattttaatgttttaagtaatttagtagaaattgtttgttttatataaaatatatatggtagtttgttgtgtgtgtatttatgatttgtatttttatatttttttttaaatatatgagttaaagtgttagtttaagtttgaatatttagattatataaattatttgtatttataatttttagttttaaatgttgttgttgatatagttaaagataatttgattggttaattattttttttttttttttgagtggttatttggagtttaaaaattaaataaataaaaaatatttttgttttttttatatggagagtaagaattgttttggatgtttatttgaagttttttgttttttatttaattattatgtattatagaatgtataatttaaaatgttttatgtaggttaaataataaaagatatgagaatattaagtgtttgttattgttaaatatgtgtaaatttaatatattttttgtaatggttagtgttttagttgttgatttttgttattttgaattggtagaaattagattttggtttgggattttgaatagatattttttttagggttgtattataatttttgggagggtattttgtttgaaatatgttgtttttttagtttgggttagtagggatagagagaaatagtatttgttagttgggttgaagttttttgtatatggagttagttattggttttttgttgagggtttagttaatgagatttgattgtttgtggtatttttgtttttattaaaaagagtttaaaaataggatgaatttgaaaataagaggaagtggtgttatgtttttttatgattttagttttagtttgtttttgagtaagggggaagtagaaggaggaattttttatgtatttgtatggtggtttatattaggggtttattaattttgggattttgtttttttttttgttttttgttataaatttttgttttaaaggaaagaaaggggatggttgttaaagtataaatttttaggttagtttttgttatattagattttaagatgatgtttaaaattttttgttgaattgaaatgttagtttggtttgaaataattgagttatttattgtttagggatagaaaatttttttgttgtaaagaggtggttggttggttggtgtgtggttttgtttgtaaatatagaaagtgggatggggattggaatagtattggttttgtgggggttgaatattgaaagtagtaaaattggatgtatttaaaaattaaagttgaattggtgagtttatttatttttttagagttatttttattgagatataattttttttagttgtttgaagtttttagtattagattaagtttttttttttgttttttaatattttttttgtttgtttgttatttgtttatttttattgtaaattgttttttatataatgttatttggtgttaattagaatatgtgtttttttgttatttatttggagaaggggttaatgatgatttatgtttttttaattggtttttttttaaattgttaggtttaatttattattttataagaattttaagagattgggaaagaggaagagtgtttaatttttattttttatgtttttaattatatattttttttgttttaaaaaagagtaattttggtttaattattttggtgttttaaaagtatggttttttggttaggtgtagtggtttatgtttgtaattttagtattttggaaggttgaggtgggtggattatttgaggttaggagtttgagattattttggttaatatggtgaaattttatttttattaaaaaatataaaaattagttaggtgtggtggttatatgtttgtagttttagttatttaggaggttgaggtataagaattgtttgaatttttgagaggtggaggttaaaatgagttgagattgtattattgtattttagtttgggtgatagagttagattgttttaaaaaaaaaaaattttttaagtttttattaaatgataatatatatgagtatgtatttattgtttattagtgaataatttattagttaaatttgttagtttatttttgaataagtaatatgttattatggtttaaaattgaaaaggttttaaaaggtatgtagtgatttttttttttttttttttattgtttttagatttttattttgggaaaagggttttttttttgtagaatttatgttgttagggttttgtgtgtatatatatttgtatttatgtatatatatatgtgtatagatggatatatgtataggtatatatatatgtaaatattttttttttttttatgtagagggtggtaaatatatatgttgttttgtatatattttttaaatgtattttggaatgtattgtttattggtaggttaagagttttttttttttttgttaaggttatattatattattgtatgatgatttattaattattttttgattgatagatatttgggttgtttttagttttttttaggatgaatagtgatttagtgaatagttttgtattatattattttgtatatttttaggaaaaagattttagaaatggaattgttgtagttgaaagtaagtatatttattattttgattgattttgttaaattgttttttatagatgttaatagttaataattttgttagtaatatgaatatttgttagttttttttatatttgtgaaaatagtaggtgaaataatgattttagtttatggtttaatttgtttttttatttattttgagtgatgttgagtataatgagtattttaaaggaaaaaagataaatttttgtagttagatgtatatatatatattttaaaggtggaaatttgtttgtgtatttttttttttatttttttaaaatattaggaaattatatttagtttttagtaaattagatagttaatttttatattggtgtgttattaatagtaaatatgttgtaaatgttggaagatatttaatatttttttttatgtgattattaaaaatatattgttgaaatttaattttgattgatattattttttaaaataatatattttaaattaattaaattaagttttgatttgtaagggtatattatatgatattttttaagatataatattttaagttaattaaattttgatgtatgttgttttttattaaaagtatatagattatggagaatttattaagtgattgatatgataaaaaagtaaagtttttttagataaaaatggttattttttttttgatatttttttatgggttgagatttagatgaaaattttttgtggtaaattttaatgattatttttttaatgtaataattgaatttatttagatgattttatgttttttaatagagaaaggtgagagtttgttatttgttaggtttttttgtttatattttttggtgggttttataaaagttttatgaatttttataagtgggaaaataaattgtttattttttggtatattgaattttttatgttatattttaaaattgtaagtttatattttatatagttaaagattaatgggttaaagtatggtgggttatatttataattttagtattttgggaggttgatgtggtaggattaattgagtttaggagtttgagattagtttgggtagtatagtgagattttatttttatagaattttttaaaaaattattgattatggtggtgtgtatgtatttatagttttagttatttgggaggttgatttaggaagattatttgagtttaggaatttgaggttgtagtgagttatgatgatattattgtattttagtttgggtaatagagaaagattttgtatttaaaaaaaaaatggaaaaagaaaaaaagattgaataataataataatatgtaatatttaatatttttatggattgggtattgtttttttttttttgtgagtttttgtttatgttttttttaggttataaaaagaaagtttgtttggtaaatatgaaatttgaaaattgattatttgttgaattataatagtagagatttatttttgggataaatatatttgttattgttataaagtttgtgaataatatttttgttgtttagttatgaaattaataaatttttaaaatgaagttgttttaagtgtgtaatggtaattttgaattgttaaagtattttatattgttgtgaaattaatgtaaatttttgtttagaattagatttataaaattttagagttagaaggaggtttggagatggtttagtagtttgttttaattttataagtgaaaaaaattgaagttggggtaaggttaggaatatgttagtaagtgagtgaatgagtgagttataaagttggtatttttgaattttggttttagattttatttggttaaattgttttagaaattttgtttaaatatattttttttgtagtggaagaatgtatgtttttttagaaattagttttaaggttttttagtaaaattatgtggtaggttatttttaattgggggttggttttgttgaagatagtgagtataagagaaaattatagaatgttttttttaagaaatatttagatagtatttatgaggtatatatttggtgtttttttttttttttttttattggtaggttgtaaattatttttttgttggaaaaataaggtttttaggttatttatggtggtgtgtagatgtatatatataatagtgatagttttttagtggtttttgttatgtgtgaaaagagatgtaaaaggaatgtaggaatgttagagaaaataaaggtattgttgttgattagttgggattgattagagatgggttattttatgtgaagtatgtaaggaaattttttgtaaagatttttattatatttttaggaaggaaggaagaaagatagaagagaaaaatagagaaggaaagggaaggaagaagggagagagggaggaagagaaagatagagggaaggagggagagagtagggatttatttgtattataggtagtatattttttttaaagttttttttgtggattagagggattattggtggtagtttttttaattatagtttagaatttttagtattaaaaatttagttgatattttttaaggatatatatttattgtaggttttttatttgaaatttagatatatgtagttagttatagattatttataagatgttttaattttaataaatttgggatttaatttattattttattttttttgttattttttttgtttgatttttttattttagtgagttgtattatagttttttaaattgatgaggttaaaattttggtaattatttttaatttttttttttgttttatttttagttattatttaggttaaatagtttagttgattgtattttttttgtgttttttttattttattttttgtttgttgttattgttttagtttatagttttattattttttttttgagttgttgtaataatttttagttggtttttttgttatttagtttttgtttttttttaatttgtttttttgatttttgttagagaaatttttttaggaaaatttatttaagtatggaatgtttttgtataaatgttttatgggttgttgagtatttttagagaaattgttgtgattgatttatgtttttatttttttggttttgtattgtgttgttttttgtttttttaggttttgtgttagttatttaggttttttttagtgtgagtatttttttattttttgatttttgtataagttattttttttgaggagtattttttgttttttttgttttttttttttttgtttaatttttattgagttttttaatttgattttgagggtattttttagagatgttttttttgattaattgagtagatttatttaataaatatttgtataaatttattgtgtgttaggtattgatttaaaggttttatatatatttttttttttatttttttaaattttaggagaaagggaggattttagtttttattttatggatgaggaagttgagattttgtttgagtggtgaagtagtttgtttaaggttatatagttttgtgggttagaagttatttttgtttttgtgtggtttttgattttgatttgtatgtagtataaatatatatatttttgtgtgtgtgtgtgtgtgtgagagagagagagagagagagagagagagagagatttatgttttaaattggttttgggtttgttatttgtatatttaatatataataaattatatatataatttattttttgaatagataatagaagtatatattataaaatttaaaaaatataaagtgtatatagtgataggagtttttttttttattttattttttatttttttttaaaagtagtttttgttatttatgttttgtgtatttttttagggatatttataaatatatatgtagatattatgtgatttttttttatatttatgatagtttattttgtttgagatttttaatttgttttgtttgattaatagtatattttggggtttgttttatattaatatattaagagttttttttttttttttgtgtttatataatagtttattgtagggatatattatagtttatttaattagttttttttttggatatttaggttgtttttaaatattttttagtataattagtgttgtagagattagttttttatagatattattttgtatatatatgagttgatttgtaggataaaattttggaattggaatttgtggttaaagggtaggtgtatttataattttgatagatagtgttagattgttttttataatggatgtatttatttatttttttattagtagtttatgagattgtttttttttttttagttttatttttgtttatataataaaatgttttgatgtttatttttttagtatttttaattagttttttttttgttatgagttgttatgtattttttaatgtgtttatgaattattttgattttttttattagttgatttagtatttgttggttttttttatattgatttataggtattttttatatattaaagaaatatattttttgtttgtgatttatgttttagataggtttttggtttgttatttgttgatggtgttttttttttatgtagaaaatttttatttttatgaaattagatttattagtttttttttttttatagtttttggggtttgagttatagttaagattgattttttttatgtttaaattataaaatttttttttatgtgtatgtatgggtgtgtgaggttgttttaaagaaagaagtgatagagtgtaattgttgagaaaattaattgtggagttagattgatttaattgttttggttttatttttatttttttaattttggatgaaatgtttaatgggttagtaatatttatattttagggttataggtgattatgaagattatatattataatataggaaattgttttgtattaaattattgatagttgtttttattgtgttattttttttaagtttaataataattgtataagaataagggttttttttttttttttttttgttttttttttgttattgtggttttttttttttttaaattttgttgttagtaagattttagtgtggtgttttgttgatgggatttgagtgtttattttgattgttttattgtttattttgattggtgatagagaggtttggagttttggttggagttatttggagtgttataggtgtttttttatttgttatgtagttgtttttttagttttttgaggattttggtgtttttttagattttggtatttggtttttttttatgggttattggtgagagtttgtgtttttttttttgggttttttgtagttttttgttatagaggttttattttgagaggatttgagatagtgtattttttatatgggtgttttgtaaatatttttgattaaagaagttaggagaagtaagaggtttggggtgttatattgattggaagagttataaattttttggttatttttttgtttttattgattatataggaaggaattattttaaattatgtatttttttagtggatgatttttttaaaaatttttatgatgttagtttttgttaatatttattatagtttttattgttatggattgtaattttttaaaaatatttaatattatgtaagttgtttaaagatattagtaatttggagatagtgtagggaattgggttgtgattttttggtttttatttgtttttgttgtttttttttttttttttttgtttgtttgtgttttttttgtatatttatttttaataaaggttttttgaaattttaggggtaggagatatagtggagtattgaggtaggttattttatatttaattttgttattttttggttgttaattaaaataatgtttgagtgttagtgtttagttttatagggggtgtgtaaaatgttaattataattgatttgaagtatttagtttagtgttagggagagggtttagggtataggtagggagtatgttattaggaaaaaaataaattagaggaaataaaatattttgttgttttttaaaaaattttaatatgaggttttattatgagtaaatatgaaggaggatgtgaagatgggtaaggtgtagtttgtggatttaaaggtggggttatttgtatgttgagtgttttattatattattttatttaagatttgtagtaggttgggtgtggtggtttatgtttgtaattttagtatattgggaggttaaggtaggtggattatttgaggttagatgtttgtgattagtttggttaatatggtgaaatttggtttttgttaaaaatataaaaatgagatttgtttaaatttgggaagtagaggttgtagtaagttgagattgtattattgtattttagtttgggtgatgagagtgaaattttgtttaaaaaaaaaatttgtagtagtttagaaggtaggttttattattttgattgtatgggtgaggatattgagttgaagaggagtaatttgatattgattttattgtatagtggagttaagattagatttaggggatttggttttttagttttattattttagttttattgtattattttttggaaatgtttagtttagtaaaggagagagtgatgatgtaatgatgtgattgtttttagtgaagagtaaaagtaatgaattagaaatgggagaaatagattgatatttttgagttgtttttttggttagggtttttgggtttttgttttgtaatatagtttaatgtggtggttatttaagggagaagggttatttattagtttttttgtttttttatttttattttaattaaataagtttttttaggattttatatatttgtatgtaataaaataggttttaaaaatttgtagttaaggagtattgtttgtttttttttggtaataattttagtggaagtaaaattatattggattgtttgaaattttgagtttaaagtgttaatttttgaaaaatgtttgaggtttttgagtttttgtggtatgttattagaatattttgtagttttaataatttttagtttttattttgtattgtattttttgtatatttaatatttattttatatgtttggggataggttagtttattgtttatttttgttgttttttaggttgaggttttttgatgagtatagttttttgggaaggattttagtttttttgtgaaagtttttagttatttttttttttgtttttagaagtagtttttttattttaatttgaaattttgttgtattttttagtgttttggaaataaaatgtgtagtaggagaattttggttttgtggatattggattattttgttttttggtataataattttttttttgtattaaatatttgagaatagaagttttaaataatatttttatattttttgttgatgtaagttttttatttggggatagtagtttggtatttgtttttttgttaaattttgatgtatttttttttttttttatgatgaggatattattgatttttagtttggaattttattttgggtagtggtggtatttgtttattttgtgggatttttttgttgaatttttttagtttgtagtgagtggtttgtgttatagtgggatgtttgattggttggagtaaaggtatttaattttttagtttgattatgagttgggtggtgaattagttagttataaataagttagatggatagatagattaaaatagttatttgtttattttttttttggaaatgtagaagggttgttttggaggtttaagaagatttaatttggttagtaatttagtatttattttgaataggaggtggagttgtgagtttggtataagttttttatttttgattttttatttttattatatatgtttgtatattttaaggagatgattagttatattattaattattgatgggtaataaatattttttatgttaaagtttttttgatgatttttttggattttgtatttgtataatgaatgtatttgtgtttttattttaaagaaaattagtatatgtggttgggtatagtgatttatgtttgtaattttagtattgtgggaggttgaggtaggtggattatttgaagttaggagtttaagattagtttggataatatggtgaaattttatttatattaaaaatataaaaaaattggttgggtgtagtggtttatgtttgtaattttagtattttgggaggttgaggtgggtagattatttgaggttaggagtttgagattagtttggttaatatggggaaatattgtttttattaaaaatataaatattaattgggtatggtggtaggagtttttggttttagttatttgggaagttgagataagagaattgtttgaatttgggaggtagaggttgtagtgatttgggattatgttattgtattttagagtgagattttgttttaaaataaaaaaaaaaaaagaaaaaataataataaaaaagaaaattagtatatgtgttttattttttaggtaaatttaatattatataaatttagttttttaagataggataggatattttattttttagaaaatgtataattatattttttaaatggtgtaggtagtataatataaatatggtttattttttaagattgtttttatttttatgtgagttttaaagtttttttttttttttatttatttaataattttatgttgagttgttttatgggaggaaaggttgttttgtatggtttttttgtagttaatgaaatgagtagttggttttggtgttttattattttgggttagagatttattttttgttttttatttttttagtgaatatttagtttgtgttttttatggattaagtattgtgttggtttttttttatttgttttgtttttagtgggagtagttggaaggatgttgatggtttttttttttaggagaggaagggtagtgttttatgttatttataattaagtagttagttgttggtttttggaaaattagtttattaaagggaagtattgagtttgaggttttgggatgggttggatttttttttaagtggaataatattttattttttttgtttaatttttttttgtaaattaaaatgggaaaattattttatggataaagttaagtagaaataaaaaatattttttttgaggtagtttggtagtatttgtatgaattagttagtgtttggataagaagtagttttttgagaaggaatggagtttttttttggattttaattgatttttgtatttgtttttttttttttaattttttgtggaaaagtgatttgtattgtagagtggttttaatatattatgggtgttgttttatgtaatattgtttttatttaaagattatttttgtttgttttgttttatttttttttttgatttagtttatgtttgttttttttttttattttattttttttttttgaaggagttattgttttttttattttttttattttatttatttttgttatttgttaggagaataggagaagatatgggttatttttttttttttatttttaaaattaattggttagatattattttttttttgtgagtttgttttataatgtagagttttattagtaatgaatttgatttttaagaagttgggttatgtttatttttagggattaaggtattgttttggtttggttggttttttgttgtttgtgttattgtttgtttttgttgattagggtgtgtttggtttatggatagggtagttttttgtagaggtattttgttgttagggaaagttttatggattagtaattgttaagattttttttgataaaatgagattttgaagtttttaattatgagttttaaataatttatataataaatttagaatttggagatttaaaagatattgttatgtttttggttatgttgttagggaattatgtttttgtttttaaatgatatattgttgtgtgtgtgtgtgtatatgtgtatgtatgtgtgtgtatgtatggaatgaggaaaattaggtgttttatgtttatgtattgtagtgaaggttatagtgttgttaggtttttttgatggatattataatttaaattatagaatttgtttatagtagtgtttatgtgattaagaaaaaaaaaagtagatgaaaagtagttagatgtgtttaaaatataattaatagattaggtttttggaatatttgagtttaagggtttggttttttttataatatgttgagaggtgatgttttaaaagtaaaaatggagaaaaggttagttgtggagaatggtaattgagataattagaaagtagatgtgtgtaattgaatgtagttagttttaaatggatttatatttttttttgtatgagggtttggaagggagagtttatagaataaaaatggagttattttattttttttgtttaatatagatttttatatatagtgagtatttgaattgtgatttgtttttttattggtgtaatttttatttgtttttggaagtttattttgaggtgattttgttttttgtaatatggaatgggaaaatatttggttgagtttagatgtttgataattatgtaggtgggtaaggtaattattgggatggttggaaggtgttatttagggaaattgaaggttaggatgaaaataaaagtaaatggtttttttttgggtaatgattgttattaggattttgttgttgataaaatgttgtttttttgttttgttttttgtgtgtttatttatatgatagttgttagatattttatttagtttttatttatttggtattgttttagtgttaattaatggtaaggtgttttttagttgttatggggagttgggtataaatagattttagtgaagttttgtgtgtatgtaaattgtgtttgttttttgtattttgttttttttttggggttatgtttgggatatttatatgttgtttgttttttttttgtgatgggggttggtgtttttgtattaggtttttatagttattaatagttttgtttatgtgggaggtgatagtaatattttgttatattataggttgtagggtttaatgtgaatattttttttagagtgagtaaagggtatgggatttttgatggttagggaagttatagtttgtattatagtgtgaagattttttatttgggttatggggagtatttagaatgtttttttatgggtttaataaaatgtgatgaataaatgtttgtggtgaagttttattgtgaggttttttgattatatgtaatataattattgaaatttttgttaggtattgttttgtatttttatttataaaggaagttagtgataagtttattattgttttttgttttttttttagttggtttttaattatttaagttaatagagaaaattattattattgatgatgtaaatttgtaaaaagtttaaaaataatttgtgtttgattttgagatggagatggtaggtatgtgaataaaatgtgttaagatatttaggttattttgaggtttaggttaatgtttttttaatttggttttgttttttttgaagttggagattgtgtatagggatttgggggattggagggtaatgttagagaataagtggaggaggtggttattaatttttagagtttgttatttattatgaagaaagttggttaggttttgttttgataatattatatagatattttatattttttaaaagatgattagagtgatatttgtgtggttaaaaagttaaataatatagaaggtttttaataaaaaataatagttttgtttgggttttgtttttttttggttttattttttagaggaaatatttttgaatttttttagttttgttgaaagttttttgggtggttatttttatatttttaaataatatatggtagtattatttgtattagttttttagggttgttgtgataaaatattgtaaattgggtggtttaaaataatagaaatttattattttatagttttgagggttggaagtttgtaattaaggtgttagtatggttatatttgttttgaaggtttagggggatttattttttattttttttagtttttggaagtgttattggtttttagtttgttttttgtgtttttgtgtgtttttttttatatggtatttttttttgtttataaggatgtagttttattgggttagagtttattttaatgatttttttttaatttgattatatttataaagattgtgtttttaaattaagttatatttataggtattggggatttgaatatattttttgaggggatataatttgatttataatattatttttttttagtttattgttttttttttatagttaatggggtttttttttttgatttagttttgtttgtgtttttttttagattttttttttttttatgttttgtttttttatttaaaggatattgtttattttttaaataaatttttggaaattttattttttattttgttgattttagagagtattatttaattatttatttaaaaaatgaaagtatttatttttttggtttttattttttatttttgagtttttgttagttagggttaagtttgatgttatttgtgttttttttagttttttgaatggttaaattttttgttatttgtttttagatgaagaatggatatttgtttatagtttttattgataggatttgaaagttgaaaattaataaatagtgttattgtgattttgttttttggattattatatttttgtatgttttttgggttttaattaaaatattttatattatttgaaaaatgatagtataatttttgtttgtttagtattttagaatttatatttatttgattttagatggtagtatattttgtttgttttgaattgggaaattgtttatttgttttttttgatgttttttggtattatatattgaaatgaggttttgtgttttataaatgtttgattatatgatatagtagttgtatgggtttttttgtgagtttttagtaataggtaagttattttaaggtagtgttagttaaattttggattttaatgttttttattttttttttttaaagattaatatagagatgttaattttttattttgttagaatgggatattaataaattagttattatttatttttattggtaaaataagaatatttaatatgaaaaataaaatagtaaggatataattttggaataagttatataattttaaaaattttgaatgaatttaatttttaaagaatttattatttttttttattttttttatttggtatagattggtgaaaatattttgaatggaatggttgttttagattaattttgtttagtggttatgtgtttggttttaatagagtagaatatattgttaatgattttgtttattttgtagatggttaggttgattgattaggatttggtatggaagatgtgtaggagaagggggtaggttttgtgtgaagtgggagagttggattgttttattttgtgattttaaattgtaagtagaattttatattttttgttatatgtttttagtttaagttatttgtaagttgagttagtttataaatttttgtttaatatgtgttgtgttgggtatgaatttaagtagatatatatagatttgttatttttatatatgtagtttttgagtaagttatgtttttattgttttaatttattattataaagttggttgggtatggtggtttatgtttgtaattttagtattttgggaggttaaggtgggtagattatttgaggttggaagtttaagattagtttggttaatatggtgaaattttgtttgtattaaaaatataaaaattagttgggtgtggtggtgtatatttgtagttttagttatttaggaagttgtggtagaagaattgtttgaatttggaaggtggaggttgtagtgagttgagattatattattgtatttgagtttgggtgatagagtgagatttggttttaaataataataatttttttttataatgttgtttttttatatatattttattagtttgaggtaatataattagtaaaatttaagtatttaattaatgtataatgatattatttttttaattttttttgattaaattaagtttaaaatggaatattattgattaaatgtattttattgattatatttgattaattaattattaggtaaaattttttttttttttaaggaagaagagattgggattaagattggttattagttatatttttgttatattgaattgaatttagtttttagaatgttaatgttttaataggaagttttgtgaaatttttttagataagaagaaaattaattttttatttttttttttttggtaagaaatgtttgtgtgtgtggtggggggggagggttgtagttaattataggtgattttaatgatggtaatatatagtatttttttaggattatgtggtttaaaatattgatgaggttttttttataatatttttgagaggtatttagatattgtttttttatgtttttttgtataggggaaatttaagatagattgaggttaagaagtgagtagtttaagtttagttagtaggttaattgtaaagtgagaaaaggaagtttagtttttttaaattatattttttattttggttaatgaatagtatttttttgagtttatatttttaattttaagattttattttaggttattttattttttgaagatttgaatatttgaatgaattagatatggttttttaattagaagtgtagatagttgtgttttttaaggttttattgtaaggataaatgaaggtggtgatgtttttgagtttttgggatataggttagtttttagagaggaggaagtagttttgaattagtagtatttttgagtttgatttgtttattagaagtaatggtttggatagagttgtttatattgttattttattttattggtgattaggaatatatattatagaaaagttatgaattatgaaattagagaaggtgataagtgttggttttatgttgttttagttttgtgttatttaatttttttggattttagttatgttattagtaaaatggaggttatgatgttaatttttttttgttgttttttattttttgatttttttaaatgttttttattggaattaaattggtagttgtatatttgttaggtttatgtatatagtagtgagttttgtaatttaaggattagatttaagtatagatagggtttatgttttgtagttttgtatttttttttttttatattttatttttgtttgtattttatgttatttttggaagattttatatgttattgtttttttgtttttattgaatagagtgtattatttgtgagtttttagtatggtgttttttggtaatttatttgaagatatgatttttattttggttgaaatttaatattttatgtgaagaataaggatagtataatttaaaattttggattattgtatatggtattttttttataatttatattttaaatatgtgtattaatttataatataaatatatggatgttttaaataatgttgggttataaaaaattggtattgataattgtgattttaatgatgagaagtatttattagaagaagaaggaattttattttttttttttaaggtagggttttgttttgttgtttaggtttgagtgtagtgatatgattttagtttttgtaatttttgtttttttggtttaagtgatttttttattttagttttttaagtagttgagattataggagtgtattattatatttagtttttttttttttttttttttttttttagtaaagatagggtttttttatgttgtttaggttggttttgaatttttgattttaagtgatttatttgttttagttttttaaagtgttgggattatagatgtgagttattttgtttggataggaagaaggaattttgtttaagtatatttttggttttgtttagttatgttgtttatatggttattgttataaagtagaaaagttattaggtatttttttatttttgaagtaagtattttaaatagttgagagtttgtggtatataaaaagaagtttttttttatgttaatgtttttaaaataagttgtgatttttgaaagtagagattaaagaaagaataatttgaataagattttagtgggtagaaaataaatattaattttatatgtattttaagaatgtaaaagaaataggtgggaaatgaattttttttgataagagagaaatgtttagtagggtggaaaaaaaaaaaagataatatttagtagtttttggaattgtgtgagtttagagagttttttttttttttttttttttttttttttttttggttagtttttatagttataaatatgtatattattttttttttgtttataatttattgagaattatttttttaatatattggggaattttaaataaaaattttatttttttaaatatagataagttttttaatttttgtaattaaatgatttaattatttatatgtagattgtaaaagaaataattaaattgttttagtagaaatttttaatggttattttaaatagttttttttttaaatttatattgtaaatggtttaggtttagggaggggttttgttttagttattgatgttttgaaataggatttagaaattttttttataaagtttttgtggtgattgggttattttagtaatgtgatatagtggtaggattatagaatattttaatttttttttgaatgttgtaatatatttttatatgggaaatgattgattattaattatttagaatgtgttttttttttaagtatgttagtagagtaagtatagtagattttgtaggtgattagtgtagtgttaggtgtgagtagtatggattggagatggtttgtttggatttaaatttttgttttgtttttttttatttaggtttttttggggttttttttgtttatttgttaagtgttatgtattatagtattttttttatagggttgttgtgagttttaaatgtgtttatgagttaattgtttagaatagtgttagttatgtaataaatattatgtaagtggtagttatattatgtataaataaatgtaaattgtgtgtatttgaggaataattttagttaatattaaagtgtgtttttgtgtatagagttggtgtttgttgtttgtgtatttattttttaaaaattgggaaatagtagatgttaggaatttatttattttgtttgtttttttttttattttttgtttgttatttattttattttagttttagatttgatttgtttttttgtgtagggttgtttttatgtataattaatgtagaattgattttattaaatttataaagtgtattagtttgtttttatgttgttgataaagatatattttagattggataatttataaaagaaagaggtttattggatatatagttttatgtggttggggagattttataattatggtggatggtgaaaggtatattttatgtggtagataagaggagaggattaagttatattttatatggatggtggtaggtaaagagagtttgtgtagggaatttttatttttaaaattattatattttgtgagatttatttattattatgagaatagtgtagaaagatttattattataatttaattgttttttattgggttttttttatagtatgtgggaattgtgggagttataatttaagatgagatttgggtggggatatagttaaattgtattaataggtatggaaggaagtaaaatattattttttggtaagagtttttttattaagatatgaggatatatgtagaaagtgaggaaataaaatttaaagaaagtgaggaaataaaatttaaaattggtttttaaaagtaaattttttgttagtaagatgtgatatgaatgttaaagttttaataggttttgtttttttgtaaatatttattttattatatttaataatttttgtgaatgaagattttattggtgttttttttaagatattaagaatattaggattatttatatttgaggattaaaagattggtagagatataattttatttttgtggtttttttgtatattttaatgttaaagtttagtatttaagattgaataaaaatgttttgataattagatataaaatattttttttgggttgggtatagtggtttatgtttgtaattttagtattttgggaggttgatatgggtagattatttgaggttaggagtttgagattagtttgattaatatggtgaaattttatttttattaaaaatataaaaattagttgggtgtggtggtaggtgtttgtaattttagttatttgggaggttgaggtaggagaattgtttgaatttggaaggtggagtttgtagtgagatgagattatgttattgtattttagtttgggtaataagagagaaattatgttaaaaaaaaaaagaaaaaaaaattttttttagtgttagttatttttttttttttttttttttttttttttttttgagatagagttttgttttgttatttaggttggagtgtagtggtgggattttggtttattgtaagttttgttttttgggtttatgttatttttttgttttagtttttttagtagttgggattataggtgtttgttattatgtttggttaatttttttgtattttttagtagagatggggttttattgtgttagttgggatggttttgattttttgatttggtgatttgtttgttttggttttttaaagtgttgggtagttatttttttttttaaggttatatagttatggttgattttgtaggggtttaggatatgttattttagattattatttttttttttaaggattgttttaatataatttttagtatttgagagattttttttgtataataagatatatttgatttattatatagagtttttttttattaatgtatagtttgtgtttttattatttttagaagttttaagtttttattttgttttatagtttaggatgttaaatgagttttaattgtgtgatttttttttaagttttatattttgtgggatttttatgtgtatttatattattaaatatggggtttttttttgttaatttgttttatgttaatttataatttagttaagaaatttagagtggtggaggaaagttattttttttttttttataatttttaaatattaaaattaaaaatgtttttatttattaatattggaattttgtggtatttataagttgggttgtatgttagtgattgtaataagtaataaaaatttttgtatgttaatattttattaaatttgattatttatggatttgtgattattattatttgttgtttattggtttgttgttgtttttaaaatattttatttggatttatggattatatgtttgttttagaaattttttaaaagatagtaaatttttagtaagtgggaagaaaaattatttaatagtattttaagtattttaaaagatgtaaatatggaaagatgaatatgaaaaagggtatttttagagtttattaattgtttatttttggagaaagtttttattttttattaagattttaatggttttgaatagtatatgtttttgtgtatataatgaaaataaattattattattgttattatattaattgggtttgtgtttattgtagattttatgaaaaataattaattattaaaaatgatttgataggagaagttaataagttttaatattaaatggttttgtaaaagtttgtaggtatattatttgtgtatttagtaatatttttaattagtgtttatgattttattaatttaatttattttttatgaatggtaaaaatttatttttttttatatttataaatgataggttattttgatggaaaattaaagatttattatatgtttttttttgtagtagtggtagtagttgtagttattaattttagatgtgtagtttttagtttattatgtgatttagtgtgtttttattgagggtttttttgttgagagagagtataatatattagtaggagtatatgttttggagttaaattgtttttggtttagattttggtatagttatttgtttattgtgtggttttgggttttttggtttgtaaaatatttgttttgtagagtttttgttgagttgaagtgagaggatgtatgtgtaagtgtgtggtgtggtatttggtgggtattttatagtattggtttttttttttttttatattgggggtttgtttttttaatttttgtttattaagtagatggggaggaagagagtggtgtttgaaattattattttttttagtgagttaaatgtgttatgttgtgatattttaggtatgtttttttattttgggggttttggttaatttttttgttaaatttagagtttgtttttttttttttttttttttttttgaggtggagttttattttgttatttaggttggagtgtagtggtgtaattttagtttattgtaatttttgttttttgggtttaagtgatttttttgttttagttttttgagtagttggagttatagttatgtattattatgtttagttaatttttttggtatttttagtagagattgggttttattatgttggttaggttggttttgaatttttgattttaagtgatttatttattttggttttttagagtgttgggattataggtgtgagttattatatttggttagttgatttttattttatgattatttttaaagtatttttagatttatttttttgtgatgttatgatattatgaagtattaagttgagattaggagattaatagtagggtgttaaatggataggattgattataattttatatggtgaaggaagaattaattggatttagtgatatattaaatgtgattagatatgaattggaaattattttgaggtaatgttttttaggatgttttttttaaaatattagttgttgaggatgggaatagatgttaattgaaaaaaggtttttgaaaagtatttgggaaatgttaattttattaggttttttttttgtaggatttttttgattttttaatatgtttatatgtatgatgattttgaaattggggaatgtagttatagtaggaagtatttttaaagtttatttttttatggaattagaattatgttgtatttaagtagtattttataggattagtattttatggaaaatattttgtgaagtgttgttttatggttttaaattaagaatgaggtataatataggggtattgatttaatttagtgaatgtgttgagtattgattttgtaagattttgtggagggtggaaatggataagattttatttttgtaataaggttggtaataagttattagtggtggtattgtttatatggttaatagtagggatgttttgggggagataatattttattgaattattgatgtagatttagttgaggtagtatttttagggtgtaaagttttgattttttttttggatgtgtttattttttgtttttttatgaagtttttataatggtattagtatttagtttattatggagaaattttgtagataaaatgaatgtaggagttaaattaatgggaagttttatttaggagaagattttataaaatggattttttggattttgtttttgagtatatagttatttgattattatttttatatttggttttaaagttaaaatataatttaaggtgagaagtttaaaaattatgtagtagataattttgttttattgtgaaggatatggtattttaatgttggtagaatttgatgatgtagtttgtttttattttttattgatgaaagatgagttagaggtttgatggtagattttattgggaaggatttttttttattggttagatttgtggattattttattattggatttttttgtttgttaggtttttggaaatattttggtagattgagtagttattttgtttatgttgtgagtagtgtttttttgattttttgttatttattgaaataatttagtttgtttttttttaagagaagtgtgaaatgaaggggagttagttagtatatgttgattttggtattagaaggttaatttttgggttgtttggtattatgtatgtttttaaagttatggggttattggtttttttgttttttatttttatgattttgaaggagttttttgggggaatttttttttttttgttaaagtagatgtatgtaaggttagtaattaaaaaaatatattttattatgtttataaatataattttttaagtttttttatgatattttgggtatggtagattatttgaagtttttttttttttaaatattgatgtgatgtgatggggaggttagtttggtattggaatggtggtttggtgatagggtattttttatttttgattttttatgattttgtgagtttagatagtggaggtgatgatattatttaggatgttttttattagttgtaatagggaattttttttttttagtgttttgtttatttatgtttagaaaatttatttttttgatgtttttttggttttttttttagtagaagatttttattttttgtaggttgatttgtaaggataaaggaagtattaagattttattgtggttgggtgtggtggtttatatttgtaatgttagtattttgggaggttaaggtgggtagattatttgagattaggagtttaagattagtttggttaatatggtaaaattttatttttattaaaaatataaaattagttgggggtggtggtgggtgtttataattttagttatttgggaggtttaggtaggagaattgtttgaatttgggagggggaggttgtagtgagttgagattgtattattgtattttagtttgagtaatagaataaaattttgttttaaaaaaaaaaaaaaaattttgttgtatttttaaagatgagaaaatgtgtgtgtgtatgtgtatttgagtatatgtttatttttatttttttatttatttatttgtttattgatttttttttagtttggttagaaaatttaataggaattatggttttttattgggattttttatagtatttgagtttagttgttagtgttgaagatattatttaaatttgttttgtttatttttgtagttaaatataaaaatgattattatttatataaattaatttagatgattattaattgaggttatttaataatgatttgtatgtttgataattattattgtttaagaatgggttatggttttaggaatgttttatttatttttttagttttttagttaataaataatatattgttttaggtgttggggatatagtgtgagtaaagggatataatttttatggtgttatatgggtaataagtaaaattgaaaaataagaatgtggtagataataaaatggataatgtagggtgtaattggggaggatggtgatatggtttggttgtgtttttatttaaattttattttggattgtagtttttataatttttatatgttatgggagggagtgggtaggatgtaattgaattatgggggtgggttttttttgtgttgttgtgataatgaataagttttatgagatttggtggttttataaaggggagtttgtttgtataagttttgttatttttttttgtttgttgttatgttttttgttttttattatgattgtgatttataattttttttataaattatatagttttgggtatatttttattagtagtgtgaatatggattaatatagggggaaggttagtttaaatatgagttttataggatttgtttttttggtttgaggtttgtgagatgaggagttagttttgagaagttttgaggaaaaatttggagatagaaggaagaataaatggattttttttttattgaatgattttatgtatatgtttgttatttgggattatgatttgatgtttttttaaatttttaggttattgggaatatttataaaatagttgaaagatgttgttttgttagaatgtttgttgtaatgtaggatgttggtgaatttagtgtgaattttttaaaaatttattgattttattttatttattttttagagtttttatattgataaaggatattttttatagattagaaagttagtagattttattttttagaggaaagttgtggaaaatatttaaaaatattgtgagtagaagaaagaagtagtttagagttttaaatttaattgggttaagttgggtaagttattgttttataggtagtaatttttttatagaattttaaaaagttttattttgtaataattatagatttgtgggaagttgtaaaaatagtatagagagggtttatgtattttttattttgttttttgaatggtaatgttttgtataataatagtaaatggtattatgtatatagtattatattattaatattaggaaattgatgttagtattaggttttaaatagattttattatggtttatgtgtattgatttgtatgtgtgtgtgtattttattttatgtttagatttttgtaattattattgttattaggatatagggttattttatttttattaagaaatttttttgtttttttgtatttttatgtatgagaaatggtagtagatgttgttttgtttttagtttgaattatattttggaaaaatttatagtgagagaaggtggatgagtttttgaaatttattggttgaaatgtattggtattgagaatttgtttaattgatatagaaatggagttttttggtttgatttatatgaagattatttataagtttagaattaaaaaatataggtttgaataagtaattttgattatattatgagagtttattagttgatgtttaattggtttaagaagttaatattagttatgtggtttgagtagtttatttttaagaagaaaattttttttggtattatataatttgggggattaataatatatatatggagtgtttggtatattttttgaagatgatttaggaagtagatatattagtaatgggttaataggttatttgaagagtgggtgtattttttatggaaaatagaatatatgatagaaaaatagttttttgtgtgtggaggtaagaaatttttaggatgtgtagttagtagtgagaatttaaggaaggtgtaggttgaaatggaaatatgttataaatagattgagagagagataatagttttaagggaaaatatttgtttggtggatttgatatttaaaagttgtatttgtggtttaggattaattttgtaatgtttaaaaaaggaatttatagaggtttaaagtgggttttgaaagtttttttttttttttgagattttttgtttgttttgtttagaatattgtttaggatggatgaaatgaatttatttggttttgttttttaatgttgaagtagtatgttagagaagttaattttagaatagttggttgtagtaatattttatttggattattttagatatattgataaggggagtttatttattttgttaaatgaaatttttggaaatttttttttttaaagatagttttgttttgttatttaggttggagtgtagtggtgtgattttggtttattgtaatttttgttttttagatttaagtgatttttttgttttagttttttgagtagtaggaattataggtatttgttattatgtttggttaatttttgtatttgttgttgttgttgttgtttttgagatagagttttgttttgttgtttaagttggagtgtagtggtgtgattttggtttattgtaatttttgttttttaggtttaagtgatttttttgttttagttttttgagtagttgggattataggtgtttgttattatgtttagttaatttttgtatttttggtagagatagggttttattattttggttaggttagttttgaatttttgattttataatttatttattttggttttgtaaaatgttgggattataagtatgagttattgtgttgggtttaatttttgtatttttaatagagatgaggttttattatgttggataggttggttttgaatttttgattttaagtgatttatttgttgtggttttttaaagtgttgggattataggtgtgagttattgtatttggttgtgaaatttttagaaattttgagagtgatttttttaatattttgtattttaagtagaagtttttagtaataatgaagttgaaagttagaagagaggagtagataatgtttttatgaagttttagaagatattaggagtatttattttgatattagattgaattgaaaatttgttatattagttttttgatttatttatatttttttttttgagttattggtttgtgttttgtaaatatagtttaagaggttattttaaaggaaatggagattaggtgttttttatagatttttatgtttgattttttggagtgggagtaggagagaattatgagtaaagagttttagtttttattttgggatattattttttttttttgtatagattttatagtgggatgttggtgaattttttaatgttaatttttatttttaaatttaatttttattttaagtttagtggtatatgtgtaggtttgttatatagataaatttgtgttatggggttttgttgtatagattattttgttatttaggttttaagtttagtatttattagttattttttttgattttttttttttttttattttttattttttgataggttttagtgtgtgttgtttttttgtatatgtttatgtgtttttattagttagtttttattaataagtaagaatatgtagtatttggttttttgtttttgatgttagtttatttaggataatggtttttagttttatttatgtttttgtaaaagatatgatttaatttttttttatggttgtatagtaagtatttattttatggtgtatatgtattaaattttttttatttagtttattattgatgggtattgaggttgtttttgtgtttttgttattgtgagtagtgtagatgttgatgaatttgtattttatatttagtgatttttgttttgaagaatatattttatttaatttatgttatttgaagatgattgtaattgaggtgtaggaatttgttttaaattattgtaaataattttttggggtattttataatattttagtgtttttttgtttttttttattgttttttttatttgattttttttttaaatttttgtttttatttttatatattttattttaaatttagattgtagtaagatttttatgtgtattgttatatgtatttttagtaatttgaaattttatttaatattaattaagttggtataaattatattattttatatatgtgaagttgtttgttatagttttgttttggagaatggtgagaatgttttttttgttttgtggtaggggtgaggggggatgttttaatgaggagagattggtaataagggattgtggtgaattggtaggggaggaaatttaataaatagaagagaggaatttaggatagttgggtattggagtgttgtaaataaagtaatatgtgatgttttttttatggaatgtttatttatgttatatttagaatttttgatagttgttttgtattttttaatattggtatataatggggttttagggtttgttgaaataaattgggttttatattatgtgttttttgatttttttttaataatgtgtgttttttagttttgtattgaaaattaggatattaagtgatattgaagttagataatttgttttatgttatatgggttgaatgtggtagatgtgattttaggttttttgattgttttatggtattttttatttttaagtttttgtttttttatatttttaaggtatagaatttattttattatttggtttggtgttgaggagaagtttggtataatggaaagatttaaattttattttttttttttttttagaagaaatttgtagaattgttttattataatttgtggatagttgatgtagtttgaagatttatattttggagttatttattttataaaatgttagttggggtgtttattggtatattgtttgttgtatatttttttatattttggaaaggattagttgaatttgttttaaattaagtaattgatttaggattttgtattttattagtgttggttataatttaaatttaatttttttttaaagttgtattttttatgaaaggtgatttgatagtgagataagagtaatgatgggtgaggtatttttaaattaggttagggtggtaggttgggatattttgtttttattagatttttgtagttatttttgatttttttgtgtgtttgttgaatttgtgagattttattgtgttttttttagttggatattttttagagggttattaagaaaaaggagtattttttgtattaataattttgggaaggattttagtagtaaaattagagattagatgatttgttggatagtaggatgggggagtattttttttttttttttaggagagtgttaagtttagtatgatttagtattagattttttatttagtaattttgagattttattatattaagttattttagttatgatgatgtaaatggtaaaattattatttttattttttgggataagaattttttgttttaaaggaatataatatataaaataggtgattatgaaatatgtttggtgggttagttaatttttatatgtgttttgtgattggtttttaagtgaatttattgttatagagttttaaaataattttttaatatttatgttttttgtattttgttttattattgaaaataataagtgttatgtaaaagtgtaaagaatatattgaggtttatagtaaggataattattaaagattgggagttagaaagttatggtttgtgggttaaattttgtttattatgtgtttttgtaaataaagttttattggaatatagttatgtttatttgttatgtattgtttatgtttgtttttatattgtaatattagagttgagtaattatgatagagattatatggtttaagatatttgttatttggttttttattggaaatgttttttaatttatgttatagatatttttatggtatttatttattgatttgtttgtttatttttttagtggatattaattttgttaatgatgttggggaatgtaaagataagtatattagtttttaatttttaagagtttataatgtaatagagataagttatgtatttaaataatagagataagttatgtatttatttttatttttgattaggtagaatgtagtatgtattatagataagaaatagttaaattgttgtggtagtttagagatgatgagagtttttgataaaggtagggaattgggaaatgtataaagatattgtttttataattgtggtatatagtgattttttaatagggaattttatgagaaattaggttaattttttttatggaattttataaattgtagtatttaaaagagtggaagtgatttagaatattattttgtgtttagatttttttatttagaagtatattttttttgtaattatggggatgattatatttatagaaaatttttgaatatttgaaggaaggttttttttattagggtgggaagatagaaggaatttttttttttttttgttgattgtttattttatagtgtaatattaaatgttatgggttttaaagaaaggtttttgtggggaaatttttaaatattaagtggattataaaaataagataggttgggtgtagtggtttatagtggtaattttagtattttgggaggttaaggtggatggattatttgagtttaggagtttaagattagtttgggtaaggtggtaagattttgtttttattaagaaatataaaaattaattaaatgtggtggtatgtttgtagttttagttatttgggagtttgaggtgggaggattgtttgagtttaggagggagagattgtagtgagttaagtttatgttattgtattttagtttgggagatatagtgagattttgttttaaaataaataaataaaaaattaagataaaattatagaattttaattatggaatagtaggatttagtgataattatattttttttttttttataatgtatgtgagtgtgaattgagattttggtaagtttttatttttttttggtttattgaatttttttaagggtttagtttttaattttgggaagattttatgtatgaaaattatttaaatttttttagttgggattaatgtgatttgataaagagttttgatttttttttttttttgagatagagtttttttttgttttttaggttggagtgtagtggtgtgattttagtttattgtaatttttattttttgggtttaagtaatttttttgttttagttttttaagtagttgggattataggtatgtattgttatgtttggttaattttttatttttgtagagatggggttttattatgttggttaggttggttttaaatttttgattttaggtgatttgtttattttggttttttaaagggttgtgattataggtgtgagttattgtgtttggtttgatttttgtgttattagaattgttttgtttattatttgtgttttttaaatatttattgaattaatttgaattggatgtagatagatattgtgtatttaaaatttaggtgattgatttggaaaaagatttaagatttttaggttagtttaagagatgtttaggggaggttttttttattttgtttttagtagggtgttaaagttattggttaaattttagtttttttttttttatatttataataataaaggtattagtatgaatgtagtagagttttgttttagaatataattttgtgaagttttattagttgaaagtataatatttggatggataaaatgtgtgtttggtgagaaagttattgaaggaatataatattggatttttaattaggtaatttaaatgttataggaagtattaagtttatttattttataggtttttgttttttttttatttggagtagtagggtttttgtagttagttattttatagttttttaggggttttgtttttttgttattaagaagtatatgttagtttgttttttagtgttttttggtttttttataatagatagatggggatgttttaggtagagataaaagagaatatataatttatatgtttattttgttggtatttttttgttttttgagtttaaagaggagaatttagttttttgtgtaggaagaatatattttaaggtatttattgataagtaggtatagttattgtatatatatgtggaggttgtattatattaaaattgtaaataaatatagattttgtatatttttttaggttttattatgtatttatgaatgggattgttttattatttttttttaatgttagtagtagggaagttagaaagtattatttttaaaatggggatagaatattgtaaatatatatatttttaattagttgtggtaataattagtaaataaaattattttattttgttgttatgggttttatgtttatgggattttttttgagtttttgatttataataattatttttgaaggttttaaaatgtttaggtgagattaaattattgattatttaaaagttttgtttttgttggagtttttttggatggttgttgatttggttttatttaaagtatttggtggtatgaatttatttggtttttgtttatattattgtatttttgggatgttgtttataggttttagtaagattatttgatagttgtttgtgaggttaatgaattttatatataattaaatatttttagttaggagaatttatttttttttttttgagaagtagagaaagaatatatgttgtgttgttttttattatggagtaaaagttgtgtggagtaattaggttagttttatatgatttaatgttgaattgaataagaaagtgattgtattttttattgggttttatagaaaagttattatttatattgtttatttagattgggattttggttatttggggtttaagttagaagaaagaggaaaaaaaaaaaatttaattttggaatgaatgtttttgaaattttgtatttttgatgaaatgtggttaagggtttttttaaaaaaaattatttaaaattaattattaagattatatttttatttataatgggttgttagtaatagttaattttttgtttttatttagatttggtgtttaagttttaatatgttggtattggaatttttgttgtgttttgtttgggtattagatgttattattaaattatgtgtggggagttgggtaattttgatttttgattagttttttataaaataataaggaaaggtgtgaggaggttagggattgggtgaaaattagtttgagggatggtagtaagtgagttttattagggggatgaatatataaaggaggtattgaggatattgttaagggtaagagaaagtaaaagatagaattatatgttttgggaggagggttaggtttgttaaggtatttagtttgtttgtttttagttaggattgtaagaaattattttagatatgtgattttgtattgtatttttaaagattttaagaggagattttggaattttttttggttatttgttttattatttaataatttttatagttaggaaatttttttttatttttagtttaaaatgtgtatgtggtgtagttttaggggaggtgattgattgaggttatgtttattttttttttgtttgtttattttttggatgggatggtgtatatgttttgttttttttttaaaatgggttttttttggtttttatattatagtttttgggttgggagaggggttgtggtatagaggtggggtgggggttgattagtggtgtttatggggattagttgttattaggaattgttgttaggtattttatgtattttttagaggtaagagaatatagttgtgatgtggttaggagtgtgttttaaaattatgtgtaaataataaatgtggaagtttttgttttagattttaaaagaaaagaaaagaaaaaattttgaaaaatagaatgaagagtttagaattttattggttttgagatggtagtttattttttaattttaaataagaagagtttagagtagaaaagggatttgttttggataagattttagagttaatgtttttaaatgtagtgtagtgttttgtttttaatttagatagggtgttggaaaggtgaaattatgttggaatggaggttattgattttattttttttggttttttttttttttttggtagatgtgtagtgaatggttaggttttttgtgagtgaattatagatttattgaagagttgttagatgattggagtagtttggttttttttttttttattgagttttgttattgtgttttttaaattgtggtttgttttagaaaggaagaggttgttttttttatttgtttgttttaagttgtgttaagttttagttttttgtattaagtaaattattaaatgagtggaatgaatattataatgttaagggtagggtgttgatattatgggataatagattatgagtttattttgttagttttttgttttgtatttttattatttgttaaatgattatattaatatttttttatttattttagggggtttttaaaaataaatatttattgataggttatgtattagtttgtttttatattgttatgaagaaatatttgagattgggtaatttgtaaagaaaaagttttaatggatttatagttttatatggttggggaggttttataatttgtggaaggtgaaggaggagtaaaggtatgttttatatgagggtaggtaagagagttatgtgtaggggaatttttatttataaaattattagattttgtgagatttatttaatatatgagaatttgggaaaaatttatttttatgatttagttgttttttattaggtgttttttatgatatgtggggattatgggagttataatttaaggtgagatttgggtggagatatagttaaattatattattttataaatgtagaatataaattttatgatattttttatataaagtttaaatatatttaaaaatatatatatatagtttaaggatatatatatgtgaaagataaaattatgtatggtgataatgagtattgagtattatatagtatttttttattgtgaaagattttgagtaaatagaaaatgtagagaataagattgtgtataaatgtgtatttattattattttgttatgtttttgtttttttttgtaaaaaagagatagattttttttatttttatttgttttttttttttttgaatgttatagttattagtttaaatgtgatgtttaatgtttattataattatgtatggttttattttttatatgtgtgtatttttaaattatatatatatatttttaaatgtatttaaattttatataaaggatattatggagtttgtgttttatattgtatttgtaagatttgtttgttgtaaaatatggatttttatatattttttatgttgtgttgtagttattagatggaggatatggaagttatttttaattttaagatgttttttggaagaatgttataggtgtgtttagttttttgatatgttttttgtatattatgtttggtagttttttttggatatgtagttagtagtaaagtgatgaattagtatattgttttttttggatgttgttaaattgttttttaaagtgtaagtttttttttagtagtagggtttgagaatttttaatgtttagtattttttttaatatttgttagagttatatttaaaaattttttttttttgttaatttgatagttgttttaggttttagttgtaattttttgattattagtgaggttgagtatatttttatttgtatattgagtagttaggattttttttatgagttatttttttttttttttggtttgtttttttattggtttgttgtttttttattggtttattggagtatgtaatgtatgtttgatattatttttttgtttattatatgtatagtaaatatttttttttggttttgtaattttattttgttgatgatggtttgttaagagatttttattattttttttgttttatttttataagagatttgtgagttagatgttatttttgtttgtatttttagatgaggatagtatattttagagagtttaagtaaattgattaaggttttatagttggtaagtagtagagttgaggattaagtttagattgaattttagagtttatgtgtttaattattgtttttaagttataattattatgagtatttttattttatagatgagtatatagataaggtttagagaggtttattgatttgtttagagttatttagtgtggtagtgttggaataaggattgttttttaggttttagattgttaatataattgtatatttagattgaaatgttggggaaatgattggtgatagattagataaaggaaatgtgatatatatatattatggaatattatgtagttataaaaaggaatgagattatgttttttgtagggatatggatggaattggaagttattatttttagtaaattaatatgggaatagaaaattaaatattgtatgtttttatttataagtgggagttgaataatgaaaatatattgatgtagggagggagataatatatattggggtttattggagggggtaggaggagggagagtattagaataaatagttaatgtatatggagtttaatatttaggtgatgggttgataggtgtagtaaattattatggtatatgtttatttatgtaattaatttgtatattttataaatgtattttagtgtttaaaataaaataaaattaaattttaaaagaaaaagaaaatgttggggaaatgtgtagaaaaagattatgtatatttttttaaatagtaattttaaaaattatgaattatttaatatttaaaatataaaatttatagagaataatatagtaaataattaggtattttaatttagatttaataaatattgatattagttatattttaaaaatattttttaatagaaaatgttgtagtttaagttttttttgtgattttaaattgatagtatttttttatagtttttttagtagtaaatattttttagaagttgtattgttatatatttgttgtattttgttatgtgattatgtgttataagttaggggtttttagtttttaggttatggattggtataggtttgtggtttgttaggaatttggtagtattgtagaaggtgagttgtaggagagttagtatgattatttgagttttattttttgttagattagttatggtattagatttttataggagtgtaattttattgtgaattgtgtatttgagggattttggttgtttgttttttatgagaatttaatgataaatgtaatgtgtttgagttattttgaaattattttttatttttgtttatggaaaaattgttttttattaaattagtgttagaaaggttggggattattgttataaataataattagtattattttgtaagtttaaaaaatgaatggtaatgttattaataatttatttttttggaatttgttttattatttgaagttatgtttttgagatttattttaattaatgtatgtagagttaatttttttaattgttatattgttataaattgaatgtttttttttttgtaaaatttatatgttgaaattttaattttaaatatgatgttattaggaggtaggattttggaggtgattaggttataagggtagagtttttatgagtgggtttagtgtttttttaaaagagattttatggagtttttttatttttttattgtatgagggtatagtgggaaggttttttatgaattaggaagtgggtttatattattatatttgttggttttttgatttgggattttattttttagaattgaaagataaatgttatataagttatttagtttatggtatttgtgttatagtaatttgaaaagatttagatataaattaatttttttttataaatatattataatatatttattttttaattgatgtttttaggttgttattttataaatagttttattgtgattttttttggatttgtttttatgtggatttgttgaattttttaaagatatagaagaagtggaattattgggttttggggtataaatattataaaggttggtaggtgttgttaaattgtttttagtttgtttttagtaataatgtgtataatttttattattttgtatttttttttatttttgatattgttgggtttttaaaatttgttaatttgatgtattgaaaaggtatttaattgttttgatttgtatttttttgattatttatgaggttatgtgtttagtgttggttttttttatggttttttattatttgggatttttttttttttttttgtattatttgattttagattttgtttatttttttgtagtgggttgttttttttttatagagtattaagtgtttattaaatattatgaatatttatagaaattttttttttttaaggttatttattgtttttaaatattgttttttggtattttttattatagaatgtttaatattaaattttttaattttatttttttttttttttttttttttttattttatggtttgtatttttttttgttagttttttatttaagattataaaaatagtgtttaaaaaatatttttttttaaatgttttaaagttaattgtaatttttttggaatttatttttggatatagtgtgagttagtgatttattttttttttttatatgggtaatagttgtttgtgaattatttattagtttagtttttgttttttttatagtttgtaatgttatttttgttatatattaaatttttatatgtgtggggttttttttattgtgttagtttagttatttatatttatattaatattatagtgttttaattttatggtataattaagtatattgtatatgttttgatatttggtaggataagtttttatattatttttttttaaagttattttggttgtttttggattataattttaaaattggttataaatatttatgaagaaaatttttttgggatttttatatgaattttatttaatttatgtattaattttaggggatttgatgttgaaattgtggaatttttttatttttgagtatgagatatatttttgtttatttaggttttatgagttttaatgaagttttataatttttttttttatataggttttgtatttttttttttagatttatttttaggtattttataggtgtaagatttttattgttaatgatattttatgaaaattatattttttaattggttgttattgatgttatggatgtttgtatattaattttgtttttagtgtttttgttaaatttttttattttttgtaattgtttatagttttttatggattatttatgtagataattttattatttgtaaataatgttatatattttttttttatttttaattttgatttttttattttttttttttgttttattatattagtaaggtattttatataataatgaatagagtggtgagagagaagatatatttatttagttgttgattttaaaggaaatgtttttaaagttttttgtaggtttttaggagaaatttttttttgtttttgttggttaggtattttattttatttttaaattgtgaatgggggttaaatttgttaaatgatttttttgtatttattgagatgattatatggttttttttttttaatttgttaatgtggggaattatattaagattttttaatgttgatttttatttgagtttttgggataaaatttattgggttattttatatatattttgtatatttattgtgtgataaatatgatattttgatagatataattttaaatatgtatattaaagaaatattatatatttgtgtatatattatattgttggaatttttgttaatttttttttttagattttttgtattgatattttaattgagattgattaatatttgtttttttttgtattgttttagtgtttttttataatgtaggtttagattgaatttataaaaatatatttaggattttttgttttttttttatatttttatgtgttaattttggtaatatatttttttaaaaggttttttattttatttgtttttagatttattgttttaaaatatagaaaagaatttttatgttttaaaatttttattttatttagttatgatttattttatgtttaatagtgtttatttgtgttttttttttttttttgtttaattttgttaaatatttatttattttattagtttttttaaagaattagtttttattttgtttttattttttattgtttttgttttgattttattgatttgttgtttttattattgtttttttgttattttaattatgtgtggaaaaaggatttttttttattgtttttgagtttatattgttgttttttttttaatttttttaaaattttttttgtttattaatattaaatttaatgttaaatattttttttaattgaaatttagggttttagttgtttagttttaaatatgttttatttttattttgattttatattaataatttagtagtgtgtttttgaaattttaaaatgtatttgggtttagggattgtggttttatttattttaatttttttattgtattttggttgaagaatgtggtttgtatgataatagttttttgaaatttgttatttgttttgtggtttggaatttgtttaatttttatgaatattttatgtgtattttttatttattgggtagagaattttttttttatgttattagttgaagtttgtataatgttttattttaatattaaatttttttttttttttaaaaaaaaaatttgagttgttaattttatagagatgtgtattaaaaattttttattatatgtttttggtagattatgtgtgttaaggaattataaatgtggtaaatgaaatagtatatttaaggtatttatttttgtaggaggataaagaagatttttatggatgtgatattttagttgaataggagtaggttaagaaatttttgtattgttatagaggaatattggagattgggtaatttataaataaaagaggtttaattgatttatggttttgtaggttgtatagttatggtgttagaatttgtttagtttttaggaaagttatagggagtttttatttgtagtagaaggtgaaatgggtgtaggtatattatatagttagagaaggagtaagagagaggagatggggaaggtgttaaatattttgaaataattagatgttatgagaatttattattataaagaagatattaaggggatagtgttaaattatttatgagaaatttagatttatgatttagttatttttttttttagtattggggattatattttaatatgagatttggggggataaatatttaaatatattagttaataatagaggattttattttaaatgtaaaggtatataattatattatttaaatattatttttttgtattttatttttttgtatatttttgatatttttattgaatattttaatttttaaaataataaattgaatatatgtaaaatgatttttttttatttttaatgtattaagtttaatagagatataaaaaataaaatataaataaataaataaataaaattttttattataattttgaattgttatttttttgtagttaatttaatttttgttgtaaatatttgatattgtgttatgaggtatataaaaggattttggtgaatatatttttatattaataagtgattttttttattttttaaaatgtttttggttgtaggttgggtgtggtggtttatgtttgtaattttagtattttgggaggtagaggtgggtagattatttaaggttaggagttagagattatttttgttaatatggtgaaattttatttttattaaaaatataaaaaattagttgagtttggtggtatatgtttgtagttttagttatttgagaggttgaggtataagaattatttgagtttgggaggtggaggttgtagtaagtggagattatgttattgtattttagttgggtggtagaataagattttgttttaaaaaaaaaaaaaaattgtttttggttgtaaagtttgttttattagatttgtttatttatttatttattgatttaattaaaataaatatttattgaatatttattgtttttaaggaatgttttaaatattggagatatagtagtgaataaatgagaaagtttttatttttttggatttgagagattttatattttatttggagattatagataataaataaataaaatatataatttgttaggtggtatagtgttataaagaaaaataaggtaaggtgaggtagataaagttatgttggggggtataaagttatgttgttttatattatgtagttgtgggtagtttttggattagttgatatttgagtagaggtttgaaggagttatttgatgtttatattgtttatataaattgaatgtttgtgttttattaaaatttatatgtagaagttttaatttttaatgtgataatatttggagatgaggtttttgggaagtaattaaagttatattttttattgtgtattttatgtttattgggtggagtgttttttttttatgttattaggttagaatagtagggtttttataatggtattagtgattttttaagaaaaagaaggaagagatttttttttttgtatgtatatttgaggaaagattatgtgaggatatagtaagaaggtggttatttgtaggttaaaaagagaggttttattagaaatgaaattagttagtattttgattttggatttattagtttttagaattgtgagaagtaaatttttgttgtttaagatatttggtttgtggtattttggtatgatagtttaagttgatttgtttaatgattatattaagtttttgtgagtatttttttatggtattgttttttttttttttatgttaatttttgtgttttaggttttttttttgtaaagagttggagttttaaaaaatttaatttgaggttttttgttttttaataggttaaagttatttatatttattatgattatttatatatttggaatttattaggagtttgaatgttttttatatattatgttatttttttatttgttttttttttttattttgttttatattaaattatttgatttttttttatattgttttttattgatttgtaatgtatatattttgttttattgttttgatagttgttatttttaaatattaaaaattatatttgagagttgggtgtggtggttaatatttgtaattttagtattttgagaggttgaggtaggtagattgtttgagtttaggagttttgagattagtttgggtaatatggtgaaattatgtttttattaaaaatataaaaaattagttaggtatggtatgtatttgtagttttagtttaaatttttttttattgaagtatatttttgaatagttattttattaaggatttgggaatattaaagtattttagtttttgattgaaagtatttttaatttatttttggttttgaataataatttttttaggtatagaattttatatagatatttttttttagtatttgagtatattattttattattttttgatttgtgtaattgataaggtgtagtttgttttaggttgttatttatttagagggtttttttttttttttttatattgttttaaaatttttttttgtttttatttttggtgatttgtggttttattataattttgtttgggatttaagattaagaatttttgatatttattgattttgaaaaattttgttttagtttttgaatattttttttttttagttttttatttatttatttgagtttttttttatatgtatattggattttgttatttttttttttatgtttttgaatgtgttttttagattttttatgttttttttttttgtgttttatttttttttttaatatttttttattttttttatttttgtttttttaaggtaattaatgttaatatttggtatgtatttttttatatgtttttttaagtttttataaatatatgtatatatatatttatatatattttaaataagggtgttttgttattgttgtttgtaaaaaaaatttaattatatagtatgtatttttttataatttgttttttttttttgatagtatatgaaggataatttttagataaatggatataaatttaatttatttttaaaaatagttaagtaaaattttatgttatggttatattatagtttatttaattttttttttattaatgagtatttagattgtttttagttttatgttattgatagggataggagatagggaaattttgggtagaagagggtgggttttagtgagggttttatttttaagttgaaaagtttgatattatggtttaaagggagaatttatatttttgtttttttatttgaatgttgttttttttaaaattatttatggtttgttttgttttttattttgagtttataaaaaatttttggttttattggtagagagaagagaagtagttggatgttgaagattatagttggatgttggagagaagtggtttgagtttagagggatagtttgatggtgtagttttagataggagtttggttagggatggttggattttaggggaagattattttttatttttgttttttttttagtttttttttttattgaaagttatttttattggtagtaaaattttttgtatttattatttttagtttgtttgtgtgattttattttttttggatgttggataagaatttgggtgttataatgtaggtgtaaaatgttgtgttatattgattgtttttattgagttgttagtatttaaggtgtttatggatggtagagttaaaagagtattgtaatttgtttttttgggttttaggggttgtaggtattgttttagatgttgttgtggggttggtatggaatttgttttttttagtatttaaaaagtatttatttggtttttgtatttatttatttgtgtgttttatttttgtgaggggtggagtgtagtatgtttttatgagtggagtttatttttgttagtgttagagtggttggtaagttttagtgtttatgtattttagtttttatttatgaagtgtttagggaaataattttgttttattattataaatattgtggttataaatatttttgtgtatatttatttatgtgttggttttttaatttttgtggaagttaatttaatgttattttatttattttagtttttatttttaaagaatataattttgtatattttagtttttttttttagtatatatatgtttttgtatttttaaataatgtatatattgttattttttgttttattaattttatgtatattttaattttatattatagtagataaaaatttatttgtttgatatgattatatttatagttttttttttttttttttttttagtgtagttatattataatttgggggtaaattagtttttagtgtttttattattttgttaaaataaatggtattaatagttaaatttttaataatgaagttaatatttgttttttttttatgtttttaattgatttttgtatttggtatagattttttttttattttttataggtttatagtatttttttttataaagttgattatattagtaatttgttagttttttttttttttttggtgatatttttgttggagatttatattttttttttagttagattttttttttggtttgttagatagttgatattttgagatttgtttttattgttattttagaatttttttttgtttttttttttgtgttggatttttttttttgttttattttattgtttgaggaagtatagtttttagtagttattagaattaaaatttggtgtagtggtaatagtttttatatgttttgtttttggtttgttggttttgtttggatgattggttttgtggttgagttagttattattttggggtattttattttagtgttgttatttttttgttgtggttttgtgttagtttttataaaattttttttatatttttttatttttgtggtttttagtttatagtagtttatggaaaatggatttttgagagatatatttatattttatatgtttgaaattgtttttattttgttgtgttatatgatgatttgtttgttttgtatgggaaaatttaggttaaaaaatagttttttttagaagtttgaagatattgttttattgtatgtaattttttaatgttgttattagaaagttgttattgttttgatttttgatgttttgtgttttattttatttttttttttttttggaatttttgattttttttgtttttttatattttaaattttatgatgattgttttaattgtgggtttgtttttatttgttgtatttagtgattattgtggttttttaatttgttaagattgtgttttttttgtaagttgttttttttttttagaatttttattatttgggagttgaattttttggatagttttgtgatttttttatatttttttatttgttttttatttttttatttttttttattttttttgtataatttttttaattttaatttttaatttatttattgggtttatttttgttattgttttaagttttttttttttatttataaatagttttttaagtattttgttttgtttttaggatgtgtgttatttttttagttttttgtatttttttttttttttagaaattgtttttgttttttttggtttttgttttttttatgttgttttttttagtttgtttgttttgaattttgttttttttgtagagattttttttgtatgttgggtagttttgattgtttgattatatttaagaatgaataatagatgtattgaaagttttgaggatgtgtgagggatttgttaattttgagtattattgtagaataaaatgtttttgttataggttggagaatttttaatgttaataatttttaaagttttttaatgggaaaattagggaatggttagattttttagagaatatttttttagatttttggttgtaagatgttgttttgtttgttttaggttgggagttgagatgaggaatgagattggagggtttagtttttagtatgtatatttttttttatttgatgtgtggtattttttaattttaaaatttttttttagagtttaaatttttagtattagtagttgtgataaaggttgttgtttagtagggtggatttaaggaaaggatttagggatttaattgatttttaaatagttttttttatatttttttttatttattttttttttttgaaatggagttttgttttgttgtttaggttggagtgtagtgatgttattttggtttattgtaagttttgttttttgggtttatattatgtttttgttttagttttttaagtagttgggattataggtgtttgttattatgtttggttaattttttttatttttagtagagatggggttttatttgttagttaggatggttttaattttttgattttgtgatttgtttatgttggttttttaaagtgttgggattataggtgtgagttattatgttttgttttgttttttttattttagtgatttattttttttttgtatagttttagaggttattggtgttatttgtttttgagtttttggaggatttattggttgtttttaatttttttgttttttattgaggatttagttttttttgtttgttaattttattattgtttttttatttgttttttgttttttaaaattttattattgttatttttaaaattttgttatttgttaaatttataatatattaaataattttggaattggttgtaaaagggttatggattgttagagattaaaaggtatttaaaatttttttttttattgttttggtggttttatgttttttaaaaggttatttttttttgttatagtgatgttttaggtgaaagttatattagatatagtgtgtttaattttttatttttgtttggaagttttgtgttatattttggtttaatttttttaaggttgttttttggtttattgatggtttgttttgtgttattttattgtttaatttttttattgagtgattattaggagttttattttatttttttaaatttgtttatttttttttttttatgtaattttaattttttttttatggtttttagtttttattattataatatttttaaataattttattttgtattttatttgagattgtatttttttagtttttaggatttaaagttttttttttttttttattattgttttttatggtagtttatttgtgtgtgtgttggggggtgatattggtagtttaattttagatatttttttttttttttgtttttttttttttttttttttttttttttttttttttttttttttttttttgaggtggagttttatttagttgtttaggttggagtgtagtggtgtgattttggtttattgaaatttttgttttttaagtttagatattatttttgttttagtttttttagtagttgagattataggtatatgttagtatgtttggttaatttttgtattgaaatgggatttagttttgttggttaggttagttttgaatttttgattttaagtgatttgtttgttttagtttttaaaagtgttgggattataggtatgtgttgttatgtttggttttttttttataggaattttgtgagttttgagttgtgaaattgtttttatatagtggatatatgtttgttttttttggagatttaaggatttttaatgattttagaattgtgtttgtattaatttattgttatgggatttttttatttagatatataggtagtataaattttgattttataattgaaagtggtttatgtttaaggttttgattttttaaaggtgttttgagttagggatataagggaatgttttgttttttatttttgaggtagtgggtagagtgttttagtttatttttttatggttagggtgattttttgaggttttgagatttaggaaaggggtttagttttggttttgttattttatgtaagattaaggttatgtttttgtatgggtattagaattttattattatttttagggttttgggagtatttgtgagagtttgaaatttttttgagtattgtgtagttagttttatataaaagttttggttttaattttatttttatttttggggtttttgtttttttttttttttttatttttttttttttttttttttttttttttttttttttaaatttaattttgtgatatttttttgggaattttatatttttgtagtgggaagggatttatatgattaatttgttgtttgttattttgttgaaaatgaatatttatatttaattttgtgttaaatttggaatatattaaataaatttggaattggttgtaaagggttatgggttgttagagattaaaaggtatttaaagatttgttgtttaattttagtattttatttaaggaaattgagttttaatattgataaaattatttgtttatagatatgtggttagttagtggaaaaggtgggattgattttaaagagtggttatttttattttatagtattataaggaggaatatttgatagtatttgttaggttattaagatattaagatttaatgtttgttgagttttaagttattgagatattttggaaaagttatatatattatttgtgtttgttttgatttgttgttgtgtttttttttttttgaatatagagtagtaatgtttgttgaattatttaagtggtttattgttgtgttagtttgtttgtttttttatttttatttttttaaagaaaaatgtttttttttttttttttttgaagatattttttaggatttattatttattggaaattttttttgaagtttgaagtttttagagggttttttattttttttagttttttttgaaattgttatttgaattatgttattagtattatatgatgaatttatttgattttttttaattgttgaatatgtatgtgttttatttttttaagattgtaagtgttagtttgtagaaattatggtttatatatttttattattttttaaagtgtttttttgtggatgagttgatgatgaaaaatttagaggaaatatgtttttttagatagagtttgagtttggtgttaggaagtttggattttgttttatttttttgttttttggtagatttatgtaaattattgatgttgtatggagaaattattggtgtttgataatagtattgatatagtggttgtaaaattttttatgtaagttgggatagtttttagagtgaaagggggtaatggtaataattgtgtagggataataggtataaattgggattttttttaatatgttgggatagatggttaatttatgttttagattattttgagtttgttagaattatttgtatagttgtttttgatattagttttttaaataaaaaattattattttttataaaagtttttatttatgagtttaattttataggtaataaaatttttagtttttttagatatttttgtttttttagttatttttatggttttaaatgtgtattataattgaagttaaattagattgtagatttgaagattagtattgttgagtaataaatgtttttatttttttttattaattattttgttttttggaaggaaataaaggttttgatttttggagttttgagtttattttttttgggtgtattttgaaatatatggattttattgttagtatatttagtgaggaaggaaggtttttgaaggattgatgatttttaaattggattatgtgtttatgataatggtgtatttggtggtttagtatagtgaggtgaggtaggtttttaaaatggtttattataaatattattgtttttgagtttatttgtttttgtattttttgttagagtgttttgtatatagtaggtttttattaatgtttgtagattttaaatttggaggtatatttggaagataatggtggttggtaaattaattattagggttagtaattttatttttgtttatgtttaaaaagtgttgtgtgaggaggttgagataggagaattgtttgaattagggaggtagaggttgtagtgagttgagattgtgttattgtgttttattttgggtgatagagtgagaatttgttttaaaaaaaaaaaaaaaaaaaaaaagttttgttgtggttgatatatggtgttggaatgtaaagaaaaatagagaagatttttgttttttagaattttgtgatttagaggtaattttagaattataagttattaaaatttagaaagtttaggagaaaggataattatttttgatttggaggaatgaggtagtatttgagttaggtttgaaaaataagatttttttttaggattgaggtgagagaaggttgttttatatggtaggaatagtataaataaaaatttgtaagagtaaaattgtaagttatatttggagaattagaaaaagtttggtatgtttagaagataagatttaatgatgttggtttggggaagttagaagttttttaatgttaaatgatggaatttaggttatgttatatagaaaatggagttatataaagtgttggatgagtgtagtgatattaattaatttatgttttagaatgagaatttggttgtagggagattagttaagaagaggtttaggtgtttaggagagatataaaggtaggagaagaaaaaggagttagaaatgagatttagaattggtagttgattgaaggaagggttaaggtggagagaataattaaatataattttaagggatagagtggatggggatgagtggagggggatgagtagatggggatgagtggaggatggggatgagtagagggggatgagtggaggatggagatgagtggaggatggggaggagtggaggatggggatgagtggagaatgggatgagtggaggatggggatgattggaggatggggatgagtggaggatgggatgagtggatgggatgagtggagggggatgagtggatggtggtggagagatatagagaggattagaatttgattggttaagattttggatttttagggaggttgtggagagataagatgaaatagtatgtgaaagaattttgaataatgttttgtataaaggagatatttaatgaatattaaattgaaagaaaaagggaaggaatgaaagaaaaaaaagaaagggaagaaggagttttttttttttttttatttttttgttgtgttttagtagggagagatattgagggttttaggagatttggtgggtattttttttgggttgtttttattaatagatttgttgttggttttatgttagttaggtggtatattaagaggggatttagaaagaatagaagattagaatttgttggtgttagatagaaaagatatgagtttgagttatatttgaagaaagaaagagaattgggttgatgaaaaggttatattgagaattatgggagtagaagttgtgaaggtaagaaggaagatggaagaaaatatattattgatgtagagaaagagaaggatgttgattgattttggaggtagtttttgtatgttttggggtttatttttttatttttttttttattttttttttttttttttttttttatttttttatttttttgaatttaattttgtgatatttttttgggaattttatatttttgtagtataaggaatttataggattaatttattgtttgttattttgtttaaagtgaatatttaatgtttaattttgtgttaaatttagaatgtagtaaataaaatttggaattgattgtaaagggttatggattgttagagattaaaaggtttttaaagattattttgtttaattttagtattttatttaaggaaattgaggtttaatattgataaagttatttgtttatagatatgtggttagttagtggaaaagttgggattgaatttaaaggatggttatttttattttataatattataaggaggaggtttgttatttggtggttagtatttgttaggttgttaagataagatttgatgtttttgggaaatgtgggtgaattattggggattattggaaggagaatgttgtttattttttgattagtttattttgaaattttgttaggaaaattttattattttatgaaaataaatttagtttttttttattttttttttgattattgggaataatagtaagatagtttttttagtgattagaaattaagttatattgattttttttgataagttattttaggataatttttaataaattattttattggaagtattggttggtattttgttttatagaatgttttttggtttttttgttttgggttttgattatttggtaaatattttagttttatgatgatgtggtgtttagatggtaatgtatgaattgtattattaaaattgtttgtttttagttatattatatttgttttaggaatgttagagaatataaatatagtttatttattaaattattttagttggagtatttgagagagagaaagtataaaatttggtggttggtatggtgttttattttgagttagagaattttgaagttgggaggtttttttggaagttttttgttgttgttttttttaatgtgatgttattattttttttttgaatgtgtttaataaaaggtagtttttagaatgtgttaattgttagaagaaggaaaattataattgaatagaaatttttaaattaatttattttaatatggattgtagatttgttatgttgattgtattgtaaaatgaattaagttagaattatattggaatttttttttggtgtgtaaaattttagtgtttttttgaggtagtgtttttagtggtgtatgttttttttgtgtagaggaaggttttttatattattttagtatagtgttttttatttttgtggtttttattatttttattgtttttttttttggtattgtatttttttttgatatgggttttaagatgtagttgtatttaaagatttgatggtaaaaataggttagtttttaaagtaattatagttttttgtaatttttggattttattaattagttttgatatttggttgaatgtgtttttgtagatattagtgtaaattttatagagggttattgagttttagtagttttttttaagtaaagttttatttattttttttttttttttttttagaaaatatttaaggttttttatgttttttttagtgtttgttgttttttttttatttggggtttttattgatttattttgatgttattgatttataaatggatttttattttttttgttgggggttagtattttgatgattatttatttttatttttattgtgttattttttatataatatttttgttttggttataaaagtaagatagaatttttgtagaaaaatttggaaaatagagaaaagtaaatagaagaaaaaaaaattatttataatttattattaaaaataaataaataaataaaattatagttttattgttaatatgttgataggtttttgtttttgtttagtatttagaatttttttagttaggttttaaattaattttataattttatttttttgtttgtattttttttggggatatatattgtttggtataagattttttatattttttttttaatgaattttttttgattatgtaaataatttatgtggttgtatatatttttaatagtatttataaggaaaataaagtaaaaattatttttaaaaatattttattttattaaaaaaaattttattattttgaaataaaagttattgatattttggggattattttattattatgtgtttatgttatttttatatatatgattttttataaatgagataggagtatttatgtggtttttattatggatatttgtttttattttttatttatttatttttttttttttatttttttttttttttttattttaattttttttttttagattgttagtggtattagttttgtttgtgtttttttatattttatgtttttataattttattaaatgttttgtagttataaatatatgttgtgattgttttttatataaattagattatattatatgtttttttatgtattttttttttttttatttaatagtgatagattgttgaaattttttttttgtttttttatgattgtgtattattttttgattgattgtagtatgaattattgaatgtagttatgataaataatattgtaataaatatttttgtgtttataggatgtgagatgatttgattaagaaaagaatagatttttagattggaatagatatttttagattgttttttaaatggtatggtgatttgtatttttattagtaagtttttttgtattttgttaagggatgatgtttttaaattgtaagaaagggtgggatgttttgtttatttgaaatttaaaatattaagataaatatggggtaataatatgattattataataatatatataaaagagaatttattaagggatgattattgttttttagagttgggttttggggaagtattatttatagaaatgagttttaggaggttaggtatattggtttatgtttgtaattttagtattttgggaggtagaggtaggtgggttatttgaggttaggagtttgagattagtttggttaatatggtgaaattttatttattaaaaatataaaaattagttgggtatggtggtatatgtttgtagttttagttatttggggggttgaggtatgagaaatatttgaaattaggaggtggaggttgtagtgagttaagattgtgttattttattttagtttgggtgatagagtgagtgtatgttttaaaaatagataaataaataaataaataaataaaaaagaaaagaaatgagttttagggtttgaaatgtaattttatttttagtatgatttttttttttattatttgatagtttttgattagtgtggtagttagaaattttttttttggtttaatttgtttttttatagtttttgttaaaagtttaaatggtataatatattataggtgattttttaatatttgagttaattttgaaaatatatagatggatggatgttagggtgagatttgattttaagtttttatgaatgtggtttatattttaaatattttaaaaataattgtgtatgttgtggtgttaggagttaggtaggtggaagggttaggttttttaggttattttttgagttgtattggatgtttgttttattttttttatagagatggtggtatagtttaattttttttttttttttattgggtgtttttttttaatttatggattgtttgatattttttgtatttgtttttgttgttggtgtttgttggtattttttgttttttttgttttttattttttttgtttgttttgttttttttttttttattttttttgtattttttagttttattataaaaaggtttgggtattatagttatggtttatttttgagattgtattttttggttagtaagtttatttggttttattattttggttgtaattttaaggttattagtttattttagttttgtttatttttaagttttttgtggataggttttttatttgatagagtgttttttttagtttttttttaatttttttatttgatattgttttttgggatttagaggtttttgagggtttggggtttttttgtgtgttgaggtgggttttgtagattttgttgttgagagaattttgattagtttgttttgagaaagaatgttaagtggttagggttttattaagtaaagggtttttatatgataatggtttatagagttgttaggagaataaatggggtaatttggagtgtgattttattattttttagtgtatttttagtgttgggaaaagttatgagtagggtttttgttttaatttttaaattatgaatttatttatatttgtggattagataatgttttaatattatttttatagtgtgtgtgtgtgtgtgtgtgtgtgtgtgtgtttatgtgtgtgtgtgtgtgtggtttaatgtgtataatttatttgaatttagttgttttgtggtttattttttattgagaattgtttttttttttttttttttaagaaaatattagtttttaaagtatgaagttttttttgtgagtttattagtagtgaggggtgtggtgtgaggatttatattggtgataatgagatttaataattattgaatttaggtgattttgatataaattatattgattaaaataatattaagtatgtgatgttggtgatatttgaatatttgttaggaagaatatttgtatggtaataattggttgtaaatggaagagatttgtatgttttattgtttttatagttttaatatatatttttattggagaatttgaaattaatttatgtaggggaggttatgggagtaaaagtaatatagagaattagtaggaattggtttatttgtttgtttttgtttttttttgtttttaagaatttgggttatttttggttttagtatttagttttaattatgaataatatatgagttaggggaaaggtgtatttataaatttgaaatttttttatgtttttttttttttatattttttttttgtagttttttttttatttttttattttttgtgtaaaggtagtaattttttttttgttttttgagatagagttttgttttgttgtttaggttggagtgtagtagtgtgattttggtttattgtaatttttgttttttgggtttaagtgatttttttgttttagttttttgagtaattgggattataggtatgtgttattgtgattggttaattttttatatttttagtagagataggattttattatgttggttaggttgtttttgaatttttgattttgtgatttgtttgtttggattttttaaagtgttgggattatagttgtgagttattgtatttggttaaggtagtaatttttatttgagaaagtttggaattttgatttaagttttttgagtttttattgtggtttgtggttatttattgtgatatttattttttatttttggttttttgatttttaaaatgagattgtttattttatgtggttgttaaatgtattataatttttttttttattttttttttttaaaggaaatttggaatttttaaagttattaaatggagtttttttgtgttttttttgttgttgttgtttgtttgtttgtttgagatagagttttgttttgttgtttaggttggagtgtagtggtatgtttttggtttattgtaatttttgttttttgggtttaagtaattttgttttgttttagttttttgagtagttgggattataggtgtttgttattatgtttagttaatttttgtatttttagtagagatggggttttattatgttggttaggatggttttgaatttttgattttgtgatttatttgttttagttttttaaagtgttgggattataggtgtgagttattatatttgatttaaatggagtatttttagggttatatggttaggggtaattaaaaatgttatatgttattattgtatttatgaatattatttttttttagagaagaaaggagttatatgattgtatttttggtgaaatttgattgtattttggtaaaatttgtgttaggattaggatagttattaatgatgtgttttttgatttttatgattgaagagttttaggttggtgttgttgtaggggatttttgtgtggtatggtttttttgtattggtgttagttgtggtgagatatagtttgtagttatagtaggataatgttaagtttaatggtatttgttgtttaggagtaaaagaattatatagtaataatatatattattgttgagtatttatttattttattgtatgtgtttgaaggattaaattgaagttagagttttttgtttatgtattaaaataaaatgtagatagtgttgagttattaaaatgatagtgtatttgtaaagggaagttagtgaaggtttaaaggtgaagatttaaaaatatatagatagtttaaaattgtaaataaaaaaatgttatatagagatttttatgagtttagaaaattaggaggagatttgagttgagagaaaataaggttagttttttttaagtggtagatttttgtagtttttggaaagatggaaataaatatggttaggtgtggtgggttatatttggaattttagtattttgggaggttgagataggtaggttatttgaggttaggagtttgagattagtttggttaatatagtgaaattttgtttttattgaaaatataaaaattagttgggtgtggtgatgtttatttgtagttttagttatttgggagaattgttggaatttaggaggtggtggttgtagtgagttaagattgtattattgtattttagtttgggtgatagagtgagattttgttttaaaaaaaaaaaaaaaaaaaaaaaaagaaatgaaaagaaaaagatgggaagaaataaaagttgtaaaaggataaatggatagatttagggtggaaagtaaggatagagtaggatttgagtgtgagatttgttatttgggtttaggtgaaatgaaataaagaaaagggttggagaagttagaagtgggttatagaataatgagatggtgaatggggtttaaagtgtgggttgttaggattgttaggaggagttatatttttagggtagggttaagttgtaagtaattagtattatttagtagagttttgtagaagtgaatggaaagatttttaaaaaatttatgaatggtagtggaaaaaaaagaattgaaaggaaagtagaaggtttatgggttagataaatttatttttagatatatgattgaattgaaatttagataaaatattatttttttatttagtgttttttatttgttagaagtttagtttttttatattttatttatataagagtaatgtagatttttaaattaatatatgtgtttatagatatgtggatagaaatttattgttgattagaatattatgaattaaggaaattttaataaaatatatttggaaagtataatatgggattgaaatttgaagttaatgataagattataaagatttagagttaattttttatgtattattttgtaaagaataaaatattatttttttttgggtttgaagtttatattagtttttttattaagatgataattataggggtgagttttgagattttttatttttaaggtttttattaattgttatttggatatttgttttttgttttttgtattgtttgttttttatttgaatagtttagatatttttagtatgtttattgtttataagtttatttaggattttgaagttttagaaaaaagttgtttttagtttggttgtttttttggtttgtattgtgttttttttttatgtttttagtttttttaagttggatggtttttttttgattgtatagttttatttttaattgtttttattgttattttttattatattaggggtttttttttttttaggtttttaaggaaatattgtttttgaggggattatgtattaattttagtaggtgtttggagttataatattttatttttttgtagtagttggaaagatttttttttaaatattagatttttttgattttgttaaatggtttgatttttttttttgttttggtgattagttatttttgtttaatatgttagtttttttgtttttttttatttaggtaaatttagatatttgttttagtttaggttttagtttttttgttttgttttttttgttttggagattttatttattttttttaatttttttaattttaatgtaggttgttttaaaatttatatttttaggtttgatatgttttttatttttattttgtatgtttatgttattttggagaattttttattattttaaattaagttttgtttttttttttgttattaatagtgtattgggtatagtgtattgggttgaggatttatatatttttttttagtattgttagttaggagattatttgttaatgggaattattagttttggttttttatattttagttatttttagttttattattttattttttttgtatttgtatatagattaatattttattttttttatttttaattttgtttttatggtgtttttagaaatgatataggtggatatttattaaatttttatttggtttgtataagtggaggagttttaggtgaagggaataaaagtttaatttgtattttgaaaatagagagttatggttttttgattaatttatatatttgtattaatttattgatttagaagtttttgaatgaagaggaggttgggtttttttgatgaaggattttattatattgttaagaattaatattgttgtttttttttttagttttttttaaagggatttatagttttttgttagggtgattgtgtattggggaaaaggaattaattagattttttggggattattggtgattggttttgagttgatattaattttaggagattttaaatattattgtggtttagtagttagagtagtggtatgtggaggttaggtgatttttggagtttttattttatgtttgtgtttatttttatagtattttgtttaggataatgtggtagggtttatattgttgtagtggatttttggaggtttgtattttttaatttttaatttagagttgtttatagttatagtattatttagtttaaagtatttttgtgataattatatttttggttttaaatttttattggtgtttagttgttaggaataatgtagttttttttagtttgatagttaaaattttttataaagttttttttttttttatttttagtttttttggttataaatttttaatttaatatattgtattttattttttttagtttttagatatattattttttaatatgaaatatttattttttttttagttttgtttttatttatgttgttttttttgtttggtatttttttttggtttttttttttggatttgtgtggtgtttgttttagtataaatatattatgtttttttgtaaaatgttttttttttattttagttggtaatagttagggaaatgagtaaaaatgtgtggatagattaatttattagtattggggagttgggtgggtgggggtggggggtatagtgtggtgtagggtatgtttttttgtgggtaggttgttaataatttttataaataaaagattgttttgtttatatttgtttattagagttagtattttttaaatttgtttaaggtgaaagtgagtgttttgtgttttaaaaattatatgggaagtatagaaataggaaatgtttattttgtttaatgtggaagtatattttataataggtggttttttaatttgtataaataaaataaaattggttggttaaaatttattagagaagaagaggaagtaattgttaggtggtaggattaggagtagatggggattatttatttagatttttaattttttttgttgagtgtttttttaattaagtatttttttttagatgttaaataaatttttatatttttaaatagtattttttttagaaaagtgtatttttatgttagttttttttttttttaaagttaggggtagaataattatatagtattaatagagtttgtgtaagtttaaatagtttaattttttttttaggttttttatttgaagtttttaaattatatagttaaaataaaaatagtatagaatttaaattgagattattatatattgtagggattttttttatttttatattaagtaaggtagtgttagttttggtggtttgtgtagatttagtgtattggaggtagaagttttaggtggattgatttttgtttttatttagatttttggtgtttttaggtagtttggaataattagattttggtgtttttaggtagtttggaataattagattttggtgtttttaggtagtttggaataattagagttgtttttggttttttggaaatattgtaattttttgtgtaatgttagtttttgattatttttgaatttttttttttagatttataaggttttgttgttggttttttttttatttttttgatgattatattttaattttttttaataaatatttatgaagtatttatatagtatttattgatggttatagttaggtgtagttttgtggatttgtatataaatgaattagatgagttggtgtttattggttttggggtttatagattaaggtttgttttgttggtattttgggtttttttttgttgtttgtatttggaatgtttggtggtttttgtgttttttttttagtttttttttttattgtgtttttttggaaaggtttttttgttatggttttaattataaaattgtatttttagttttatttttttatttgaggtgaagtatgaaatttttttttgtttattttgaatttagttagtttattatgagttttttttgtatttgttagtttttgttagtagttgtaaaagttttttttttttttagatttttatatttggaaattgtttttaagttgtttttttttttttattgtgtgtttaggaatttatttttgggttttttttgattggtttttttttttttttttttttttttttttgttttattgtttttatttattttagttttaaggttgtgtttttgttttaatttttttattgtgttttttttatttatattagagtttttttttttaaattttgtttgattagtgttatttttattaagtgatagagatgatgtttttattttttatatttttaatagtatttaatttaatatttggtatttattagaggtattaatgatgtttgttgttttgtgtggtgaaggtatatttggattttggatggttagttttagttttttatttttgttgttttatagggattttaaatgtggagtgttttttattgtttttaattagggaaatttagttttgtagaagatagtgaaattgatgaaagtattgggaaatggaatttaggaaagttaaagaattggtattatttgatgtgagaaagagaagtgaagatgatgagagattttagggaaaaggttatatgttttgttttttttgagataagtgtgtgtattttttttgtttttatttttatttgtgtttatttttggagggatttttaattatttaatgtttgggtattggttatggtgtttattgtttgtgtgtgaatttggatatggtttttaagttgtgtggtgttgtttgttggtgtggtttaggatgtatagggttgagatggtgttgtatgtatatttattgagtatatttttttgggagaggtgtggatattattgtgaagggggtttagattttttttttaaatgtttgtatttttatagggattagatatggagataagaatttttagaagagggagaggtttgaggtatagtaggaaggtataagtttaaaggaagtgaagatttttagtgagagttattagatttttgaaatggattatagggaaagtttgtggtttttttttttttagaaatgttaaatttataatagaaaatttttttattgtggtttgagtgttaaattttttggaggtttggggatggggttgggagttttttgtttttatatttttatggtttatttatttgggtggtttagtttgttttgtaagtagggggtgggagtggggttgtttattttaattatagtagttaaatgtgttatttatgagaaataataaaagatttttttttttttttttttttagattttttttagttaaatgttgttgtttttttaaatagaggaggttgttttgtatttttttttttgtagtgtttgaatttagtttttgtatatattttttttagtagtttagagtatatttatgagtttagattatgaggaatgtttattatttttttgaaagatggtgtgtggaggatgtgtatagatagaagttaggttgttgaagattttattgaatttattagtattaataatagatattgttagtgaggtttgaatgtttttgtttatttttttgatttaataaatagttattgagtaaggtttttttttgtgtttggtaagatgtttgttatttgttgaagagataaagatgtatgagatatggtttttgtttttaaagtatttataatttagtagggaagatagttaggtgtataaataattatatgtgttataaagaaatgattattttggtttaaaggaaggttgttgttgatgaaggatggttgtatagtagaattataattgttagtttgaaatttaatttttttaagttttgttatttttattttgtattagttttattttttttttttttaaaatatttatttgtataggtattagttatatggtttttatattggaatagtttagaaaggtgtttattggaaagttttgttagtatttttgtttttatttatttaatttattatttgtttttttattagaataaggaattattgtttattaattttttgagtatatatttagtgtttatttatgtaaaataatatatatatattttaaaatttttttttttttatataaaaggtagtttattgtttgttttgttaatttaatagtatattttgagattttattatgtaagattttattatggtatattttgagatgtattatgttagtatatagaatgtatgttttttttttttttttaggtagtataatattttttagtattgtattgttttggagatattagagtgtgttagttattaattagttgtataatagattattttataatatagtggtttaaaataataatttttttattagttataattttatgggtgaattatttggtttgagatttgttaagggttttttattgttgtttttgtttggatttgtttatatggatgtgattatttggggttagatggtttaagatggttttattagtaggttgttgggagagtttgattttagttggaatatgtgttttgagtaaattagttttagttgttttatatggtgattgggttttataaaaatagagaggggttggttttgttgtggaggttttattaagtttttatttgaattttattggttaatgttttattggtaaaagtaggttatggggttaagtttagagttaatgtggaagtaattttaggatgagaaatttattagatgttattatgtaattatttattatttatggagtaattaattagtttttgatgatggatatttgtttatttttagttttttggtattgtagataatgttttaatagataattttgtatattagttagtttatatgtgagtagggtaagtattagaagtagtattgattttgtgttggatagagggtagatgtttttttaattatttatttattttatttttgtggtgttgtttttttagatattttaagtttgtgtttttttgttatttgtgtaggagttttgaaaatgtgaaaagattttagataggaaatgtatataaattgaattaattagaaatttatttttaaaataataaaaaatatgaaagttagaatagaaattaaataattttgagtaaagtaatgtgtatattatttgaagaaatataagtatgtttgttataataatattttatatttttgttgtgtttatagtatagaaatatttagtttgtttttagtattttaatttttagaataattttatgagttgaaagtataattggttttattatgtgtgtgtatgtgtgtgtgtgtgtgtgtgtgtatatgtatgaatgtatttaaaggtttagagaagttatttaatttgttttaattaataagtaatagttagaatatatatttagttttgtgataataaatttgatgttgttttattaattgtattttattagtagggatttgtattttgtatttggtttagtttttaaagatatatatgtgtttaatttgttaattgttttgttagtataattataattatatatgatattattttaggaggttttttttaaaaatatataagtagttaatttttaatttttgaataggtggggaatttttttgaagtttttttttgttttatatatgttattggtatttaggttgagagttttattttttgattatagtttttagtaaattttgatggaggaattttttttaagtttagggttttgtttttagattttagaaaagaggagtttttttaaataaaattttgtttggtttttttgtaatggatgtagaaggtagattgtttttttttttttaatttatatttagatgtttttgtaaggggtttggttttggtaaagtgggttttatatataaattatttatttttttgaagtgtgattgattagtaaagttgttttgtttaagggtagtttgttttttttagtttggatgttgataggtttgatatgtatagatttttaagtaggttgttagtttttaggttgtaggttgtaggttaggatgtttgtttttgagggagaagagaggagaagaaatttattttgggggtaagaattaagttatattatagaatttttaagatatagtagggtaggttaatatagtttttgtttagagagtttttgatggtgttgggtgttaagaaaattatggttgtataagatatatagagtgaaggtgaatataaagatgtttaggtaaagtttgtgtatatggtattgatttttatttgtttaagaatttttaaatattaaagagagttaaagaaagatagaaatttgatgtttaattaaagtagtttatgatggaagtttggaaatatagttaagtaataatattgtaaatagaatgaggtatagattatgtttttgtatgtttgtttttgtggtatttaatagtgtgttttttataagtagaatttgtataaatatatagttataaaatgttagagttgaaaattattttataaattgttttgtttaggttttattattttaggaatgagttaatagaggtatagataggttaggtaagtggttttagttgttttgagttagattaggttttttaaattttagtgaagtagttgttataaaattgtgttgttagtattttaataaatgttatgtgaatgtaggaatattttattttttttgagattgagttttgttttgttgtttaggttggagtgtagtggtttgattttgttttattgtaatttttgttttttgagtttaagtgatttttttgttttaggtatttaagtatttgggattataggtatgtattattatgtttggttaatttttgtatttttagtagagatagggttttattatgtttgttaggttggttagaaatttttgattttaagtgatttgtttgttttggtttttttaagtgttgggattataggtatgagatattgtgtttagttaaaggaatatatttatttttttttttttattgtagaatttattattattattatattttaatttttggggtatatgtgtagaatgtgtaggttttttatataggtatatatgtgttatggtggtttgttgtatttattattttgttatatatattaggtattttttttaatgttattttttttttagatttttattttttaataggttttagtgtgtgatgtttttttttttaggtttatgttgtttttattgtttaatttttatttatgagtgagaatatgtggtgttaggttttttgtttttgtgatagtttgttgagaatgatggtttttagttttatttatgtttttgtaaaggatatgaatttatttttttttagagttgtatagtattttatggtgtatatgtgttatagtttttttatttagtttattattgatggatatttgggttggttttaagttgttgttattgtgaatagtgttataataaatatatatgtgtataaatttttttattatgaagatatatttattttttttttaaagagatttatttaagagttattgattttgtaaaattatggaaagttatttttttaatttatttatgtattaattaaaggagatttttttaaggtattttttattaggggtggtgggaaaagggagggttataaggatgaattgattagtgttttttgaaagatttttaggaatttgggttttaagatattttggttattttatagaaagttttaaatgttagaattgggtgaaaaaaatttaattttttttataatggtttgttatatgtttaaggtgtagatagtttggtagggataatttagtttgtggttaagagtggtttttatgtgtatgttagtaaattggttattagtgtagtagtaggagtagaaattattaagattgtggattttttagtttgttatttgatttttgttttgtaatgttgtttgtatattgtttatttggtgtaggttatgtttggtttgttttaaatattttgtgtttgttggagttgaggatgtagtggatttattagttttataggaatggatttttttatttaaagtttaatttggtttaggtgtagtggtttatgtttgtattttagtattttggaaggttgaggtgggaggattatttgagtttaggagtttaagattagtttaggtaatttagtgagattttatttttataaaaatattaaaaaattaattaggtgtgttttagttatttgggaaattgaggtgggagaattatttttttttaggagttgatgagtttttttttatttgtgttgagttatgttgtattattgtattttagtttgagtgatagagtaagattttggttttaaaagaaaataaaataaaaaataaagtttgatttgtttttttattttatggtttattgttaattttattatttttggtttttgattgttttatatgtgggagtgtagggagaaatttttgttagtttttttaaagatggttttgataatttgttgttttgaataaatttgaatatttgataaaagagtgtttagaattttttttttttttataaagtgtaaggggttagatgtattgttttttttgggatataaattagttattgttttgttagttattgggaatattttagaagtttatttattattatttgtaatggtattttatatttggttttttgtgttataaagaaaaatttgtaaatatttaaaagtaaggattttagtgaaatgtgggttttgttttattttgtttggtgtgggaggttgtgtaagtttaattttaagaatattggtagtggtatttatttttattttaagaattgagggaggtgaggtttgtgtagaattaaattattttgttatatttgtgagggttttttgtagaatgaaggtaagtaaatttaaataaataaaataggaatatgttggaaatagttagaggtatatgtttggaattaaggttatgagttgagttttgaaaagtttatgagagattggtttgtttgaaaatattttttgtgtgtgtgtgtgtgtgtgtgtgtgtgtgtatgtgtgtgtgttgttttgtttgttatggttttggtttgtgttattgtatttattttatgtgtggtggttggaaatgttagggttttttgattgaaaaaggaaataagagattatgttatttatagtatagaagtgggatgagttttattatggtgtatatgtgtgtgtttgtgtgtttatgtttgtgttatttttatgtgtttttgtgttagtgtttgtgtgtttgtgtatatgtagtgtgtttgtgtgtttgtatttgtgtgtatgtttgtgtatatgtgtttgtgtgtatgtgtgtgtttttgtgtatgtgtttgtgtatgtgttgtatgtgtgtttatgttgtgtttgtatttgtgtgtgtgttgtgtggtatttgtgtgtgtgggtttgtgtatgtgtttgtgtgttgtgtgtgtttttgtgtttgtgtatgtatgtgtttttgtgtgtgttgtttatgtgtatttgtttgtgtgtgtttttgtgtatgtgtttatgttgtgtagtgtttgtatgtttatggttgtgtgtgttgtgtgtgtttatgtatgtttgtgtgtgttgtgtgtgtttttgtgtttgtgtgtttgtgtgttttgtgtgtgtatgttgtgtagtatatgtgtgtgtttttgtgtttgtgtatgtgtttgtgtgtgttgtgtgtgtgtatttgtttgtgtgtttttgtgtgtatgtgttgtgtagtgtgtgtgttgtgtgtgtttgtgtgttgtgtgtgtttgtgtatgtgtttatgtgatgtgtgtggtgtgtgtgtttgtgtttttgtgtttgtgtttgtatatgggtttgtgtgtgtgttgtgtgtgtgtatttgtgtgtttttatgtgtgtatgtgttgtgtagtgtgtgtgttttttgtatgtttgtgtttgtatgttagtgtgtgtttgtgtgtgtttgtgtatgtttgtgggtgtttttgtgtttgtgtgttagtgtgtgtttgtgtgtgtttttgtgttagtgtgtgtttttgtgtttgtgtgtgtttgtatatgtttgtgtgtgtgtttttgtgtttgtgtgttattgtgtgtttttgtgtgtgtttttgtgtttatgtgtgtttgtgtatgtttgtgtgtttgtgtgtttttgtgttagtgtgtgtttgtgtttttgtgtttgtgtgtttttgtgttagtgtgtgtttgtgtgtgtttttgtgtttgtgtgtgtttgtgtgtgtgtgtttttgtgtgttagtgtgtgtgtttgtgtttgttgtgtttttgtgtttgtgtgtgtttgtgtatgtttgtgtgtgtgtttttgtgtttgtgtgttagtgtgtgtttgtgtgtgtgtttttgtgtttatgtgtttgtgtgttaatgtgtgtttgtgtttatgtgtgtttgtgtgttaatgtgtgtttgtgtttatgtgtgtttgtgtgttaatgtgtgtttgtgtgtgtttttgttagtgtgtgtttgtgtgtgtttttgtgtttgtgtgttagtgtgtgtttgtgtgtgtttttgtgtttatgtgtgtttgtgtgttaatgggtgtttgtgtgtgtttatgttagtgtgtgtttgtgtgtgtttttgtgtttgtgtgtgtgtttttgtgtttgtgttagtgtgtgtttgtgtgtgtttttgtgtttatgtgtgtttttgtgttagtgtgtgtttgtgtgtgtgtttttatgttagtgtgtgtttgtgtgtgtttgtgtgtgtttgtgtgtgtttttgtgtgtgtgtgtgtgtgtatgtttgtgtgtgtgtgtttttatatttttgtgtatataggggtatagtatagttatgtaaaattgtttttttttaatttatagttttttttttttttaattagaagttattttgttttgttgtgaaaataaataaattatttttttataaaagaaagattaaataatttgaaaagtttaaataaaatttattttatgatataatattaagaaatagaaatttttaatggagaaaattttatattagattgaggaagatagattagtttaattggagtttttgtttgttttatattttttttttattttttatttttatttgttaataaaattatgtttttttataggggataggtttattttttaatgtttgattaatatgttttttatttgaatttaaaatatttggtgatgattggtaaagaatgaggatgggaaattgaatattatattattttatgaaagttttttttttttttattttttttttttttttttttttttttttttttttttttttttttttttttttttttttttttttttttttttgtttttgttgtgattgtttttttgattgagtagatgtggatatgggggagttaattgtaggagtgattggtgttttatagatattgttttttgaggtagttgttattagaggattgttattgaaaatgtaagaagagtttggtatttgattgtattttgtataatttaagtaggataaattgttgtagaagatgatattagaaatagttattatgtagtgggtttttattatatgatagatatggtgttgttataagtttgtgatttgtattgtttgagttttgaatatttgtagtaggtatgagtatttgttttatttttagattaggagatagtagtttaaagaaagtgaatgatttgttagtggttatatagttaggaagtggtagggggtgtttagttgggttggattttgaaggttatgtagtatttttatatagatttaaattttttaaattgatttttatttatgtgtgtttggtagttatatgttaataagttataatttttttatttattttgggaaaatattatttttttttatttgtatttattgttattttatttttgttgtaagaaattaaaatgtgaagaagatagatttgaagaagatttttttttggttatttttgatgatgagatgtagttaggaagatggagtttagatgttaaaatattggaatttttgattgatgtatatttatggttagagggaaagtaagttgtattgtggagttaagaaatttgagaaatataggaaatttaagttgagaaaaatttataattatgatgtttttatgtgtaggaaattttaggtttttttgtgtttaatttttttggaaagtttttatttaaaaaagtttttaaaatttttatttagttatttttaattgataaataaaaattgtatataaaggtttttgtattttattttgtatgataaagggttgtatggtttttttttgatgtttgagttaagtgagtatattaatagtatgtagtgtttagtttttattaatttttaataggtttatttatttttgatttttttattttaaagttaaaaaaaagattatatatagagagaaatgattgtattatagttttttttttaatatgagttgtttaatttttaatggtttttttttattgagaagaaggttttagtaattaagtgattaagttatttagttaaatttttttttttttttttattaatatttaattagtattgatgttttttttggttaaattttattttagagtttgtataattgaattttttttataaatgaattttttaaaatgtgtatttgaaatattttttagtttaagaaaatagtttttaataagttatgtattgatttttttttattttgaaatattttttaagtgattttttttgaaagattttttgtggtttattgaatataaaaaataaattgtgtattaggtttggtagaggttatagggatatagataatttggtatttgtttttaaggagtttaggtttttaagaggaaataagatattttgataaatagttataaggtaaaatagagaattgtttagtgttgtaatttaattgttgattttgttgtatttaaaagttggttaaattatagttttattgaatgttaataaatttttattttttttttgtatggaattttaaaaattttttattttttttgggttataattatggtgattatattttttatggtaaaaattaagatatgttgtttgataaaggatttttgtgttatttttaggtgtgagattatttatatttagattttttttaaagtaggtttttttaggtaggttttataaaaatagaggtttgttaaataggtgtgtttttagattttttattaaaagtttataatataaatagtattttattttgtatttgaattaatatgttatattttaaagtattattttatagtttaagggtgtgtgttagtttatttataaaaatatattgttgtatagagtaataatatttgttattatttaggtgtaataaaaaggttttaagtggttttttttaggtttttaattttttttttgaagataaagtttttttttttatttttatggtttaagatttttggattttgtaagtgattgttattgaagtgtgttagatgtgagtagttgtgagtatagtattttaaaagaaggtgaaggagtgatttttttttttttattgttttttttattattatttgtagtttttatatatgtaatttttttaaaatagtaaggtatgggaagggatattagttagggttgttatagtttaggtatgggatttttgaagtgaggagatagagatgaaagtggtttgtattgataaatgatagatgatgaaattaaggtttgttggattaagatttaatgatttatttaaagttatatagtttgttggtggtagagttagtttttaatttttagttttgtgagtaagggaggtttttatttttattatgatgtttttttggtgttttggggttattttggttgatttttatttattgtgatgttgggtatgttttttttatgtgattatataattttagaattataattttaaaatgatatattattgtattattatgggaaaataagttggaagagttggagaggtgatgtttgttattattggtttttttatagaggtgattttgtaggttattaggatttttttaggttgatttttagattttgaagttgagtttaaggtaagttttatatgttatggtttttgtttttttgggtattattgatttattgttgatttaggaatttttgggattagattttttttattaatgttttgtttatggttaaaatattatagagtttagtgggattattgttgtttttattagatggtttttatatttaattattttgtaatatggttgtatttgtaagttatttgttgatttttttgtagtttataagtataatgattgggtatttatagttatatgtgagatgtgttaattttaatttttatgttatagtatagagtatattataataattattatattattatagtttggttaatatggtgaaattttgtttttattaaaaatataaaaattagttgggtgtggtagtgtatgtttgtaattttagttattagggagattgaggtaggagaattgtttgaattttgtggggtagaggttgtagtgagttgagattatgttattgtattttagtttggataatagagtgagattttattttaaaaaaaaaaaaagaaaaaagtttaaaaatgtattttttttattaaaaatatatttaataattttgttaagatatttgattgatttttatatttagttttattttagtgtaattttttatttatttattttatttaatggttatttattgagtatttattatttggtagatatttttttgttttagtattaaataaatagataaaaattttagtttgtttgtggtttatatgggattggatggtgttaataattgtattgaaaaataaaaattattagtttgttaaaaatttggattattgtgggagtagagagttaaaggaaaagggaatttatatgtattgaatattagtgattatgttatatgttgtgttgtgtggtttattttatttaattattatagtagttttgtgaaagatgaatatgattatttttattttttatagatgaagaattaagatttaggaatataatatattttgtttaaggttatattagtgaggaaataaatttatattagtttttttaatattatgttagatgtgatgatattattttagaattatatgtttgatatatggattattatattgaaattttagggtatatttttgtttattaataatatatattaaggaatgttattttatagatgtatggatatggaaaatgtgtgtgtgtgtgtatatatatgtatgtgtatatatatgtgtgtgtgtatttgtatgtgtgtgtgtgtatatatatatatatatatatatatatatatatatatattattttgttttaagaatatttttatatgtaattatatggatgatttttgaggatattatgtttagtgaaataaattagttatagaaggataaatattgtatgattttatttatatgagtatttatagtagttaaatttatagaagttgagaatatagtggtggttgttagggtttaggggaagagagaaatggggagttgttttttaataggaataaagaataagtaaattttatgttaagagtttttaatatatatatttatatatagatatatataaatgttattttaatggatatgtttaaaatattatttgaaatgtagttgttaagtttatgttttttttattatttttgtagattgatttttatttttgaatagtagtaattattatagtatattttttttttataataggtattttttatggaatattttgttttagattagtaatttgatgattatagtaatatgtgttttttagataatatatgattttttatttggttgagaatttagtggttgattttgttaaaaataggtttttaatggttgagtgtgatattttattatggggtgttatttgggagtttttttttttatatatgaaataagtatggttgtagaattgattatttttgtttttttgatgaaatgtatttagaattttaaagatattgaaaatatttttggttaaaattagttatatagaagtatggaatttgttagtgtttggggataaaatttttttgtgtattgaaaatgtagaagtagatagggaagtatttttggggaggagtgagaagttgtattaagtttggatgttggggtaggggtgaaggaggaggttttgatgatgtaggttttgattaggttggagttgatgtaatggtaagtgttgtggttgtggtattttttggtgatgttattttaaggagttagttgttattagtgtttttaagagtttggttttttgggtgaggggtattaagggatagatgtgtattttaggatatttgttattttgttggttatttttttagtttggggtttttgtggaaaagatgtatgggttatgttttttagtttgttttattattttaaatattttttgttattttagaataatatttaggtttttgatttgatttttaaaattttatattgtttttgtattgatttttaagttttagtttttattaattgtatatttttttattgtttgtgggttatttgaattgattttttgattttttaaatatattaggttgttttttttttgggattttttattatttgtgatttttgtttatattgtattgtttttaatttttttagggttggtttttttttgttttttaaattttagtttaaatgttattttttttgagaggtttttttggaatatttaattatttttttttttattattttattttaattttttgaatatttttatatagttaatgttgtgtttgtttattttttgagatttatgaaagtagggattatgtttgttatagttttgatagtgtttttaagttttaggtgagtattttgtatatagtagtttaatgagtagtttgttaaatgaaggaaggaggtatttaggttgtagatgatttaaatgtaataaatgtatttgtaggttattttttaataatgtaaaagaaatgaagattaggttaatttttttttttaattttatattttagttttaatgtttagttatttttgattggttagagattaattaattatatgtaatagtttgttttgagggggtttaaatgtattgttttttttagtgatttgtaaatgtattggtttaaaatttattttttggtatagattttagaatttttatttaatatattagaaatttttagggtttattttgaattttaaggttggtttaatttttttagtaagtagttgtttatgtatggatgtttataatgagtgattttattagaaatttattttagttatttaaagtgtgatgtattttatatatataaagtgtttttttatatgagtaggttagtgatattattgaatataaattaattgtttttgaatatattggaattttataaagttttttttgttttagaagtggaatttagttgaagatgggtttgtttttagaagattaagttattatagttgttaaaataaaaataaataaaataaagattttaaaaaataatagatgttggtaaggttgtggagaaataggaatgtttttatattgttggtgggaatgtaaattagttgaattattgtggaagatagtatagtgattttttaaggatttagaattagaaatattatttgagttattaattttattattgggtatatatttaaaggaatataaattattttgttataaagatatatgtatatgtatgtttattgtagtattatttataattgtaaagatatggagttaatttaaatgttttttaatgatagattggataaagaaaatgtggtatatgtatattatggaatattatgtagttataaaaaggaataagattatgttttttgtagggatatagatgaagttggaagttattatttttagtaaattaatataggaatagaaaattaaatattgtatgtttttatttataaatgggagttgaataatgagaatatatggatatagggaggggaataatatattggagtttgttgagggtgggtgaggagagggagagtattaggataaatagttaatgtatgtggggtttaatatttaggtgatggttgataggtgtagtaaattattatggtatatgtttatttatgttataagtttgtatatggtgtatatgtattttagaatttaaagtaaaattttaaaaaataaataaagtaaaataagatttttatttattggggtaggtttatggtttttagggttgagaataatttttaggggtttgatttttaggaagggagaattttttttttttttgtagggagtatgggttgggtggtagttgtgtttttgttatttgaaagtgaaaagtggattttaaatgttgatttatattttataatattattggtgtttagtttttgatattttatgggatatttttttgtatttgggatttaattttattaatttagagagaagatgtagattaagttttaaaaatttgattttagaaaagatgttttaaataaagaatgggttattatttgtatttgtaaattatagagaatgttttgtggtatggaattattttgttaagttttgtattttaatttaattttttatttgtttttattttagggtggtaattgttaatttggagattattatttagggtggatttaatagttttatatgggattttttttagggagaatgatgggaaattatttttttttatatttttttattttgggagagggggtttttatttttttgtttagtgtgatagtgagagtgaagtgaagagaagatttatgatgttaagattagggttgagtaatatggtaaattttagtttattttaagtgtagtaaatttttaggtagttagaagagtgatgtattttggttagtttaatattttatttaatttgggaatatttaatagattatttttttataatagatttttatagaatttaaatataataaaatatatttgatattataattatattgaatatatatttattttttttaatgatttaaaagatatttaaatattttattaagttttagagttatatggagaatattagttattttagaaatggttgttaatagggatttttggttgatagtgggatggtttgtttttgttgattgaaagtagtattttattggatgtggtgggtggggggtgggatattagtttttgtttttttaggtataatttggtaatttggggggtttttttaaaaatatgtagaatttaaaatagataatgtatgaaaagttttttagtgttgagtttaatgtagaaaaatatttagtatatataagatgatttgatttagtttatttgtgattggtttggtttatttttgttttttttttttaggggtgggggagttttttttatatagttaagggatttttaattagaggaatttgatatatttaatttaggataagtaggaattttttgatttttagtgttgtttatggttttagattaagtaataatagaagataattataaggaattattatgaattatggttaaatgttgaatggtgattttttaaattagttattagtatgattggattgtattttttgttttgggataagtttagatagagagagttgggagaagtaagtgtaaaaaagtttaggttgttttttttttttttttttttttttttttatatgttgttaatgggagggtaaatttttgtaaagtttttggagagtgttttgattttaattttgaaaatgttaagtttatatagtttttgttttggtaattttatttttataagttttttttatttatgtgtaaggatgtttattatagtattatgtattttaattttgtagtaaaaaaaaaaaaaaaatttggggaaaaaaagaaatgtttgtgtagggtattggttaaattggtaaattgatatgaaataaaatgttgttattaagaaaggtgatggatatatatgaatttatattttaaaatgtttgagatttattgtagagggaaaaagtggaagtttgtatggataatattattttattgatgagaaaaaaattagatatatatataaatgtatgtatatttatagtattttttggaaggatatataatatattgtttagttaatatataatttaaggattatgagtattataaattgaaattaatattattataaattaatataaattaagatttgttgatgtatatatagtattatggtaaaatgagtataattaaattatttaaaagtttgtttttttatatttgttaaatattttttagtttatgttttaatttgtttattttaatttttatttttattatttatataattaaattttaatttagtttagggttatttataatttttaaattgattattttattgtttttttagtagtgttgaagataatgatgatggtattagttattttttattgaatttttatgatgtgttaaatatttgtatttatattttttttaaatttttaaaattgtaaaagttgatgaggaagtagaggttttgttattttaaggaatttgttaaagttatgtagttagtaagtaagttttagagttagtattgaaatttaggtttaatgttaaagattgtattatttttatatgttattttgttttagatatagagttggtgaatttattttttaggtagtgtttttgtgggtaagatagatagttgtttaaaaagagatagaaaatatgttttggattgttatggtttgttagtattttttatttattattgttattaattattttgtgttttttatttgttttaattttgattgtatatttataaagtttatggaaattgtttaagtgtatttgattttgttgatatttttatggtttgaatgttagttttatgagtaggggttaaatggagtatgttatttgaagattgttttagtttttagagttggatttggtttaaatgggaatgttatattattgtttattttaatgagataaagagtaaagaaaaataaaaaagtaaaatttgtatttgaaaatatttaagtaatgtaatttgtattagttgaattaattttaagtttggtttggttttgattttagagatttttatagttttatgtgtatttttagggtggttatgtagaggtaataataataatattaggaagattattttaagtttttgtttttattttttgtttttttgatattttttatttgttttttatttagttatttattggggtatggtttttatttgaagttttttttggtatttttaatttattaggataagtggggtgggtgtagggggttgtgtttataaaatagatatttaatttggttttaggaaaggttttttagaggaaatgataattatatggagttttgaaagagaaattatagaggtagaggtgtttatttatttaggtagagagaatggtatgtgtataagggagagataaaagggtatatagtatatttgtatagttgtgagtttttaagtatttgattttttttgaatgaggatattgattataggttatttagttgattttgttaaagttttattatattaggattattagggtataaaaatatttttaaaataaatggttttgttattaaatattttttttataatattattgttgatattgtgatttttaaaaattttttatatttggttatatttgttttatttttttaaagttatattgatagatgatatattagggtaagatgaaaattgtagggatttgtgtagaatgaaatgataattttttgtttttaaaagggattgttgatataatattttttttgtaaaaatagggaaatgtttaaggttggagtttttgtttttaataatgaagatggatatttatatgaaaagaagataaaagaaaatagaatgttttagttgtgggttaagtagttggttatttttatttgttaggataaaaatattaaatgataattttttttttatttttttttatgaatttagtattaaagaatgttattaaattttaagttttattaatttttgataatgtataaatttgggtttatagtttatatatattatagttagggatttttatatattttttagttagttaagaaaatttttgtttggagttttttattgattattgtattatttaaatttattttttgtttatgaaaattgaaaaggtgaagattaaatttggaaatttatgtgtgttaatgtagatattaatatgaataaaagaaaaatatatgtattggattttggaaagtaaaattatagatttattttggtttaaggttagttataagtggaattgtaaagaaaggttagaaaataatatatggtttatatttaagaataagaatggttatattatgtataaaatgaattgagttaaaagataaatagtaaaatgttatggtttttattgttagtagatttttattaattataaattaaaggtagttagtaatatttatagattaaaaagttagttgaaaattgagatttttgtagtaaatattaagtgttgtgtggtatattagttatatgtgtataataaagataataaatttatgtaagtatagtaatgatgaaatgtgtataaagtagtttgaattttatagaagtaagtaaagtataaatagatagtatgtttaggtatagagaaaagtaagtgttattttagtatttgagttagtgataatttattgtttaggttttttagttgagttaatgtttatatggtgttatatattaattgaaattaaaatagtttgtgtatattattgttttggatagattattgagtgattagtagaaattatattaaataattatttttttatgagtgagggatttataatatttaaaatatttattttaaagttttaagttgttttgatagttttgtttgtttataaatattttttaaagagaggtagtatggtatatgtaatggaaaaagatagtaaagtggttagtattttaaatttaggatttagattgtttgggtttaagttttggttttgttatttattagttgtgttgattttgggtaagttatttaatttttttgtgttttagttttttttttagtaagtggggttaaggatagtatttattttatagggttgtgaagttgaaataattaatataaataaaatatttagaataatgtttgatatagagtgagggttattatttagattttgttatagattagtagaatgattttagataggttatttaattttgatttttggttttttttttgtaagatgtaaaggataataaatattttatagtgtgattgtgagaattaaatgagatattatatggaaagtagttagttttgaaggaaatattttagatttttttttttttgtttttttttatttttttttttgtagggatatttgtaaggatattttttttagtatttttgtatgttaagtattttgtttttattttatttatttagttttgattatattttgtgaaattataaatagttagatgttagaatttaaagaattgatttgaagatttgtttttttattatgatattgtttttttatagaaatattttttttagaaatttttttaagattaatgttatttaattttggtttatttattttttgattagtgtgggttgtatttttatttgtgatattgaatatgtttgattattttatgtatatgttatgtttttttaattaaagtttgtgttttgtgagagtaagtattttttataattttttttggttagttttttttgtttggtttttagtttgattggattagaattggataggattagaggatttagtaggttaggagtgattattagttgtgaagttggtagtgttgttaaggagtggaattaagatgtttattgtttttggggttatattgattatatttagatatttagattttggaaaatttagggttgtttttgagtttatagtttatatttaagaagaagggtagaaatttaagaagtggttaagaaagatttttaataatttatttggatgttattaggggaagattaagagtatggtttttaaggtgtttttaaggatggtattatttgttgaatttattatggttggggggttttaatagtttatagaagtttttaaatattttaggaagtttttgtttttattttatttttttttgatgggttatagtttgtattatagtaggaatttttttgtaatgagttgtatttatttttaggtaaatgttttagatggggatatgaggttttatttatagtttgtaaaatttttttaaagagattggtgtaaagtagagttttatggatttttttttggtatgtttgaagatttgatttgtttattttttaaaggttagatttattttttaggggttgatatttattaaaagttaattatataggtgtttaaataagaatgttagtgtatttatttgtaatgagaatattttagattaatatttatgtttgtttggttagtttatgttttttttgtagggaagtttttttaggaagttagatatgttgtagaggtagtttggtgagtatagaatttgaatataggaagttagaagagtgggttggtgttaagttgagtttatatgtgtatttttaaggtttttttaggtagttggttaaggttttttatttatggttaaggttagtgttggttttttaattagtagttgatgagtttttgttttgattggtagttttgttttttgtaggtatttagttgagttgtaattaaatattttaggattgggattattttgtttttttgtggggttttttttttttttgttttgttatgtgtttgtgttattgtggttttggggatggtatgtttgagggtagggttttatgtaggttttttttatagtataatggagtgttgttttaagatatatttaaagaagggtggtgagagaggtgtgtggttatttttgttaatataaattgtattgtttaatgtatataagagatgggaaaaagaagagagtaaaagaattttttttaggtaaatgtttattatggaaattgtgtgattatagatgtttatatataatttttagatatttgtttaagttttttgtttttgttttatgtagaaggtgatggtgtgtttttttttttttgaattttttttatatatggaatgatgttattgttagtttttgtttttagttgttttttttagaattggtttattttttgttgtttttgaatttttttttatttagaggttgttttggttttttgaggtatttatgggtatagttgagttgatggttaagtgtggaggttttatttgtagttgttttttatgaggaatagttgttttatgtttatggggagagtaagttttgtgttttaaatagttttgtgttttattttattttttttgttataatagtttaatttttatgaagtttgttgtgatgtgagttataatattaatttttgggtgggggtggggggtattttttttttttggagtaatagaggagtagatatttgttttttttttttttttttttattgttagtttatagttaagagggaggtgtttagaggggttattttttgttttttttggtggtttgttttttatgagttgttgttattttttttgtatgtttatttgttagttgattttattttgggtggaaggttttgtgtttgttttttttttttagtatttttttgtttatagtaaggggtgggtttgagttttattattagtgtgatatgtatttgtttatttgtgtattgatagagatttgttagtgatttaggtatgtttagtttggtgttgagtgttttaggtagtattgtggttttaatagtttgtagaattttttaagtattttaggaagtttttgtttttattttgtttttttttgatgggttatagtttgttttatagtaggaatttttttgtaatgagttgtttttatttttaggtaaatattttaggtagggatatgaggttttatttattgtttgtaaaatttttttaaagagattagtgtaaagtagaattttatgtaaaatttttttgttttatatgtggtatgtatgtttgtgtgtgtaataaaattgtagagttgatttgtagaatgggttaatgaagtttgttttatggtttaatttatggtaggagaatggagtttgtatagttattttttgttttaggttgtttaatatgtagggtggttgtggtagttgtttttttttttttttgttatttattttgtggatattttttggttttaagggagtagtatatgtttttttatagttttttttttgtagaggttagttaaggatgtattttgtttattaggtgttaggatttttgttttatgtggttagttggtggtagttttgtgtttttttagtatagatgtggttggattggtattgggattatttgatttttttttatagggttttgttttaaattgtgggttggtggttagattttttttagtttgagtatgtttaggtgaattttttgattgtgtaggttgtggttgatagttttggatagggaatagtttttaattttggttgtttattagaattagtttggagtatttaaaagttttggtgtttaagttatattttaaattaattttgttatattttttaaggataagatttagtgttttttaagtgattttattgtgtttgtaagattgagattaattattttttgggaaaagagaaaggaggaaagaggaaggtagagtaagataaggggagaagattggaattagggagaaggaagaaattaagggttggttagaggtggtgaagtaaggaggtgttttttagtaggtgtttggagatttttagtaaaaggatgatgtgtttgttttatttttgattttgtatttggatgtgaggaattaagagaggtttagaagaggaggtagggttttttttgtggaatttgtatgtatttgttttttttattagatagattgttttttagttgtggatttttagatttagagtttattggaatgttttttagtttttgtttttttatttataaaatagagatgttaaattgtatttgtaggttgttatgtggatttgataggatgatggtgaagttggatatatgtttgatattttgtaagggaagtttaatgatgatagattttagaagaagtttataattttattttaagttaattttttttataattttgttttttttgttgtgttgaaaggtagtggttttgaaatgttgttttaggagagttaaaaagaaatatagaggtttgggtttattgatgggtttaggtatttgtattttttttaagtgttttgggtgattttgatggttagtgtttgggattttttttataggtgaaggttttaattgtaaagttaagagagagagattttgtgttgtttatagagttttattgttttttagggtttgttttgtattttttagttgttttttttaatgattttagtgattgttttattttaatataggaaagaggggtatgtgaggtgtgttagggttagtagttatataggggtaattttggttaggttttattttttatttataagttaaattgagatgaattttaaaattggtattttttaaattagtaatttgtagttaaataaggagaaaatgtttttttatttttggtggtagaggtaaaaatgattggtttgttttgtatgttgtatttgtttgttttgaaagttttatatttggggtttttgttgtgagttatgagagtgtatggtgaaataaagtattttttttatattaatatttgtttttaaaggtatgaaaagttttttggattataatgaattaaagtgtttgtatattgatatgtttttattgggtattgtgggaatgttggtttgtgggagtttataggatttttggtggatttattgtttattgtttttgttgtaattataataggaaaagggatgtgtttgtttataggagtagttattgtaggagttttgagaggtttgggagttggagggttaagggattttgatgatggagagttttattattagtagtttgagagttttattattagtagggggtttaggagtattggttggagattttttattttataatgtagttttagttttttttgtttttttgaggtagagtttttattaagggtagtatttagttggttggtagtgaagtatttatgttgttgtggttagtttgggaaagtggaaaatgttatggagattaagtttggggtgggatgggtggtttggggtggggtgggtggatagtttttgtttttattttttttttttaggggaagtagtgttgtttagtagtttttatagagttggggaattggagtaagttgtttgttttttgttttataaaggaggagaagggatttttgttgtagtttttgttgaagagtaagattttttagtaatatttagagtttttgttttagtaaaggattttaatattttttttttttgtttttttttatttggttagggagttggtgtttgatttagaaaagtaatttggttataggatattagtgtttttatggttaaaatatattttttataagttgttaggggttaataaaatattagttaggtatgtgtagtgggtttggaagggagaagaagggaggaaaatgaaagggaagaaggaatgatgttgaaaggtaagggttttttaattaggtgaagtatagtgtttaattgatagattgtgtagatggttatgtgtttttgtaatttggggttttgaggttttttatgaaagggatagttataagatatttattataatattgtagaagttttattgagtgagaaaagagaaagttaaatgaatgattaattagagaataaggatatttataatagtaatgaaattgagtatttgttgagttattgtgtgttatgttgtattttaaatattataatatttggtaatttattttattgttataagaatttttattggtgagttaggtattattattatttttattgtaggaatgaggatgagagggtttgattggaattttttgatttaattaatgtgagtgtttatttaaggattataggtaagatttaggttgggtaaagattgagttttttgttgagatatgtttttttttttaggtggagttgggaatttttgtttttttatttgttttttgtattgtaatatagggttttttgggaattaagtttataggattagaatttttttggtattgttatttttttttatttttataaatagtattaggagaaaatatgggaaggggtttttgtgtattatagtaggtatagatagttttaaatatttgggatgagatgagagttttaggggttttagagggatttaggatggtttttttgggggttggaatgtatggtgtgtttgagaatttggtaatgttgttaattggagtagtttttttttagtttgttttaaattttttttttttttgtttatgtttagagaatttagatatttttttttttttttttattttagtagttttattgagtgtatttttaatttataggaaatgtttaggggtgggtggattatttatttttattttttattgtagaatttttgtgtgtgaagggtaggaaaataggttaaaatagttattgggtatttatgttgtgttttaggaagtttgttttaagatttttaagtaggtttaagaatggaagtagagagtaagttagaaatatttttattgttttattttattattattttttaaattgtatgttggtgtttttttattaattttaattgatttaagttttatgatttttgtgatttttaaattttttataaatttattttaattgattttttttttttttttttgttttgaattttttttttttttttgtttgggaatttgttttttaaattggttatggttgggattttaattattttttaaaggtgtagtgataattttataataaagtagggaggttgggggtgggaaggggagggagttttgttttttattttgattaagagagtaattgttttttgtttgttttttggggtttatttttggtattaggttggggagattttaaatttggtgttgtaatatttattagatttaagtgagtttggggttttttaaaggtgaattgtagttgtttggataaaattttaaaattttgtttgggagatttttagtttttgttttataattgttttttttggtaaagaaattaggaagttttatttttttaggattttaggtaggtaattgtttttttaaattgtattttaatttgatggaaatggatattttttgttttgagaatttttgtttatatttataaattgtttgtatttgttttgtgtatgggaggtttgattatatagtgttttgtttttttttgagatgtgtttttatttttggttataatttagggttatttttatttttaaataatagttatgagttttttagttttttggtattttggagtgtttttttgtttagtggtggattatagttaggtggtgggtgattttttgaggttgggaattggtaaaattttttatgtggtgttatttttaagtaaagtagtataaatggtgatgagttggtagtttttgttataattaatgtttttatggtttttaggttttaattgatttattatgaggttttttgtttaggggatttggtttatgtttgaaatattagaggttttgagtttgggttttgagtttatattgggattgtgagtttagggaagtggttgtattagtttttttggaggtgtgtatgtgttttttttatgtaggttgatttggtggggtttttatggggaggaggggggttgagttaattttttatttttgtattttttggagatgtggagagtttattatagggaggtagatttagttttttttagtgaattaagtgattgtaaatagagttagtttggaagttttaggtagggttttattttttatttttgttttttttttttgggggttgttttttgatttattattaaaaatgtaaaagttaaaatgttttaggggaaaagtttaatttgttagaataattttgttatttattaataaatattgatttattatattttgtgttaggtgtttttatgttggagaagtagttagtttatttaaaatgttagtaaagattttagttgtttaaatgtgttagggataggtaaggaggataagtggtgtgaggaggatgttgggatttagttgaagttggaaagtttatagttggtatttagagaattgtaatagggttttttgggatattagtatgtggggaatttgttttagtattagaggttttgggttaggtttggttttttaggtgttttttgtgttattttttattttgtggagaggtatttttggtagaagtgaattttgtaaaatatgtaaaggtatggttgaatagtgaattttttttttgtttttaggaaaagtatatttggtattttttgttagaggggatttagtaatttattaaagattttttttttaatttattttttatttttgaaaaatgttggtagggtgtagtgatttatttttatggaagtgggtgaattatttgagtttaagagtttgagattagtttgattaatatgatgaaaatttgtttttattaaaaatagaaaaattatatgggtgtgggggtgtgtatttgtggttttagttatttgggaggttgaggtgagagaattatttgagtttaggaagttgaggttgtagagagttgtgattgtattattgtattttagtttagaagatgggagtgagattttgttttaaaaaaaaaaaaagaaaagaagaaaaatattaagttttttgggaagggttgggaggtgataaagagaggttgattaatgggtataaatatatagttagatgaaggaataagttattgtgtttaatagtatagtaagttggttatagttagtaatttattatatattttaaaatagttggaagagaagattttaaatgtttttaatataaagaaatgataagtgaggtgatgagtattttaaatattttgatttgttaggtattgtatgtatgtattaaaatattatatgtattttataaatatgtataattattatgtattaattgtaaaaaaaagaaagaaaagattattattgtttttgtttatttatttgttattattatttatttatttttttatttattgatttatttattgtttgatttatttatttttttttttatttgtttatttatttatttaattaataagtagtttttgaataaatgttgattttgtgtttgatatggtttaggtaggtaaatattttattgggagttgataggaggagggttttggaattttggtttttaggtgtttgattatttatattggttttttaggttgttttttttaggtttattgggtttttagtgttagaaaggattggttagaggatgagagatagattaatttgttaggttaggttttattattatagaaaatattgaatagtttgttagtgattttattttaagtatttttaaaatatttatttttattttgttattgttttttatgttaataaaggaaaatttttttaatagattatgttaagttttgattagagtgaatagaatagtttgtttagggaagtaggtaattaaattatgttgtgggagtttaagttgagattattttttagatttttttttgtttgaaaattttatttataatttttatttatttttttattattttaagttatgtatttttttattataataagttatatttttagtgtgagtgttttttatgttataggtagtagagaagattatagtgaaattatttagagaggtgtgagttttgtagaaagttggagattagaggatgtttgttttttaggtttttgatatttttaagaaggtgtttaaatagattgttttttgagtagttttaatagttttgttgtttgatgtggtgtggagttttagataattttgtttttttgagagtatttttgggtatttgtgtagtgggaggaggagagagtaagggttgggaaatttgattttgaattttttttttattatttattagttgattgatttaggttatttttttattttttgaagtttgaatttttatattttgggtttttttttaaatttattggtaaaataggtttagtattaatggggattttatatgaattaatagggttggaatttatttaggttgtttagttgtgttggttgtttatagttggttgaagtttagtttgattggtttaggtgtatattatgttggttgttagatgttttgaatatgatttttggaaataatatatgtgaaagtttttaggtagtataatagatggttagttaatttgattatagtatttggttagtattatttttatgtttaatttaaattatgttttataatttttttaattaattgataaatggaataatttttaaatttgtttgtattttttgagggttaataaagaagttatttagtgtttagggttgagtttttttttttagtatttttttatgaatgttagtgatttggttgtttaaagttttagggaatgaattttatttaagttttggagagtgattgaggaagtgtttgtggggggtttgtgaatgatgataatatttgaggaaggtggtttttgataaaatgtggtagattttaaataatgttaagatagatattttttaatttggatttgtgggttagtgtggtattttaggtgaaaatggtagatatgtgtttttaggagtatgttatatagtttttaatggaattttataaaatttagtgttttgggggagatgatagagagattgagggaagattgtagaattttttaatgtttttttttttttttttttttgagataaagttttatttttgttttttatgttggagtgtagtggtatgattttgattttttgtaatttttgttttttgggtttaagtaatttttttgttttagttttttgagtagttgggattataggtgtttgttattatgtttggttagttttggtatttttagtagagatggggttttattatgttggttaggttggttttgaatttttgattttaggtgatatatttgttttggttttttaaagtgttgggattataggtatgagttattatgtttagtttttttatgttttttataatagaaaatgaatgtattattttttatttgggttttagaaaagataagtatgagttggtgtttaatattagattaggttgtaaattgataggagagttatttatatatattagaaaaagaggagtagagaagaaaaaaaaaataataataaaagatttgagatatttatttatttatttgtttatgtgtattagaaattttgagttttaattgtgttttttattgagttttgggtttatagttttggttgggttttttagtattaagtgaaataattgttaatttaggaagtaggtaatttttgtttatttattatttgtaaaatgaggaataaaagagtatttattttatagaggttttaagaattaaatgagtaaatatatatatgtgtatgtgtttatatatagttatatatatatatagtattatagatgtgtgtgtgtattttttgataattaaattatagttatgtattttttttttagaaaaatttataaatataagaaatttagtttaatatttttagagattttttaaagttatgggttttattttaattatttaagtgaggaaattttttttatattgaaatttttattatgttttttttatttaaaaggaaattgtaagttaaatttgattatagttagtattttataataaatatttttttgtggtttttatttttttaagatttttaagtttagttatgtttagaatatattaaatgataagaagtttgatataaataagaagttttgttttattagagtttatagtaatagtatttgatttataataatagaaaaaatattgtatggatatatattaatttatttttgagtttaattttagatgaggaattagtttttatattttatttgtatagggtggagagagatgggttttttttttttgatttgtttttttatgtttatttagagtaattaaaataggaaaattgttgtataggttttaaaatttattttttttatttgttttttgaattttgttttaggtttgatgattataattttttatatatgttatttatttttatttttattttagtttaaatgtttttttaaaaatattagggaaaaatatttttagttttattaagaaaataaatatgtttaaataatttttaaaatgtttaggtagagttggtgtttttggtttgtgtgtattttaatggtgagtttagtaaaatatatgttggaaatagaatttttttttattttatatgtgttagtttttttttggaataaaataaaaaggagaattgattataatttttatattggagttaaattttttgtggttgtgaaaggttattttaagttaaataatatgatgtttttttttagtttttaattatgattatgtgttagtttttttttggaataaaataaaaaggagaattgattataatttttatattggagttaaattttttgtggttttgaaaggttattttaagttaaataatatgatgtttttttttagtttttaattattatttatagatattttgtgtagagttaattaatgggaatgtaggttatggtgtaagtgaagataaagttgatttaaaggaggaatgaatgtggagttgagatttgttggtgtattatgatttttttgtttttatgattttattgaatatttttatatttttaggtagagttggttatttagatgggaatttattgtttttgttttttgttttttgtttttgagatatagtttttttttgttgtttaggttggagtgtagtggtatgattttggtttattgttagttttattttttaggtttatgttatttttttgttttagttttttgagtagttgggattataggtgtttgttattatatttggttaattttttatatttttagtagagatagggttttattgtgttagttaggatggttttgattttttgattttgtgatttatttgttttggttttttaaagtgttgggattataggtgtgaattattatgtttggttgggaatttattgtttattattttgatgtttatttttagggtatgattgttgagtttttaaagatttaagtgggaaaataataatattttgatgaaaaagttagatttattttattagttttttaggattaagtagtattagggtgtttagtgtttgtgttgtttttgtttaatagatagataagtgaggaataatatttatgagtgaggagatagtagttgtgtagtaagtgagtatgtgaatgaaaggatgtgaaaagtaattattaggtgaagtgttttgtttatttttagaaattgtttattaggattgtgtttatttattgtgtttttaaattattaatatataagattatgttaagtttaatatgttttgaattatgggagttagaattattttgtgttttataggtattagtttaattataggttagagttgaaatttaattttgatatataataaatgtatttgatattttatttaatttgtgtatatatttatgtatgtatttatttattagagatggggttttgttttgttatttaggttggagtgtagtggtgtgattatagtttattgtagttttaaatttttggatttaagtaatttttttgtttgggttttatgagtatgtgggattataggtttgtgttattatttttagataattttttttttttaattttttgtagagataaggttttgttttgttatttaggttagttttaaattttaaggtttaaggaattttttagttttggttttttaagtgttgggattataggtatgagttatgtgtttggttatatttattatttttattttttatagtttgaagtatatttattatatatggattagtttttttttaaagttttattttatttgtggtattatatagttgttttgtgagtgtatttaattagattttattataattagatgttattaattagttggttattgttagtaatatttttttttattttatgattataagtgttttgtttttgtaagttttttgaatgtttttgggttattagttgttaagtattttttttatatgttatttgagtttattaggattttttaattttttttattttagtagtgaattaggtttatttatattgtgttagtggaattgtagggtagatatattatgagatatattagtaggttatttaaatttttttattttttaaaaggttaaaaggttagattttagaaattaaggtgttggtttttgtttttttttttaaatttattaatttggtatagggattgatatttgaaaattatattagtaaattttggttattgttaaatgatggatatgtattatatatggtttatgaatatttaggtaaagtatggtttttagatattttaaaagtttattttgaatttagaatagaggaaaatattataatagtaagaaaattttataaaagttgaatttatatattttattagtattattttaaaaataaattgttttttttttaatttgtttaaaaaagtttatttattaagaatatttaagaaaatattggtgtttatttgattttaagtttttggaagaagatatttgattggtgtaattttttattagtgtttagttaattgttgatagttatttatgtgtgatttgtagtttgtgagtttagtgattgtttatgataagtttgattaattttatatttgttttgtatattattgtttgtatttgtgtttttttatgtgtaaaatagaagtatgattgaatgaaagttttaaagagtgtagatggttttatgatttgaagttttgagtatatataaagggtagatataaggaaaatttgtagaaggataatgaaatgggagaagaattttaaagtgggatttaatttattggttatatattgaatgtgatttgtattttatagtgttagtggaggattttttttgatttggggttgggttttttttgtataaatattaaagatggaagaaaggaagtaaaatgtaatgtagttgagttttggatggattaagttaaggttatataaaatagttttaagtaaaagtggggtttaggtgtttatattatgagttgttaatattgaatattgattatgtataaggtattattttaagtttattgttatattattgtagtttattgaaaatttaagtttttagatgttgttttgtttgtttggtgttgtttagtttaatgagttatttatttattagtatgagagtttatatttattatgtgtttgttattgttttaagtatgttgtatatagtaatatattttatatttttaagaatttaatgaggtatgtattattattagttttattttatagatgaaaaaaattgaggtatagaggtatttagtagtttgtgtaaggttatgtagtggtaagtgattgagttaggtttaaagttatgtgtgtgttgttagttattaagttaggtttttttttatatattgattattgattatggttataatatggttattgatgatatgagtttgtttgttatagttgtaaggaaaatattgaaaaatgtgtaaaagaatattaaaggattatttttattttttttaagagataagaattttaaatagtattagaattattttgatgatggttattggtatttattttttaaagaaaatgtgttgggtatggtggtttatatttgtaattttagtattttgggaggttgaggtgggtggattatgaggttaagagattaagattagtttggttaatatggtgaaatttttttttttattaaaaatataaaaattagttgggtatggtgttatatatattgtagttttagttatttgggtgattagagtaggagaattgtttgaatttaggaggtggaggttgtagtgagttaagattatgttattgtattttagtttgggtgatagagtgagattttattgaaaaggaaggaagaaaaaaaagagaagagaagagaaaagaaagagaggagggagggagggagggagggagatagggagggagagagagggagaaaggaaagaaagaaaaagaaagagagagagagagagagaaagaaaaagaaagaaagaaaaagaaagaaagaaagaaagagaaagaaagaaagaaagaaagaaagaaagaaaggaaggaaaggaaagaaggaaggaaggaagaaagaaagaaagaaagaaagaaagaaagaaagaaagaaagaaagaaagaaagaaagaaaaatatgaaggggaaaaattattttgtttgtatttaatttagaaaataagggtttgttgtttttgattgtttaaaagaagttttttatggaattgattaggaaataagtgttattagggatgattaggtgtttgtttgtgtttgtagtgttgggaagtttatgttagatttttagaattaaggttggagatattttaggagagttagttagaggttgggaattttgtttgtttatttaatgttgttaggttaataagtagtttttattaaatatagttaagattttaagataaagatagatgattgttgagtgtgtttaattttgaggatttgggttgttgttagttagttgttgagaatggttttttattttggattttaatagggaaagtgtaatgtttttagattttatttttaggttattttttttttttttataatatgtagattgtttaaaaagttttggtattttaggaggattttatattttatagaagatgagggaatttttggaaatttaggtgatagaggttagatatattaataaatggagtagtttatatttttttttagttggaaatagattagaagttttaggtattggaaaatgttagttatatagtattttgagtttgagtattttgtggatgtttggttgtggatgttagttatggatgatgataagttttttgtgattttttatgtagagttattagtttgtgttagaattgtagttagtaaagaatgattttagagattatggatgtgtattttttagggttttagtttttattttaatatttggtttgggtgattagttttagtgttgataggtggtagttgttggtggtttaaggggatttaggatatttttaattgttttgtagatatggaggttttgttatgttgtttaggttggttttaagtttatgggtttaagtgatttttttgtttatgagttattatatttgattttagttttgtttttaaatgtgtttagggaaggaattttaaattttttttgttagattttattttggtaaaatgatttttggtatattggtaatggatggaataaggaggtatgggtatttttgatatattttttaataggtttttttgtttttaggtagaattatttgtttattttagttagatggtaataattatgttgttgttgttgtttagagaaagggttttatttttttgtttagtttggagtgtagtggtatgattataggttattgtagttataaatttttgggtttaagtgatttttttgttttagttttgttaatttttttatttatttttttttttttttgagatggagttttattttgttatttaggttggagtgtagtggtgtgatttttgtttattgtaatttttgttttttgggtttaaatgatttttttattttagttttttgagtaggtgggattataggtatgtattattatatttagttaatttttgtatttttagtagagatagggttttattatgttggttaggatagttttgattttttgattttatgatttatttgttttggtttttttatatgttgggattatagataggagttattatgtttagttaatatttggttaatttttaattttttttgtagagatggaggttttgttatgttgtttaggttggttttaaatttttaggtttaagtgatttttttgttttggttttttaaagtattaggatgatagttatgagttattatatttggttttagttttattttatttttaaatgtgtttaaagaaggaattttaaattttttttgttagtttttattttagtaaaatgatttttggtagttaggttttttttatagtaagaagagaaatttgatttagagagaaaagttatgtatttaaaatgttttagaaggttagatggatggatgatggatgttggatggagagaaagagaaaaagaagtagataaatgaatagatgatatttatgatagatgaatagatagatgaaagagaaagggaggtagatagatgaatgaaggaaggtgagaaagataggaaataggtgattgtaagagatagttaattttttagtaatgagatatatttattatagaattatatattaaaggaggttttttaaaatttatttaaaatagaagttatttttttttgtgtttttattattttttttatatttttttattttagtatttttttatgttgtaatattagaatttgttagttgttggtttttttggttggagtatgtgattataaagtagggattatattttattttgttgtgtagttttagtatttagtttagtgtttagtatttggttagtgttttatggaaggaaagataaaaggaaagaaggaggggagggaagtatattagttaattaatatgataaagaaatttgtataagatgatagtgttttttgttaggaatgtattatttttaatgttgtaattattaatgttttattaattaaatttaatttatgtgatattttatattttgttggtaagttgttatattttaagttaatatagtgatagtatttgtttagtgttggaggggtgtgttaatgtttatttttgtttaatattgttttaagggatattagtttattattatattgtttgttttttaaataatttttaaaaaatgtattttattagggttttttgttaatatgtatatgttttttatgatttgattatgatattgtatgggtttggttagtgagagttggtgtagttaattgtagggtgtttttttagttagtgatagtgtggtttttgtaggtattttgttttttagttaggatatgtgtgttgtttagggtttagggatgttgtttttgttttgtttagggttttggagttggtttgattttttgttttatattttttagtttaaatttttttgttttttaaggtttattttaaggttggttaagtttttttttttttatagtggatttttttttttattttgggagttgttttgtttttttttttagtattttttggtgttatatttttttttgttaattatttttttttggggtatgggattgggtagtttataaagttgtgagtgttttttaagtttatagtttttttttgaggaagttagttagtagttggtttttatattgagggttaggttttgtgttttgtgggtttgtaattttggttataattagtattggatgaaggatttttgtttaataaaatgatagtggatttgttttaaggtagatggtatagttttaaagtgatttagtaaatgaattttgtttatttggggtatgtgatttttgataatgattgtttggtttaattagatttaatttgggagtgaattttgtttttaatattgttatatagtttgtttgttatttggatatttttttgggtttagattttattttttttttttgtaagttttttttagattttaaggtttttgaggatagagttttgtttaatttttttttgttttttgttagtgtttgggttttttgtatttttttgtaaatgtttgttgtataggtgattgtaaaatatttaggtttgaggtttttatttttaaggagttagtttttttatggttttttttttggttgtgtagttatttagtttgagagaggtttgggataggagaggtttttttaggatttttgatgagtgtggatgagtttgttgagtagggtatggaagtagaagtagttattggttagggatgtggttggagggataaatatagaagatgtttgtggttttttaagttagggaggtttgtagttaggggtttggaagatggagataaggtagttagagaataatgaagatagagttagagttatgaaaagtgatagtagtaaatttagagagagggatagagattaatagagttatatttaatgaggtttatttaaattaagatatttttttttatggttgttagttttgagtttttgtttttttttttgggttgtaaattttttttgagtagtggttgtgtttatttattttggtatttttagagttttgtagggtattatatgggggttggtatatggtaggtgtttaataataattttgaatttgaattgaattaataaaaatatttttttatttttatttatttatttatttattattatattttaagttttagggtatatgtgtataatgtgtaggttagttatatatgtatatatgtgttatgttggtgtgttgtattaattaatttgttatttagtatttatatttttttaatttagtttattattgttggatatttgggttggttttaagtttttgttattgtgaaaaatatttttttattaattgatttgaggattttatagttttttttgaaaatttatttatagggttattaaggtttttattattttgaatgttgatgtttatgttttaaatttaattgtgtttttttgttatggtttaagtttattttttttttagtggttttaaatgtatggaatgattttttagttatttaggaagaaggaatgttgtgtataaagtttggatttaataaagttagatttttgaaaaatagttttttagtattttttattatagatattggtttgggtagggttttttattttattgaatttagttgaagagtttgattatattaataatgggttttatttttaattattgttttttagtttttttttttaaaagttttatggtatttaagtaattgttaatataggaataattgttagtggtattattttttgttgtgatttgattattaggatgaggttttttttttgtatttaatttggagtttttaggtatattatgtttggggttgttagattatatttaaaatttgtaagtaaatttaatggtagttgtgatttgagttgtattgagtttatgttgagaaagtaggatttgggaagatttttttgggtatgtagtaatatttttttggagtaagtttatttaaagattgtttagaggtttaaattttttatttttatagagtatggaagggtggtattatattatagggttttgagggtggattggaagattttattttatttattttaaagaaaattttatttgtttagtttttatattattattatatttttttttgaagtttttttggaagatgatattttattattagttttttttatattggatttgatttatgatggatttagtatatataattgtaatatggtatttatatagaagataagtttttttttgttttaatgaaaaaggttatataaaagtatatatttattaataggaatatagtatagttattaagagtatagattttgaagagtttgattgttagattgttagagtttgagtttagtttagttattatgtgattttggataatttttttttaatattttgatttttttatgtgtgaagtggggaatataatagtgtttattttttaaagttattatgaagtttaagatgaatggatatttgttaagtgtttagattagtgtttgtatatagtgttatataaatgattattgttgtgtgtttttttttattttattgaatatttaatatattatttttttttatataattttttattaggataaaaagtaaagttttttttttaggtaatatgtaattaaatttaatagttggttaaaagtttagtaagattttgtttattatatttttttggtaatattaaaataatatttgttttaatttaaaggttgttttatttgttgttatagggttaggtattgtggggttaataggagtgaaatatgtgatattttttttaaaagaatttgtaattaaataatattggaaaatataagaagtgatatattaggtagtaaaataaaattgaagagtagatgtgatgaattattggagaagtttaggagatgtagatattagtgatagtttgaatggttaggtgaggaaggtaaggagatttttaggtgggatgagttgagttggaagaatgggttaagatttgggtgatgaaggtaagagtgtttttagaaggtaaagatatagatagtggtaaggaagggtggttagttatggtgatttatatttgtaattttagtattttgggaggttgaggtggattaatgatttgaattgaggagtttaagattaattttggtaatatagttagattttatttttataaaaattagttagatatagtggtatatgtttatagttttagttatttaggaggttgaggtaagaggattatttgattttgggaatttaaggttgtagtgagttataattgtgattgtattttagtttgagtgatagagtaaaagttttttaatttaaaggaaggaaggagggaaggaaggagggatggaaagaaggaaggaaggagggaaggaaagaaggaaggagggtagagtttgggggtttgggagggtgaaggtatggaaatgaaggttttggtgttttttttggaggagtagtgaggatgttgttttagtggtagttaaggattaattgtgttaagagtatagatggtgttagaaaattaggtgatagtagttggattatgaaggtttttataaagtaggtaaatgagtttagatttggtttaatagaaaataggaagtgagaaagaggtaagaaatatgatttagaatgttggttagttgtgttatttgtgtgtttgtttgtattagtagtgtttttgagttgggtttgatattattttttggtgatggtggaataaaggtaagttgaagaaataaaaatatgtttatatatgtgagtttttaagataaattatagtagattttaggaatgtgtttttgattgagtaatgaagatgtgttggtggggttttggttggggtgggtgtgggtgttatttttgttttatgaggtttaaatttttattggtttagaaaaagaattttgagtagttttttgtttatatgggttattattgtttttaatttttgtggagtttttttagagttttttgatggtttgttaatattaaaataaatatattaggttttttgtttgtttttttttttttgttattgggtgatggtttttgttttttttaatggatatattttagatttgagtgtggagtgggtagtttttggttgtttatgtttgatattgttttttttttgtgtagtaaagggaaattaatagtatgtgggagggggaatttgtgttttaagaattgttttggtttatatatttatagataatatttaattagtattgtaggttatatggattggttggtgaggttgaggatgagttatttttaaattatttatagagaaagaaatatgtttttgaaagttagagtggttggtttatatatggaggtaagagagaaagtaggtagttttataaagtatttagattttttgtgatagttgatgtggtgtgtagtgtgttaggtgggaagatggggttttgtgtttttagtaatgtatttggaggtgaggttttttgttgatgggaatttttgtgttgggatttgggggtatttaggatatatttttatttagttagatttttttttatagttttattttgtaaatggttttaggatttttgattaatttttagtaatatagtttagtggtgaatattaagttatttgaggttgaaatatggagaagtatgttagtttaatagaaggttagatggggaggggtgagggagtttttagaaagttttggagtataagggttttagttgagttttgaaggtttttatttgttgtaaagaagaaggaattttgttttaagtgagatggaaagattatttgagtaaaaagaaagtattagtgatagaggttgtaattttattttattggttgagtttaaattttttttataggaaaaaatatatagaagataagagaataattattaaggaagtttaaggtattgtttattaaattggtttaagggggggattttattaaatgtaaatgaataaagaataatatatgtgatttaaaatatttgttatgtttttaatatttatgagagggtgtgaggtagggaggtgatttttttaagggttgaaagttgttaattttttaattatattgtttttattgttgggagattgaagataggattattttagggtattattttggaaaagtgatttaaaaaaaattaaaaatttttttttgtataatgttttgggatattttgaattgtttttgttgtgaagatatagaatttaggtgtttaggaaatattgtaattttttatgagaaatgaatatttagaagtttagagttgtttggtatttattttggtaggttttttatttttggtttttttttagtagaagggttagtgagtagtttaggatttttggagtaggggtatttttatttttattttaaaggaagtgatgtggttttttttttgtagttttgtttttatttttttgataggttattagaataatagagtgtttaagtggagatagggaggaatgtgatggttggagggatttaaaaataattattttttttttattttgaatgtgttattttgggttagatattttttgaagggtttttttgaaatttgggaaataggaaatgttaagaaaatttttaatttgtttggttatgtgaattttttttggtgttgaaatagaattttggaagaggggattttgtattgtggttgagtttttttaattagagaatatttgtttttatgagaatatggtggatgtgattatttagttttaatttttttttttttaaatatgtaaattttgatgtttaaagaataaaattagaaaagaaatttatttggttttagttgtgtatttgagtgttgatagggtggttgagaggggtttatgtgtttgttgttaaaaagtttttttggtattttataataggatttaattttgtagatttgtttgtgtaggtttatgtattatttttaaaatttttattatttgtatttgtagtagatgattaatgattaggttttttttttatatatttggttttgataatttttatttaaaaatatttagatgtaaataatttaaaaataaagtggttttaagggttttttttgggaggatggaaatgttgtatattttgataggggagtgagttaaagggatgtatgtttttgttaatatttataaaattgtatatatgatatatttattttgttgtatgtaaatgatattgagaatgaaaatttttaagataataaagtgggttgagtttggaaattagaaaaagtggatatgatgtaaatgattttgttgaaaatgatttgagttggttagtagaaattaagaaatgtgtatgtgtgggtagtttttattgtgtggggaaatttttgtaaggtgagtagatttagtttagtttatagaaattttagttgattttgtatatttatttgtgtttttgtaggtgtttttggtgtttttgtgtttatttttgtttggtttatttttttatttaattggattttgatttttattttttgaatataatatttttgtaatatttaatattttaggtttgtgaaaagtgaatgtttaataaatgtttatttatttattgagatggattgttttttttgtttttgttatattttattaaaattagttagtgtatttggttttaaatgtatttgtaaaaatggaaagtaaaaggagaaatatttatatttgtattagttttgagaaaatttttagttatttttgtttttaaaagaaatttgttttagaatttttatttgggaaaaattgtttttgtttaataggaaaaataaaatatagattttagatgtagtgatgtttgtgtgaaattaagaaaatagagttaatgttgatgttttagtggaggtgaaggtatgttttttttttttttttttttttttttttaaggtaaattagaagattgggtgtggaaatttttgtaggtttgttttgtgttggtttgtatgtttgtagatggagttttatgtttttttttattagttagtttttttgttattattttattttgaaattagagaggaagggaatggaagggtaaattgttaatattagagatttttggaaattttttttttatggtatatgagtatttaagaatagtttttttttagttgtgtttttgtgattttggtgatatttagtgggtttagttttgtttttagttagattttagtgttttttagtagttttttagggtatgggttggaggtagtgggatggggggttaatgtgaattgtattgttttggaaaaatagtttaagagagattttttttttaaagtagataatttgagtataaatttatatttatatgatttttaaaaattaatttatttagtattttttataaattgataaattttttatgaattaatgatttattagtgtttaaatggtgggtagataggtggtgttataaattttttttggtattttgtgtgttattatatatgataagttttagtaatggtttggttttattgaaggttattttaaaggaagaagttttttattttatatggttttaggtaatattttattgaagatgatttagattttggattttggggttggaataggtttgtgtttattgtttaaatagggttagtatagttttgtggggggtttttggaggaaggggttttaggaaggagttaggtttttttgtttattggttgttaggttgtttgggggttttggagggtttagagtaattgatggttggtgtggaggagagtgtgtgatagttagttttaaggttaggttatgagagattatgttaattagtgaagtttttggtagggttaggttatttggttattaggtaaaaagtattaggttatttttgttttggtagaaggagaaggtgtatgaatattatttattaatatgttttaaggaattattaggttagataataaaatattttttgtatttatttttttattatttttttattttttaaatatttttttagtttgtttttttagtttgagaaattaggagggtttttttattgagtggtgttttttgagtttttggggtatagtttgtgattttttttaattaaatgaattttagggttttaggttaggtgagtatagatggatttggagttttttttatgaaatgttttgagttgagttttttttttttgttatgttgaattttgtatatgtttgtttttgttttaattttggttttagaaaaaaaaaagaagaaaagaaaagaaaaagaatgtttgggtatagtgtaaaagtttttttagatttagattggaaatttttttattattttgaaattggataggtgttgagtggtatttgtttttttgttaataaatagtatgtatttggtttagatataaatttttgtgggagtagtggtgtatatgggtttattttagtgtttgggaaggattgaagggttttgaattaggaggaaggtttgttttttatttttttttttttgattttttgatagagattatatagtgttttttttatggtattttgatggtatatggtgtataaatataggtgtgatttttatatagtgtattgtgttataattataataagtgagaggagataaagttagttggagtttaaggttaatgttgaaaatagtgaatgttaatttttattgaaaataatgttatagagtaaggtgtaggtgtttttttttaattgttgtgtgtatggttttatgaatagttttaggtgaagggtttttatgaaataagttattttttggggtatagaaatatttagtgatgtattttttgaggattttttttgggattatttttttgggtggtatattttaaatttttgtttggatgggaagggagtattaggtaattttatttggaataaggtattatgattatgtttggttttgttttttgtgttgataggtagtttatttttttgggatttagtgtttttgattttaaaataagggattttgattatatttttttagttttttgttttttggttttttatataagaggtttagtttagaagtttaattttagatgtatatttaattttttgggaaaataaaatatttgttagatttataattaatttaattgtttatttgtgtaaaggtttttttgtttagttttaggatttgttgttgaaatttgaaaaagggtggttttagatttatgtttatatgagtagttgtggtagttatttattagttagtttttgggagagaaaatggagaagaaagtgagggaagaaaatggagggtaaattttttaaggtttatttttttattagagagatgttttttgggtaagtgtttttatttggatttttggttgtttaggaaattggggaatgagggttttgggtgtggagtttttttggttattatgaagtttatggggttgtagttattgagtagagttagaggtatttttgtatttttatttttaatttataatgtttggatttgggaggagattttttggtttttgaaagaagtttttgtttttgtttatgtaaatattaggtggatgggggaggtggatgttagggtgggatgtttttgtagtgtttagatgagggtgagattggaggggttagtataggtgttgggtatttgggtagtatttaataataatttaaggtagtggttttttatggggatgattttgttttttaggggatatttggtatggtttggagatattttgggtttttatattagataagggtttttgttggtatgttgtgggtagaggttagagaagttgttaaatattttttagtgtatagggtagtttgttttttttataataaagaattatttgatttagaatgttaattgatttaagttttaaagtttattaatagtttgtaagttgaaagtattagattgatataaatgggaaaagttatttgtagtttatttttttgagggataatgggttgttatttttttttatgttattgttgggtaagattttatgttggtttttgttttttttttttttttgaatattttttttttttgttagtttgtttgatgttgtttaagtttttttttttttttttttttggttttttagtaagttttatgaatattaattgggatatttagggttaaaatgatttttggttttatttgagaaatgtttttaagtaagaaaaagaataagagttttaagaatattaagtgttttttattttggttatattaatggtttatattggttggggaggtggggaagggttttgggagagggaggatgggtttttaatttttaaggagaatatgagtgagggttttaggaagggagagggtgtgataagtattttggagaaagaaaggagagggtttaaggtgattttgagtttggggtaagatttgtagggtttgtaattggtagagtgtttggtatttggttaagtagtttttttttttttttttttgttttattatttgtttttggttgttgtattgttggttttttttagtttttttttatttgtttgttttaatgtttgttttagttaatagttttattttttttttttaagttaatagggggaagtagagagtagtagaatagtttaaaggtaataatggtagtttttttattgtgtttattttgtatttttgggtttttgtggtttttattttagtagttggattttttgagatttttttttttttattaagtttatttttattaagggttttttttatgtaatgtatagtatattttatgtttatttgatattaattatgttttgttttgtgatttatttgatattgttgatttgttgtatagttttttatttttgtaaatgagatttgttgtttttttaagttgattgtttttggaggttaggagatgtgttgtggttttgttgttttgagttttttttagagttttatgtttagtttagttttgttgattggggataaaggatattgttatttgttatttttgtttgttttgtgttgatttttattagatgtttggtattatgagtttgtgttgtttttattttagtttttgtggttgatgttgtagtgtttttttatttttatagatgaataagttgaggtttagagatgttagatattttgggtaaggtgaagttgtgatgatttgagaatataattgaatgttttaggttttttattttatatggtgttgttattttagttttagaaggttttgaggtttttttgagatgtgtaatgaatttattttttttgagtataatataatttttatggatttgtttaaatagttttaatttttatgtgtttatttatttattttgtaaatatgtatatagtttttataaggtgttaggtattattagaatttgggaaaattaagatgaagaaaatgtagttagtgtttttaaggaggagagagataggtggtagtgagtttattggtgagttttgagggggtagaataagaaaagggtatgatggggaggtgggggtttggttaagaaaggttttatagaggaggtggtatttgagttgagtgtggagaggtgtgtaaaaggtagagtggtattttagtttgaggatgtatgtgagttaggatttgtagaggaatgaggttgtagttgatgttgttagtaattatatggagtttaaggtaagtagtgggtgtggggagaggggagtttggaagtgtgggttagggttagtttgttttgtggataataggagttatttagggtatttggataagagagagggatgtaattgttttgtgggtttagtagatattttgggaatattttagagggaagttgaatggggtaagatgagggaagattggttgggagttttttgttattgtttaggtaagttatgtagtggggtgaatagaagtggtttttgtaagattagaaagaggagatattttaagagatttttgtaaggtggagatgatagtgatggtgtgtttataggaaaagaagagggaggagttgaggattattttggtttttttgttaggatataggttgagggttgttaagggggttgattagatttttagaggtagattttgggaaggtgtaattagttttttttgtgttgtgttgggtttgatgtatttgatggatatgtagatttgtttggttgtaaattagggtttgaggtttaaaagagatttaagagttatgagtttaaaggttttataatagggttatagtttaattttttttgtattatgaagattttatgaatgttttaaaatttatatttaggtttgttttttttagagttattattgttttttagaagtttagtttgttttattttagttgtttttttttggatttattattggttttttggagtggttaggtttgtgtagagaattttgaatggattattttaggtggggattttatggtttagtataaggtttgatgtttttgttgttgggtaggaaattttgttttgatgagttttaggatttggttggttgttttgttttgatgattttaagaaattatttttgttaattttagaattttatttttaggtttttagttgataatatataggtattgagttttatttgaattttttttttaagaatttattttgattaaagatgttagaaaataagattttaaaattaaaaattatggattttgtaaaaagagtttaattggttttaaaagttttatataattttttttatatatgtattttttgtaagttatttgtaaataaagaaggtatttaggaaaggaaaattgttatttttgatagtttaatgtaaaaatgagagaggaatgagagggagttatgattgaattttagtgtttttgttgttaggtattttatagaagttattttatttttttgattatttgataattatagttttttatttttttttgttttatgaatttataaatttaggtttagggaggttaaataatttatttaatatgagttagatttaagtattgtagagaatgagaggagaattgataatttatttaatttattgatgaatttagtaatttgtagagttgaggtttaagtatagatttgtttgattttaatgtgtgtgtttttttttttttaatgttattagtatgggtgagttgtgagtattttggagagggtgaaaagtgggaggtagaggtaaaagttgagttaaatagtttttttagatgagagagagtgggtaggtagtggatatttgtgtaagtaagttggatgttgttagaaatttgagttgaagttatgtgggtatatttatgttttgtagtttttgttgaaggatttattattaaataggtggaaaatataaaaattgaagatatggtgaagtattattatttgattaatttagtattttgtttttataggtggtgtataattttatttagtttaagttattatgttttttaggagaaaaggaggttttagtaggtattgaggataagtatatgataagttattgttttgttttttgggaatatttggttggttttttattttttagtagtaagaagatttaggagtagtattttgtatgtatgttgattgtttggttttgtatataaatgttagaaaattaaagaatagatttggttattgttatgtttgtttgtttttattagatttgatttagatatggttttttaaagttttaggtattttagaataattttggggaaggtatttatgaattaatttttaaaaaaatttttttattttagaatttttttaaaagagatatgtttttaaaattttaaatatttagaattgggtaaatgaggtgttgttaagtagaggttttgttgagtaaataatgattatattaaaatattagttttaaggaagtaggttttgattttgtttttagagtagtatattggtgtggtgttaaatgtatgtttttaaagaatttaaatattgtttttttttagttagataaataaattttttgatgtttatttatgattagttgttagtgagttttttggaagttatataaagtagtgagaataagaaggtgttttgtaggttggttttgagtaaagattttttgttttgattagggttttggatgttttgtttaattttttatttgaagttttgagggtatttttttgattgttttttaaaattgttttgttaattgttatagattaaataggtaaggagtagttattaagtttttttttttttttttatgaaggagtttggttatgagatttagttaatgagtttatttaattttttgttttttagtttatttatttaagggtttagtgtattattggaaatttttatataatagaaagttagtgtttggggggtatttggttttaatttgtttgtgtttgagtatttatatttataatagtgttaatttttaagggatttatattgtattaagagttttattttaggttgttatggaaattagtatgtattaatatgattgagaattatgagaaattgggttgggtttatagaaaattaataagttttgatttttatttaaattattttttttatgagattttgttttgaaatttataaagttgggttaagttattagtattttttatgtatatatttattttttttttgtagtttatgttgttttttttttttgtttttagttttttatttgttattgttttttatttattattgttttttttgtttgagtgaatttgtttttttttgaattgttatggttattttttttgttattaggatatttttgtttgtattgtttgtttttgattttatagaaggaaaggagtagttgtattttttttttgaatttattttagggttttgattatgttagttatgttatagatgtttagtaatttttgttgggttagatgttagttagttgtagggtagattggtgttaggggaggtagtttggttataggtaaaaaagtagtttagggttattgtagttagtgtggagaagggaattttggggggaaatttggatagatgaatttgattaatttatgaggttaattatagaaaaaaatataagaagggggaaaattttttttagtaattagagagatgatagagaagtagggaatgtttttgattgtattatagaagaggagattaagatgattttagaagttatttgttgaaggtataaagagagtttaaggtgaaaggagttttatttttttttttggtggaggtgtagtttagtaatttttgaggagtgttgtttgttttgttaggaaaaatatgataggagtagtttagtggaggttggagatttaatatttttttttatttttaaatttgataatttatttttaagtattaaattttatgttatagtttaatatttttggatatttttttgttataaggtttttagaatgtgttagtttagttttagttttataggaatttatatttaaattgatttttttttttttatttggagattgttggaatattagattaaaatagtttatgggaaggttgagtagagtttaattttagaatttgtggtatgtttatgggatatggaaaatatatagaagtgatggttttatagagaaagggaaaagttattttagagaaaattggagggagttaagaaaatgtggagagaaagtggggaatggtaattttagatgtagagggaaagaaaaataagagaagatgtatgttagtaataaaagaaaaaaaattattataatgtttgttgggtaggaaagtgatttttttgttttttttttagtttttttgggtttatagtattgaagataggagtagagtgtatttattggtgtttattttttagttgggtgttgttgaagaagagagaaattttagttattttgttattaggttatttttttttttttgtttttaggttgatttaagtaaaataggggaaaattgtatttggataaaggaaatttttttttttgtatttaaaagttttatgttaggttgggtgtggtggtttatgtttgtaattttagtattatgggaggttgagttaggaggattatttgaggttaggagttttaggttagtttggttaatatggtgaaattttaattttataaaaaaattataaaaattagttaggtatggtggtgggtgtttgtaattttagttatttgggaagattgaggtaggagaattgtttgaatttgggaggtagaggttgtagtgagttgagattgtattattgtattttagtttgggtaattgatagagggagatgttgttttaaaataaataaataaataaataaataaataaataaataaataaataaatgttttatgttaggagaattttttttgtagagagttatataattaagtattgtgtttgttttaaataaaaattagagaaagggttaaaaattaatattattagtgatatttttttttttttttattgttaattatttgttggttattgttataatagtgttattttttaggtttgaaatgaaaattggtgattatattaagtaaagagtttgaaaggaaggttgggttattgtatgattatttggattttttttgtaaatatgtgaatagttttagtttttttttatatgggttgagggtaatagaatgatatttttttgggttagaagagaaatagagatagaataagtgaaagttgtttggtattagttaatagttgtaatttatatatatagtttgggattggtatgggtttgtggtttgttaggaatagggttgtatagtaggaggtgagtagttggtgagtattattgtttgagttttggtttttgttagattagtggtgatattaggtttttttaggagtgtaaattttattgtgaattgtgtttataagggatttaggttgtgtgttttttatgggaattgaatgtttgatgatttgtgttggaatagttttattttgaaatgattttttattttatttgtggaaaaattgttttttataaaatatgtttttggtgttaaaaaggttgtggattgttgatataaatgagtttgattttttttttataatgtaaatgttattaaagagatagaggtgttagtataagtatgttgttgttttatgtatatttatgattttgtggttttgggtaggtttgtttagttgggagttatagttatatttagggaggttgtgtgattgagtggaaaggtaggatattttatgttagaattttgggtttgagttttggttttataattgattaattaggtgtttttggaaaagttatgtatttttggttatttttaaaagaggggtgatagtagtaataatttatttgtggtttgttgggaggattatattagatgatttatatggaagtatttttttaataatagtgtgttatgtgaatatttgtttttgtttgtaatagatatttttataataaggagaatgagaaggttattattttattttgtttgtttattgtttttatttaataatttttttttttttttttattatattttaggtagtaggttagaggttagggaaatttgttgttattttatagtattttattgtattattgagaggtttatttttgatttagtattgaaagattatttttggtttttaaaaataaagttgaaagtttaagagttagaaagattaaggattaagttaatttttaaaataataaatgtttttttatattttttttttatttatatggtgttggtaattttttaaattagatttttatttgggtattttatattaaaaatgatatagttttttgttttttgtaattgtattttttttgatttttttttattatgatttgtatattattgatattttttttttggaatgttaaaagtatatattatttggttaaaaggaaaaaatattgatttaataaaaatggaaaagagagagagagagaaaatggatattttttttttttggttttaaataaggtaaagtttttattttttgttttttatatatgttaaggttgatgttatggatttaaattagttttgagttatttgaaatgggggggagtggggaagtgtagtttaataattttttgaagtttgaaaaataaatttgttatagtttgataatttaaaaatgattgatggattttttttgtattttttaagtagggaggggttgggtatggagaatgaaatattttgagaaaagatttaaatgtggaaatttttggtttaagagggtattttaggagatataagaaatattttttgggggtatttaaagggaataatattgtaattttgagtgatgtatggttttattgtttgaggaatagggatgaaaattataaatttttttggttggggtattaatttattattaaaagttattataaataatggatattgtttatggttgagaagtaggatatatttagagaagatattttttaattttttataaaattattttagtgttattggaatatgttttttatgttatttgagttgttggagtattttttgggtagatttttaagtagaaatagttgggattttataaattttgtttgggattttaatgtttggtgttatgaagattttggtttgtgttttttttgatgtttagaatattaagaatatttttagtttttatattatggtaggttatgttttggttttttttagtaaaattttttttaggatttaagtttttatttgtattggtaataaatgtgatggtatattgtgattttgaatgtaagttagtagggttgtaggtatttgttttttttagtgttttaattgtattaaattttttttattttttttgtttttgatgtataaatataaaatggagttttagaatttaaaagtgatgttatttgagtgttattaaggatttttagaggattatggggtatttttttttgttataaatgaggtttttaaagtttggaaaggtgaatttttggattataagtggaggaattgagaaagggtgtgttgatatttagattttatagtttgttattgtgtggtttgtgatagaattaagatattagaatagattagtttatttggttataaatttaggataatatgatgagttttagagttaggggttgagtttttttgggattttttttttttaaaggatgtgttttattgttaaatattaaaagttttgaatttttgtttttttgttaaaaggtattgtagatatgatggtagtgaaattattttttttgtatttaaagttatttttaataaaattattttttttaggtggtgtattaagttagtaaaatatatttgtttgaatttatattttattaattatgaatttatgtttggggattaaaaattttttaaaatttattaggtgtgattttaatattttttttatagttttttggggtgttttagtaggttaggattatttttaaagatatttaaatgatgtttttggtttaaatggaaatgaaaagtatataaaattgtaagatataagaattttaagaatttggtagaggtgaaaatatataaagaaaagatgaaatttagatgtttttattttgtttttttatttaatataaatttttttttagttgttttataattataatgttagtatttaattttttaagggttaaaggaggtttgtagagtgggtttttggttgattttagtgtggattgtaggtttggtgttttgttagatttttatggttaaatggtaattatattgtttttagttattttgttttattttttggggggtttagggatagttgttatttttttattagtgtttatgattagtgtttttttgttaggaggtgggttggaaggttttttgtagttatggttaagttttggttgtggttgtagaagttttatttgttttatttggttaatatttaatttttttatgtatttgagggagtggggaattagtgttttttaggaaatttaggttttgagttttttgttttagattataataggtaaatggagaatgggttgtggggattggagttgaggaatgaattttagttgataaaatgtaagataaggagggaataggaaagtaaaggataaagtgaaggagaaaaaaataaagggaattttggtagggaaaagggatttgggagataggatgggagttttgtttgggttatagtgaaggtaggggagagaggtttgggggattttggggatttgggttgtgtttagttattttttgttttttattaattttttgttgtttagttattttatagagtagggttttgggtattttgtgtgttgaggatagagttgagtttatagttattgtgtatgaaggatgttgtgattttgtttttttgtttgtttatttttaatttggtgtattagagatgttgtattgaatatatttttttttagtatgtaattgttaaaatgttgaaagaaagtgtttggtttgttgggtttgattgtaataattataaatttgttttgtaaatttttggttttttagtaatatattgaatattaaaggattaaatgtttggtgagtagagttaggtttttgtaaaatatttggtaggtaggtttttaggaatttaaaggtatttgtttttgttaaattatgaagattttttaaatgtgagtagagaaaagttgtttttagttatgaggagttatgaggggtgtttttaggaggagagagattatgtaagaagtaggtgatggggtagtggggtgagtggtttagagaagtttttttattttttggattttttgggtagtggggtgagtggttagggaagttttttgtatttttttgggttttttttttgagggtttatgttttgtttgtggtgtggagttatttttgtttatgtatgttgtagatataattatttttggtttagtaagaatagttgagttgattatttgaaaggattaaaatttagttgttattgtggaagttttggggttatatattttaatattttaaattaggttttaagttggatttgtttttgtgatttaaggaaattttgtttttttttatattttagaattttttgtgaagtagttttgtaaataggagggttttttttgaataatatggaaagaatttttttttggggatttgagtttatattatataatattttaaaatatttttgagatggtatgtgtagttttagtaatagggttagattatagttaagggtttttagagtgtgttgtatatgtttttgtgggatttagttttgtatagtgtttagggtggtgggggtgggggtgatggggaaggttttgtgattggtggtttttttatggttatagggttttttttttgttgatgtggttttatttgttttgatttatttttgatggtatatattggtttgttttaggatttattagggtggttttaaatttttatgttatttttttgttttgaaatattatttttggtttttttgtttttatttgaagttttgaggttttagtttttgttttattttttgtttgttttttagtttattttaaatatttttggtatattttttgagtgttttttgttattttttgggattttttgtttagttttttatatttattgttttgggggagttggagttggattttgtatgttttttttgttttttttgggagaagtaaaatatagttgaaaaggtatatgtttggtagttatatagttttggatttgaattttggttttgttgtaatgagttgagtgattttgagtaagttgtgtgatttttttgatggtagttttttttgtttagagttgtttgtaaaagttattttaatgggttttggtattatagttaaatattttttgttattttagatttagtgtttagttagaagtagatgttaaataaatattttttaaagtggtttgtttatggttggattgtttgatttagatatgtttaaaagatagattaaagttagaggaaagaaagagttaaaatgagttatttaaagttagtgttaattatattatgaaaaatatgttgtttgtggatttaagattggttaaggggtttttttagtggaaatagtaatttgtttgatttaaaattttttttgaagtttttattagtttaaatttgagtttatttttatgattttaggtgtgtatatttttgagttattttattggaagagtgtttattgagtatttgatttgggtgatgagtatgatgttttgttttaaggagtttattgttatggagttaagtttattattttttttgtagtattttgtataatgttgtgtgtaatttaggtggttagtaaatgtttgtatttttgaatgtaatttgagttaatttgttttaaggtttttgtaatggtagtaaggttttgttagtgttatatatgtataggtatggttattgattatttagttgttagttttatttggaatattttggttttgttatttttgtttgaggaatagttggtgtataaaggttttgtagtatagtttaaattttatttgtaatgtagttagtatatatttgtattttttttgtaggtagggttttttaggtttgttgttgtaagttgtaaaagtgtttgattggttttgagtgtttgatgggaagtgatagttgttttggaagtggattttttaggggtatgattttttttgtgttaagtgtttattgttgataatgttgataggttttgtatagtgggtatgtgtagtgttttgattttgtttttgtttttaggaggttagttttattggttttattgtgagagtgtgtttttgggttaggttagttagttgttaattgtgtttttgtaggttgtgttgatggaagatattttagtttttttatttatttaaaatttatttatgattgtttttagtttttttttttttttttttttttgtttttttgggtttttgggttttttgtttttttttttgagtttttgtttttgtttttttttttagttttatatatagtagtattttttttgtaatagaaagtatattgttagaggttttttgttgtaaatagttatttagatgagaggttatgttagtgtattttgtttatatgttaatgagttaggatttagaattataggttgatttggtttattatttatttgttttggtattaatagttgttgttattgatagagattgtattttttttgtgatagagaggtttgttgttttttttgggtataggaagattgtttgatgaggaaggaagaggattgttaaagagttaagtagtgttttttgaaatgtatttggttttatttatgttgagtttttttaggtgaattgaattaaattataaattataaaatgaaagtagattttttttagtatgtttatatggagtttattgaggagtttattattatttgttagttttttttgttttttagagtatagaggatgtaattgtttttttttttttgattggtagattgatggtgtggataagaagttttttttatgggttttttagaggattattgtagttattttgatggttatagaatgatttattgagttgtagaattggggagttgggatttgagtaagattattatatgttggggtgtttttgagtgggatgtaagtaggttgtgaagttttagttatttgtgatttatttgttttaaattaagaataatagaattagtattatttggggtgtatttggtttttgatagatgtttgggtttgtggtaggttattagggttttttggagttaatgtagtgtggagtttttagaaaagatgtttaggttgattttttaattagttttaaaaagtaagtgttagataaggtagggttggaggttggtagtgtttagttggttgaggatgttgtattttttagtttagtttgttttgtttttttttttttatatatttttttttaggtttgaggttatttttagtaaatttttattaggatatgtaggttttttgtattttttatattattagttttagttaatatttattgatttaaataagtgaaaattaaatatttggtttttaattttggttttttatgtttaataaatgaaggattttttttttttattgtttttagtagtgatgttttgatgatagtgattaggttaagttgtagaatttaataagtatttgtttttagtttttatttttggtgtatttttatgaattaatttttgtagtgataaaaatagagggaggtagtttgggttatgttttgtgtttatgagttatatggtaggtataggagttatggtatgtttggtttaaattatgattgataagtagagtatatttgtttgttgttaatttttgtggagtatatagtgattatgttttatttatatatggagataggtatggatagtggtgtggggtggggaggagagttatatgtgtggttttagattttaagaaaaaagagttggtggatttattttaaatgttagtttgtttgtggaatttttagtttttgttaggtagtggagagttttgtttggtattgaatataattagagttttttatttgttttttattttaagttatattgatgttattagttttaattaaaattggtatgagaggtagagggttttgtgggtatatgggggttggggtttgggataaataatttggattatgtttataaaagtaaagagattggaagtatagaggtatattagaggttatagttttagtgttgtgttaagaaaggtttttttttaatttatagtaggagggtttgaggttaggtggggagaagagtagtggagaagtggtggatggaagagatggattatatagagaggaagtaggagattttttgtaatagttatagtaatatagttttggtatgtattaatagaatttaagttatatttttaaggatgtatgagaaagggtgaagaataaggttattaattaggtaagtttagatggtagagtggagagagattttttagaggtttgttatggtggagtttttagatgaggaaaattgaaggttttaggggtgaagtgagttgtttattttataagtaggagtgttttgattgttgtttatgtatttgatttttaattttttatttagaatataaattatgttattttttattatagtttttttttttttttttttggagaatgatagtggtgtatattttttaattagtagtgttttattttttattatatttgtgagttgaggatttattataagttagtatttttgtggaattttatatggtataaaaatagtttagtttttttttatgttgtgtaaggaatataattaagtttttttattgggatatagtttatgtgttataaaattttatttaaagtgattagtgtattggtttttagtatatttaaaaggttatatagttattatttttagttaattttagaatttttttattattttaaaaagaagttttgtatttattagtaatgattttttagtttttttgtttttttattttttgggaatttttaatttattttttgttttgatggttttgtttattttggatattgtatgttaatggatttatagatagtgggtggtttttgtgtttggattttttatttggttttatgtttttgagggttatttatgttgttgtatgtgttaatgttttgtttttttttttggttgagttgtaagattttattatgtgggtagattatattttgtttatttgtttattagttagtggatatttgggttatttttatttttggttattatgaataatgttgatgtgaatatttgtgtataagtttttgtgtgaatgtgtaattttaatttttttgggtgtattaggagttgaattgttgggttatgtggtgattttgtttaattttttgaggaattagtaaattgtttttttataatggttgtattagtttatatttttattagttatgtgtaggggttttaattttttaatatttttgttaatatttgttattatttatttttaaaattagagttattttagtggatgtgatttttttttgtggttttgatttgtatttttttaatgattaatgatagtgaagtatttttttatgtatttattggttatttgtgtatttttattggtaaaatgtttattagaattttttggttttttttaaaatttagttatttatgtttttattgttgagttataataattaagttttttgttggatatatttttatgtttaatataatattataaaagtgttaagtttgttattttatgtttgatatttttttttgaaatagtgaaatagtataagtttaaaataagagagggttgagtattataataggtagggtttttggaagttttagttaaaagaaggtaatggaatgaggaaggtaggaagaaaaatgaagaaattttgttttaaagttaaaatattggaaagtaggtgattgaggtttgtgtgtatataggttttttttttagggtttttttaggtgtgttttaaaatgaggataggagtatgggtttgtttttttttggtaaggttattgttgggtaaatgggtttgtagataagatataaagtgttttgaatttagtattaagaaaattattaggtttatggaagttattgggaatattattaagtagttattatagggtagggtatgtgttttatttagttttaagttaaatatttagtattttataaaaatagtttggttattgaatgaataagtttgttgaagatgagattttaaggttatatagatatggtttttagttttttttgttatggtttattatattaatttggtgaattaaatagtataattattaatatatttttagtattttttgttataaatgtatttttttatttattttagaagtatgttttttgaattattggattgattatatttttttgtaggagggatatgagtttataggtgttttgtagtatttgtatagttagtgtggtagtagggaatttggttttgtgtttttttttagatattattttttattttagtttagaaggtaattagattaaggaattttttgaggtttatttttggaatagttagttttggttgaagtttttattagtaggtggttggggttaagttttttttgttttggtttatggtataagttatttttgtatattatttttaaattgtgaaaataatgttagagaaaggaagtatttatttgggttttttattttttagtttttttagtttttgagggtttttgtttgatttgtatttttagttaaatttgtataatagaatatattagaatttttttggattaattgtggtaagtgggtaagttttgtttttgttttgtttgggttttttattttttgttatgtttttagtaggttttttgttatatttaaatgatatggagattaggttttatgaatgttattggtttatgttttaattagtttttttttttggatttagagtttttttaagattaatttttaggtattggagatggttttggggagtagtttttgttagtttggaggaaggtaaatttttgtgttttttatgtttttgtgtttttttattatttttggtttaggtagttgtgtgttttttagttatatgtttaagggttattttttttttttttttttttttttaaatttggaaataatattttgggagtaaagggagggtgtgggaggaagagttataggggatagaagtaagtatgtagttgttaaagttatattgttttgtagatggaattttttagatttatttagtataatgtggttgtggaggaaattttgttgagttgatgataaggggggaaatggagttatttttttattagttgttttatttaggtagaaaaaagtttttatttttttgtgtgtgttttgttggttattatttttagttgttagtgtggtttgtttttttttttgttttgagttaattttggtgttaggagaattttgtttggttttatggagtgttttttttgtaagataagtgtttgtttattttatttttttttttatgtttttttttttttttttggtgtttttttttatttgatggttgtatgttatagattttgtgtggttgtagtagttatagatagtattgttaatgagtttttagtttttttggtggaatttaggattaggatatatttagtggtttttatgtttgtatagatgtttagaaatagtttttgatttttggttgttttttttgttttgtattataggtattaatgttgttttttttgttaatgttttgttattgtttttttatttttttaggtagtatttgttaaagtttgtttttttaatattttaaatatagtagtagtttttttgatagaggggttaggggttaaatgagtttggaaaatgttatttttttttttggagaattaagtatttgtgagtgggggtgataatatttattaattaatatagtagggatattgattagttagatttttttgtgtttttgggaattggttaattattagtttttgggaggaggatattagaggttgttgttgaaagaaaaaaaaagtattgaattttatttaagttagttttttatttggtttttgaatattttttttttaaaaaaatattatttattaggatgtttgaaaaatttgttatatagtaaaataaattagtttgttttagttttataaatatttgttgagtttttaatgtatgatagatatatgttttagggatttaaagataaataaaatatggttttgtatttttaggtgttaatagttgaatggggaaggtagatatgtaaatagatgatttttgtataatattgtgaatagggaatagttgaggattatttagtttaatttagggatttggagaaagttgtttgtagaaaatgattgagttgaatttttgaatgaattaaagttgatttaagagtgataagttgagtaggagaattaggttggagttagagtattgggaattttagatttaagtatggaagtaatagatttgattttgaatggattattttggttgtagtatatagaagagatttataggtaaagtataagatttagatagaggtagagagattagattggaaattatagtagtgattttggggagagaaggtaaagggagagagaagtgtttaggtggtaaaattggtagtgtatttattgttttgttttgttttgttttttggtttttattattttagtgtttattaattttatttttagttataagagatgtggtatttgtatttatttttttgattggtattttatttgtgatatggttagttaggagtgttggggtattgatattttataggagtaatttttaattaatgaatagtaggagttggtgtataaatattttagttttttagttttttagtgggttaataagagatgtatggtttatattggtttttagatttttttggtaggagtaagttttgtttgttggtagtaataatttgtttgatgaggtaatttatgtatgagttttttttttttttttttttttttttttgttttttttagagtttttagtattattttttaaataaattatttgtatttaaatttttgttttagggtttgtttttaagggagtttaatttatggttatgggatttattgttgaatgaatatggggtatgaggaagagaaaaatatttaggagattttgaggttgtaggtttatttgatgttatagttaggttgaagataggaagagagggaggtttgatggagggagtgatgatagtttgagtttggggtaggttgattgaattttttaggggatgttttagaaagtaattggaataagtatttgttagttaggggagaaagtgagattggatataaagatgttaggaatattattataggggtggtatataagattaagagagtgaaagagattggttaaagagagaaaagaaaatgtttagatagaagtttgatgggtagtattgagaatttattagaataggttagggaggaggtgtttttgagggagatagagaggaaattttttaggaggaaggaggtagtttaaagggagtagagttatggaagatttttagtggttttggtgtttggggtattagagtatttattaagatataattttatatttagtgaatttagttatatggagggtattggtggtttttgtgggggtggttttagaggtatagtataggaagaagttagattgaatgggtttaaatgtgggtgggaagtgagttaatgagtgtggtttggtagtttttttaggagggtagagatagagaagataatggttagggtggagtatgtattagtatagatattttgaggatatttgaggttagaaaggaaggatgtgattgaaattgtaattgagagtagggataattgatggaggaaggtttttgaagtaatgggagatggtggaattagggtgaagtgtggagaggagtagggaaggataggtagaaatggatatttgtgtatgggttagggtggaaagttgtggtaatttttgtttaatgattttagtttttttagagaagtaaaaggtagtgtttattgttaaaaggtgaggaagatgtgtgagataagtggtggttgttgggaatagttattaaaaggaatagaaaagatttgataaagaataaagaattgttaggtggtgttagaatttattgagtttagagattatgaatttttagtagtatttgtttgtaaggttgggtaattttttttagtattatttggaagtttagatgagatttgttttgggttggagtttaagttggggtagagaggaaggttgggatgggaggaagtaagttgagggaggtagggaggaggttttttgggtagagagaagaattagttgtttgttagtattttaattagtgatatgtaggaggtaggtgaaatttagtttttatgtttttgtttattatgaatttttttatgaatatatattgtaaggaatttgttttatttgttaaagttttatttattttatttatttaaaaaaagagttaatatttttattagatattattaaattaatttagggaatttgaatatattttgaggttttttttagtttagagttttttgttatagtgattttttttttttttttttttttttaattttaaagttgttatgagagaagagatttttagaggtttttatggagataaaattataaatttatgaaaaatagaaaatattaaagttatttgatagttgtgtttgattttttattggtatggtttgattttttttttattttttttttattgttgatgagattttgtagtttgtaggaataaaatggtggtatttattgatttagtttagtttaaatgtgtatatagaggtattatttttttttagagtgtaagttttttggggatagggtggttttttttttttagaattttttttgattgtataatgtttgtatgtatagttagtttaaagattgtggaatgtagttgaattttgaatttgtttatagttagttaagttatattaaatttttttagtatatagagagttgagaatatatattgagtttggggtttgaattttttattgtaggtattggtttgaggggtagagtttatgagagtttttttgggttagggtttaaggaggtttttatttaattgggggtttgttgtatggttttaggttatggttgttgtttgggagtttatgtttttttattattagatattattttttagtatttttgtttgttaaattatggagtttggattttttttagattaagtaagtatttagaatgtaatattattttatgtagtatatattgaaatatattttataaatagtaatatatatgtttgtattgaattagaaaagatagttaaggaaaaaaattagaatagttttttaaatgttatgtttttatgtttatttttgtttttaatgataattattgttaatatttttgtgtttttttttatattatttttttttgtttgtaaatgtgtatatgtatatgttaggtttttatagaagtggaattgtgttttgttgattgttttgttttgttttatttaatatgattttaggaatataattttttgttaataattatagggtatgatttttaatgttgaatagtattttattatgtggatgtgttgttagttatttatttttagatatttgtttttaggtttatgttattatatataatttgtgtattttattatttttttaaaataaataattggaagtgaaattattaataaaagttttttaaaagttttttgatatgtattattaaatttaaaaggtttttatgtttatttttatttgggtataagggttattttgggatttttgtttatatttttaattgtatgttattttttttagtatttagaattaatttttttttttatttttgataatttgattttttttaaaaaaaatttttattttaggtttatgtgaaattttttgaagtggattaggggtggtggtttatgtttgtaattttagtattttgggaggttaaggtgggaggattatttgaggttaggagtttgaatttagtttggttaatatgaaattttttttttattaaaaatataaaaattagttgggtgtagtagagggtatttgtagttttagttatatgggaggttgaggtagaagaattgtttgaatttgggagttattgtattttagtttgagtgatagtggttttattttaaaaaaaaaaaaaaaaaaaaatttttgaaggttttgaatggaaaaggaaaatgttggaggatggttgttttttaggtgggagtgttttatggtttggaggggtgaggatatttttgttgagtttaggagttttgattttggtttgtttttgtttatatttatttggtttggttttaaatttgtagtaaggttgtggttgggagtttagttattttgtttttttgggttagttttgggtggaatttagattttttgtggtttttgaattggaaatttatggggaagttattgtggatagagttattagagttgaggttttgtttattttttttttataggaggagttggtgttagtttttttgtgtgaatttgtgatttgtgaagttgggtaagtttttgttagttttgatatgagtaagggatatagagttttttaaatatatagattgggattttgtttgaattatatgatgatttaggttttttttttttttttttgttgtttttaatatataaaatgagtatgtgtttatttaaaatagtttttaaatttaaataaataatgatagattgtttaaatagattttggaaattgttttaattaggatgtttgaaaaattaggaagattttttatgaaagaagtttttaggttattttagttttgaagttgtagggttttttttgtattttggaattgtagaagggtaaagtttagaggttagttttaatttttagggggttaaatgatttgttttttagttttatattttaataatgtgtaaagaaggatagataggtaggtattgtattattattttttatttttgattagaatatgggatgtatatattttaatttataatttttatagaaattatggattatttttagattagaaagttaagagaggaaattgtttttgtaaaatggtaggtttagtagaattttttgggggaagggtaggttgagtaggtgtggagtaggtttgtaagaggatagataagagtaaggtgtttgttttgttatgagtttattttttgtatttaatttataaatggttttgagtgatttatgttaatttttataataatgaattttatggttatggatgaagtaaatgaggtttggggttgggttatttgttgaaggttataaattaataaaatattaaagttagggtttatttatattttttttttaagttttatgttttttttagttttttgggatggtaatagtatttttatgttgaggttttgggttaagagttgttagtttagtttattttattttagaaatgatattgttttatgtaatgtatattagaaatggtttgttaggtttatgagaagtattgttatttgtgtgggggtgagggtggtgagagggaattattttagttttgaggaggtggggatatttgggatagtattttttttgttttttagtattgtgtgttagattaattgggagaaaatgttagttggagtatgtttttgtattttttggttttttaggatggttttaggtttagataggataaatgattaggggtttagtttggtttagattttgttatataaaattttgttgattattaaagggatttagagtttggttattgatttttttaatgttaagttaaattgtagataatttattgttagtgttttgataaatttggggtgttttttggttgggttattgggggttttagtttatttattttttagagagagaagtatggatgggaggattagttgatatttgtagttgtgtttgtgatgttttgggttgttttttggaagaggtagagttttggtttgtggagaagttttgatttttttttgttttattgatttttgtttatatggagaggggtgtgtattttggtagataattatgattgtgttttagttttgtgttaagagtattaaatatatattttatgtatgtttattgttttgtttttttaatattgaaatttagaaatgtttaataatagatatttaaaaagaagaagaaagtttttgtgtttttttttggtaaaagttaattaaggatttttaaagatgtagaaggtttattgggttagtagttgttggtttgggttagttgattgtgttgatttgattaatgttgttgatatataggatgggttatttgtttttttatggtttgtgattatagagtattttataaattagagttttttagttttggttttgttagtattggggggttgttttgtgtattgtgggatgttgaatagtatttgtggtttttgtttattagatattagtagtatttttattttaaattatgattattaaaaatgtttttaaatattgttaaatgttttttgggggataggattatttttagtgtgatttttgttttaaatttttgtttgttttttgtaaaaggtggtattggttggagggtaatttatgagaatgtgaggatggtttaaggtaagttttttatgatgtttggaagtaatattgatgattggttaattgaggttatttttaggagtttgttttaaaaaagtaattgaataaatagataagaatttatatataaaaatatattatgatattgtttataatagtaaaagttttaaatattataaatatgaattttttaaagtatggtatattttatatattatgaaaataattgtataaatttatatttaataatgtggaaagttattttaataatgttttaaatttttattaagattattttaggatttttagaggttgttatatatagaaggagtaattttaaatagatttataagtatttgggtaaagtattaagttaaagattaatgattgtatttagaaagtttaagtgaataaatatttattatgtatttatagtgtattataattatgtttagtatgagggagataaagagaatttttggttttattgttatagtttttgttttagagaaagggaatttttttgtgtattgttggagttttttttaatagtgatgtttagggttatggtatgttattgttttttgtaataaaattgtgtgttttgagttagggttgttgggaataatgtgaaattatttttgtttttttttttattttgaataaattagaagtaaaaagaatttatttattgatttatatatttaaatatttatttagaaagttgtttaaatatttattggatttaaatgtgaaatataatttttttaaaatttaggaaatgagtaattggtgatttgtttaatttaagtttatttagagggtagattttgttataatatattatagatttgatttgagatggagagataggaatggaagggagatattttttgttttttagggatttgtatatttagtgatatatttttgattttttgttttgtgagatttataatttgagtaaatgtagagttgtggttgtttagtttagttatttttaagagaaattttttgatagttttttttttttaggagaattttgattttagaggttggtattgtattagttaaggttgtttttggtttttttattgattgagtttttgattgattaaatgtttttatagagttgttgttagttatgttagggtattagtagagagaagggtgttggtttttatttgggtttaaagtttggttttgttatttgttaaaaagttttttattttttgtgatttttagtttttttatttttagaatagaaataaataaaataattttataagattggtataaagaattagttggatgagaaagtgtatgtttttaattttagaattttgggaggttgaggtaggagatttatttgagtttaggagtttaagattagtttggaaagtatagtaagattttatttttataaaaaatttaaaaattagttaagtatggtaattttaggtatttaggaggtggaggtaggaggattatttttgagtttaatagtttgaggttgtagtgggttatgattgtattattgtattgtagtttgggtaatagagtaagatttttgtttttaaaaaaaaaaaaagaaagaaaaagtttggtataaagattaaaataatgtatgttagatatttgataagatgttaatatttaattgaggagtgtgatggttattattattgttagattttattatttttatggatgggtatgttagttaaaattgtaaaatttttaatattttttaattgtttttgttgtttttttttttggtttttagtatttttttttatattatgtgataatttatattgattgttgtttatattgttttatttaatggaagttttgtgaagtaggaatttttagtttattttatgtattgttgtatttttaagatggttggtatgtaaagagggttttaataaatatgttttgaattaatgaaaatagtggtttttgaattatggtttttaaagagtatttgttttttttttttttatttttttgaaggtgtttaggttgttttggtaggatgtttttttttttgtggggtggtattttttgttttttttttaatatttttttttttttttttttttttttttttaattgtaggatgtttttgtggaattgtatggttttagtatgtggtttttgtttgattttttttggttgtttttgaagattttgtttagtttggttttggtgggagtttgtattattttgggtgtttatttgggttataagtgaagttaatatgtttgttttaaataaatatgtaaaaggtttattaaagtagtagaaataatatgtattgttagtgatgtattatgaaataaagttgtaggttgtttaagaaaaaataatatatatataaatattatatatatagatagatatatatatatataataattaatagtttttaggtaaaatgttgaattagttatttattgttaaagggaaatattatttattttttatattattaagaaaaaaagatttatttatttaagatagttttattaaaatttttgtttttggaaatttgattattaattgttaagtattgttttgtgtggttttatttggatgttttgtgtttgtaaatatagatttgttttttatgttgttggttggattattatttgaagagtagatggatggaaaaaggatttgattattggggaagttggttttttggttgttggaggttggggagaaggtgtttatttatttgtatttttttgttttgggggttgtgatattaatagagggagggtttttgtggggggaagtttatgtttttttggtttgaagaagagattttttgtatatgatttatatgatgtatatttggtgggaggaaaagagttgggaattttagatggatttagtatttattgagatttttatgttgaaggatagtgatgggaaaaatgtttttaaattataggaaagtatttttttaagttattaattgtgttgagaaaagtattttagtaatttatataatattatttagtattttaagttttgattgtgtatatttatatattttggatatgtattttttaatttttaatattggttttgtttgagtaagaaatagaattttttggaatttgaggaagtgaatattttggtgatttttgtattaggaaggttagagttatttagagtattaggttgttataagtgtttgtttttaggagattgaagtttgtagaatttgtttgtgttttagtttggaggtttggttttggaattgagttggggtttttattggttttttttagggatgattaatagggtagtgtggtttttgaatgtttggaagttgatggagtttagaattttattgttaagaaagagtagtagaggggtgtggttgggtttgttattttggggttttttaggtaggtttgtttttatgtggagtatgggagttatgattttttttaagatatgtattattgtagagggaaggaatagaggttttgggttttttttattagaaggatatggtgaaggttgggaatgtgaggagaggtaatggttatggtttattttggttgtagtatatggtatgttggttgtgtggttttggtttatttgtgagtttaaagtaaggttttaaatgattttggagagggttataaattttaaaagaagtattgaagtgaggtgttatggattaattgatttttgtttatggaattatatgtaaaatattattttgttattgtagtttggttttatttgaaaatttgataaaaaaaaagttttaggtgtggaatatgggggttatttgtatattttggggtattaaaaaaaaaattaatggtggggaattataaagaagtaataaaagaagtgatatttttagtaaataaattaggaaattttttttttttttagtttagaattagttttgaaatattgatggaataattttgtggtattattgtattatatattatttatttgtattaattttggaatgtattttgtttaatgtttaatgttgtggttgatattttgaaagttgttttaaaaaaatatatgtattttagtgtttttttgtttttaattgtatttagttatggtttatatattatttgtgagtaaaggtgattgttttttgtttgagatttttattttttgattttttaaaagtattttgagaaggtgagataagttttgagttttagttatttaagaaaaatttggatgttattggttattgaggagttttgttttaattaagttatgtgtatttttatgttaatagaattgtttattgtgatagttatatttgttgtttttttgattttgttttttgaaggtttttttgtttttgggtaattttgtatttaatttatggtatttaggattatatgtatgtttggttaaatttatgagatttatttagttaaaaatttagatggtaaatgattagtagatttaaatttatggtggtttgatttttagagagttgttttatgtggtttgttttaatatagatttatttagagtttttttgttttttttttgtgggggtttttttatggttgttttttagggtttttttgaaatgtagtggtgtttatgttttattaagaaagtaggaaatttgtggtatgaagttagatttttttggtgggttttagggaatagaatgattagatttttgaatgattttaatttttaagtaaaatattattttatgaaaggtttatattgttaaagtgatgaatatggaatatttaattttgtgttgttattttgttaaaattattttaatggagttagtttgtagtatgttttatgtggtaagattttttaagttgttttagaagtaataatgaagaatgtggatgtttttaatataaagtttgttttgttttttgttgttgtttaaatgggatttatagagtatttgaaaaatgtatatatattaagaggttatgggggttaattgttggttggttgttttttgttgtggggttttgttatttggttttaataatagtaaatgtgtttagttttttggttttagaattgtatagtattgtggttgtatttgttttaagagtagttgatgttgtattttttttattgttaaaaatatgttagaagtaatgaatgtatataaaagttttaattagttatttttttttttttttttttttttttattatatttaattattttgtagttgggtaatagagaattatttttattttgtattgaagagggatttatatttgtattttaattgttttttatgaatgaaaaaatagttttttgtatgtatttttttttatattggttagggttagagttaaatagagtatatgtattttttaaattggggataagggttttaaaaaaagttttaaaaggagaagaatatttgagaatttttttggtttttttagttttttgttgtataaatattttgtaagagaggttagaatgatagttgatagggtttatggttattgggttgtttttgaagatttggtaggggtagaaaattttggtaggtttaagatttggaataaagttatagaattaaggaagtattttaatttagtttaaataagatgttaatattttttttatagtttatttatttttttgtgtttagatgtggttttttatttatatgtgatttttgttttattagtaaatgtttattatttaaagatgtagttttggtttagtgggaaaaattaggaagtgattataaattgagaggagttataataattaagattaaatgtaaataattagggtaattttaatatatgtttagtttttatttttaggatttattgagtgaatagaattgtaaatagtttttatttgtaattgaatttattttaaaataaatagtttataaatgtgaatttaaattttaattaattttaattgtatttttaaggtagtggttgtttttagatttttttattatttatagttagtaatgtatatttattttattagagaaaaataggaaaggtttgaaatataagttattttaaggaaattagggagttagttgaaattttattttgattttattttgtggtgttttttgtagtttagataaatgtggttatatattttttaagaaatataattttatattgttaagtttatgaaggttttaattagatttttattgttatttaatttggattttttagggattttttttttaaattattatgggataaaggatatttgttggaggggtgggagggaggaagaatttttaaatgtaaaatatttttaagtttggattagggagttggaagtttttagaataattagaattaagggtatgaaggatttgtattggggttgatgtgatgtttttgtgaagaattttgtgtgataaatgagaaatattttgaagtttgtggtatgatttttagattttagagatattagtatggtttaaagtgtagttttgtttggtagtgtaatggtataaattttaagttggatatgtttaatgggtatttaaataataaatgtgtagttttaattaataggatatttaatgataattttttggttggtagggatatttgtttttaaatgtttattatgtataatatagaaaaaaattttataaaattaagtaatgtgaaattgaattggagagtgataatataagttttttagttttatttagtgaattattttgttttatgtttttggataattatgattttggataattatgaaatatgtattttattggatgtaaagaaaattagatggagtatgaatggtattgtattggtttatttggattgttttagaaaaataattttaagtaaatattttattaataataaggttgttttgtatattaagttgagtatagaagatgggaatattggtggaggatggaaaggtttgtttaattaagaaaattttgagattattaataaataagattgtagtgtagatattgagtaaatttatgtatttaaattttttggaaaatttgttgtgggttttttagatagtttattttattaagtttttttttttaaggtagaatttgtaagagtgatagtggattgtattttttttggggaagtttttttttggtggttttgtttattatatttttttaagtttttaattaaggtttgtttttgttttgagttattggggttatttttgttttaaataaaaataagtgtataataagtgtttttgtattgaaagtttttgttattaagatttttatatttttattttttatggttttttttaagattgatatttttaagaggtggttgatattttgtaatattgtatatataaaaaatatggtaaggatattttatatggttaaggtaaagtaagtttttagttggttattattagttataatggtattttgtttgtgttgttggaaaaagttatattgttattaaattttttttgtttgtttagttaatattgtgaagaaaaataaagtatagtgtgagatattggttgtgtttggaattgtttataatgtgttaatatgattttgttttgttatttattattattatataagattttgaaaagtttttttaataagttagtaaaattattaggattttattttaatgaagtttttagggattaggttaagggattgttttataggtgaaattattttagaaggagatttttgttttttggtaat

(The sequence listing continues in the following parts.)

The invention claimed is:

1. A method for detecting and/or classifying a colorectal cancer belonging to a distinct colorectal cancer subgroup having frequent CpG island hypermethylation (CIMP colorectal cancer), comprising:
determining, by analyzing a human subject biological sample comprising colon cancer cell genomic DNA, a CpG methylation status of at least one gene or genomic sequence selected from the NEUROG1 sequence group consisting of NEUROG1, SEQ ID NOS:138, 124 and 110, wherein CpG hypermethylation, relative to normal controls, is indicative of a colorectal cancer belonging to a distinct colorectal cancer subgroup having frequent CpG island hypermethylation (CIMP colorectal cancer), wherein a method for detecting and/or classifying a CIMP colorectal cancer is afforded.

2. The method of claim 1, wherein CIMP colorectal cancer is distinguished from a colorectal cancer subgroup not having frequent CpG island hypermethylation (non-CIMP colorectal cancer), said method characterized in that the presence of CpG hypermethylation, relative to normal controls, is indicative of CIMP colorectal cancer and the absence or relative absence thereof, relative to normal controls, is indicative of non-CIMP colorectal cancer.

3. The method of claim 1, wherein the CIMP colorectal cancer comprises a cell proliferative condition and/or cancer.

4. The method of claim 3, wherein the CIMP colorectal cancer comprises colorectal carcinoma.

5. The method of claim 1, comprising: contacting genomic DNA isolated from a biological sample obtained from a subject with at least one reagent, or series of reagents that distinguishes between methylated and non-methylated CpG dinucleotides within at least one target region of the genomic DNA, wherein the at least one target region comprises, or hybridizes under stringent conditions to a sequence of at least 16 contiguous nucleotides of at least one sequence selected from the NEUROG1 sequence group consisting of NEUROG1, SEQ ID NOS:138, 124 and 110, wherein said contiguous nucleotides comprise at least one CpG dinucleotide sequence.

6. The method of claim 1, comprising:
obtaining genomic DNA from a biological sample obtained from a subject;
treating the genomic DNA, or at least one fragment thereof, with one or more reagents to convert cytosine bases that are unmethylated in the 5-position thereof to uracil or to another base that is detectably dissimilar to cytosine in terms of hybridization properties;
contacting the treated genomic DNA, or the at least one treated fragment thereof, with an amplification enzyme and at least one primer comprising, a contiguous sequence of at least 9 nucleotides that is complementary to, or hybridizes under moderately stringent or stringent conditions to at least one sequence selected from the NEUROG1 sequence group consisting of NEUROG1, SEQ ID NOS:138, 124 110, 190, 191, 246, 247, 162, 163, 218, 219, and complements thereof, wherein the treated genomic DNA or the at least one fragment thereof is either amplified to produce at least one amplificate, or is not amplified; and
determining, based on a presence or absence of, or on a property of said amplificate, the methylation state or level of at least one CpG dinucleotide, or a value based on an average methylation state or level of a plurality of CpG dinucleotides, of a sequence selected from the NEUROG1 sequence group consisting of NEUROG1, SEQ ID NOS:138, 124 and 110.

7. The method of any one of claims 5 and 6, wherein contacting or treating the genomic DNA, or the fragment thereof, comprises use of a reagent selected from the group consisting of bisulfite, hydrogen sulfite, disulfite, and combinations thereof.

8. The method of claim 5, further comprising contacting the genomic DNA with at least one reagent, or series of reagents that distinguishes between methylated and non-methylated CpG dinucleotides within additional target regions of the genomic DNA, wherein the additionally target regions comprise, or hybridize under stringent conditions to a sequence of at least 16 contiguous nucleotides of at least one sequence selected from each gene sequence group of the combination of gene sequence groups consisting of: CACNA1G sequence group of CACNA1G, SEQ ID NOS: 130, 116 and 102; IGF2 sequence group of IGF2, SEQ ID NOS:136, 122 and 108; RUNX3 sequence group of RUNX3, SEQ ID NOS:140, 126 and 112; and SOCS1 sequence group of SOCS1, SEQ ID NOS:141, 127 and 113, wherein said contiguous nucleotides comprise at least one CpG dinucleotide sequence.

9. The method of claim 8, comprising determining a CpG methylation status of a gene or genomic sequence combination selected from the combination group consisting of:
NEUROG1, CACNA1G, IGF2, RUNX3 and SOCS1;
SEQ ID NOS:138, 130, 136, 140 and 141;
SEQ ID NOS:124, 116, 122, 126 and 127; and
SEQ ID NOS:110, 102, 108, 112 and 113.

10. The method of claim 6, wherein contacting or amplifying comprises: use of at least one method selected from the group consisting of: use of a heat-resistant DNA polymerase as the amplification enzyme; use of a polymerase lacking 5'-3' exonuclease activity; use of a polymerase chain reaction (PCR); and generation of an amplificate nucleic acid molecule carrying a detectable label.

11. The method of claim 6, further comprising, for determining, the use of at least one nucleic acid molecule or peptide nucleic acid molecule comprising in each case a contiguous sequence at least 9 nucleotides in length that is complementary to, or hybridizes under moderately stringent or stringent conditions to a sequence selected from the NEUROG1 sequence group consisting of SEQ ID NOS:190, 191, 246, 247, 162, 163, 218, 219, and complements thereof, wherein said nucleic acid molecule or peptide nucleic acid molecule suppresses amplification of the nucleic acid to which it is hybridized.

12. The method of claim 11, further comprising, for determining, the use of at least one nucleic acid molecule or peptide nucleic acid molecule comprising in each case a contiguous sequence at least 9 nucleotides in length that is complementary to, or hybridizes under moderately stringent or stringent conditions to at least one sequence selected from each gene sequence group of the combination of gene sequence groups consisting of: CACNA1G sequence group of SEQ ID NOS:174, 175, 230, 231, 146, 147, 202, 203 and complements thereof; IGF2 sequence group of SEQ ID NOS: 186, 187, 242, 243, 158, 159, 214. 215 and complements thereof; RUNX3 sequence group of SEQ ID NOS:194, 195, 250, 251, 166, 167, 222, 223 and complements thereof; and SOCS1 sequence group of SEQ ID NOS:196, 197, 252, 253, 168, 169, 224, 225 and complements thereof, wherein said nucleic acid molecule or peptide nucleic acid molecule suppresses amplification of the nucleic acid to which it is hybridized.

13. The method of claim 6, wherein determining comprises hybridization of at least one nucleic acid molecule or peptide nucleic acid molecule in each case comprising a contiguous sequence at least 9 nucleotides in length that is complementary to, or hybridizes under moderately stringent or stringent conditions to a sequence selected from the NEUROG1 sequence group consisting of SEQ ID NOS:190, 191, 246, 247, 162, 163, 218, 219, and complements thereof.

14. The method of claim 13, wherein at least one such hybridizing nucleic acid molecule or peptide nucleic acid molecule is bound to a solid phase.

15. The method of claim 13, further comprising extending at least one such hybridized nucleic acid molecule by at least one nucleotide base.

16. The method of claim 13, wherein determining further comprises hybridization of at least one nucleic acid molecule or peptide nucleic acid molecule in each case comprising a contiguous sequence at least 9 nucleotides in length that is complementary to, or hybridizes under moderately stringent or stringent conditions to at least one sequence selected from each gene sequence group of the combination of gene sequence groups consisting of: CACNA1G sequence group of SEQ ID NOS:174, 175, 230, 231, 146, 147, 202, 203 and complements thereof; IGF2 sequence group of SEQ ID NOS: 186, 187, 242, 243, 158, 159, 214. 215 and complements thereof; RUNX3 sequence group of SEQ ID NOS:194, 195, 250, 251, 166, 167, 222, 223 and complements thereof; and SOCS1 sequence group of SEQ ID NOS:196, 197, 252, 253, 168, 169, 224, 225 and complements thereof.

17. The method of claim 6, wherein determining in comprises sequencing of the amplificate.

18. The method of claim 6, wherein contacting or amplifying comprises use of methylation-specific primers.

19. The method of claim 6, further comprising contacting the treated genomic DNA, or the at least one treated fragment thereof, with an amplification enzyme and at least one primer comprising, a contiguous sequence of at least 9 nucleotides that is complementary to, or hybridizes under moderately stringent or stringent conditions to at least one sequence selected from each gene sequence group of the combination of gene sequence groups consisting of: CACNA1G sequence group of CACNA1G, SEQ ID NOS:130, 116, 102, 174, 175, 230, 231, 146, 147, 202, 203, and complements thereof; IGF2 sequence group of IGF2, SEQ ID NOS:136, 122, 108, 186, 187, 242, 243, 158, 159, 214. 215, and complements thereof; RUNX3 sequence group of RUNX3, SEQ ID NOS:140, 126, 112, 194. 195, 250, 251, 166, 167, 222, 223, and complements thereof; and SOCS1 sequence group of SOCS1, SEQ ID NOS:141, 127, 113, 196, 197, 252, 253, 168, 169, 224, 225, and complements thereof, wherein the treated genomic DNA or the at least one fragment thereof is either amplified to produce at least one amplificate, or is not amplified; and
    determining, based on a presence or absence of, or on a property of said amplificate, the methylation state or level of at least one CpG dinucleotide, or a value based on an average methylation state or level of a plurality of CpG dinucleotides, of at least one sequence selected from each gene sequence group of the combination of gene sequence groups consisting of NEUROG1 sequence group of NEUROG1, SEQ ID NOS:138, 124 and 110, CACNA1G sequence group of CACNA1G, SEQ ID NOS:130, 116 and 102, IGF2 sequence group of IGF2, SEQ ID NOS:136, 122 and 108, RUNX3 sequence group of RUNX3, SEQ ID NOS:140, 126 and 112, and SOCS1 sequence group of SOCS1, SEQ ID NOS:141, 127 and 113.

20. The method of claim 1, wherein the human subject biological sample is selected from the group consisting of cell lines, histological slides, biopsies, paraffin-embedded tissue, body fluids, stool, colonic effluent, urine, blood plasma, blood serum, whole blood, isolated blood cells, cells isolated from the blood, and combinations thereof.

21. The method of claim 1, wherein CIMP KRAS mutant, BRAF wildtype tumors colorectal cancer is identified or distinguished.

22. The method of claim 1, further comprising relating CIMP status to at least one selected from the group consisting of age, sex, tumor location, family history, race, country of origin, and tumor characteristics including, tumor type, tumor grade, invasive margin characteristics, lymphocyte infiltration characteristics, direct spread, lymph node spread, venous spread and type of residual adjacent polyp, if present.

23. The method of claim 1, wherein detecting and/or classifying a colorectal cancer belonging to a distinct colorectal cancer subgroup having frequent CpG island hypermethylation (CIMP colorectal cancer), comprises determining, between subgroups defined by CIMP status and BRAF mutations, effects of selected risk factors including, but not limited to body mass index, smoking history, alcohol intake, dietary folate intake, folate metabolic enzyme polymorphisms and history of hormonal use.

24. The method of claim 1, further comprising determining a CpG methylation status of at least one sequence selected from each gene sequence group of the combination of gene sequence groups consisting of: CACNA1G sequence group of CACNA1G, SEQ ID NOS:130, 116 and 102; IGF2 sequence group of IGF2, SEQ ID NOS:136, 122 and 108; RUNX3 sequence group of RUNX3, SEQ ID NOS:140, 126 and 112; and SOCS1 sequence group of SOCS1, SEQ ID NOS:141, 127 and 113, wherein CpG hypermethylation, relative to normal controls, is indicative of a colorectal cancer belonging to a distinct colorectal cancer subgroup having frequent CpG island hypermethylation (CIMP colorectal cancer).

25. The method of claim 24, comprising determining a CpG methylation status of a gene or genomic sequence combination selected from the combination group consisting of:
    NEUROG1, CACNA1G, IGF2, RUNX3 and SOCS1;
    SEQ ID NOS:138, 130, 136, 140 and 141;
    SEQ ID NOS:124, 116, 122, 126 and 127; and
    SEQ ID NOS:110, 102, 108, 112 and 113.

26. A method for detecting and/or classifying a colorectal cancer belonging to a distinct colorectal cancer subgroup having frequent CpG island hypermethylation (CIMP colorectal cancer), comprising:
    digesting genomic DNA obtained from a human subject biological sample comprising colon cancer cell genomic DNA, or a fragment thereof, with one or more methylation sensitive restriction enzymes;
    contacting the DNA restriction enzyme digest with an amplification enzyme and at least two primers suitable for the amplification of a sequence comprising at least one CpG dinucleotide of a sequence selected from the NEUROG1 sequence group consisting of NEUROG1, SEQ ID NOS:138, 124 and 110; and
    determining, based on a presence or absence of an amplificate the methylation state or level of at least one CpG dinucleotide of at least one gene or genomic sequence selected from the NEUROG1 sequence group consisting of NEUROG1, SEQ ID NOS:138, 124 and 110, wherein CpG hypermethylation, relative to normal controls, is indicative of a colorectal cancer belonging to a distinct colorectal cancer subgroup having frequent CpG island hypermethylation (CIMP colorectal cancer), wherein a method for detecting and/or classifying a CIMP colorectal cancer is afforded.

27. The method of claim 26, wherein the presence or absence of an amplificate is determined by means of hybridization to at least one nucleic acid or peptide nucleic acid which is identical, complementary, or hybridizes under stringent or highly stringent conditions to an at least 16 base long contiguous segment of at least one sequence selected from the NEUROG1 sequence group consisting of NEUROG1, SEQ ID NOS:138, 124 and 110.

28. The method of claim 27, wherein the presence or absence of an amplificate is determined by means of hybridization to at least one nucleic acid or peptide nucleic acid which is identical, complementary, or hybridizes under stringent or highly stringent conditions to an at least 16 base long contiguous segment of at least one sequence selected from each gene sequence group of the combination of gene sequence groups consisting of NEUROG1 sequence group of NEUROG1, SEQ ID NOS:138, 124 and 110, CACNA1G sequence group of CACNA1G, SEQ ID NOS:130, 116 and 102, IGF2 sequence group of IGF2, SEQ ID NOS:136, 122 and 108, RUNX3 sequence group of RUNX3, SEQ ID NOS: 140, 126 and 112, and SOCS1 sequence group of SOCS1, SEQ ID NOS:141, 127 and 113.

29. The method of claim 26, further comprising contacting the DNA restriction enzyme digest with an amplification enzyme and at least two primers suitable for the amplification of at least one sequence selected from each gene sequence group of the combination of gene sequence groups consisting of: CACNA1G sequence group of CACNA1G, SEQ ID NOS: 130, 116 and 102; IGF2 sequence group of IGF2, SEQ ID NOS:136, 122 and 108; RUNX3 sequence group of RUNX3, SEQ ID NOS:140, 126 and 112; and SOCS1 sequence group of SOCS1, SEQ ID NOS:141, 127 and 113; and determining, based on a presence or absence of an amplificate, the methylation state or level of at least one sequence selected from each gene sequence group of the combination of gene sequence groups consisting of NEUROG1 sequence group of NEUROG1, SEQ ID NOS:138, 124 and 110, CACNA1G sequence group of CACNA1G, SEQ ID NOS:130, 116 and 102, IGF2 sequence group of IGF2, SEQ ID NOS:136, 122 and 108, RUNX3 sequence group of RUNX3, SEQ ID NOS: 140, 126 and 112, and SOCS1 sequence group of SOCS1, SEQ ID NOS:141, 127 and 113.

\* \* \* \* \*